United States Patent 10,233,495 (METHODS AND COMPOSITIONS FOR SCREENING AND TREATING DEVELOPMENTAL DISORDERS) - sequence listing, part 182

SEQ ID NO: 1169 - DNA, 1502098 bp, Homo sapiens
  misc_feature (369734)..(369734): n is a, c, g, or t
  misc_feature (455029)..(455029): n is a, c, g, or t
ttgcagcagagaaggaagtttaatcataaggctgccgaataaggagacagggggaaacctcaaatctgcctgtctgagccgtttaggtctaggtattttaagggagttggagtgaccgaggtgggggatcactggttgaagaatacaggatggtgagatgaagaaactgcattttcatgctgattcagttcctcttggggagaggcggggggcggtcttcaaactggttggcaatagctcttttgctggaattcaggatctgaaaaacatcttaagccatttttaaacaaacaaaggccttatgattctaacatcagaaatcttctctgtaggaacaatgaggaggcaaatggttagcatctggtgctctgggacttttggttacgaagaagtgggccaaagtgcagcctgattaatgcttaattacaactatatttctgtccagaacccagcatctaattcttgttaaccctgtgaggatggtttcaatagaatgtttccattgtccttaaagggaggtatagttagtcccattatactccaggtaatgatgacagtcttggcaaaatcttaggaccctaagttgtttgccacctcacaacctatattatccgtcctagtcttagttaccacatctgactgctgggaagactgagggtgatttgtttggtctgtgcacaaaacctttaaagagaaatacacatgttagttaacttaaaaatccacaggtactgtggcaatagtttgtgtaacaagttagggtaaatatctttctggtaagatgtacaagggaagtcaatttacctggaagacaggaggtgtcaggcctccaggcaagacagaagcaaaaactgacaaaacaaagcctacaggaaatttgggtaataagtttgaatcttcttaaagttcttaaagtgtctagaaaaagcattctaagacaaaactcctacaattcagcaagccttgggaaaaaggctaaagctttctagcctctacctgaaaatacccactgcatagaaaacccaggagaaaaaattcaacctaggcagtcaagtctgaggtattgtcaccccatttaaatttgaacagggcactctaaaatgacatactggccttcataagaggaacagaaagaggtttgtagtcatgcccataggcctatgttcttaggtaaactaaactagcttgatccttaaaaaacgagagagagatggtgaacagtggaaaaggttcaaaataaaatatgaaagacagcctctgttatagcacttgccatatccccccaggcaactgagtgcagagctgacaaacttatgacatgggagaatgaaataagctttctagaatgcaaggatctgagtacaacaccatatttgaacaacaatagggggcaaggtagtctgggtctttaactatttagaatactctaaaaagagggctggggagagaaaggccaagtgcacatatatttaaagctatccagtaaagacttacttacatttcaaggtgaaatcagaatacaatgaatgtgttttctagctaaaaatcatgatcactaagtggttgatacaattttttccaatcaattgctaacagcatttattcactaattttgttttttatttgtgtctgatctacttctgcaacttataacatgaacatatttattcacaggtcagatgaagaattgcctaattttaatttggaattatctaattctaaaaacaaaaaagaaactatttataggagaggatctgtaactggggtccatgggagtttattaacaggtttgccagaaaaaaatacaagataccagttaaatttgaatttcagataaacaagtaatttttttagtctagatatatgccagtattgcatggtaaccctatatttataaacaaatttcagagagatagatacatttctctctctctctctcctgtttttttgaaactgagtcttgctctgtcacccaggctggaatgcagtggcatgatctcagctcactgcaacctctgcctcccaggttcaagcagttctcctgcctcagcttcccaagtagttgggattataggcatgagccactgtacctggccttctttaacactttttgtttacaggccaaacatcaccctcagtcattccagcagtctactatgtgaactgagactaggagggataatatagattgccagatagatctaggcatgagctcgttagacactgcataaaaatttggagtagaagcattttgacaaggaaattggctatagctatctttctaccagagtcttaaacctatgatctctcaacagttagtcatcattaagacaaagattaattctatcaagccttgacttttccctgtggcctgagcttcctaggagccgaacataaagggaaacatgaagggcaatttaccaaatagcaactgaagagaagagtccactcagtgaaagcagaggagtttgcccgggggcgtgttagggaggcagagaaagctggtttacagggctttgcagacagacttgagcctaagggccatgtcacacctttaagttaagttggggttgaccttttaaacaagaagttgtgcatgacagaaggtctgctttgtgaacattggattctggaggagcaccaccgcaggaaagactggagaaaggtggtggtgggctgggggcactggcttggaagaagagagtgaagaggcaggagagttggaagagactgggaggctgggaatacagtactcaagggccagggttttctcccctccagctctttgtcctttgcagccaccacccaaggatgctggtgaaggtgtttttgtgcatccccattctgagagtgcagcctctttcctgaggcccacgggagggtctgggtaatgacgaaatgcagtctttacctgtgtcactgaaagtagacccgcagagctgcggcttctgctgccatttcctcctctgatctccaagaggcaggaaagtcctccttgtcatgtttctggagctttggagaaaaaaaaaggaagaggctctttcatgggcccttgggatctccttgaacaaatttcggggggctgggggagactgaacaaaatttgcaaattagaggccagtaggtgtatcttttaattgtttcagttgctacaacttgcaaataggctttatacaagaatccacatttaaaataatcagatcatttgccatcttgtaatcatctactgaggctgaggggggtgatgatatgatataggtctgtgtccttgcccatatctcatgtcaaattagaatccccagtgtcagaggtggggcctggtggcaagtgactggaccatcaaggcagaattccccattggtgctgttctcatgatagtgagttattgggggaccttattgtttaaaagtgtgtagcacctccctccactctctcttcctcctgctccagccacagaagacgtgcctgctttcccttccgccatgattgaaaggttcctgaggcctccccaaccatgctttctgtacagcctgagaaaccaggagccaattaaactgctgttccttataaattacccagccccgggtagttccttatagcactgtaagaatggactaatacaggtgatcacagattgggatgaagtgggggaatggggagcatttgccattcccagaatctcccccacactcttctaattttcttatgtttaacaggcatcattcatttattttacttcctggattttgaaggcattgagtttgccaccaacccataatcccctccttcaaggtggcctgtggtttacctcctactctctttggtttagactctcttgcatgagctctgagcagttttgttcagtgaaccaaatttatgataatgacacaagggccatgagaactgagtaagtaataagtatttccattaaaagagggttcaagcagggaaacagtaaaaaagagattaaatgagaaaacaacttacaaaaaattaacaatttgtctcaaaattaacacttgaatcatttaaattcctcctcagattacaggcatatttaaaaaattgtgtgtatgtctcagatttacatatagagtgaatacaatttcaattctatcagagaggatgttctcagaactctcttccttagaaatgctcaattttctcccttaacctcctattatgattcaatttcattaactaaatttattgttcctgtgtgtggctctatacattgtaaaatgccgcaggttatccgttcattcttcatgggaatgcacagtgtagtattttgtgttatgtgttaaaagtcatttgggattgagacaatttaatagcaccaatgatagctagcatttatgatgtgaaaggcgcacattatttctttgatatacattatttcgtttaatccttacaataactcataaaactgacgctacttaaccccatgttactgtggaggaaactgagttctgaggaagttcataccccggtccaaagatcacccagctaggtagtggggtaggtgccagtattatccccaacaacttttgcctttttattcatcctgagggatctacagtgtccctaaagagcatcccacagatactgttccactccattttgaaaaaggtcaacttaacgattaaaatatcgactttttaaaagttgatcctttaaaaataattttgccaactcagcaaaaagtctatcaactaataaatgacttttgctatctcaggccccaaactctaaatctaacctagaggcctctaccctggcagcttgcagcagatggagaaatttccccatttattgcagctcaacattgatacagaaggcaaaacagtgagggaaccatagcctcgcactcccgctgagctgtatttccactcctggtaagtaagtttgagcctaaatgaggctcattagcatataaccgggccacagatacatttatgagggtcatggatcttcccttcagaatttggctgccagcacgctgattttacattttgccatgtagatttaattctccttagtgaaagaaaaccacattaagaagtcatttcctttcttgcagaggcaaacatgctgcagttgctacaggcaaggcaaacgggattgctattcttctactcaagaactaattttcattttgatactaccttgacgtctgttataaatccatcttatcttataacaattcaataggatgacaaagagatatgcaaagcccaggaaatatggccttcccacttctgctactgccattggaagacacagaaataaagcattaagtggcctcaacaacacagatcataccagaggaatccaaataatttagagcctgtgaatgttaatgccttcctggttattaggcaaccgtctgttattgtcatatgccttacagatggcaacattgtgccaatccttagaagaagtttttgggaaataataggaaataaataaaacaaaaactaatcatctttgcaaaaactctgttgtacctagcttttaaaagttatgagatttccctcctaaaagccccagatggaagcatgtggttctgtttagaacagcggcactcaaccctggttggttgcccactgtaatcatctaggaagctttaaaaaataaaacccaccccagggattctgatttaattggtctggggcagcctgggtttggggatttaaaacaaaacttctcagccaattctaaggtgcacttactgttgagaatcactgctttttgggagaagtgtgtagatagagcccacacacatatagaaagaatccgcttgcctttaagcacattgcttgtgatcctatcaacagtactactgctgtcctttgcaaaccttgccctagaactgcttttcttctgtttatgctctgtccatgggatgtctggcctacaaggcttgtcttagcaacactaacatgcggatgcagttcagcagcctttgaatgtttttaatctctgcagaaatagggagcctgggaaaggccctggtgggcaagacttgtgtcctagaagatccatccaggtgacttgaagactaaaaatgctacagtttggagtaaagttccatttccctaaagcaacccaagaacctggtggctgcaacttcttgcctggctaacggagagaaagccctaatgatcttaaatagtagtttatccaaaaggcagtatttgccgtgggtgaactttaatggaggagtttcacttctgataagccttctagattactttggctgcccacaggggagggcggtgactacttgttaacacacaagacagttgctctgtctctgtaatgccaggggccagacctagcactggaacactgaaccagacagactcctttattgttctcctggggcacccaggtagggaggttacacaccaaacggctgattcttagtgagatgggattacaaaatgggaaggctgctggatagagctagcctcattgcaaaggcttttgagtatcaccttggtttcacaaagaaacgttatgaaaaacagtgatggagggaaagaggttatctacggatcatccaaaaatggctctccaagaaggcgagagttagttaggtctgagcttgaacaatgagaagaacaaaagttcctttaatctctttgtgtctcagttttcccctttgtaaaatgggagtaggaaaaagagtggtgagcagtgccgtgcctgacacatagttaagtggtatttaatattccctgctgctgctactactgtcagtcattagcattatttttaggctaaataacactgacctaatgacagcgagcactaaaaattccacagaggttgtttctaggagtaaaagtatttttcatctccatggttccccagtgatctgtatcttttggacctaactaactactttgtagaaggattaaaagttatgatcagaattcagatccaaaacaacttattataatgagacactcaaatctggggaggaaatgtacctccttcagctctaaagtgaccctcactaatccctaatcctcagagctgtcctaaggagtgagtaaggtattaatcgaggcttctcatggtaaaagctaaggtcctatggtaaaagaatgtggtggaggtcaaaggtagtcaataccccaggagtatggttgccagatttagcaaacaaaaatacaagacactcagtgacttgttttaggataaggatgtctcatacagtattgagacgacatcctgatatgaaacaatgatttgttgtttacctgaaatacaaagttaactgggattcttgtattttatttgacaactcaacatagcagaccccttaaaaaggtgtcacaggaagaacttggcttgcatttggtaactaggttgttcccaaagttgcctggctgtgaatcctggaaaaaacagaggggatcatgtgcaggaagataaaattcaaggccatcattttgtgcactccagggcttattattattgcatggtcttattgcacggaatgcagtgtaaatcaacctgcactattttaattccttagttcaccagttctaaggtgcacattttttcatattttaacatctttgaaatcaaaacatgtcctataaccaaaagtgtgtcatagtttaattggcagtgtttttctttcttagtagtacataaaataacagcacttccaactgactgtgtctgggattcagtgcactatatttctccatctctcctttctgcaggtaagtcacgtaagttaaatgtgactctgcttgctctgaaaatgctcaacaccaacgctgatgtattacatactggtttccttctgatgcaacaacaatagtcaaaacggttttcacagaagctttgttctttagaggaaagtgcacgccaaagtgacaacgtttgcaaaaacttgaaccaaagtctttattcacattcaacagactgaagtctgtgatggcctctccaagcaaattctatttctgcacagctttgaaaagagatttaaaacaaaaaatctatcttcagtcatcccactttatctgctagaaatggtttttggggaaggtagtgttaacaggatttctgactgaagaactgatacgtgtcgattttgacactgtgctccctcctgtgcactgagtgtgttatcacaaggtatatggggtaatgatgaattccctgctgtattgctcaaaccgcctttgctattgacatctttagagttctgtaatggaatgcagtaggaggaatggttcacaataatttaaatgtttttcagaatttggaacgaacctggagtaaaatgccaaattgtcttcaaacgggggaaaactactttaatgctcttcttacagaagcaaacggctgaatataaacttggatgtttttataaaaacatatttcattattatcacttttataaaacaacatacagaagcagagagcttaaataaaccatttcttatgggttgacggttctgtttacacaggggtttatataaagtctcaaaaggaaaataactgtattgtttttttagatctgatcctctcttattactttctattcaaccaagttttgatgaacacatgatatattccaggctctgttctaggtcttatgaaagatgatacaaagataaataagcccaagatctttgcctcctcaggttcaccatgcaataaggcagacagattcatgcatagataatttaatactggcctaactaccgaactagaagttccatcaaagtgttcttggagtatctggggcagggggagacaaaataattcttgctggaattcaggtctgagattgacttttaaaaatcaaggacttggactgggcttaaaagatggtaatgagattttgaagaaagggtaattctgggcaatgggaacagcttcgttaaacacatgatgcgagtaccagttccccagcaaggcaacttgtacccatggtcagcttcaccaactaattacagcactgttccctgatgaatcctgacctggcttctaggcagctactaacaaacatgtatcagagttagcaagagagctgaaatttgccactttgagaagccttaacattccattgtttaaagatggaataggcacgcacaacaggggtctaaaagatggtctccggccctacaaatgcaaagctgcaaacagctttgaatcttactgagagaaacttattcccttttcagtgatctttcagtccctctgactgttcaagaataaagtctcagcggactagtacgtccttgataaggcatcaacaacacctctaagagaaagagaagagccatccagactggctagaatataataagattgttttgtttagatcatatttatttttagggacatctctcatttatgacaaatcatgtcaagtctccttttaaagtaaatttaagttaaacataaaagaatcaattttaaaaatatatgaaatgaaatggtgtgaaaatatggcattaacagcttgagaaatggcccctggggaaggaagtacaactgaggtgggaaagggtgactcaagatgtgagggtgatgcattggcctttaatgcttgtgggtggcagtttctactgggctgagttctagaaagctacatttttcatggatgcatgggagtcaaaataatttcatgttataagaactccgtcaaaaaatggtatgggggatggtagaactttgggtagggcaggcttttaaaggaaggcttcactgaagatgtagcatataagttgaggtgtgaataatgagtatttaagtaaaggggcaggaaggaatatttcaagcagaaagaacagcaagtgcagaccttcaaggaagtgtggtggttgggtaacaggctggaagagtgagagagaggacttggggggatggcagatcatttgcaccctgtgggcagggctgagaagtttggattttatttttggtgtgatgagaagataggcaaggaagtaaaaggactagaataattgctcataaagaatgtcctggaaggataatgaattaaagggagaaagtgatggcaacaatcagaagagaaagtttgggagagggggctcatttgccccataggctagttagcgtcatggccactaagtgagaggacttggcccctcactatagatggaccttgtcatctggcagctttctccctggtgcttgtctgtaaagcacacagagatcctggcttccctgccaagattgctctgaactagtgtgaaaatcactcagtttttgcccaatatccattctgcctctcttctatcattcacttctcaaagttcccgagaagccttcctggaccattctgattgagtcatatttcacgattctggatgctttcatgcttctggcacctccctggcactgtcctttcagtacatgtttcctgccagacatggagcttcctttgtctatgtgctggttactgagcagactggcgcccacgctggactttcttggtggcccaatgaatcaccaggtgctttcacttgaggcagaaaatggtcttggaccacaaacctctgcctgccacttgtgataccttagaacgctgaagttctttgaatattacttagtagaaaaatatgttcattgcttcccttctctatcctgtgaactggaccttggactaagcactagactgtgagatatctatgtgcaaacaaattaccttcaggtccttctacttactgtgaaagttcaaaagcccagttcctcctccttttctgaacagaaattcaagtaatcaatggagcattaatcatttgattagttgccaaagctttgacttaagcataacttacttgagtaaaagcaagtatttttagtgctgcctgtggggccaaaatgctgaaataagctcttatattaattagtggcatcccattttcaaggggtatagagtgttggatgtttaagaatttgtaacccccaaaagtaagtattaactagaaaatcacagtgctggaaaataattatgccaaaccactgtactataacagaccccaattgcttatccaattatacattgaagtatcacattgtcaagccgattgccaaagcggcaaatgagactttgctagcatcataatttggaccagatattactccactaactacactatgaatagtctttggaacatgctatgtaccctatataaacctccacgaaccaaggtgggcatttcaggtttgttggagtacgcccatgccatcaaaaaaaaaaaaaaaatcactggaattgattagacatgaaagttcacagttttccattgaaagcctgttaggagcatctcagcaaagagcaactgcagctccaggttctgagcagagttgatttcaattaaaatatcaaaggtagtcacttcctgtcagggagaccatcagtaattctatcctcaaatgtgtatctgagaaaaacaaccccagacactgcctcctggatctgcaacactgctccctgattgattggccaccatttagaggtaatttttttttttttcgagacaaggtctcactctgtctggagtgtagtggccagctcactgcagcctcaacctcccaggcttaagtgatccagccacttccgcctcctaaagtgccggggttataggcatgcaccactgtgctcggcctagaactttcttacaacacaacatcaggacagctgaagaacaggagcctggaactgggctgtgaggagctactaaggggttgatattcttaggacaccccattgctatgattttcttctcaaccttgtaagggattggaacgatcttgcccaacagttgggtctgatatgtcagacgaaaatcccactgtggcaagagcctgactcccagggttcagtagagaaataatttgcactcgcccagtagttctttgcttttcaagtaatagtaagccctaaacaatatcaaacttggtaaaaacaaaatcttcctgtctagtccccacattgcccagtcagagtaacatccatcttcgtatcctctcggctagctgtatctgataccagtataggaatcccccttcttcacccagtggatgcctgaaaccagggatagtactgaaccctatgtatgctctctgttttcttctacacatacacaaacctatgataaagttgaatgtataaatcaggtacaggtacaggttaagagattaacaaccaagaataaaatagaacaattgtaacaatgcactgttcacaattgcacaaacagaagatccctgcttgcagaggatcttagcaatttattttattttttttttttcgagatggagtcttgctctgttgcccaggctggagtgcagtggcatgatctcggctcactgcaacctctgtctcctgggtacaagtgattctcctgcctcacccttctcagtagctgggactacgggagtgcaccaccacacctggctagtttttgtagagatggggtttcaccatgttggccaggctggtctcgaactcctgacctcatgacctgcccgcctcggcctcccaaagttctgggattgtaggtgtgagccaccgcgccctaccagcaatttcatcatataatttgttttatttccttattaagtcaggaactttcaccttttctcttaaataccttatgtcctctttttggcatatctgaattgccagcatcactactcttatgctttggggctgttattaaggaaaatgaagggttacttgggcataagcactgtgatttcatgacagtcaacctggtaacagagatggctactcagtgactaacaggcgggtagtgtagacaacatggctacactggacaaagggaggatccgcatcctggccaggacagagtgggacggcgtgcaattttgtcacactgctcagaacgttgtacaatgaaaacttatgaattgtttatttctagaatttttcatttagtagtttcagactatggtaaactgtgaaaagtgaaactggagataagaggggactactgtagtaggttttcaataagcattggtcaaatacgtcactaaattacacttttcctcccaatatactggctatgctagctcatcatccccattttccacataaaacaaggaacttaaatcactcaaccaatgtaacatggataactcagagtggtatttgtttggatgagacacacaaacactggatccactagtggatccagacatgcagcaaactgtatgtctcatccaaacaaatttgctgtatgtctagtgctcttctgatccactctataaattcctgggaacgttctttcagttaacatagttgaaaacatgggtggtaaaacagcatagaaagcaaaactaacactgcaaatagggatcaacctctaagcccggagggccctgctggaaaacctcttctgaggggaaaattgcatctcagggcagttttcaggaattaatcgctgatcaccaacacctcaccccaggcgccatcatatctgaacccttctggtttttcagtgggtagaaaactggtgaggcaaaagggactagagatctctgccagtttgatttcctcaggcctctgtttctaaaaacatgctcactgagaaatgaaatgaaactccttctgaaaaggaggtttgtgatgaagcagacttcggagaaggaagcatttattcaaaaagcaatttccttggccagtcatgttctgtaagcctttttcccccccgccggtgtttcagatattggtgtttaagcaagactgttctcctttaatcctagagtgatgtcaacccacagtactcagaacaaggaatgggaagaggcatagggccaatttctgcctttgttggaatctcctgaacatttcatttcctatttgcttctgctacatatggcttcttttttcaaaggtaccttgcagagtcttcggaagcacagtgtaggcaaggaaactctccaaggagaaagaaaaatctgcactacaagatgctacgcaaacacacaactaagagagggaggcaagcacacagcacgcaaccaataatgcacagccacagaatccttctcaacacaacattgcaggcagcagcaactgggttgtcaagataaaacctatttgaagaagctgatctagctgggacctttgaacaatccagatccccaagcatttaaagcttgtttctctgcagaattcattcaattattcaacaaatatgaacatgtattcagtgtattttatagtgtaatagtaatcaagctggacaaggtagtgcctttgggaggcttacattctaggagagaaggcaggcagttagcaagtaatcatctatcactgccttgggagggaataaaagagggagctacctgagacaatatggtcagaaaagactgctctgaggaaaggacagtcagctgaggagtggcaagtgcaaacaccccaagggaagaaggaggcatctgtatggtctgtgcactggctgaaggcaagtgtctgaaggcgagtgaggaagttctcagatagaaggtagaagatgaggtggagaagtgggaaaatctcccttccctttagcactggaggcgaaagggctagaagacgagagactgaatgattctttcagtcacatcactcttttcaagcacctactttgtgctaggcgcagaagactattaaacaggcaaagctgtaataaatccaaactcagtgagctgaaggtagaaaggccgtcccagaacagctggacccagcactgcctctgaacatgggcaatgacactttggggctcaatgtttgcttactgggtctctcacacaccctaacatcagccctgcctataatgaactttccccagaaaagcaggtgagcagcaagctatttgcacatgtggtgactaccatggagcagcaaggatgcaggctgacctcacagacttctttctgaatgcataccatatgtttggcagagctaaaagagctatcccagcaccatctagccaggtgcttggcactggatctcatatgctggcagatgaaaaatgactaatatgaaaatctatattccaacggtactcaccagtccactggattggtcacgattccttctttctacaataggatcattctgcttctgattacaaaactgcaccctctgaagctgctactcacccgttggaagttacatgccctgtgcagcctacaaatccattaagttctgatggagctattccaacgcccttcaaagaacctggcccatgtgagttgcacaaacaaattggagccaacctttcccaaatgcctctctctatttcatttaaaaaccctctttaatgaagacataaagccttgaatgcatctgaaacgctatgcttaccatgcatgacagcagatcgtcacagaggatttcaaatgcttttttttttctaaccagaatacttgaaagaaactgagatttccttgttatgagttcaactgttcattttatatgccctataattgaccattctccagaagtcagcataggcaacagagatgtaaggcaactgcaaacacacacacacacacacacacacacacacacacacacacacacacacacacacacagctttggcacagtgaaaaattaaaatgcaatgccaggcttgggactattttgaagcctcaggctaggaaagcaataccctcacctttctcagctgcctactatgtacctaaccttccaattatttatggctgagatgcttaagatgtactggagaaacagccatggctgagagatacacaaagctgaaatattatagagagttataacttcatgaatgaaaaacctataaaaatcacttaagggtcctaatctttcagttaatctcacctcagtgccactcaagggtttaaaggagtttcactgattggtttttaaaggacaacgataaaaatgctttgaaataactaattataatttcaggtatctatgtaaaggtccagacacaaatatttgaaaatggactgttcctagaatcagggattgacacagatctttaaaactttctagcccaaacatccatgtgacatttgtatccctttggccatattgctttcaaggcttcaatgctctaggaaagaggatcttactgcagtactgctagatttaggtggagatcaaaattaccaatgtttgaaagtgatatttttacattaacttgatcaagagttagaacttggacttattactcagacagtctgatccttcattgacaagctgtgctgagaaaccattctgtgggctaaagaggatatggactcccaggattgctctggcattgcggttgagaagatatactggaataacctcttttgaaaacagtttagcattacctcctaaagttgacatctacaacaatatgactgccaggtatattaccaagagaaattctcatatgtgtacaagaagacatgcatgagaatgttcaaagaaactctgattaaaatagatagaatctagtaatgaccaacatcccaccagggagtagatgaataaaccctgatatgttcacataattaaataccatggctcaagcaaaacaaatgtttgatagtgacacacagctcatagggagaaatcttaacaatatattagtttaaaaaaattccctaaagacaataaaaatatacacactttaggaatccatagagatgcctaaaactatatgaaaagtcacaaagcaatggtgagcatagattgaggatgctggactgactccatgtgaggagacaaggggatggttttttgtgtgggactatcatactgttagatgtgggatagtagcaaaatcataggttttgttctgggcaatgggtttgcagatactcattaacatcattaaacataactacttacacaactaaagaaaaggaggctatgatggaaaacaaagagaaatgatcatccttgagaggcatgtaagattacaacatcggatgaccgcagttttcctcaagataggaatccagctcccattccaaaatgtccaccaaagttgcaacatagtagcatttgccatataaaagtactggagttattaactggattccagatgtctgaaactgatgtatcccttcactgaatcccgactaggatctattttgggtatagcacttcacacaggttgctgttcttaattaaaacttctctgccttaagagctttatgtctgtgagatagtcatccaaatgttctcctctccataaatgtgctcttatgttttattttcacagcaaaatgcttgcccagattttaataaacatgtccgcagtagtaatatacatttcgcatgctttccacatttcataatctctttagtccttttgtttatgttgattcccacaccaagaaggctgtttggaaggctttgcagctctgtctccatttcttctgcctatcattggggaatgaaacagcacactgattgctatttgggtaggaaacacagacaagacgttgaaagaagtaaactaatttccaagcaattttgctcctttctctctttttgattgattttggcaataactcaccccagttcattgacattagagtaaagcctagtagccaatttattgcttcaaaatctgtgagagttcctaattggttatcagactgtgtctaccagatgccaaaattaaatttcttttaaatcaagaaaaaagtgattttctggcatcccagatgcaaaacaaccccgattaactgttctttcacattgcaaatggctatttgggccttgggtggagagaaaactcatctacttacaacaggagggggtcagattctggactcgatccttcagccaaaatgcagataaaccacaaggaacaaatactactctatgaaaaatggagagctgggccgggcgcggtggctcacgcctgtaatcccagcactttcggaggctgaggcaggtggatcacctgaggtcaggagttcgagaccagcctggccaacatggtgacaccctatctctactaaaaatgcaaaaattagccaggtggggtggtggacacctgtaatcccagttattcgggaggctgaggcaggagaattgcttgaacccgggaggtgaatgttgcagtgagccgagattgtatcattgcactctagcctgggcaacagagtgagacttggtctcaaaaagaaaaatggagtggtgttcctggctgaaggagagatgccctcggtccaatgttggggaaatttttgctcccggaaagtggaaacatcaaaggactggagcccaacattaaggatggaataattatgttgttgttattgttatttttaatggagctctattgagtgcttgctgtctgcctggcaatgtgctcagtgccaagtacaaacatgatctcatttactcttcataagagtacctaccccatccatggtgctgtcatttccatttttagatgaagaagttaaggcttagagatgtgatctcatagctagtaggcagttgggactccagggtcccactccctttctgtctattccccctcctcatataacaatacatagcatttgctaagcaatacagactaaattgaggctctaacttaacttaaagctcttttgcatacagaatgttatttgatgaactctagggtaggtagaggcacaatattattatccccattttatagagaagggaacaaaggcccagggagattcagtgaattgcttgagtcttctgccatgttggactaaaagcctcagtgttgctctactaaaaaggtccctcaactaaatataacaggggtggcctgcatctagtctctgaattggaacatcacaactgacagagcttatatcgtgggttctcttatttaaaaagcagaaattctaggtaatggtccagtgcaatttcgactccatctcctaatcctttgacatcaaatgctctggtcctgacttactggtcctggacatggttttcttggcacagtagcaggcctttaccattttacctgcatctctcaaccctttgtcctgtttccatctcatgtgagtaggagttattctttaaacaactgccttgtatctcactaccagccctttgcacatactgttctccctgcatggatggcatttcttcccctgatccaccagcactggacttaggtggccctccaagatggttccatttcaggacacttattgtacatgccttctaatttatcttccactctataggtttcctgggggcaaaatcatgtcttttcacaatagccaatcttttctttgacttcccagacatcaatgtcatatggttcaatctaataccttaaccatgaccttataaaaccaaagctaggcacataggagaggctcactaaatacttcttgcccagataaacttatcacagtagatattcagaaggatgacatagttgtacccatcctcagtcctcaaataagagtttaattatgttatgtaaaccatatgatatactagtgaggcaggaacagatacacattgtaaaagagatccagaacaaaataagatttctctgtggccttcgccaatcttaaaatgtaactatatttactgaatcaaactcttacagcataataaacttacttacaaagaatcagggtagacagcctaaccttgagtacctcaagtctttgcccctggatcccacataacaatatccttccctcttttaaggaaagctggaaagaaaaccactctgccagcagaagggcaaataaaaggtatgtctgtgcctgcacacagaggttggcatcctaccctgatttgtgacccataattaatgtcaatttcataatttcggaggatagaagatcaacaaggaagctgacctctggctgtctcacagctaatcatcttttgaggcggaaacttgagaggaaacagaaacgacaggctggagcaccaggctgtggctcggagtgtgttttgggtgatctgccaagcagtgagaacccatggtcacgtgccctctctgtgctggccccacagtgacacctgctcaccctccattgggtaaggtgggaacctgcatcccaccctgtagaaggcttggctggacgcctgctagtctctacaaagttccttctcattgtgtgcactcttctacatggcttcttaattatgtatgtgcacaggctgtgtcgaatggagttgcctttgcctctgctcaccacgtattacatttttaatcagtatatataattacttaccgcaagctgccaggccagattttctgagcattagtctaattaacttaaacttgataattatgtttcggataccatagcagtacacacggaacggcagactttgctgccagcttatttgattccaataacgtgttttctcaatactggactagttttgattttttttttttttttgaaaaaaatggccatctgataattactttggtttcaaaatttcccctcagataaacccattctgctatttaggacagcttctcaaatgatttacacggattgaactgttatagtatgtttctgtgtatttttacacacacaaatctgtttttactaatataaattcaaactgaggagaaatgacagtagaaggaattctgatggtcaaatgacagaattgtccatgtttcaactgctctatgcattgccttttccatttcaatttgggttgatgaaaaatgagagacaaggaaaagcaaaacaaaactaaacaaaacacagaaaaatgcccagacttgtaagggagaaaggtcagcttctggttgaacgagggcatgataagttcccacactaataaggctcaattcacctagggcttaccatgtgccaggcactgcaaaaagctcttttttgtggactatctcatcgaatcgtcctaacaaccctatgtggtaattagttattactataggttgaattgcatcctcctgaaatatatgttgaagccctaatccacaatgtctcagaatgtaacttggtttggaaatagggtctttgtagaggtaatcaggttaaaagaagggcattagggtcagccttaatctaatatgactggtgtccttatacaaagggaaaatttggacccagcagctgccatgcacgcaaagagattaagtgaagatgaaggcaaagattggggtgacggatctctaagccatggaatgccaaagatcatcagcaaactcccagcagtgaagtggacacactgaacagattctcccttagagccctcaggaggaacagctctgctgacaccttcacctcgggcttgtagttgccagaactgtaaaacgacaaatttccattgtttaagccacccacccaggttgtggtacttgattacggcagccctagccctctaatacatatactctggttaccactactccccgtttcacagatgccaaggctcagaaaagctatgtgatgtgtccaggtctgcacagctgtcaagtggcagggaaggagtccacaacaggcctttcggactcccatgctcaacccttgacctcacccatgcctgtgccactctgcttctgcccaggaggctgaaagaatcaatacaacaaatcccagaagtggatgaagcactatgaacactgtaatgcttctaaggtaaaagtcaagcttagatggtgcctgttttcacatttgcacatcgcctcttttatttaacacgtaaaatgactgcttgaaatacctgcactctagttttggagggcaacaacatggaatttaaattttcttagggtgagggtagcgggattattttgttctcttctcacataagacaataatggaccaaaaataccacttaccaattacaaaagacaacaaataacagagcacaactcaatgaatcgaattgcagaaggaagaacaggtgggctttcccaagatgtcataatagatggaaggagaacaagagagaatgaacctgctctataaaggccaaagacaggaaatgagaatcattctggggaaaagatacaacctttatccaggaggaaaagcatgggaatatgataataatttttaaaaaagacaattctccaagaatatctcctggaatagatccaacggaaagcttgacaccagataaagaagggaggtcaggttcattgagggcctattacatttggggtatgtttgagggtgaaaccccccatagagtgttgtgaagtagaagctatcgcctcccactttgcagatggggaaataaagttctaagcaattaaataattactaaagggcagctactccttggcccagcaaatcactggaaatgctgacatggaagaacagcaggaagggttgtcctaagaagaattactttccttcttcagactagtagtgtctctatgtctgtggggaacgtgcacaagctcacactcaagacacagacttctcgtcataaaaaaatttcacaaattacctctaagttgctctaaaacgggagtgcttatcatttttaggcatgtcagcactttttagaatctgatcaaagctatgtatgactcctttccctagaaaaatgtgtgcacacacataaatgcatacactttacttgaaatttctagaaggtttgtacaccctcagggatccatgagtcacagctttaaagcccacaaaggatacatctgcctccaaggagcccagcaactttatgacacactaaaacaaacacataacatgcactcgcacaaccttgaccaggacagtccccctccacagtcactggcttgtatctccatgttagcacacccacctccaccactgagggggagctctgctgtgcttcgttgatctgcattcactaatctacattccaggccccacataaagcaagtataaagtgaatgttaagtgaatttgaagttagaagacctggacttgagctctatcactccctctgggtcatgttgtttcatctccttgaatctcacttttatcacccacgctattaggcagaaatcaccccggtttgcctcaccttttctgaaggattgctgggaggaacatatgcagcaatgcaggtggaagccatttagaacagtaacagtgaacactgactgtgtgcaaacactgttttaaacactttacatttattcattaatcttcatgaccatcttatcagggtggcagtgttactatccccatttcagacatgaggaagctgagcacagagaggtcggggaactggcccaggtaggcacagggctgggatgcaaatgcaggcaggctggtgccaaggccagctctcgtaaccactgtgcatagtgcctcttcaggagaggcaatgccacaaaaaatgtctaaaattatcctaacgagaaggcaaaagaaccctgtgagccttctatgaacattagtggagtttggaggtgtggggtttgcagggctttagatttagaccacccagaagagctcgatgttacatataactgcaactagcttgtgcatccacaactccaaattcagccctgtggtggtcagcgaatatcgagggagaaaagcagcagcctcatgtaggaagtgtagggccagggccccctctcaaagctcattcacatgtacttactttgactgccacaacgaacacatttgtaggctttccggcttgtggcttacctgcctgtgaccacaaagctcatatgtaccacaagtcctctttttcctacttcaaacaaacaatgctcatctccctcctctgaatttttttgtttgagagtttccaccttaaggttttcaaggggtccacaattcagttgtatcttgagtggaaatcttattctgtaaggcccctgtcttcattctcacacagtcaaagcacactagctgacaagcaggcttcgagcagagccatgataaagcttcaagccctgcctgcccagagctcacagccccggtgggtgacccggaaaataagcaggcacctgcaaaaggcctgtaaagtgctgtgatgaggaaaatatgggcaactgtgggagtcacagaaagggggtacctaatccagcatggggagagggagacactagagggtccaaaaagctgcgtatcttctctgcctttgtattgtcacaaaaatctaggagtcctcatgagctcaatgttaagtggttgcatgctttgactcacttaatcgaaaatgtttttaaaatcctgcttagacctttttcctcccactgttccctgagttagctccttctcaccctctgggtctcaatttccaatgtaattaattccctcttttcacgaagccttcctggagcaccctacactgcctggcatctcctgtgccatcttcctgcactttcttcctttcttcccagggaggcaggcttcatcttgatgtcccgggtgtggactgcagaccaacatcacctggcggcttgttagaaaagcagaacataaggccccatcccaaatgattcctcaatactttaaagctgcctcgcccaggaccttagccatcagccccatgtgactaccaggcccctgtaaaacggcttgtctgaactgagaggtattgcaggtgtaaagtacataccagatttaggagacactgtgaaaaagactgtaaaatatctcattaataattatttcatgttaattacctactgaaataatatttatgatattttggattaaataaaatattacaattaattttatctgtttttttaatatggctactataaaactgatagtcacatgtgtggttcccattatgtttattttggacagggctgccctacagcgtgagatgcgctggtttggataatgatcaagaacaggcattggcagacgacagccactgggtcaaatctggccaggtgcctgatttggtaaaggggcttttattggaacacagtcacactcactcatttactgtctttggctgcttttgggctacagcagcagagctaaggatttgcgacagaaactgaatagcctgaagagcttaaaatatttaccatctggccctttttagagaaagtatgcagaccccagtcaagaacgttcattccagaactggaccgattgacttaaaatcacgtctctaccactttttggtgtgtgaggttcggcaagttacctcacctgcctgtgcctcagtgtttgtatctgaaaacagaagatgagcatacatacctaacagagttgttatgaagattaaatgagttgatatatgtgaacttccttaaatagtgcctcatccatagtaggttctcaataaatgttagccaccattaatattactgctagcagttatcacaaattgtaatgacacatttttgctttaactttttttcctgtctgtctccccatcaaattaaagacctaggagagtggcatcattttctgtcttgttccagctgtttaagcacagttaaacagcccacacgtgagattcaatacatatttgttgcatgaatcaagtgcagaggagggaagtaattttcctaaggctccacggccagaaagtggccaggacttgaatgtggttctatctgcttgccaaactcaaattcttaacttctcttgatacaccaagtgtagtctatagaccagcgacatcagcatcacttgggagcttgttaaaaatgccggagcttaggcttcatctcagaccgactgaactaaaaactctattttaacaagatcgccaagaaattcataggcacattaaggtttgagaagcactgctctgggctataattcccagtttcgactcatgtgcttatttgttcaacaagcaattaatttagcatcaatcattccacagagccttgtgtttggaccccctaattccagagctgatgatttctattcatcccgatcaggtcctgggggtgtttagggtttgcaatgaacggcaatgtgctgtgtcagaagtgccctttctcctaccaggttcaaaccactgcaatgctggagtgacctctctgcacagaaatctgcttaacattccttacccgcctgtagtgaccaggccacaggctccggcagatgcagaaggtctgaaaatctagttgtaagtaattttcctctaggtgcctacctcagtgaattggttctcctgtgcattttatacatcagtggtcgcaccactcaaacacacaatccattcccgagtttaacagctcaggcaccttcctttttgattttataaatgaatgcaaatcatctcccactcatattataaaccaattaaaattctcctcacacttttaaaaaaacttgttacctggctcaaagatccttagctcttttcttagaaactggcccttatgtggcctgtatgtgaggatgagggtgtttgaaattagcaggaaatcttagaatggtttcccctttgtcacagccagaagtttcagattgtggtcatcagatgaacgctttaaatgagaaaaagactgattagcataattcttaaaggtctgaactctacactcacagatggcctctgagaggatggatggtacagaaaggagattaggataaatctaattagtttgggggtgttctcatttctcaagtggtgagcgatggagaagaagtgatggatggacagatggagataatgaagccccattaaagccttttttgattctcattctccatgatggagcacattatcccattaatgtttctgtgagctaacacagccaaagtttggcgctgtcacctcgaaaatgaattcgaattgcctgcccagctccttacatgtgtccacaggagttaaatgagcctgaaaactgtattcctgctgagaagcccatcctggcagcatgggctggaagccctcccctttgggaatgggccttcctcctggctggtttctaacagcactcaggccagagtcccatagcttttctgctccggggttctacaactagaatttcctctgaaatgggctgtggcttgcacgtatttccagggtactgagacagaccgctgctgttctcttcagtggaggtgacagctacaagtgctcaccatcacactctgattagggacctgagggcagggtccaaaaacaaaaagtggcaagacaggcccatgactcagtcacagagatgtgacataaataataatacaggacattgcacaggctatgtgcaaagtaagggcctgactggctccactagctcagagaacagtgagacagtgatgggccatccaggaaacagcagggaaaggggagagactcctcggggtttgaaaaaagaaccatgtgccccctgatgacagcagcctcctaaatggaccccttgcttctactcttgactccctacagtccagcatcatttaagaacataaaccagatcaaatgattctccccttcaataataatcagagctgacatttattgagcacttacttatgtgtgctcagcgctgatccaagcacattgcatatattatttcatttcacaacagccctttgtggtattaatatcatccttttattacagatgaggaaattaaggcacaaacaggtgacctggcccagtaagtagcagaatttattgacaagctcaggtttcttgacttcagaactccgattcttaacctataactcctgttccatgttcattccatgccctcccaccacacatggaataaaatctaaactcctctctgacctcattttgttccagtgtctcccatgctcactgtgctctcgtcacattcttcaagaactccaagcacggtccatgtctaggccctgtgcacttgtagttgcctttgtctgcttagaaaggatttcccttctcccatatccaccttcgaaatgtcagggtggcccacgcttgattctcagctctcttactttattctactgctcttcccaaccaggtggtctcattcaaggccatggctttaaatactatctcctatgactcccacatttatgtttctagcctggaacgtttaatgagttccaaccatgcgtgtttaatggctcatctaatctttcctctcgcatgtgtagtgggcacctatatttatcacccaaagataaaaaaaaaacccctgacttgtaactctcctaccctacttcagtctgtaaagtaaatagcactatcatccagctggttactcgagccaaaaaccagcaattcttcttagcttctgagcctttgcacccaatccatgaacaaattctacctgcttccaaggcacatcccaaagggcctatttctctccacctccactatatcatctctgatataaaccactgtgataattttgcttgcacttttacctctctttaatccagccagggagtgacccttttaaaagttaaatcagatcatgtcattcccttgcctaataccttctaactctaatgtcatgctaggccctgaagacctctaggccaccgtctgcctctttaaccacaactcctctgcctgctcaccaatgctccgggcacactggcctcccttctgtttcctgaacatgccatgctcatcctggatgtatggcttttgcaatcactattcactctgcttagaaaactctctaccccaggtttccccgggcttacagcttctcatttagttatcagttgaaatgttacctccttggtgaggccttttctaacccctctaaccaaattcatatgcataaatactttctttatcataccaagtttcatttccttctcactctctgagatgtctgtgtgtttaattggttttttctgtctctcctactagagtaatctctttggcggtctgggtctgatctggtttgttcacccctctatcccccagtgcctggaactttatcagggatcaataagtatctactgaatgaagagcaccatttatttagaagctcacaaaatgctaatggaggaggtaagattgaagacagatgataaagctgggacttcaatcctatagtcagtgggaggggaatggataaagagtaaaagtgacgcaaacttgtagggagtgggaggaagtctaaaatcttccatttgttgaatgaccataacccaggaggccctggtaatacacaggtgaacaaaaccaaaatggcccctggcctcatagagcttgtattgtagcatgtagtttaaacttttttccccattttaggatggagcaggggtaagcaaatgttttactgtaaagggccagagagtaactatttctggctcttcaggccatatggtctctgccacaaatactctgccactgtagtgaaaaaggagccacagatcatacacagacttggctgtgttccgataaaactttatttacaaagacaagcagcaggtccaacttggcatgtgggccacaactggacaacccctgggacagagacttctgtcccttctaaagaactggggagtactttaggcttgtcatgtagagaaacaggctttgaatcataagaaccttaagggtcttgtggagaaaaacatagatttattatttaccttaagttttctaaagcgcttagaaaacagtgagtggacctggagctgctgacctggggttcctgctagtcttttgttttactccttcccatgaatcaactagcttttgtaagaaacctcacagttacatggatttgaatatacttaacctgacaaagactaactcaaagtggctaatgcctataccagatggtggacctgcccttattccactgttagaaaggaagagaatgggcactactgattacttgtactgatttaagtttaagctaatagcttggcattaccctgacttcagccagggaagaaaatcacatccaagtttgcagactccatgaaacattggccatatatttgttggctcattagcttggacataaagactttctagaaagagatgccatcattaggtgccactcagactctaggggtgcttttggaaaccactgtgatcagaaacgtatatattgttaagggaagagagagagttgttctggacaggtaccgagaggcaggttccaggaagctgaagccaacagaatcaaaccttaacgtacataagccattcctgggctttgtccatgggttgcctttgtggtggttgtctgcctggtttccagggagccttcaattagaattctgagctgagatgatttatcctgtgtgctacattagctccatttgccattaacataaataaggctttagttacatgaggcaggcataaagggtatgtatgccttccattcatgaaaacatcattttttcaaaacaccagtttcttcttataagctaagttacactacccaaatatgtagtaatcagtaatacagaacaataaaaggccttgatacactgatccgggcatacgaggttatcaggaaatcctcaagtcagtgtctctccccatgggaccaatcctgtacctctttttccttcacctccattttgacttgaaatgcagtagacaacagagccagttcagtgccttgccatgctcccagcacttagcactgttcgataaatacatgagggataaacaaattgtaaggaaactcccatcccatgagaggagaaggattctaaagtgcatgaccacacggacacacaggtaacatccatctctttgggaaaaggagtaaaatggactttcctgaaacaactgctaggcagaaggtgggtgaaagccacaagcatagcctgcctcatagtagttccacgaaagtccattttacccctcttcccatagaaatggacactatctatgggtccctgtgtgtggctgtctcctgccatgtcgctggattttctcaggatccctgacaagtagggatttttggtcaatctttcatagacactcttatctcctcaaatggagacaccatcactggcattgaaatgctaaggtgagaactcaccaagacacactgtaggtaaagttccagctcagcttagggtttgatatgtaacgggcccaataaatgatagtgattggtattaggattgctttgttcttgttacagatgaagaagtagaatgtcagtggattacagtgaacagtccaagctacaaaatgtgttgcaactggaatttgcattccatgtgtctggttccttctctatgtacaggaatgaatcaggagagcacactggctctaccttcttccactctgacttctcagctttaatccctggagttccagggtggtatggactgaatgtgtgtgcccccaccacttccccaaaattcattaacaccacaatccagttaagatatttgttagtagggccttcgcagaggtgattagggttagatgaggtcatgaaggtggagccccaggatggatttgtgcccttataaggacatgaaggaccagagctctttctctccaccatgtgaggatacctcaagaaggtgaaccagaagcagggtcctaaccaacaccccgaccatgttagcgccctgatattggacttccagcctccagagccatgagaaataaatgtttctgtttaacccgtttagtttatattctcttatagcagcttgatctaaaacacagatacctcaagatggctacaaattctcctctaagtgcttcagagaggattagaagataaattatatatctattttgttttctatgctaggcctctatgatataatataaatataatcatttgtattataaactagaatataatacaaataaaattgtattataaactaccttaaagaaagtcctccttacactgaaccaatgctaatgttggttaagccaatttcccttagaaaaaggcatgtaggatcttgaaggcattggtgggctgcattccctgcactgtgagcaaggcctgacctagaatgacctgtaacatcacccctgtcatgggtcccaagcgcacagccaaaggtcttcaaaacatatgggtatccttagcaaataagagcattgctaagtgcatgattaataagccagaaaggctatggcacttgacagacggatgaggcatttcagaaagataagtcaaagtgcactgtgaggtgagtgcctcccttaactttcttagctgtgctactcggttcataaaccagggattaagtccattttcatttcaattttttatttcacctttaagcaactcctaaggcttccaggagaattttgtttgacctttagctaaagttcaacttctaccaagttacgaattttggatggtccctaaatgatcacttaagacagatttcactataattcaaagaaaggataatccctggcccaagagttcacaaaggaaggattcccagtggtcccagagatggcaaaagttatggatttcatcctgctaatgcattttagtgatattttcattgtgcaacattaattaccaatgtcagcctggatgcatttgctgggtattgaaaccacgacatttttttatctctacctggtcccagatgaagattagcttagtgcttccttgtgtcctaggccctagagaaaagatgcagcctacgggatggggtaaccttggcaagttgccatttgcttctaaagttatgatagcagtgttgaagccgtcactgagactctggtgctcaagccaagtaggagccctttgctatcatgacatatgctctagatttgcatttgtctaaaatctagcttttaggagacctctcagagatgtctcagggaggaacactcagaaaatgtgaagaggagcaatggacagagacagagacttccaatttatagtgaagaacagacctttgaagttgacttgttacataacctgacttatctaccagatctgtctgattcctaaagaagtatatgaaaatctctcaatttatatttcaaactcctgaccttcaggtgatccacccgcctcggcctcccaaagtgctaggattacagtcatgagctactgcgcctggccatcaattttgtctaatcagagttttttttcccttgaattttggattttgtagttaactactgggttgttgtgtgcctgtaataaagatagagttatttttgtccacaaaagttgaaaacagagctgccagttgacatgaaagtacaactcatttccatccacagcctctacatccattaaataaagagaaactcagtgctcatctcactcatgaatcagaacaggatatctgcacatgccatttctctaacttcccaaatgcagcaggaacacctcagccccgctctctcagtatctcagtggactggaagcacgttcatttaagaggaagggctcatagctttctgcagacagttcaataccatgatgcatccgattcagtttcgtccattctatttcttattgatcagcatacctcaggctattagttttattaattaaatgataattttggggggtgagtacacaaggagataaatgtctcacaaacagactccaagcttgcaggcaggaggcatgcagtgatttacaaagtatttatctttctggcatttttttttcccccaggaaaaagtaatcatcactaccatcttctaaaaacagagatgcttgttttctgggcaggcttggaaactagccaagacagcaggaagattgctggaatttcaacacacttgctgtggtaccatggtgctagtgacctgcccttgcagatataccttgactccccacagaagtcacctcaaagtctctgctatttagcaaatccctaggtgtctggggagtaggggtccagtctggggctgctgcctcttctgattggctgcctggctctgactctgatcccagaatacccagaggaatttgtttccatcctcctggcccacaactcacacaaacctctaatagtacacaggttattaaaagcaaataatagctgggcacagtggctcatgcctgtaatcccagcactttgggaggccaaggcgggaagatcacgaggtcaagagatcgagaccatcctggccaacatggtgaagccccttctctgctaaaaatacaaaaattagctgggggtggtggcgcatgcctgtagtctcagctactcgggaggctgaggcaggagaatcgcttgaactccggaggtgtaggttgcagtgagaccaaatcatgccactgcactccagcctggtgacagagcgagacttgatctcacaaaaaacaaaacgaaacaaaacaagcaaataatagtgtcccaatagaagcacttgccctaccacagccctctctctctgccatcaccaggcactttctgacatttccatctttctgacagggtttctcaacctcagtctctattgaggttttgggtcagataattcttagttgagagaggtggtcctgtgcattgtagggtgtttggcagcatccttggtctccacccacttgatgtggtgagcacacacctccccatccacaaacatctccacacgttgccaaatatcctctgggggagctgatttgccacaacccccacaccccaccagtgaaaaaccaatgtcttgggacaagtggaaagtgatgggggaaactgaaacctccctgacgctttggttcctgtaaggaaccacaggagactacatcattgtcacctctccctggtttgcagacattatttctgagtcatgtgaatgaactagaaaccttaaataggaagtcagaagggaagctggggaggagagtggggaccgagttgaaagatgatattgactatttgtacttttcaattagcacaggtgcaacgcttcaggattcttggccaaaaaatgatataaaaatgattggaccgacctgctctttctagggtaaaggtctgtgagtcatatcactcagaaaacatttttgagcacctatgatatccctcatccagtcaatcaagagatttaacagattcttcttctctccctccctgcagccattcttctaggtcttgccactattttcttcctcctggattctcccaagagcctattctctaccttctaccagccttgtttctcagtatccattctctcactgaaggtgagtggtctttttgaaatgcaaatcagatggtgctagtcagagggtgctagtcagccatctgctagcttccctggctttccattcttttcggataaaatcccaactccttaacaaggcctagaaagccatacattgcctttgttatttcattacttacaactgtgtggtccaactccactggaccagtcttgcctggttcctcccagagtgtgggacactaaccaccactgtgtaggtaggcacagaaggtggctttacgtagaacgcagtcacgaccttaaaaaatgttgaatcacatagtgattctttaggttcaacatcctttttcttccttgtgctctctcctagagaaagtcagttcggtgctcctttgtccttcctgcaccaaggcttattgatcaaccttcttgtgttagaaaagaacaagcctcaggctccaacatagaatctagttggcatttaataatactattttatttttgattgtacttacttttacagttaccttttgtattagtctgttctggcactactataaagaaatacctgagacagggtagtttataaagaaaagaggtttagttggcccatagttctgcaggctgtacaggaagcatgatgctggcatcatggggaggcctcaggaagcttccaatcatggtggaaggcaaagtggaagcagacaggtcacatggcccgagcaacaagagagagagaggggagttgccgcacacttttaaacaaccagatctcatgagaactcactatcacgaggatggcatcaaggggattcatgagaaatctgcccccatgacccaatcacctcccaccaggccctacccttcaacactaggtattacaattcgacatgagatttggtggggacacatatccgaaccatatcacctatttatggcatattataaatgtttccagtataacattccagaagtgattagtgatgcaatcttgcctttttttttttttttgagatagtatctcactctgtctcccaggctggagtgcagtggcacgatcttggctcactgcaacctctgcctccagggtttaagcaattctcctgcctcaacctcccgagtagctgggtttacaggcgtgcatcatcatacccagctaatttttgtattttttggtagacgtggggttttaccatgtcggccaagctggtaattccaagctgaactcctgacctcaagtgatccgcccaccttggcctcccaaagtgctgggattacaggcgtgagccactacacctggcagcatctttcctttttcagtgcatgtattcaggtagaaaaagaaagtttacttgaagaaacataaatagtagtagcagtagtttctagacatggcaaataccaggattaatgcttggtatttgggaaacaaggagttacttaaatttgcagcatgctctcatatgccagacgtccttcagccaggctaagaaggtggagtgggcaggagtaggagacattggattgttccttgtaatctctcatgcaatctttggagtttgatgcagatgtcaccccgccaaaatttgagtcagtgccccacctatgcgctccgctaataccttcaacaccccgcttagaggatctgtcatggcgcctgtgagctctgagatcatgtctgttgtgttcactgttgtttctgcagtgtctgacatgcagcatggcagaataaacaagacaccaggtaaatatatcttggcttgatgggtgaaatgggggtaaggagggaaacttatcatccttttcagccaggtctgggccacaccaaaagtgaaaggcagaatgagatgcctagataatccgtgccaataaagatgctgacccacctcctcctggacaacagagacaaaagagttaataatgtgaattacttggggtgcagcttccatctccctcaccacttaaagtgtcagaatttgacccccactggctaatgcaaaaaacacacagaagctggcaagacatgggcttgcttgtccctcctctttctttctacctggagctttacctttacaaatttgtagcacttgaaggtatgtttccctagccatttctggatcataacaattcctttttcctactgacaaaatctgaaacttagccggaagcactctcttgccagggaaagaactgtgtcagacgtgcgatgcgtgataaaatactacggtaatgtggaataatgctttcaactgttgccagggtgagcatgcatgcagaatgatggaaattgcctgcaaatacaaatggttgctctgtggctcatctgtaacctcaatgtaggaaagcggagatattcttttccctcctttgcaatttgcacagcctcttgttggaaactatggagattatgccattgaaagtaactgccatgtttactcaacacacaatttttactaatacagtctccccatgtagtcatctgtcttgtgaggttccctcaatactccagctgttcctgtggctgctgctgcgaacacctcattgaagaaatcaaggtgccaaacccaaatgctttatgtgagggtgtggaggtcatttttgcattgctgaaaatgacatccactttctaccttagaaacaaaggctgcataactgaatgggattcagtgcacccctacccccttctcagtggtgaattcaatgggaattatcagagggctggtctgtataactagaaaagccaaaattgttgggtgtttactatgtgttaggtattttgccttcttttaggtgaacctcataacatgctatatcataaatattatcctcctcattttggtgttgaaaaactgagagtcagaaaggttaactaacatgctcaatatctcccagataataagtgaccaagccaggatttagtcccaggtctgtatgactctaaatcttgaattatttccatgacaaataatgttaaactaaagccagcatttttctctttgagttgtggttaaactttcattatctgtggcctttaagcattatttgttggttttcacgtacccataactatcaggatacatgaaccaatgggaagtcacgtcctcatgaagagccagtagcctaaatgtgaaatttctcatgcataccagaagcacaaggggcaaaacacacacacacacacacacacacacacacacacacacacacacacacgtcaaaggcttctccctctttatgaaaagtaaaatgccattttctttttctacaaagggaacaagataattcattcacggatctcttgattagctcaattgttctgagatgataatagttaccatggattaggtacttactacatgccaggaatcaagggaagcactttgcaagaaggataacataatatttataacccaatgatgtaggcactactattagtcccattggacaaatgtgaaaactgaggtttagagattatgtatcctgccaaggtcactcggttcagttgggattcaaacctaggcctctctggctctgcctccatgttcttacctgctatgttatcttgttttctacaaacccttcctagctaccatctatgtgctggataaataagggaatctttttaccgtagagtgaaaatgagaagttctgaggaagtgacatagtgttctaggaagtgccctcctttaagaacaaagtaggctggtttctcactgccaatcaaagtgtgacattggcccttctggggctcacctttctagtctgcaaattgatggtagcaaaggacacaatgtgtaaggacccttcctgccctaacgttctgtcattctattaaccacattttcccctctcccatcatttctcctgggctttgattttcactttttcatggccagtagaagtcacacatacccaaggcgaggctgccctcctctagtgaactgcaatcatttgaacatcctgcctcaattgaatcatcctgacagctatccctatggctggccagtcaactcccaagcacttcctggaaatgcagatgctgtatccagggcagaaagtacttcccctgtcatctcactccctctctgggctccagccccaaggccttttaggtcttcagactggctccgtgccacccttgcaccagtgcacatgctgttcctctgcctggaacacattttcttccctgcctcctgtggttaggggccaggcaggtttccctaaacagggctaaaggcaggctacgatcctcattctagattggccctctcctatacagtacttctctgaattggtccctatttattcagttggatcagtgtcttagtcttccactatactcacccttgtgtccctgcacccagcccagggcctggctcacaggaacctctcaaaacctgttggtagaagaatttgcacattaacctgccacccacatctgtgttctcttattgatgaggtacaagaaaggaagatggtaggccaatttacagtggggttatgaggctaggtctcctctcagcccactaatgtctcagaaccacgttctttgctgagttcatatgttttttttttttaccccatctccaaacagcaagtaatcttgcagatcaatgcctgagaccaaagagacttatgaatgttaagaagattatgcacataaatgtaccactatgacagccccgctaagaagaatagtgatatcgcactgcgtgctagtttatcaacctttgctacttaaaaaattcacagccaatttaattaaaaatataacagctctgaaagctgctaaaatgactatgacaacaatctatcattttgtaatagtgctgaagatccattagggactttgcactggatgccaactttttaaagcccagatagtaggggcatttcattctgcacaattaatgtcactgcatttaaaatattgactatctatgaagaagaaaataccaaacatctttataacccacattttttatggtcaaaacttgcttagaaaggtgctttgaatttatttgttataagctgcacatttcacgttcagaaaattaaaatggtttctactgactaactcatttaatcatttagttgatttaatgaaaaacactatgcatttttctcttctccgttgctaagattaatactttctgttcattagcaatcaaatattgcaggaaggtttacatcttattctcacttaactcattgccttttatttttaaaaaattctaatagaattgaaatggtatcttttaaatcaggaattttcctcttggtaactcgttttgtcttgtggaaaacacatggctagcctgtgacattgaggcatttatgtctgaattgtttttctagtctttttaggggatgcattatagggaggaaagggagtggacactttagaaaaattatgaatctagttttcagggcccctaactcattaatacatcagtgacattctagcatcctttgaaattctgttaagaagggccctttgatttattagtgggattttatgagctacctgggaaagtgaacccattaaaaatgttaactgtaagcatctggcttccattgaataaagaatcgaagccaccacataaaagtgactctgcacaaacatggcactcctctcccatcactcccaaagcttcccattgtaaatgccacttcatcacagcagtgccatttgcagttgtagtctcatctctgttatccactgctattttcaggagtgtataaatgagcagcgaaattcctctcccctggaaatgcctgtaagagcagattctaaaatgggaactttttgtgacaagattgggtacaaaatagtataattactgtaaattgttcaataatagggccagtagtttaaaagcagcatttccagatttcctttgcttccataccaaaaagcattttcttgaaccccaattgcttcataggaggaaataataaaaggcaggtgatagcattttgtacttagcatagatacaatggtttaaggacacggtgcactgagtcaagaccactaagaggtagagggcaaattaaccatttggacagtaggaaaaggaggcattttaaggtggcatgcaatgagccagccagctaattatagtaagagcagcttccctaacttttactttctatttcaaggtgttcattgcttctctctctctctctttctctctctctctctctctctctgtgtgtgtgtgtgtataaatcatctgtcttcatcattgcattattgatattgattgattgtaggaggagaaaacaagaatttttccattttatagttaggaaaactgaaacacaggcatcagtgtgctgtaaccctactataatgctcttctctttttacgcacttaggaaaaggataatttttttttaacatttgtgcaattatttaatatgtgtctccccaacactgtaatatctatgagagccaaatcactacctgtcttgttcatcatcacagtcccagcactaacatagtccctgctatatggttggtaggtgctaagtaaacttttttttaatgaatgaatgaatattattttctgaggtcattcctattggagcattagtaaagcaggacaaaactccaggtcacattcctgtactattgttgaacttctattcacccttcaggactctggtgaaatgtcagcatctttgggaagcctttctgagttctccctgactttgcctgggctccattaatgcttcgtacttaggcctgttgtgtgttgtttcttttgcttccttctcttcacggaactactctttcatgtgggtaattatcctgttcctcaggctttggatggggttgactccatttctaactggccttgggatgggttcataatccagatctggcctctcagggaaccctatccttctggccatggttattggctcagcaatgatcctgtagcttaacttgggccagcatggtctgtgcaaagtttttataggcattactgaagcagcgggggtggggtgggggaaacccacaatctttctaccataagctagtaggatgtgagcctccggctgctggtgttcgcattaccttccctgaggagaggttgcctgagagaagcagagagacacaaagcccctaatgacattgcttgtgcccctggatccagccgcgcctgaatcaacaatactattagacttttcagttacatgagctaataaactcgttctcattctcttaaggctcttaaggcaggttgagttgggtttctataacttgcaaagggtctctaatttctctatgttgcagtctattgagcatgtactccatgaaatgtgggtgattcatttctgtattcccaatgctgagtataggccttgtccttagtaaaggcttgttgaattaaaaaaacggtgcaattctagggcaaggacatttccacaaggccaggtattttggggatgaccctgtcaataagggctatgtatcttttggatcaaactctcatagaagaaggaagacctcataaagacacccagaaagtaggggcgccaaggtcaaccagaagagagaaaatggccttcagccagtcaaggagtagcttacggcagctaagaataagacagtgggagctgtgcagccccagaatggatttcccatgcctggttttaatcatggctatggtagtctatgtcttggttttaatcatggctatggtagtctatgtcttggttttaatcatggctatggtagtctatgtcttggttttaatcatggctatggtattctgtgtcaaatggaatgactaatcctaggtgctttggaaatgttaaattgttcataagtcccttagagctttgtttctcctttgaaccccatggagggttttgggcctcagaacaggtatattaaaccgtctccatttcaactggtaattgagggcctctcaaagtctacctagaagagaatgtcttctactatagaaagaaacagatgatgcaaaattttgattttttaacctaaagtttggtcctgtctggcaaaacaattgaagaaacatgactttccaatctatttggaaggtgagggttccaagtacaccctcactgtgatctgaaaattgtgaaaatctgtactaatgagaagcttaggaatcacctagacctgggtttaaatcctagatttgccacatttctggggtggtggggtggactgacaggccctgaacagacaacgtctatgagccctagtgttttcatgtgtaaaacaggactatactgcctcacaaagatttgatgacaattaaaggaaattacagatgttaaatgcttaacaagaatctagtacatagtaagagctcaatgtatattaactgtcattgtggtgacaacaatcatgataatttcaagcttttatatccaattttgtgttggatgcttcattaggtaggaatgaacatctcaaacatatttgtccatctatcattatttctatatatgttgttcacccaaccatcatatcaaattcctgttcctttagtttggaggtccttattttttgggggggggggtcatgaacctccttgaaaatctgatgaagtatgggtgatgtgctcctctctgaagctccaatagcacctcacaggttccaccttaccccactgtacctccatccgcctgcactgtgactgcttgtttattcctttttccaggctctgggaggtcagggagtgtatctgcccagatcatcattttctttaccttgcttagctctgtgcctggcagagaataggtgtttgatattcactgaatgcataaatgaaaattgcaaagccttccccctgaccccttaaaaattcacctacactcaagtttttgcatctaatttcagaccctgtctgaggactccaggtaagaagctactattaatgactacctattgtaggtcattaaaaatgcagtagggaaattttcaggccaaataatgaagcagcctgtttttcaggccaactaatgaaacagccttaccacaggccagaaagaaagtgtagatcgtcttctcaagagaggaaggacaaagtcagaattgacactgtgttcgtgatgaaggcaacctttgtccaggtcccttgttttaccaaagacgacaagaggagccagccttgcccaaggtcacatggccactggtaaagagacttgagcctcctggcttccagaccagtgctcatcaaactcaaaccttccccctcttcccctctcgcactgcctccccagaagctcagtccttgcgagaattcaatgaaaatttccttccaagcatggtccgaagacaatgtaaggaaatgcaggatttacatgactttggtcaagtgaggggacaggactttaaaccaaagagttgatttaaatcttttaaaacctacagagtgaagggcttgcctcattgcctcatttgaaagatgaaatcattctgtctttatttttcattgatgggagtttggctttggagggaaaaagatctggcacttgagagctggcccagtgaggataggggttgtcattttctcctcactgaggcttagcaatgcctttagctaaggcccggcccatgtatccccaaaagtgacaaaggtacagtatttcacacaggaacacttggggagcatttttccatgggacacggcgtgagaatccattaatctcactgccacatactcaggctatttctcacaagcttagccagacatttgggtttttttaaaccatgaaaaaaagagccttatcctcctcatcataccagattgctccagcggataaacatcagacatggtttttagagaaatatcacacgatctgagaacatctgcaattctctagaacgtaccgttgtcagaacttgacttaaacgaaacaacagacatcagactttctttcagacgttttgcactgaagctttccattatagcacgaatgcctccttctgaaatggcaccaattgaaaacgcaccaggacacgaacattaccacaactcaaattcagatactcgcatgttattaacaatggtgctaattcctgtttcagagatgaaacttacagaggagataccagtgggttttcctccattgctacttttcatttgctatggaggccacaaattcaagagatcactcattcttaaattaacaaaagtagccaccacctggcaaaacatcaggccctgtgcaggcgctttatatgcacctttatatgtatcgcctcttttaagcccctcagtggtcctcggagacagctgctgttatcttccatgtcatacatcagggcactgaggcccagagcccaagtgatattgtaacagcacttcctgtgtgctaagcactctccatgcattttatttatagtatctcattaaatctcaccaaatcctttgaggtcagagccatcataagctccaatctacagctgaagaaactgagacagctctcaaagctaggcctagtttcctccaaagttcagtcacatttgttccatttgacagtatgagggaaggcctttttttggttaagcgtatagactctgcagttaaacctcctggaccctacccttgttagcagtatgatcttagataagcacgagttaactttaccatggctcagtttcctcacctgtaaagtggcataataatggaacttacttacttacctcaaaggatgaagagaatgcaatgcaaagcatgtagcatggggtctagcatacagtaagttctcaggcagtcattagcagtattaaaaataatactggccagtggctcatgcctgtaatcccagcaccgtgggaggctgaggcatgcggattacttgaggtcaggagttcgagaccagcctggccaacatggtgaaaccccgtctctattaaaaatataaaaattagctggccattggtgggtgcctgtagtcccagctactagggaggctgaggcaggagaactgcttgaaccctggaggcagaggctgcagtgagccgagattgtgccattgcactccagcctgggtgacagagcaagaccctgtctcgaaaaaaaaaaaataccataacattttttcttcttatttttatataaaataaggctgtattcataaaggatacagggattaaagcaaaccaaaagagaagagtgagggtaagtttaattgtgtgataaggatttaggtaagacagcctaggcaacatggcaaaacctcatctctaccaaaaaatacaaaaatgagctgggcacggtggtgggtgcctatagtcccagctactcaggagactgaggtgagaggatcatcacttgagcccaggagtttgaggctgcggtgagctatgattgcaccactgtactccagcctgggcaacagagcaaaacccggtctcaaaaaacaaaaaatacaattaataaataaaaagtaaaaaattcaggattaaggtaagaggtgccccgctgtgcagcacagagctccatcggattggaaaaagtggctgccaggggatgcctccccttattagttcagacaggcttatgtaccggtctccttgcgggaagtcctgtgctgctcagcgttgatggaacacacaatgaacttttccttgcttttgtctctaccagaactcgactgagtgcgccctgctgtgtggttttatccctggtcttgggataggtttccatggctataggaaagaggtggagacagggaatgccaccttctgagttcatcagaatagaagtgtgcacctgcagcaagacatgattctccctaatttgctttcaagacaaaactgtgtctactgattgggtagatattgttgaggcaagatgcggtatgtctagcctgtgtccaacacatatggcgttaggtcattcctttcatctcctctaatggtgcccagtacaatgagaatgaaatgcaaatcccttaccctggctctgggccacccagacccatttgcgggtctctagcaacacccccagaccctctatctctcccttggtcacaagggcttcctttcctctttaaggtccttacaccagctcctcctttgcctgtgacactctgtttccaggtttttcatgtacgttcttcttctgttgggtctctcctcgaatgtcagtcttcaaagaggccttccttgtgactccataaaccactgcagctctctgattcacttccttactctgtcttgtttttctgtctgctaaaatagaactgataatcctcgtcctccttctctcacagcatttctttgatgagcaaatgagattcatgtgtatgtgtctatgaagatgcttttataactgtgagtaatcaccagggatgcaaaggagggttcaatttctatgtcagttcacactgggtgggtttttctgggtttttctgaagcacagccctgagatgaattccaagactgcagtattctcagtgacaaagggtgcagcaatcccttaatgatgtctgacttgggagagggaattagaggcgtgggtgtcacatatttgctatctgtgccaaaaataaagtcatatattaatagaagcccaaaatcaataatttacaaatagcttcctcaaactttcaatggtacttctggaaaagtgagatttgaaattttactctccttcctttgcactctaaaaatttattcccctgatattacttttatattaaaaactaattagaaaacttcataggtttcatcatatatttaacatcattgctaaagttctaacactatttttggaaatcatcaaaagagaaaagtgtaagacagacaaggaaaacagagaagttttccatgtttaatattataagtcaccacaaagtattattttgatattacaatttttttttttttttgagacagagtcttgctctgtagcccaagctggagtgcagtggcacaatctctactcactgtaacctccgcctcctgggttcaagcaattctcatgcctcagcttcccaaatagctcagattacgagtgcccaccaccatgcctggctaatttttgtatttttagtagagatggggttttactatgttggccaggctggtctcaaactcctgacttcatgtgatccgaccaccttggcctcccaaaatgttgggattacaggtttgagccactgtgcctggtcttaacaaattttaaaaatagtgataggcaaatacatctaatgaaactagagtattatttgtcatttctttggatgaaccaatgcatgtaaggaggatgtagttctgggtttctcctgtttcatcacacagtaacccaccgtggctctctcctccatgccgatattatataattgtcaaggcattgagacagattttaattcatttaataattaggtcaataaaaaccattattgctgacagtgccattaaaagtccataatgtcaccttcatgggggaaaaactaatatagttccgttggattttttccgtgaaattaatatgatagcatttcagtgggtgtcttaaatagcttaaatagacatttttattaacagaactaatcatagaattaaaacaaatgaaaatcgttacatttgctgtgatgaggtatccatgttcacaggattttatcagcctcattcctgtgaagaacctgaacatttactaccacaagaacagtatattcaacttgcctggagcactgcttagggtcccaaagaggctgcccatttgtgttttggtgatttcctcttcaacaccatggctccatttctcagagccaccctactgggaaacatgccagaaccataacctcctaaaccaaaaaccttcttcatgtcccctttttggctggtagtatttcatctagaatatctaagacagtatttcagctcagaaaaatactaaagcagaaggggttgcacctacgccgcccagcaatgttttatcacctctccttcctcagcttaatcactaacggtagatagatcttaacatgaactaaggtaaactctagtatagtgctatacgatttaggtaaattctcactagaagagcaagatagcaggaggaaagaagattataccaagagtttcctctcagacacatgaatgctatggttctgtgagttattcaaatgtgcaagtcactgtgtatggctgcatcattgctgcttgggtacctacaactcttcataatcagatataccaggattcacaagaattcaggggtggtcaatattgatcaaaggccaaggccacagatgtagctagcacattatacactgacagaacgcttgctaatgtacacaaagaagtagcggctggagcctgtgaggctgtgcaaacagtataggctttgggtttgggaagacccgcattagatcttagtaacttggttcccaacaggatgaccatgggcaggttagctcccttcagttttcagtttcagcatctggaaaatggattgatgaagtccacagttgtttgactctgtggtttttaggatggttcgaaagagatttcagatgaaacatatctaacaaacactgtggctggcagagagtaagggctattcttcagaggaaagagtcatctcagttggcattggacgtatttaaaatatgattgggagggtagcctctgctaacctccagccacgttggtgaactctcagaaagccttgtgcatgcccagacatgctgaatctaaacaaaccaaagggaagctgcacttctccactgattactccctttcctgccctttggaagattctagaaacactaggaaatctacttaaatattttttaactcagttttaaacaacatctctcagaaaataccattcttagtagaataaaccttctttgaaggcgtacatagacttacatatgtgatatttgcaaccaatcagcattttgggtgactgggcaggtcttgggaagtgggaggcacagtaaaaatgaaagactttgtttgacctccctgagttctaagcaagatgtggtgcctgagaaagcttatgcaggtcctactgggcaagactataaagccaagcgcaacagagaaaaaaataccttagggcacggacgtttggtttctcaaggcctgtgatggggaaggccctgaaactcccctaacagggatggaagaaatctgtggatattttgttcatgagaagtagaggaaaaggggaggggagaaagtggaaacagcaacgtgtctggaaaccagctggcacctgtgccttgaagtaaataaattgggtaaagaaatatgatagctagatagtcctagaaatgaacatcctgaaatcatcccataaactttattttggagggggatagggaagagaagagaccctttcttccatttatttcatttagttggtgatattattgggcattaacttgggattcactattcctgtggcaagtacttacctttgctgaaattaccaaatattctctgaaacagactcttatcagaaaattgatctataatacataacggtgtcttgcaagaaaaaagtcccttgtgggggcgattttttaaaatggttcactgcaggcctttcacaatcacatggaaatttggagattgctcagatattgtgggaagaggagaaagggaacaaagagagacataatacttgagactttacaggctcctaccattttctagtctattcgacaagagcagcagaggttcatatcaaggaagtgaaaaccattcaggaatacaaaaattgtttacaaaaaacagcctgtgctttgcattcttttctgttacttcgacaattgccaagaagtgtaactgtgcttgctcggtattatttaaattaaattatcaaatgcaaatgctaaatatgaacctctcagcaaagcactgggttataatgccatgtcctctattcagactaaaagctgattactggttctggagttacaaacatgtcagacaataatttaattgctttgcaggtagaggaatatgcagcgttcttgttctcattctggaactcaacacgactctttaatacaacataatgatcataaacacacacaaagtcttcgcctcacacctgctttatggtaaaaagaagctattgcaaatttctgcaaagctcaaagaatgaggcagtgccagattttttaatcactaagcaaaacaggtttctcaccaagtggcccgggcttttactcctggttcagagagttacaagacacattttcaaaatgagtttaaagctataatgaatttcaggtgcaaaggaccaccgtctaacagctaatttgcttcctgtcttcaactgagctgttaaccataggcagccagcatgtgcacccctttcttgggccactggtgaagacagatgtcacaatcaatactcattaactctgggatcagtgtgtatcttcctcaggaagagaaagggggtcttaaatgtaactaggaggactttgtaagcattttctgagcattgcagtggctgagtgttaaaccacaacaggacaggagtgcaggagggggagagaagaaaggggagggtgagagagggaagggaagaagaaaagaggccacatttcgtgatctcctctgtctctggagctcttttttatcagctcgtgaaattcccaaggatcctgatcatctcccccttcccagctcatcgcaaagagttgttgtacatttctttgcaattgggtagggaaagatcttgaaaggtggatccaacttgaacattagacttttgtgaaacatgatacagaaattgtagtgttgcagagctgtacctgctcatttgctgactatgatgacccaacatttattgagcactgtatgccaggcctgtgctacctcaatgcttcacctggagtaccttatttaatccttatggcaatcccataaccctataggaagcagtcatccttttatatatgatgcacataaaactgtctgaaatgatttgcacctaatgtaatgatggtaggcttaaatgctttcatttttgtactttgctgtgttttaacaagtttttgtgatggatttgttcttgtttttgcaaaatcaagaataacttaaaaataaaagactggatgccaatacaaatctcccaagatgttaaccttggttaattctgggtgatgagaacgtagatgattgttatttccttctttgtacatttctgaatgtttagtttccctatataagtgaaaatatagactttaaaaaagaaaaacaaaagaagaagcccttcactagtgccacagtgtgaggagaatgaagcctaagcctaaattttattaaacagcagggtgacccaatgctctgtatcaatgctagatacaccaccaagcattcgctacgcataatcccaccagctccttccaacaactctgggaggtaggtgtcaccaccctcactgtacagacaagcagagtgaggtttcgagtgggtaaaggaccagcacttgaggtcactcgggtatctggcctccacttacccttctggcctgaggctccatggcatgccctctgacctttgctcataccctggtctccagccgcctgagtccttgtctttttctgaccacaacctcaaagtccctaggtccatacctaatgttcacactctctcatttacttggaaagccattttccagactacacccattcttccaaacgtgtatcaaatactcccccttccacaaagattctctgagtcacctcagccttagtgtattcaccttggtgtagtatatgccacaggctgccacatggcaggtgccaggccagctcaggcacactgaatgctctgtatggcttatgcagtgtttaaaagatttaaaaaataattagacttgtattaaaaaaaaaaaatgtgtacctagtggctcaggttcccctaccctgcttggcaataattaactgtagccaaagcgtctgccctattcagacagaagcctgtgtgtgctctagttcccaacagtttccttttaatactccttcttatccttggcccatttctcttaattcattgttgtcaggcctctgagcccaagctaatccatcatatcccctgtgacctgcacgtatacatccagatggcctgaagtaactgaagaatcacaaaagaagtgaaaatggcctgttcctgccttaactgatgacattaccttgtgaaattccttctcctgactcagaagctcccccactgagcaccttgtgacccccgcccctgcccaccagagaacaaccccctttgactgtgattttccattacccacccaaatcctgtaaaacggccccaccccatctgccttccttgactctctttttggactcagcccgcctgcacccaggtgattaaaaagctttattgctcacataaagcctattggtttggtggtctcttcacatggacacgcgtgacaattgttttatgtgcccagcacatcacaggtgttcattgagggccagaaactagtcacttcactactgctataatcctagggagagagaatggtggtctgaattacaagcagtgagaatagagaaaagatattccaaagaatctgtcctctgaaattaggggctttatttatttattggaacactttctatcttgaactgtagtgatacgggtatacatcttacctattctacttgactgactgcatccccctgaagacacgtgtcaggtgccatgcctgccctgtgatatccccagcgctgcctagctgaatggtgcatacataccaggcacgggatgaatgttggttgactgatcattcattttaatcctgaaacctggcgtttatgtttccgctacatttaaaagctggcaaaacacatctccttccctcccactcactcaattaaaagctcagtacattaattatctgaattaaagtcaagagtctgagatatccctcccaatttataaagacagggacgaggtaaatttttttcccaagttgtagggacagaaagaagactaaagaatgaggaccttacaggcgagcacggggccagcgaaggattctgttttaagatcatctcctggtgctcattagtgctgttgctcttcacctgggtgagcgggcttgcttccatggagaagagacctccgccagctcctgctgcattaacggtctccgaatgtgatttggcggcagcacgggtctcattagagtgggggatgtgcaaaggcagaaggcctcactttgagaaaacactttgcgtatgaacaaaggtggaaagatgtcaggcttttaaagggaacctgcatctcgctcctcacttagcaaagtcatcaggagattctgctaagtaaagaagttctggaccttttcaagctattaaaggtgacccaacaaagcaaaatggctttgttccccaaatttctttttgtcagttgccttgaacaaccaagcctgaacgaaacagcctaagggagattgccaggtaataataaatccctatttgcttcagtaaaggacatctcaaagaagggataaaataaaaaatatcagaattaaagaggcacaaaaaaccctgaacatccggggcatgtagatgctcggtagcaatgaatgtattaggttggtgcaaaagtaatagcgattttcgccattactttcaatggcaaaaactgcaattacttctgcgccaacataatacttggggcctggttctcaggggtagggcttccagcattttaagtagcagtctgccatcaggcaagatgtgcatattcatcattgatgtggcttgatcatgacatattctgttttcttgagcaaggaaagaactcagcaacatctcgcagagcgaccatcaggttatgtccttgtctctggttcatttgaggagagtaggaaattatgaaacccacaagaagagtttatggctcctcctcacactcctacacttaaatccaggaagagactgccaggcgtcggtcaagtttgaagatatttaatggactatgcattatctacactgccccatttcaaggtcaatagctgtctgtctctttatcccataaggctaggttttcccttgaagaagaaggtactgctgttactggtagagggtgcctatgttcttggcatcttgaagaactggacaaaatgcgcaaacaaagcaaggaaagaatgaagcaacaaaagcagagatttattgaaaatgaaagtacactccacagggtgggagtgggcccgagcataggggctcaagggccccgttacagaatttttgggggtctaaatagcctctagaggtttccattggttactgggtgtatgccctatgtaaatgaagaggatgaagtaaagttatgaagtcatttacttggcgtatgccctatggagaggatagcccctgtcatagctcaagtgtgaatcagccttatgttccctgcctgcagaccctattttcctgtctcactgccacttgggtctcctgagaaggccctttgctgactctgccttctgggaactggcaagtcaggtgatctctggagctgccccacggtagaaagtgcagagcgaacagccgaggactgtcatgcactaagcatttggggaaaccaccctttctcccaggttggtgggctctctcgagacaggtacctgtacttacttggtattggagtgctctaatcttagagtctagtgtaggcttcaggggagagggagctaaggcggccattctgtttgctttgtttccaggccttgggtttgtctctagagggagaaagagtcctcctctgtctagcttgaagcagtgggaggctgtatggggcacggaataagaaactcaaagtgtccctttccggcgtgtcctgctctgtgggcacttactccttcagagcttgtgaagacagagataaaggtcagtcaagcccaggaccaggtgttgggattgttcttatccccaagttttctaatttcactaggaatattaaaggcaatttaatgcaatctgcattttaaagataaaagtgatggagttcaggacatgcttccccaaaatatggcaccttggcatagtgaatattttcagctaaaggaatgtgagaaggtaacagaagtaggaaggtctttctgactgttcgctccctgtttgtccttgcggcaggttagaagaccctcattggagaggtgccctgaagaaaggaatgttcttatctctgaagacaaagggtcacagagaagaatctgaacaaaactctgtgctaagtgtccccagtttattgccattagactacatcctttttgacctagaagctccaccttcaaagtttttaggtagccatgaccagtctaactgtagaaatggaatggaacattggaaagactgtaaacttggagctctaagaactaggttcagtttcctccacttatcagctttgtggccagagtcaaattttgcctctctgtgcctcagttaccttactacaaaattaggactattctgaggcttcaatgagggttaaccatgtactgagcatgatgctgggtatgctactctgtagacactacttctctcccctctcctctttggtgacttttaaagatcatggggaagctgggcgcggtggctcatgcctgtaatcacagcactttgagaggccgaggcgggcagatcacgaggtcaggagatcgagaccgtcctggctaacacggtgaaaccccgtctctgctaaaaatacaaaaatttagccgggtgtggtggcgggcgcctgtagtcccagctactccggaggctgaggcaggagaatggcgtgaacccaggaggcggagcttgcagtgagccgagatcacaccgctgcactccagcctgggagacagcgagaatctgtctcaaaaaaaaaaaaaagatcatggggaataatctacatgaaaatggatgttgtaaagcctaggacattacatgtgttatgtggcaagaggggtaaatggtagagttaatttttaggcctctcttaagcctcacaatggttctaattttgtaataaggtaactgaggcacagggagacaaacacttgactatggccacaaagctgataaatggaagaaactgaacctagttcttagagctctaaatttatactctttccaatgcttcgttccacttctacagttagactggtcatggctacctcaaaaccttgaatgtggagcttctagatccccagcggcaattcccatcaaggagaattttgcctgcttgactctctcctaccatccacagtcattgttactgcaagtgagttaaagcagttgagcaaatcatatatatatatatgggtacagggtttatatatatatatacatatatatgtatacatatatatgtgtatatatatgtatatacatatgtatatatgtgtatatacatatgtatatacatatatatgtgtatctccccagtgtatggggttagaatgcagctgtggaacatgggggtgtcctcttagtgactcaaaccaaattatcactggagaaacaatgagaacaacaaaatcaaatgcaaaccaccaaaatacaagtgtagtcctcatatcaagaaaaagataagggaaagatcttcagaaagcccctctattaattatttagtctcagctcagacagttccagaaacagaacagtgataaacaggaccattgccatacttctggagatgaggaaaacaccagaatagaaatcttcagtgggctagtatgggactctggctgtgatccctctcttatccaaaattctgctaagggacttgcctgagaacacacacagatttctctatgagagcaaaataagagatatatacataggttagataatgcaatgaagatcaaaaattacattttggaatgttgtattccatcttatggggcagcatttaatcaggatcctagtgcaatcttccatctggagccccaaatccaatgtcacacattgcgggttggggtgcggaagatctagcttaaccctagtgaggaagatgtcctgcctggttaacttccagctcagtgggtattagtagcatagcagggatgccaaacaggaacacactatggggtgtcatcagcaagaataaggtccagagctatgtggtgggttagaagtctgaaagtcagaaaaggctttggaagccctcttgtcttccattttacaggtgaagaaactgaggctgaatgatttgtttaccattcaggttacacagagagttaaagtcaggacccagaccttccaagtcccaggccaaagcaggtgattattctgtagcatgtgctgtccatattcctcggcagcagtatatcccagcagcagcataatttcagaaaaggaatgagaaaaggggatatatccattggagggtacccaggatcaggggtttcaaagatgcacaattctgggacacagggtgagtagtcatgagaagtggagatatggggtgggggtgcgtgatggtttccgcaaacacaggagaaagaaacattaacaacgtgggccgtggaaaaggaattaaacttgtttggtttcatggagcaggtagataactagtgggtggatcggaagaaagcaatttatatgtctgtggtgaaacatacacacataacgtaaaatccaccatttagccattttaaagtatatcgttcagtggcatttagtgcattcaacagtgttgtgcaaacatcaccgctacctagtttcagaacattttcattatcccgaagggaaaccctgcacccattaagtggtaactcccctttcccctacccccccagtccctggcaaccacttatctgctttctgtctctatcaatttgcctattatggatatttcatagaaatggaatcatacaatatgtggcctttagtgtctggggaagcagatgcttttttaacataatgaaaattgcaggatgaagagtgtggtttgaaagggggcttggtaatgacttaggatgcttgaattcaggccaaggctagaagtccacatggtagggatattgcggaggggcctctgaacaagaagtgggcttgaaaggctggctcttcagggcttttctgacctggagatggaggccctctctgacaagcccctgggactatctccctttttccccacaaccccacctctgccagtgatgaccagtctctaccctacggtaaaactcaggtccaaccacgtccactccttttgctaatttcccctcttttcattctcctcccacctccgggtctgttgacacttgcttgccaatttgcctgacacactgcagacaatcttctcactcaagcatgtttgacctgaacatacagctttctgctgagctgatctggagtttcagttggccgtttgggcagccagacatgaattaagaacagggataaacaaggatggcttgagctttaactacaccgatttggcccaataggctcggggataatctataagacctaacagctgagggcaataaaattagctacaaagggactgcggggtagaaacaatgtcttctgatacttcacacaacacacactcacacacaaaagacaccaaaaactctccgacagaagccttacaacagcttagaggagaggcattgtgcttgaaaaactatattttaaaaagcagagaggaaacccacggtgactgaagtatcattttcccggtggtgatcatggatttcatcccaagacctggaaatcatgttagaactacagtatcagcccagctttgtgtctagggcttaaacttgaaatgttgtttacataaatagttaaggaacacatactgggttgaagagtgtgctctccaaaaatgcatgtccacctagagcctcagaatgtgaccttatttggaaagaggtcttgggagatgttattagtcaagatgaggtcatactggattagaatgggccctaaattccgtgactggtgtccttataaggacatcaacggagggcagaaggccatgtgaagacaaagcggacactagagtgaatctgctgtaagccaaagaaggccaaagattgcggaaaggaaggattcttccccagaactttcagagagagcatgattctgctgacactttagttttggacatccagcatcttgaactgggagggaatgcattttggttgttttatgccactcatgttgtgccaatttgttacagcagtcctaggaagctaacataatacactcccaattccctcttcttttatacaattgtacaaccctatttgaaacatggaaaaggctcttagttctcacaaaaaaatctcattatatttggagttcaacttctgaacacgggtttagaaacaaatagggtctgatttcactgattttcaaagggctttctttgtaatgactggggtttgttttatttgtttgcttgtttccaggagaagagaagattggcctcagacacttccgtcttcagacctgtgcctctcctttgaggatcccttccccgaagctgccaaggagaaccttccctcacattgttcctcctttgttccccgctctccttttccaggctgagagacctggggccttggaagcaagcacacgctggctgagctgtgattcctccatgttgattataatttttatcacattatatgggatccctctggtggttactaggggatacgtcagttttgagagattggaacctaaccaaagaagcttcaaatctagaggataaggggactcagagtttacaagtcacagcaagcagatgctggtctgctttaggtgcctcttacggggattgtgagagggctcctggggcctgaggagggtcttctgaggtgtgaaaggctgtactggtggtccctgaaagccatcgtcatttgtgtgaggaggagtactggaggagctgtcttaccacatgaaaaacagcatggagcatcccagccacatcaaaggcacggtttgagccttgggctgtagaggctcagagagagtgacaaataagaccctggtgagagaccaatggggacagtatttccagactttggcatgaaacagatttctgagcacctcatgaaatgtctgcaagggcagctcctcagagtgaccctcccaaatcaatcaaagctggccccctatcttaattatgacttacaaatagaagcatgcacctggctggatgcagtttgccacatggtttacaatagcggtagaataagaaataacttaccaaacgagtacattttcttggctggctggggcactcagagttgacactggtaaggctccattaaaatgcctttatgttctgatatacacagatgtgttaatttatagcatattcatcagaagacataaattaattgctctctgatgaattttataacacctcctttatgcctctccaccctccccctccaaagtacactgaaaaggtcaacagcactatcgaatgcagcacacttcaacttccttccaagcttataattaaagctaattagtagctttggtaattagcgcatgtaagctttctgctttctgaattaataagactgagtcaggttttgagccaagtagacttttcactcactggttctgattcttgaactgtgtttggctggttaatttaaaacatgtctgttgaaagtggaatactagaaagaaaacatacttgtgatggtctgctctcaagccagtgtgatttatgaacaggccaaagtggaactgttgtcacaagagaaaatcagaatgctctgggtttccaataactgaccagtctcaacctctcagtgtgaaatgagttgtgcccagttactatgtcacatggacacaacacaacgtcaaggatgcccttgcacacttatgtcaccctctcataacacatctgtactaagcacatcaaatcctctttattttaggagaatgcagaggcaatggcagtggggtgccaagatataactaactgctcattttgattcaaataaaaatcaaagaggagaaaaatcattagtcaaatcagcttctgcttttgtgtagacaaagtgattctccaaatagcttcgtgtttctttttttagccagcatgtgggcatcctgcatgcccagacagaattaaaagtgcatgttttaaaatcaagaaatcaaatctatattctattaaaagaaaaaatgtgatttgttttcagactttagaaacagttgggataaaaatttccacgggtgagctcatttgctttttcttttcccatactaatctcagaaaatttatttttgttttttaaagaaagaaaggaaggaagaaaaagaaaatcacttagtgatttactggactccttataagtccaggacaatggtgggggttgctcacagcgctagtaattttgatacataaagaaaaggaaacagtcactgctgcagagagaggaatatataagacagctctgggtcactagagtaaatggttttcattttaatggcgcacttactgccactgtgatagccacatttggatctgtaaggggcagttaatactattcaagagcaaggcacatttggtcttgtggatggctgtgattgtgaaggtgacaaggggttatggattcccacagcctcacaggcccagctgaataggaagccttgtgcccccttggcagctcatcctaccccgtggcagctcatcctacctaggtggatacactccagtaagatctatacacagtggttctcaactgggggagattctgcccccaggggatacttggcaatgtttggcacagttttgattgtcataactggtgggagagggtagatgctactggcatctagtgagcagagactaggaatgttgccaaacgatcagccatgcacacgacagtcactcctcaacaaagatgatctggccccacaggatactagtgccaatgtcatggaaccctgatacagaaggtctaaacagggtctgaggccctccttgtctttgaggaagagttaaatgttagctttccagattgactctggactgatcttggccttatacaagtcagaaagaagtgagtgatagctcacccacaggggctagatctgagtcagactggaagaagtcggcacactcagggtaacggcagctgcctaaaagccaagcgctgggcatttttatgttgcagctaaggccagcatgctgcattatggatgagctcatgtgccatggcaaacagtttaagaacgatgcttatatttaatgaatcctaaatggtttattacagagggtcaagtttctgcttcctgtgggaatttgacatttatgaaaatgcacgcacattaattattcagtggagacgtccttcctatggaaattcactttcctgtacactcgacaggactacattccctgtctgcatgggctactttgttgttaatcctctaagcattaattaaataaaatttgcaaccgagccaggatgcatctaccctcaaatgttatgcaaaagacagttaaatgctgtttgatttttcctgctagtagccaatcattacccatagctatttatgttcttccttttgttctttaaagcataaacctggtatctcttcccactgagaagaaaactacgctcagtaattaaattacaccacattaaacttacttaagttcaccagcagggaaaattccgtgcccctgggtttaacagtaagtcctaatcacgcttgcaagccatatcttttctgtgagttgttatagttttcattcctggaattccattaaaaatggtaatgtcattactcctgttactgctcaaaaccaacagcataatcctgaattttaattagtaattacaattaatcattatttcattaatgaaatgtttagttggtaattgtctttgagcaccttactccctaggcttataagcatttcataacatctaatttgttgcctgtttctgatgaagtggcactgtcaaccttattttatgttaacactttgatggggctctgcatcccaggcctgcaccaccggctgcatatttacaccttggaaatgtgtggcttctggctctcgataaggttcgcctgaggacgtaccctcgcattctttcctgccagcttaagaaggcgactgtttgtgctcccagagagcacagcatgtgaagagagaaataataattcctggaacgcttacttaataataaatctgggatccaaattcatggatttttgagaggggatagagcaaggatttggaggtagtctttggaacaggaaggttgattttaaaagagcttaaagaattaagaataagctgggagggttgtcaagaatttaacacgaggcaagatttttgttgatccttttgcaatagcaaagatattcttatttattaggatggttttttaggggtgaggggaagcttgtcttccccaccaaaaggtcagggacccaagtatgccttgcacacagttgtattcctagctcctggtgcggggttgggcatacacgtgactcaataaacagctagataagtcattgttcctgcatggcctatggttaggctatgaagggggtaactgaggtacaagagttaatggtggtttggtgatggtagcagggtgtgggatgctaggagatgccaaatcagtgggctggtgtgctcacaaatgacctgatgtcatagttgtctgtcactgacaattctaaaaggacggattcatccgactgccctctatgtaaaaaaatttacacatacacacacacacacacacacacacacacacccgacggtgaattattcagggaggagaaagcctgctatccttggcaaattaaacaaggaggatttgagcaaagaaaagatgtgctgctgttatttcaaggaagtattcacagcttcagaattaaaactgagatggaacaacatcagacttgttggaaaatgctccgcgtctgtggtgtatttcagacaagttagtcagaaaattcaaaatatctggaagaaataaatgacggccaacagtttggtgttggccaccaggtgccagagcacgtatggtcttggcctaaggtgagtgaaagacaggtttctgggtcaagacaggtgtttccaaatggcaatttttgaggctgctgacattttacaaaataaaagaatgtgataaagcttaagtttttggttgtattttataaatgtctatatttaagaagttcatgctttagcacacataagacattcaacaagtcatttggaaataacatcaaatgtcgaaatttgagaccctttataattaggagtggaggaccaagtggactccatcccttgtccccacataggtcctatttctttcctaggccacacagcttttaaacataatatttctcccctattatccttcagtatttatagagcatccggcctgtgctaggagcttgaaaagacagtccctctctcatggagctcccaatatagaggccctttccctttggactttcttctactggaaattgccttttcttgtgtagttccctttgctgactctgcttgtcctcctgttctcacaaaggctaccatgcagtgggggaataaatatgaaaaaaaatataagatcattgcactgcagagtgaaggagcaaatcccttaacagtcatgagtacacattccagctcatgagcataaagccacactattcatagaaatgggtgatactgattgtacacttaccatgtgtgaatattgtgcttagtatatcacatggattacatcacttcacctgcttcggagaacctggattgagcataatggaaattaagagttggcccatccctagatccacatctgttacctgctttgctggctgcctgggaatgaggtcttgtctgtctgttttttgtttttttaacttcagctttggcctggagctgcagcccaggccactatggaaggaaagggaatgtagcctttataaaatcatctatagcctggtgggaatgtcaactagtacaaccactatggaaaacagtgtggagattccttaaataactaaaaggggaattaccatttgatccagcaatcccactgctgggtatctacctagaggaaaagatgtcattatatgaaaaaaaatacttgcacacacatgtttatagcagaataattcgcaattgcaaaaatgtggaatcaacccaaatgtctatcagtcaataagtggataaagaaattgtggtatatatatatacaatggactactactcagccataaaaaggaatgaatgaattaatggcattcgcagcaacctggatgagattggagactattgttctaagtgaagtaactcaggaatgaaaaaccgaacactgtatgtcctcacttataagtgggagctaagctatgaagacacaaaggcataaaaatgacacagtggactctggggactcaagggaaaagagtgggaggggggtgagggatgaaagactacacatcgggtacagtgtacactacttgggtggtgtgtgcaccaaaatctcacaaatcaccactaaagaacttattcatgtaaccaaatactgcctgttccccaataacctatagaaataaaaaaaaaatttaaatcagctagagccaagcagaaataataaggaaagtgaattccaagaaaaagtatggaattctcttcaaagcataacagaaaatgttttgccatttctggttgttgtcatgaagcaaaaaaacccacttgcccacttggcatgtcttacctgacaaaaactacaaagaaaggcctgcccagggtttctgcaagtcctggatctgggaggctgtgtctcacagagagtgacagccaagactgaataactgtgagactgtgggcaagctggtgagttcttctgtgcctcaagttcctctatgtaaatggggacagtgatccttgctcttgggcttgttgggaggattccatggaatgatatgtgacacctggcacacagtgtacactcagttatcatcacatatgtcatcttcaatatgatttttgccaattagatgtggactttttgcgttcattaaaaatttaaacaaacaataataacaacaatcacagtgagtttgggtttataatactgtggatttcttccttggcatgattggagataaaagaaggaacattccatgtgatgctgtgaggtcccaggaaaggtgtgacagagaatcctgagtcatgcttacctgtcattactagtgggaatgagagccatctgggatgacctaagtgcatattgtttgcagacagtgataggtgctcagggagcaggaaagtggagcatgaactcacaatagaaggtaggagcagagacaatcaagtcctatcctaccagatcaactgagagatttctattccctaaagttccacagtctttgtacccctctcaccatgtcaactttgctctccttgaacgatcttatcccctctcttgaaccatactccctgtttttctcacatttacgtccccttcaggatatggcaaattgtcttatgctcaggaaacatttgctgaatgaatcctctggagatcttcagaaaatcagcatattccaaatgaagtgactgagacttaagcaagagacccagggtgggatggacagactcttgaatagcatcttgatctagaccagtataaactcgtgggacctaaacaaaagtggacctttgttcagtgaagaagattcccagggagcaggtagaagcagatggagctaactccagatacaggctgtgctctccgcagaccccagcgtcttcgtagataggaggtttagcagatggtgtttttgcattaagtttctaaattaccatctataagatcctctgttttctaaaaactagttgccttaaggctttaagattttaatgtaattttaatgtttgtgtgtgttgttagtgtacctgtttctcaggtttgctatcccagataggttatttgctaagatcagaagaaaatcaattggcaaaagaacatgctcacatgttacatgttattaccagttggaacaagagccatctgggatgtaagactatccaccaaacgggtgtgtggaactgtcccttggcattgcacaggaggaccacttttagtatgatttcctgtgctgtggctatgacatcagggaggctgaggcaggatcacttgaggccgggaggtcggggctgcataatgagttctgatcgtgccactgtactccaccctgggagacagagcaacacccgtcactaaaaaaaaaaaaaaaaaagaaagaaagaaagaaaagaaaaaagaaaaagaagaacaaattcagaagctacaataggaatagttcagaaaccatcctccagccttttaaaggcacagaagagctttgtttcacattcgtttcggcttccaaagcaactagtcaagtcagtttcacctgttttattcacaacagttatctctccaatccagattccttctttaaaaaaagggaagaaaaaacattctcatatttcttgttttgctagcaagaaatgagctgcagaacactttcagagatccactagctgttttccttaagctgaggctgagagcttcaggggcactccaaagaaagaaagaaaggaaagataaaacaaaggacgagaggctggggggaagaaagagaggaagggagggagaaactatagagaccactgtgtggacacccacaacttctggttctgaggctggtgggaaaggaatttgcaatagaagaggaggggaactgagaggagagcactgtattaagagcttataggaattctaaaaagaaaaaaaaaggaggcctttgatccattccaaagagggaggcagaaaacttcaaagcagaataacagtcccctgcactctgccctactctaagtacccggagcattcattatgaatcagcccacctcccctcggcccacgtggggctgtgcaagccagacacgcaattcagacccacagcttgttcagcctccccgagaacacagcgtgtgcaaggtttgggaatggaaatatagcagggtgcccactcctaagtggggttaattcacggatgtggaaggaatctctacctttcgcagagactgctagaaacaccagcttcccttctttctcttcaaaggaagatggtgtttttttctccttaatcctgagtcatttacagtaagatacacgtaaataatagtccaggaggtaaaatgtgatctacacagtctctacctcaaaaataagttttttgggggacttgtttaccattccgaatgtgacccggcagccctttacaaaaagtaacatttgcttttattagatacagcagatctatttctgtgagcaccgcagatgtaactgggattcatttttactggatgtctcagaagaccgggccgactgccagctctcctggacacaggaagttacagggtgcggtcacttctgctcacccatttctccttcaacagcgcagatcacatgcacagagttcttaggagacaggtcttccccaaggcaaaggcacacagaaatgctttccttcccagctgccccttgatgaaagaaactaaacacctcttcagcatggatatgacactagccctcggcttcttattttttgcaatgactactctgtgtcagagtcagtaaaaatcgcaatgcagagaagagagataaaaagaaacatcctggagaattctcctggttatttttaaaatattgtctctgttgacttgaagtggtgtagaaacagttccatatgctgtgtttcttttttcctgttgcatcttatagtttaaacatagatcttttatcggatacaacttctgttaacaatatggcctactgggttagcaaagaaaccgttcttttcttacagttctggatttggggaggttgctcacatttaactgtggaaagcattatgctcttatggtctttgccaattcttttctgtaacacaaacctaaattacataccaatttctcgaggttcttgcctagtttggaccaaattaggtcccacaaattcctgatcttagcaactgtgtctctcagttattttccgtgagacaatatgtttgtctgtacttcatattgctttgtggagacaattaccagtgctatatccctatttttctttttcttgaaaaaaaatttaatttttagaaattatttgtataggaaaaatgttaaaatagaaataagaatataacctctttgaccaccctgctccagtcctggtcccctccctggaggtagccgtattagcagacaggctcgtgttcttccagacatttttctgtatatttgcacacatctaaatacatagtcatatgtcttgtttttgttgttaccatcattatacaaatggaatcataccatagaacagatgcctcataatttatttacctattcctctattaatggatgctacggtctgaatgtatctcttcaaaattcatgttggaacttaagacccaatgtgacagtattaagaggagcctttggggaagtgattaagacatgggggctctaccctcatgaatggacttagtgcctatataaaagacactgaagcaagcactctggtcccttctcccttccaccatgtgaggacacagtgtttgtctctttcttcctgtgaggacacaacaagaagactccatgccagaagcagagggcaagccctcaccagaaacccaatccgctggcaccttgatcttggacttcccaggctccagaactatgactaataaacttcttttttaaattacccaggctaaggtattttattgtagaaacaggaatggactaagacaatgaatatataccttgcctgttaatttgctgagaaccaaggtttcattttcaacatttactagctaatctagcctagagaagtacaaagaacccaggacttggattttagtccaacaatactactaatgtccaggtaatcttcggcaaatgatcatcctctttgggccaacatatcctcagctgtcagaccagtgggcatgtacagtgaacaacttagtaccaggtactacaacaacttacacatgcctaggccccagggcaccatggtgattctgattcaaagctagggctaagattggctacccttagcaaagaagagttactgatgtgtaggtgagaaaaatgtctcacgatttagaacaggatgggacaaactacatcccatgaaccaaatcagacctgccacctattattataaataaagttttattggaacacagcaatgctcgtttgtttatatattgtctttggctgctttagtgctaaagtggcagagctgagtagtttcaacagagatctcatgactcacaaagcctaacatatttgtcactgggtaccttgcaaatgtttgcagacctctgctttggaaagatccctatggtcacacagagggtggggaaggaagacaatttagagtggtggtggtgatgggggtctgagtcagggcaagagaaaagaacaatgtgcgagacacaacacaggcagaagcacagaagttgtgactgactgaatggataaaagtatgagaaacagaagttaccagtttcatatttccaacttggaggcttgggtgattgtcattaaccaagatgagtgtcatgaaaggaaagaagatgtttatgggaaggtgagtaagattcgaattagggactttctgaattcaaagtgcagataaaggtgtccaggaagcagttggaaatatgagtctaatattcaggagagaggtggggctggaggtcaagcttgagcgccaccatcttggagatgagagcaggtttcaggtgagcagaccagaccaaagagggaaaaacatagaggcaagatatttgaggaagaaattctgagaaaccccaacagttaaaggactggcaaaggaataaacctgagaaggagcaatcagaagagtagaagaaaacaaacatgataatatttgtgaaagcagaagcaactgatgttggcttttataagaggtctttgttgggctcatgtcggggtaaagagtgctctgaggatttggtgcctcttgtcagtgtcctgtggtggcttccatagaaaacactccacacccattatctgcaaggagacagctgcagttttgcctcttcatgtggtttcctcaaacccaccccctgggaaatgcaatatgattctctcacagagcagatgggatgctaactggaatcacctctgccttgcagagttctccctcagttgctccaacagtgcctggtagtgtaaacaagactggcttaccagtgcagcattcaataccagtgcttacccagcagccattcaaccagtcctgctgatgccccaccatgtgccagccaccaaagcatctagtgccaagattacaactgtttccttctgctcctggttcttagagtttttttttaaaaaaaatatataaatgatctgcatttagtgatatatttatttttaatttttttatttccataggtttttgggggaacaagtggtattcggttacatgagcaagttcttcagtggtgatttgtgagattttggtgcacccaacacctgaacagtatacactgaacccaatttgagtcttttatccctcacccccaccaatgctttcccccgagtctccaaagtccattgtattattcttatgcctttgcatcctcatagcttagctcccacatatgactgagaacatacaatgtttggttttctattcctgagttacttcacttagaataatagtccccagttccatccaggttgctgtgaatgccattaatttgttcctttttatagccaagcagtattccattgtatacatataccacaatttctttatccacttgttgactgatgggcatttgggctgtccatatttttgcaattgtgaattgtgctgctatgaacatgtgtgtgcaagtaccttttttgtataatgacttcttttcctctgggtagatacccagcagtgggactgctggatcaaatggtagttccatttttagttctttaaggaatttccacactgttttccatagtggttatactagtttccattcccatcagcagtgtagaggtgttcccttttcacagcatccacgccaacatctattactttctgatttttttttatcatggccattcttgcaggagtaaggtagtatcatattgtggttttgatttgcatttccctgatcattagtgatatcgagcattttttcatatattttttgaccatttgtacattgtctgttgagaattgtctatttacatccttagcccactttttgatgggattgtttgtttttttcttgctaatttatttgagttccttatagattctggatgttcgtcttttgtcagatatatagattgtcaagattttctcacactctgtgggttgtctatttagtctgctgactgttccttttgctgtgtagaagctctttagtttaattaagtcccacctatttatctttgtttttgttgcatttgcttttgggttcttggtcataaagtctgcctaagccaatgtctagaagggttttttctgatattatcttccagaacttttattctttcaggtcgtagatttaagtccttgattcatgttctgttgatttttgtataaggtgagagatgaggatccagttttattctcctacgtgtgacttgccaattatcccagcaccatttgttgaataggatgtcttttccccatttctgtttttgtttgctttgttgaagatcaattgactgtaagtatttgggtttatttcttggttcactattctgttccattggtctatgtgcctatttttaaccatgctgttttggtgactatggccttatagtatagttcaaagtcaagtaatgtgatgcctccagatttgttctttttgcttagtcttgctttggctatgtgggctctttttggttccatatgaattttagaattgttttctctaattctgtgaagaatgatggtggtatttttatgggaattgcattgaatttgtagactgctttaggcagtatggtcattttcacaatattgattctactcaatatccctgaagaacacagatgcaaaatccttaagaaaatacttgctaactgaatccaacagcacatcaaaaagataatccaccatgatcaagtgggtttcataccagggatacagggatggtttcacatacacaagtcaataaatgtgatacaccacaaaaacagaattaaaaaaaaaatcacatgatcatctcaaaagatgcagacaaagcatttgacaaaatccagcattgctttatgattaaaaccctcagcaaaatcggcatataaggggcatacctcaatgtcataacagccatctatgacaaacccacagccaacataatactgcacagggaaaagttgaaagcattccctctgagaaacggaacaagacaaggatgccctctgtcaccacttctattcaacacagtactggaagtcctagccagagtaatcagacaagagagagaaataaagggcatccaaatcggtaaagaggaagtcaaactgtcgctgtttgctgatgatatgatcatatacctaggaaaccctaaagactcatccaaaaagcttcagaactgataagtgaattcaacaaagtttcaagatagaaattaacgtacacaaatcagtagctctgctatacactgacagcaacctagttgagaatcaaatcaagagctcaaccccttttacaattcctgcaaaaaataaaatacttcagaatatacctaaccaagaggtgaaagagtgtacaaggaaaactacaaaacactgctgaaagaactcttagactttctctatccctatatttggaaagaaggttggaggaggggtacagaaggacggagggaggtagagagagtgttaaagaagaaggaaaggggtaaaaaagaatgggaatagaggcatggactagaaactaattagatggtgaggcagagaccttgcattgcgtatcttacatgcactggcttggcagccttgagaactgatgtgtatattgaaagcaacagcacatgctaggtgtccagcataatacctgacatatattaagaactcaatacatgtctgttataataatatttttgagtatccagaggaactaggccagcctttgaattgataggccctttggtaattttcatacagccatgtagcaaaacttatattaaataaattgggggaatttcatattatactacattccttttgcattctcactggcaggagtatttagcctggatgaaacttgatacttcaaaaagaatcacttgctaaagggagaagtgagccccaccttctgttaggaagatgtggtgagtacatcaatattacaaagattcagtgtgttaaatcaatatgttcaaagtagtttaaatgtccaatactggtttccaacttctaacttttctctatcctctctctcggcctcttttcaaccattccttccttaatccttccacccatccctctcctaacccccaccattgtagactaatttcttttggttatctttctaagcctttgcacacttttccctattgacgagctttgctgttaggattctccagctacttctgcaaagaggttttcaaaggacttttgaaaatgcagcactgtgtatgttttggtaaaataaagcaaacattttgtgtggttgggtttgttgtttgaagtgttgcagtctccctctggggcctcctactgtcttctgactagcacctcaacagcatcccttcctgctgatttgcagagggtttgattctttttcaatagtgcataatgctgctgtcttattgcctgtttgctttagttcatatttcttctccagatggattttctatgaagatcatccctatttgtttgatctttaatttcagaccttgtcattttcttttcgagtatgcttttttatggatgtttcttttggcagaaccacttcctatgagcctcagtgtgtgttaatggcactttcatttattatcatagacaatttcaatttctagagggatagttgagttctgttgtggttcaaaggagaaataaatcctcttgcaactttggctattttatttcacttcacttttggcctcagaggacgagagagaagctgagaacattagccacatctgtccatgaagatttctccaatatcaatttgctcccacacctgatgtactgaatactcagaaaaatgctcaggctataaaaccatgtctaaggcacagacagtttaagatcaggctttgaatgaaggcctcagtttatcttacacattactgaagcccattctatagaagactaatagtttccacaggtgtcttgggtggagaagggaaaaaagtcaatggactgagatactattggtctcaggaatcatttgcccaatctaccctaggccaagctttgaaggacaggccatctgaattcactgagtgactgaatcccagcacaggaaatgttgatattcttattgattctttaatggccattttatatccaaccatccagccatccatctatgcatttatccatcatttatagtaatgtccctaaggctgctttcttgctaaaaataaggaatattgacagctgaaactcactttattattctgccacagttttaagcatccctgcaaacacgacttctttaacgatctccagtttaattccacagtatggttccctatctgcattattctctcctactctgatcatcttatttatttatttagacccagggtctcactctgacacccaggccggagtgcagtggtgcagtcttggctcactgcagccttggcctctggggctcaggtgattctcccacctcagcctcctgagtagctgggactacagttgcgcaccaccacgcccagctaatttttttgtagagatggggtttcaccatgttggatcaccctactttaaaattgtaatatagttcccttttccagcaacttccatttggtttaacctgttctttattttttctttgcacttttcacctcctagcctaatatatattgtacttatttactatgtttacagtttgtttattggctgcttcaagaacataagctcctctcaccatctactcactgtattctaagtgtgaggcatatggtgggtatttggtaagtatgtgtaaggcttcttggggaaatgacccttcagtgcctttattcaatactcaagagtgtttctcagcccctaacctggcattgtaggagacacaatgtgcgcgagtgcgcgcgagtctcatacacgggagtctcagcgtgtgtctcatacatgctgctggatgtgtggcatgcctggcccctgcccaccaattgccagtagtgaccttatcatcaatgtaacaattaaaaacaccccaggacatttccaaattcctcatatggctccagtaaggctttgcttgataattactgcaagtcttagaataaaaccatttttttacactgtgtttccacttggcaaataattagtccaccttatggcatcctaagggcactctcagagataatacactttcttttttatatgcctccctcaacagatttcaaaatcctctcacacaattaaagacagtgatatttaatggtaaaactcagctgtcaatgatgccttctatgtcagtcattaacaagccagtaaaccaatatttactaagagcttttgagcctgacttcatgccatgcagtgtccattttatagcacaaatggtaccccacccactaaggctgtgcctgtgttacctgcggtcagcatctcatctaatccttcctcacattttagcaaaaaccaggccctgcagtcaaagaacaagtttgactgatttcttttcactggactggtcagttattcaaccatgatggacaaactgctgagttaaattggaataacacaggccaagagaatcacatttaaagtcagagatggcaaaaataacagacatttctatgacagaacatcaacaaataattactgattgtctactggatacaaagtactgtggtatagggcaccagaaggtgtggttaacatgacatcaattgtcattctgctgggtgacaatgaaatatgtataggaatgtatactaatattcagataaatgcagatactgcgagcagctatgctaagtgctttacaggcacatatcacttaatcattaacatgaataccataggtatccctattttatagaagaggaagctgaagcacagggcagtaaagggacaaggtcactcagtcgggaattagtggggcaacagtttaaattcaggtttctctcatgccaaagggtcttaaccactgtgtgataaatcaaatagttttcagttgtctgaaattttcagttttcatttactttggttgtgtaggcacaaacacaagaagatctacagataatgtatattttttaacttcctttaaattaatgcatgttggattgctctctaccatttgccccatctaagtctttgtagttggaatccatcgttctctgcaaatttgacatttgatcataaattgctcatctcgagatgaattacaacacctcacattaaagaggcacttagggagacatttctattccatttcaagagacttatataagaaccctttttgatctttcctaaaattaaaatgaaaagccacattttggcaacattatggaataatacaaatgttcaattctgtggaaaaaggtagagacatgactgatcatttgatatttaaggcaaagaaatagtggttttatttgatttttcattttgaactctgtcagactgtgatccttttttctatcttcatagtttttaaaaaataatcatcagaaacaagaaacaaagagaaagcagtaaaacacattttctttgcctccaggattgaagacattttccccttggcatgtacctactaagtaggaaaacctagaatgaaagttactgtgttgcttcagtaacttctaagaaatcaatataattttggttttctgctataactctcaaagcatatttgatgtatctcttagtcattgacaactttctttatactctgaagcaaagttatcccagccaagtgtatgtggctgcggatgataaagtatggctatttgaagtttgcttcttcttaaagagaaatgcaaagttcccagaaagacgctagatacaacggttcacatacacttcacaaggcacttgcctaacttcttggaccaaattacattaaatctttgagccaagaaaattaactcaccactcattgaaaaacagtatttcagccatgtcatatctttggttaaggcagacttaacgggaaaatctctttccaatatgatatgtgattcctttacaagtacacagtttgttaagttttatacttttttaagaagtagaggttttttgtttttgtttttttaaccaatggtactctctctgtgtgtgtgtgtgtgtgtgtgtgtgtatcctaccaaattccttagttaataagcaagacaaatttattcacagaactcattttgtattatgtaaattttccaagaaaaaaaagaaaatcttaatttgtgtttcaaagcctctctagtttaagcacaatgactttgaagaaacaaccaaaaaaaagataaaatgtggatgcagaatgatgtttattttacatgtatatggtacacattgggtaccaaaagaaagtcatggttaattacaataatcactctagtttggccaaataacatggaactaacgacatgaatttcaactatggatagtaatattaagtgggttgaagtaatctctacacaattaattttttctagtgccttggcctctgaaaacttatctttggtctatatggatctatgtgcatctaattaaaggttcatatttgcaatgcagggttttagttaagggaggttaaacatgagatttccttagagcgcctcagtgttcatgggcctctatattctcatatctctgcaccagcagtaggaggatgtgagagcccagggagccctcgaacttcaaaattagatctgtgggagaaaacatgtaaatctcagccagaagaatctatgcctcctttttctcccatgctgccttactcatagcactgatagcatgcatgatctgttagccttcactatccttgcagaggaactggattcggtggtatggaaaagacatatactattccatgaatatccatgtgctctgctccatttcctgttcccttgcagataagtgagcatactctgaccagttctggccaagggactctgaatgaaaatgctaccttaaaggccaaagtatttaagagccagcacatgactctccagctctctcttattctgtctcagtgatacagaggctgcaggcccaggtgtcagaattatacaatacagaaaatagatctcttataagggagtttgtaagaaaattggccctagagagccaccagtcccttaaaagagtttatatgacagcctgggcaacatagggagaccccatatctacaaaaataaaaaaaaaattagctcgtgcctatagtcccagttacttgggaggctgaggttggagggtggcttgagctcaggaggttgaggctgtagtgagccatgatcacaccactgcactccagcctgggtgacagagaccctgtctcaaaaacaaagcaaaacaaaacaacccccccctcaaaagtttacattagtggcaaataaactttgttatgctgggaagatattaccaagaatagcttagtttactgtgacaatttaaatcaactgctaagataaccaaagtaatcagaagctataacaggacataaatgctgagtacaaatatttatttttgtacctcctctattggagaaaatctagaaaataaattcaatatatattccaaaggaaaaaggaggaaagtctaggaagtttttcatttgggataaaagccaggaataaatatatgactttcattggaacattttcaggcactcagagattcagagatatccttaatgctaagtagatgtataattagctccctgtttagggactccaaaatgtgccatgtcaaaactgtctcctgaaaatgttgctttgcgattccaaaagcaatcagaggttgttgaaaaatctttgggattttgcagtgtgcagttttccccaacaggcctaacattaatcattataggaaaaacattcaaactcccccattctttcatagtctagtctaaacattcaatgcaatatcataattctgcagacataaattccctcattatctgtgggccaggtcaaccacagcacagccagccacctagcagacccatgagcagggccttttgcaaaggtgtagcactggccctcaaaaagacttacagttaagcactccaggaggctgcaattgtgcacagcagccaacctgtctaattgggtcattttttcactgggtgatttatatagaatgtggactcaaggctgactgctcttcgaacagtatgactgcttttgtctgactgtaccaatgaagcaggatggggttgctggtatttaagaccaggcattctggtcccaaagaaacattgctttgggctgtagttctgtgttattgcaagaagcatagtatccgatgttaccagtgtgggctcagttacttcatctgtaaaatgggaggctataaccccacctacctcttagggttctcgtgaagatgtgcttgagaagagctgaaacagtgtgcctgacacagagaaagcattcaatgaatgtgaaccatttatgctatacagcattattactgatatgaagtattagtgatacattattgatataattatcatcaacattatctgtgatgctggtgatatgatgatgatgatgatgatgatgacagtaataatcattttctgagtgcttgccatgtgcttgccagtctactaagtgcctaatgtggattacttagtgaatcctcagggcaactattgagactattatctccttttgatgaatgaagacactgagtcttagaaaggttaagaagcttgatcaaagaagtaataaagctgaaatagaagccaagcagtttgacttccgagcctgtgcccttagttactaccctctaccccagcattgacacaaacacaaccacagcttttattagttgtccttataatgacttagcctcatgcgataagactgtctgtcccagatagagccacaagttacttaacatatctcagtgtcagcagccacaacctgctaggtaactacaactccaaagtgccctgcctcctgaatgagatggaaaatcagtggaatagggaatgggggttctgcttggaaataacctgtaaccagaccagttaaggtggaaaggggtggctgtgaaaaatgaaaacaataaaacaaaacaaaatgccaaaaagcagggtgatatagagagggtttaaagggtattgctcccctttcactcctagcctgggattcaatttgtggccaaaagctgatggtaagtgtgtgtgtattgcagccatagtcagcagagcaaatggggactctcaactactggtcctacttcccctaaggagctgggtagttaacatgttatccctgcacctgagtaaattaacccattactccttacccagtgatccacttgcccccccatgatgtgcactgtagggagttcatgctgtttagctcagaaattctaagttcacatggagtccagttttcctggattgtaccttaagtggttgattgttggagccacttcatatctatatttaagttagactattgagtactgtccctcagtttcaggagccatgggagcaaatcgaggggcaaaagttacttctggatcttcccaatcatttctcaaccattgagtcacagcctgtgacaccagacgtctttaacttaactccaacctcattgtgctaggttctgttttctcctcaattatttttttttcttgctctaagaaaaggataatacacccctaccttatctgtaacatccagccacattgtctggcttggttatgtgactttctttgcccaaaggactataagcagataagaaatatccatgtctacatagaatctttaaatgaggttgcaaggcttaactttctgcatttttgtcctctgcattgtgaatagcatggccccgatgagggcttctctgcttcagcctaggtcttggaataagagatgcacagaatagagccaagaagaagtgctgccaaccacagactcataaatgagaaataaatatttgtttatttgggggttgtttgttactgcagccgaggctaatacacaaatttttcaataagaactcagcctcagcttacatcatgtgcgcaagtgaatctggggatgctaggggctatcttccctatcattgagtgaaagactatttatgtattaagccaacaggcaaggacagaatcaagaaatgttgtaaaagtaagagctccgagtcctttgagcccctgaatccagctgtgcctgaagacttaatgctacatgttatgattatgtgagccaagacatttcttttactttagctagtttggattaggtttctaatctggtttaaatgaatactgacttatatcaggtctcctcactcttttgcaatgatatctgagcacaagcatatatgacatattaagtaatagtaatcacatgggggtaagttacactggggtataaatcattgtaattgaataagcctgtcatgggttgaactgggttccttctccacccccagcttcaaatggatatgttgaagtcctaatcactactacctcaatatgtgacattatttggaaatggcattgaggatgcaattagttcagatgaggccatactgaaatagggtgggctcctaaacttatataattgatgtgcttataagaagacagccacatgaagtttgagatacacataatgtcttgtgaccatgaagacagagattggagtgatgcagctacaagccaaggaacatcaaagatcgctggcaaactaccagaagctataaaccaaaggcaaggaaggattcctctacaggctacagagagagcatgaccctaccaacaccacaacttcagacttctagtctccagaactatgaaacaataaatttctaattttttaagacacctagtttgtaatattttgttatggtggccctaggaaactaatacaaagcccatcaggtgaatttttaccaacagatcccatggaaaacttctgatggaaatcactattatactcatgaaggtcattgacagggtttggctctgtgtccccacccaatctcatctcgaattgtaatctccacatgttgagggagagacctggtgggaggtgattggatcagggggacagtttcctccatgctgttcttgtgatagtgagttctcaagagatctgatggcttaagtgtatggcacttcccactttgtgctctctctcctgccaccttgtgaagaaggtgcctgcatctcctttgccttccaccatgactataagtttcctgaggcctccccagccatgaggaatggtgagtccactaaacctctttacttataaactattccagtctcacataattctttatagcagtgtgaaaatgaactaatacagctatattgccatatctatgtccacacaatatccagagacacagaaaggaaaaaggaggcagcacaatgcaatggtcatgcacattggctgaaagatcaggaagacctgaattcaagtcctagtttgttcatttactttaggtgatttctgactccagtgttctcctgtacatcacagaaaaatccattgtttcattcatgatgttttatgagagttaaacgaggtagtggatgggaggtgctttacactgtgcctggcagagtatatttgttaaacaatagatagatagattagctaaatagacagacagacagataggtaacttagacatatagatagatgatagagagagagagacagagagacagacagacactttgggcgactatcaaaatattataaactggttggcttataaaaaacaaacatttacttctcacacttctggaggctagaaatccaagatcagagtgctagtatggtcagttcctggtgagaaccctcttccaggttgtagattgtcaactttttactgtatcctcacgtggtggaaaaagaggaagttagctctctgacatcttcttataagggcactaatcccattcctgaggggccctatcctcatggcttaatcacttatcaaaggtcccaccttcaaacaccatcacaatggagattatatttcaacatatgaattttgaaggacacaaacattcagtctataacagatagacagatatacacacataaaaatatatcaatgcataagtctatagatatgaaggtctgtatctttcctgcctatataaaatttaatcaaatcattagcagttaaatagtgaattttcaacacattcccaaatagttttaacttacttaatatgttgtgttggtggtaattttcttgttgttgttttttaaactgaacttgattgacctgattttatgtagatatgcaaagataccacttactcatgcagaccttgttgtgtaaataacccaatcttctgtctttgcaaagacaatctttccctaagagttataatctcctctcaacacatcgattatatggatcaaaggccctctgacttatatcagcctgggccaaaatagtcattaccaaagattttccactttccctctttaatagactaagctttagaatttgggtaatggtttggatgtcaaacaaaacctgagaacttgtttaggttcagaagaaagtgagagtgataatattcctttcttcatcaatggagctttctaccctttcccgcctattatgtctaatgttattgtgcaccaaaaatgaagctctcctaatcttcatttaccttcataataaagagagtctttgtgcgaaccatttctactatactgcaaagacacaaagaagaaggcctttatgctgaagctacaatttgttgacatttttatggatatgaacctgaattgtcatgagtgagcttgttctaggagtagatgtgtccgagttttcacacatgaaagactgggtcctgacctaccaagaggcagtaaatggaatactctgaggattaaagacattactctcaatatgtcttccccataagcctaagattccaatttagtgctacgagaatcacccctctgtattacaatatgcattgagaagactctctttgaggtgtgttagaaagaaataccaacacacttgaagaccactagctcattaagttgattagttccttgccagcctataatgaaattctaagatctggagggaattgaatactggatgattaagttttggccaagcggtacattactaaagaaatagggaggagaaaagggggagccctagtcgcttaagagtaaatcaaggggacacaaataatctaggaggggatggttcccaaatggccccaggaagtcctgttgggatgggcacccagatttttaaccattttccctcactccccatagtaccttaaatcaagaatatccatgaatgttactaaatgcagcatgcccaagatggagtcctccccatgagtttacaaagaagactcaagtcaagaagacttgatggactaggaggtactacttaaatgggaaggaaaaagtttcttgctagatgctgcaggagactagaagatgagtagatattctgtgatcctctcaaaatttcacaggttgagctcctttgcacgattccatactgttaggctgggcattcttatcctttgtgactgctgcacaaggaagaaaatgagccacactatcccttcaaacgctgagagctggtttgacacatttgtgctggtttggataactaagtaggagacccaggacataagtggcagctggctggcaaggatgtcagatgcagaagtacccagaaaacctactcagggtgttttcttcctttcctggtcccctcctgttacaggaaggctgacctctgcacatgccatatgagcttggccctgcggtttgccttctgccaaagaagtccctgatataaaatggaacttcagaaccttgcctttttaggagtgtcattagaaatcaaatcagtatgggctgaacaggctcaaggactgctgctttagtgtggcagctgaagtccaaatttttgagagtaattgggcccaggctgttaacaggtgcagccacttcctactagggagaaagaatgcctgccatgtgtgttacacatggcctcagaaggaagccacctgtcaagagaaatgcagacactgggctggaggggcccgaacagtgatgcaagtctgagtgatgactaaatgaggcccctgcaaaggcagaatggcccaggattgtaattaagacactttcttaccttcgcatggtaagatttgacttgttatagtgctatttctagtcctaaactcactatacgtctatgctatcatttctaaattatattccattcaacactagtatttggagaaacacagttaattttctgtgagaaaaaaaagagttcagttttttggatttgcttaggagacacttctttgtacaggctccatctggcaattctcagaacacattattctattatctaaaaatggctgagtagtcctggagtatagaagcctgattaattttaagtcacctttccctgaaccaatacagtcatcccttggtatctatgggaaattggttccaggacctccctcagatgccaaaatgcacggatgttcaggtcgctgatataaaatgtcatagtatttgcatataacctatgcacatcttcacatatcgttcaaatcatttctagattatgtataatacctaatacaatataaatgctacgtaaatagttatactttattgtttagggaataatgacaaggaaagaaaagcctgcacttgttcagtacaaacacaattccccccaccccccaaatatttccaatcctccattgattgaacccatggatatggagggccaactgtaaacattttcattagatcttttataaaaatgtcccatggaatcctatttgagaaattcaggattacacaagtaaacaaaagttgagagaactggttttctctatcaaattgggcaaaggtcttctctgcccttgtcattatgtggatacgtttttctatgaggagcactatagcacagtggtgaagggaatgggtttggacttggactgcttgggttggaatactgcctccagcatccattacctataggactctgggcaagttacaaaacctctctgcactgttttctgcaatgtaaaatggtggtggtgtgggggggtggtgtgggaataatagtaatatctgccccagaaggttgtggacagatgaagtcagacagcctttgtaaagagcctagaacagtgcctagtaccctgtaagcctggggcaaatgttagctgcagtcattgccaccatcaccatcatcttgccatcatctcccatcctctctctcagaatcagattccagaagtcattttgtctccattttcctcactgctctccacagtcattcactctcgctgtcccactcctgcttttgaaaagcctccacccctctagccttcataactagcacaggccttcctcgctccaggctgaaatattacagctttcccctagctaggttccctgaccccagtcccactctctacccaaacaacctgccctcaatgcccagacaaacctgcctgaaaccctgctgtgttcttggccccattctgctacaatgtttctgccttcattgtctagatggcagagttcaaggttaccttgggttgcaaccctctcacaaactaattcaaacctgttttccaaaccacatttattccctcacccccagctactgttcctgctgttcttcccacttggaatgtcgttcctagcctctgcatagactcaaattccaagtagattccagaacccatctcagcttgtgtcttcttcccaaggccttcctgatccctccatctcttactctggcatgggacactagcatctgctctactgtggagtggcaggtttagagggcttaggtttagagacctgggctcatatgccagctccaaaatgagcaagcggtgagagttttgatccagttgtgtaacccctctgtgtctcaggttccttatctgagactggagattgataatgctctctctccaaagggatagcatgaaactcaagcaaaagtacttgtacacattcagatttttttccagtcttcctgtgtgttttttgaggagccctagatttggcaaaggtgcctttgaaggcggaagtaggaaactgaagcgggctaggttgtcagacctccagcccctgcctctacacttcaaccagagctgcgctaccttgatcaattatatttatatatttgggatctgggtgacctttacttaggaaaaaaaagagatctattccacaaaagaaagaataagaaaaccatctcatctcccagctgggcgcggtagctcatgtccccaatcccagcattttgggaggccgaggcaggtggatcacttgaggtcaggaatttgagaccagcctggccaacatggtgaaaccccatctctactaaaaatgcaaaaaaatagcagggcgtggtggtacatgcctgtaatcccacctactcaggaggctgagacaggaaaatcgcttgaacccgggatgcagaggttgcagtgagctgagatcatgccattgcactccaacatgggcaacagagcgagacttcattttcaaaaaaaaaaaaacaaaaagaaaagaaaaaagaaaaccacctcttatcattagtaccatacaggctttccataattatttcactatttcacaacagtacagctggtctccccagatacattgtaacctccttgggagaaaggactgagtcatctttaagtatgtattttccctagttaaatatgttgtacccggtaagtacttaaatacttgttgatgaagcagctctgccttactgcccaccggttcctccagagatcacacttttataaggttaagcccatcaagaagttccttttccacttccctgagcaggcagccatggcttctttatctcctttcactctcttctgggaagatctacttcaatcccagtgccattatctctctctaccaaacactgctcagagaatagcctctgagacctgtttccttaccaggattcagaggatcacagatactagagatgaaggagaaaaaaaataaatctatcagggcatcatgtcctctccttgtgcaaaacggttaagtcctgaacattttctaaatatttgtcaggcctggtattaaaggcttgaagtgacaaggtccctcaagggagaagttggcattaaacctcactcttaaagatgacttcttttactgacttttcagtttcatgtttcaccactgaatctcacttctcacttttagttaaatcccttctaagtagccaggctacagtgagtgggggctacagaaaagccacaggaggagtcagaagagggtagagctgtcactctgtgggctatgtttccctctgactacaggtaatcaaaaaggatgggcaaggtgaaatcttgacatctcacttgaacagaagtactcccccattcttgcagattccccatcattcccattcagagagccaaaatgcaactgtgtaattataagataatgtcttatttttgtggccccactgaggttaccaactcagacacctataggggccctttgataaggatggcaaacccacttccttcagcatattgccagctcacaggaaggtgcatcatgtcaccagattatccccctttaaaaaaaaaaaaaaaagaaagaaaccatctatcaaaatttcaatgaggaatctcttcatttttgaatgttggcaatgaattcaaattatctttaacccattgtaaaggcacagctgacaccagtcccttctgtaggagatttcttctccttctgaaatccatcgccaattcataagcaagcacgcaggaatggacaatgctgtatgtttattacatttataattttgtgtgtagaagccttgcctcaatcctcaaaatgcagacacctatgctgcagtcttttgcgtggttacatcactcaacgtccccagtacatatgttcagaaaaatggtcaggtcctcagggaatagttaaaactgtgcaggactagactacttaggtttatatccctgcctcagtgcttgacagctctgggaccttgggcacctcagttttctcatctatataatggtgatgataataacagccctgggctcatagggttgttgtgaggtttaaatgacatagcagggtgtacatcatttagcaaatacactaggagcttaataaatgtcatttggaagctgcttcacatttccacattctattaaaacacccaggaaccaatggtgccctcacttcatctctagattttgctaaagagttggtttaattttcgccatgtcttcgggtttcatttttacctctgaaggtcaagttggcttgctacattcttggcagagtccatagcccctttgatggtagaaaatgatataaatgaaaaggtcagatgatcttgcctgggttacctgtcattctggaagatcacagctgtatgctaaactagatctaggtatgtgtgtggggtggggctgaagtctacacccatattgtggtaggcacagatatgtaccacccaggttgcccttcaaggagggacttggcctcccaactgtaaggtggatagtgattagcaagcactgttcagccattagctacttgagaatgggcctcagctccagtgagctgcttccctaaagaccatacatttcttgggcagctttcatttcctacagagtgaggcaggtgtgacaagatgctgctgtttccattcatcacggaacaatccagataggcaataatgaacccagggctccccactggcttgggtgaagctttggagggcctacctcaaagtccagcttctaccttgcccactcctgtttctgccccttcctttcacaggtgttgatgcctaataaacatcttgtactccagagtccatctcagcactgcagcccaagaacccaacccatgacacacgggtgtactgatgcacacacacactcctgaaacccagacaatcctttaaaactatctttttaataaacagaaaccagccaagtttgattataaagaaaaccaatcgtgcattgagacctatgggattagcagggtcaggggtatctatagagttgggaaggattaccactgatattttcttccaatttcttttattgtggtagaatacacataatctaaaatttactatcttggctatttttaggtgtacagtccagtgacaataagtacatttacattgtgggctacaattgccaccaaccatgtgcagaactctttttcgtcttgtaaaactgaaattctatacccattaaataacaactccccattctccctccccccagcttctggcaactaccattctactttctgtccatgagggttgacaaatctagataactcatgtaagtggaatcatacagtatttgtcttttagtgactggcttattgcacttagcacaatgtcctccagattcatccatatcatagcacttatcaggatttcccctttttcaaggttgaataatattttattgcatgtatataacacatttgatttattcaatcatgtttcaatggatactgagttgcttctacttcttggctattatgaataatggtgctatgaatgtgggtgaacatgggcgtacaaacatctgttccagttcctgctttcaattatttcaggtgtatgcccagaagtgggattgctggatcatatggtaatcctgtttttaattttgtgagaaactgccacactgttttccacagcagctgtaccattttacactcccaccaacagtgcacatgagttccaatttctccatatctttgccaacacttcactcttttttgatagcagccaacttaatgggtatgcagtgatatctcattgtaatttcatttgcatttctctagtgattagtgatgctgagcatcttttcaactgtttattggacacttgtacatcttctctggagaagtgtctattctagtcctttgcgcatttttgaatcagtgatttttgttgttgttgctgagttttaggaattatctatatattatgaatattaatctattatcagatatatgatttgcaaatattttttctcactctgtgggttgcctttttactatactgatggtgtcttttgatgtacaaaaatgtttttcatttaagtccaattcatctatttttccttttgatgcccgtgtctctggtgtcatatccgataaataattgccaaataaaatatcatgaggcttttgctctaaattttattctaagagttttatagttttagttcttaaagttaggtcggagactcattttaaatttttatatggtgtaaggtaaggaatgtacctaacattaattgtattcttttgcacttggatacagagttttcctagcggcatttattggaaagactgtcttttcctccatttaatcatcttggcactcttgtcaaaaatcatttgaccacatatgtgaaggtttacttttggactcctctatcctctattctattccattgatgtataaatctatctttatgccaataccacattgctttgactcctacagtttacagtaagttttgtaatcataaagtatgagtcctccaggtttgttcttttccaggatttctttggccatctagggtcctttcaattacatatgaatttcaggatggctttttgtatgtcagcaaaaaaagcatcgttggaattgtcacagggattgtgttaagtctatagatcgctttgtatagtattgaaaacaatattaaatcttctaatccataaacataagatgtgttttcattgattgataccttctttcagaaatgttttacagttttcactgtacaagtttttcacttctttggttaagctaattcctaagtattttattctttttaattctcaattttcttttcagattgttgttagtggataaaaatgcaatgtatttttgtttgttgactttgtgtcttattgctttgttgaattcatttattactccttacagatttttttttttggtggaatctttagggttttctacatgtaagttcatatcatctgtaatacagtttgtatgttgtccccttcaaatctgatgttgaaatgcaatccccaatgttggagatgagtcctagtgggaggtgactgggtcatggaagcagaactctaatggcttggtgctgtcctcatgataatgagtgtgttctcatgagatctgtttgtttaaaagtgtgtggaacctcccacaccctccttctcttttgcttccgctctggccatgtgacatgcctgctcatgcttcactgtctgccatgagtaaaagctctctgacacctccccagaagccaaacagatattggcaccatgcttgtgtgactttcagaactgtgaaccaattaaacctcatttctttataaattactctgtctcaggtattcttttatagcaatggaagaatagcctaatacaatctgcaaacagatataatttaatttcttcattttcaatttggatgcctttatttttctggttgaatttttctggctaggactttaagtactatgttgaatacaagtggtgaaaatgggcatactttccttgttcttgatcatagaggcaaatctttcagtctttcgtcactgaacatgatgttcaatgtgggttttttatatgtggctcttatcatgttggggtagtttcttacttttcctagtttgttgagtgtgtgtgtctgtgtgtgtctgtgtgtgtgtgtttaaaccacaaagggcttgaaatgtggcagatgctctttctgcatcaactgagatgataatgtgtttcttcctcttcttgctctgctgtgatgtattgtattggttgatttttgtgtatagaaccatccatacactccaagaataaatctcgcttggtcatgatgtataattcttttaatataccggtgagtttggtttgctagtatttcgttgaagatttttgtagcaatgtttataagggatattggtctgtagtttttttgcaatgtctttgtatcaaggtaatgctggcttcatagaatgaggaagtgttcccttttatttaatttttttgaaaagtttgaaaaagatcggtttagttgtttaaatttttggtactattcaccagcaaagtcataaggtctggggcttccctttgctaggagattactgatcactgatttaatctccttactagttttaggtctattcagtgttcatgacttagtctcataggttttgtgtttctaggaatttgtccatttcacctgaactatccaatgtgctggcatgcaattgtttatattacttgcttataatccattttatttctgtagacttgatagcaatgtcctcactttcatttctgattttattaattttagacttctggttttttttcttagtctagctaaaattttgtcaattttgttgataatttcaaaaatcactttttcccctgattttctagtttttccttgatttctattatttttctgttctccatctcatttatctttgctctaatctttattctttccttctgttagctttggggttagtgcgttatttttctagtttctaagttgtaagcttagacatttgtcttatttttaaatataagtatttgtagctataaaatttccccttagtactgttttcattacttccatatgtttggatatgttgtgtttttgttttcatttgtcttttaagtattatctaattccccttgtgttttcttatttaatccagttgttgcttaagattgtgttattcaattttcacaaatttttgaatttttcagttttccttctgttactgatttctaatgccatcctattgtgatcagagaagacactctgtacaatgtctgtcttttaaaatttactgagacttcatttgtggccttgcatatggtctatcctggaaaatgtctcacgtgtacttgagaagaatgtgtatgctgttgttaggtagagtgtttggcatgtatctgttagatccagctggtttactgttttgttcaagtcctctgttttcttacttaacttctgtcttttgtctctttgctagcattttttatttaaagtctattttttctgatattagtatagccaactctgctctgttttggtttactatttacatggaatatccttttctgtccttttacttttaacctatttgcatcactggttctaaagtaagtctgtgaagacagtatatagttggattatgattttttaaaaccattttgtcaacctctgtctattgactaggctgtttaatccatttacatttaaagtaattactgttaaggagaggtttgattctgtcattttgtgacttgttttctatatgccttataggtttattttgtccctcatttcctgtattcctgtcttcttttgtgtttggttgatttcttgttttgataatgaaatgattaaattccttttcgattttttctgtatattctttagctgttgtctttgtggttaccatggaaattatatttaacatcctgaagttattacactgtaatttgaatttatgccagcttaacttctataacatataaaaactgtgctactttaacaacattataccctcccctttctgttgttgatgtcataaaattacatctatatatcttgacttcctcaaaacatcaactaataatttttatccattagtctcttaaattatatagaaaacaaaacatggagttataaaccaaagttataataatattgatttttagaccaatatattttaaaaatccgttattctcttaattcatatagaaacaaaaagtggaattacataccatgttaaaataacactagcttttctacttacaaatatatttaccaatacaaagacctttatttctttatatagcttcaagttactgtctagcatcacctcattttaaccttctggactccctttagcatttcttgaagggcagatctagttctaataaattttctcaggttttatctgggaatgccttaatttcttcttcactcctttacttcttttgcagtacagttttgttggatacgtgattattggctgacagttttttttcttttaccactttgaatatctgagccttctggcctgtaaagcttctaatgaaaaaatctgctgataatcttagtgaggatccctagtgcatgacaaatctcttctcttctgctgctttcaaaattctctctttgtctctgactttcaatagtagtatttataatgtgttttggtgtgagtctttcaggctcaccctatttgtattttggtgagctttttgatgttcatattcatgtcattcaacaaatttgggaagtttttattcattatttcttcaaataatctctctgcccctttctgtctccctcttttccttctggggctctcacaatgcatacgttggttcacttgatggtgtaccacaggtcccttaggctctgttcatctttcttcaactttttttttctctctgttcctcagacttaattttcattgacctatctttaaattcattaattctttcttctgcctgtcaaaatctgcctttgagttctagtgaatttctcatgtcagtcattatatttttcagctttacaatttatttttggtttctttgcatcactctctctttattgatgttgcccttttgatcagacattattttcttgactttccccaattattcctttagtttttttgatcatctctatgataggtagtttaagtatctggctaatggatccatcattaggtcttttcagctcagtgtccattggtttatttatttattttccctttaatgcttaatacgttcctgttgctctatatgccttgtaattttatttttgttgaaaactggacatatgaatcgaataatatgataattcttgaaatcagattctccccctttgctagggttgctggtatttgttttcatgtttttgattgttgtaggccaactctatagcaaggatcactctgaggtataaacttaaagtcttttctgagccagtgccttgcctggaacatgcacagtagctatctaaagtctcccacatatgtagttgcttttgaatgtcctagttttcaatatctgggtcccaaaaagggaaagaagaaaaattaagggaagcgaaaaaaggcatcagccctttaaattccctaggagtcacttcagctagagaggaaggtacaacaataatggctaccacctcttttttgtacctctgtgattgaaaacggcaatcagtaatcagaatacagatcccaatatttgcaggatagagtcctttttgcccaccgtggctcccacaagccatgtgcaaaccaggagtacatgcacagctgcctgccatggggctgaaagatggggaatgggtagttattactgtgctaagaactgaaattgattgaaattaatcacaatttgtgcccctttccctggaatattcaggccttcagtggactccagagttccaaaatagctacaacagacagattctgccaatgcaattgttatctatgtggaaatacagatttctcaagcttcatactctataatcttcccatcaattatattttaatatacctatgtttatagggaaagaatgccaaaaagatttaaaaaaatcacagacctttaatagctctttggggatttttgagcaatttcagtaatcttctaaaataatatttagaatatcttctaaaataatagagatcttagaaattataaagacaaaaaagattatttgtgttgacattcaatactttttcttctgaaattcccaaagtacttacatttaggatatattagataaattaggtaacgcaatgggaaggtaagctattctaagttttccagccttgttattatccagtaataatgccattcaacttgctggcacttagattgtctgaggaacctttccaaatatggtgtcatataaatgccattgtaaagctctaccagaatagcattatcagattcttccttcaatgcccagtaacaataaaacacttggggaaaaagatctcatttcagagtccctgtctctcatccttcactcttgagtattcagctgcatctgtcattctttgtttttatatttctgtttattcaaatatcacatgatcctaaaacagaataaatcctgtcatcatgcaaattccatttaggacagtactctcatatatgaggtcaggttcatatccctttataggcaatcaagctaatgtatatagttgtttgttaagaaataagattctcggccaggctcagtggctcatgcctgtaatctcagcactttgggaggccaaggcaggcagatcacttgaggccaggagtttgagaccagcctggccaacatggtgaaagcccatggctccattaaaaatacaaaaattagacaggtgttgtggtgcacgtctgtaatcccagctactcaggaggctgaggcatgagaatcacttgagcctggcaggtggaggttgcagtgagctgagatcatgctactgcgctccagcctgggtgacagaatgagactctgtcacagaaaaaaaaaagatgagattctcccattattaaatgcatatgaaaaagatcaaataatgcatgcgatatgagttgtgtccaaaccacaatctcatggaggcaaaattatcaagacttcaatccgattggtggcttgcaaactaccctaggcctccaacccacaaatatatacagcctccaacccacaaatataaacagacacagatgaaatctggatgctaggaattcgtttcctaaactttccaacagcacgtacctgagggactgtatggaagagatgaaacaagagacatgtttaggaggaaggagctagttgtttaccaattaatgacgaactatctaaaacttctttgctctctaaaagtaagacttgtaatgttttcagaaataaatatgggttattcttaatcaggtatattataagagtagcttatagaaggagatatgcattgtttctgcagtgaaggaaaaagcataatttaatttttgacaaaatcagaaatattataaggtatatgttcagctgcagaagctataatacctttgactttagttctttaaaataaattatagatacacaactatatgcactaacagcctaaaagtaagtcatgctgggtttttttccatacaattttaattaggtatattttttccaatgtgttttgaaatgatctgctaggaccaaatgctaacatgaaattccctgcatgctggtagttaatttaataaaaattagaaaggtgaagccctgttccctagagggagaaggtcttaacacaaaacattcattatttccacataaattgcaaaaagtaaagatgctggatttaaaatctaagcaggaagaaactgtcaactttcattatcagtggacaaatgttttaatttgcaatattccctagcaactttttgaacagacaactttacctctttaccaacatctactttaattcctaatttgcagctgcataagtactatgttgggcccaaagctttgggtatatctcttagaggtaatggaatccttgttgttttctggcactgcctcattaaaatgaaactcagactcagggtaaccctgaaaaacctaagccctccaataaaaaatgtggtatatccctgcacttaaattacgcaggagaagtgaaggctggtacatcacacacagaagagaagctaaaggtcaagctattagagttaatgagccgatacaagctcaggctctctaaccagagaggttagggacagaatacatggccaccccaaggaactttatttaagatatcaattaaaaatgagtcacctctcttctcagctcctgcactcaacactgacactgggaacaatgactgaaggactcacacatgtctgagaaaaggcaccttgtgggtgtgacttgccacaaaagcaagagtctttctgcatttgtaaatgtgttggtaaggcaacaaaaagaatactactgtgcaaggggaggtagaggtggtgatcctggcaacctaaaagcctgattgtatgttctaatccattctgatgtcaccaaagctccccttcgagggaataacctggattatggccaatactttctacttctaatagtcttccagtttcattgttcacaaggggttggtaaacaaaaatcaatgaaaagagcagggtcttctctattttggatttggacactgatgatgaagctgtgatattctgatccaggactcaatggctcctcctggatcttctaacaaggtcaatctggctgagttccagacagtcagctgatggtctcatatgaggaatctaaagttgatgaagatggtggtagtagagtggtgtaatcctcatagctcaaaaacgatcagagctcattaattattaactaactagaacttttatggctcattagctactggttaaatgtcaggtaaaatgtaatatttaatagaaaatgttaagattagaaatatgcagagcatttcttatgtgccagacctatgctaagtatttcatatccattattgtacttgatccttacaactcccatgcaagggacctatgtttatctcaatttaacagagaagaaggcaaagtgtgaaaaactaagtaacttgtcttaagttaaacagctaatggagtggtagacttgagcttcaaacccaggtttagccaactccaagcccattcaattatcacttgatacacacccaacctatgtaatacttagctttgttcttagtcattgttgcaaagctcatttcacccctcagtcaggcttattacattcattcgtgttctcaagagacaagagggtcttgcccaaaactacagaatatcactatcacaagttgccattcccactagaatttaccttgatccccagtgatgctacatgcattattatgttagtttcttcttggaggtgttatttttaaactgcaagattaaagctcctacaagcttctgacaacatgaaaatcagacacgactttgcagtctttttaaaacaaactagtaagaaggtcccaattaagagaaaaagagtagtcacacatacctgtagaactgattgtaatttaccctttcatcttgctctaaaacacattccttgagtctcagtttagtagagataagattcacccagtcgggggatattagttcttcctggatattttaattaaactgttacattgagtagttctgaaaatcacatataatcattcaaggtatggtggagttctgttctccagcatatggctctccacccagccacattccatctccttaggtaaactagctggaggccttcagtgtaagctctttaatttttaaactcttgggtggtgctttgttcttcgggtagagagtagagcaagagaacgaattaccaaacagtaatattacccccatcgacaagcgggtggtgtttatatcacacatactatataccaagaaatgcgccacaccttttacatgaatactcattttaaaacagtaaagactttatatttagagaagttttaggtttacagcaaaactgatagtaaggtacggagatagcccacatatcccctgccccacatatgttgcctcccatattaacttccccccaccagactggtacatttgttacaatttgtgaacctacaaggacatatcacccaaagtccatagtttacaagaggattcagtcttggtgttgtacattctatgggtttgggtaaatgtataatggcatgtatccaccattacagtatcatatagagtagtttcattgtcctaaaagatcctctgtgatccgcctattcatccctccctccctcctaatccttggcaaccactgatctttttattatctccataattttgccttttccagaattccatatagtcagaatcatggagcatgcagcctctttaggtaggcttctttcacttagtaatatacatttaagtttccgccatgtctcttcatggattgatagctaatttgtttttggcactgaatcagaaacccttgttgggatgtaccacagtgtatttatccattcacccactgaagaatttcttggtggcttccatgttttggcaattaaggataagactgctatgaacattcatgtgtagatttttgtgtggctatgttttcaactcctttgagtaaatatcaaggaatacaactgctggatcatgttgtaagagcatgtagttttgtaagaaatcgccaaactgtattccaaagaggctgtaatatgttgcattcccaacagaaatgaatgagagttcctgttgcttcacatcctctctagcatttggcattgtcagtgttctgatttgggctcttctaataagtgtgtggtggtatctcactgtttgaacactcatttttgaaatatccacataggctattatgatcttcattttacagttcaagaagctgaaactcaaagaatgtagatatttcaaactggccattgtaagctagagccaagattcaaactcaagtttggtgaatttcatagcctatactttctatcattgaggtacatcttgttttctcagttgtattatgtgatttgcaagtcctatgaataatatatttaaattataccaacatgaaaactaagtgtaatcttcagtcaataaaatatccactaaatacttcaaaatatgaaactggaagcttatctaaatgaactaattctttaatatcaccatgaaaggatgatgttttaaattaagaagtgaagaatttatagtttccagattgagaataatttccacaaatttttattttcatcatattctattgtgggtgtgcatgtgtgtgtgtgacagacacatatgcagacacagagatatggggacacacacatagacactttccatctcatgccatgttggaacttcccagagacagttaaaattagctagctaatttccataaactatcaaaataaaattatacttattgagagtctagagttcctgtcatgaagacttagcagttaaaaagcatggaagtcatggaatctcagtgctccttcgttgcaatccacactcctgctacaattagaatcccaccaatagataaagtcatcaggagctaattagtccacgtgtaaaaaataaaaataagacaaagaacagacttctaaaaaaaacaaaaacaaacaaaaaacaacaacaaatcatttgaaccattgggtacttcgagtacatgaaaattgtgaagtaaattaattagctttgcattgattggtatcaaaagtcgttagccctgcactgcaaggaaatccccagaagcctaaggtgcatgaaagaaaaaggctgggaaggaaatcaatctctgctcttcaacgctgatgctttaaagggtccctgctgtataactcgcccggaagcattccagggggaagaacccacagatttatatctgccacacgtgtcactgaacacaaatacgtctgataaataattgaagctcggtattgtgcttacgtcgcatgtgcaaaaaaacagggacaggaaggcaaagaggtcaagtttcccatctgactttccaatgagcatcccaatcatcacttaggtcattattctacctcgtgaagtgtcagaactcattgtcttagggaatccaggtgctggcatcacatatttagcaaatctcatttccctctctctcacaccgcagagcactctctagtccaagcacagtgcagggcagaatccagagcttattttatttaatcctcacaattttgtgatttttacagatgaaaaaactgaggtctggggaatagaattgtttttcacaggcacaaagctggtaattggtagatctgggatttgaaccgaggtccaggaaactctagagcccatattattgccatactaggctccctctctaaataactttctcattaagtgagcagagagagaggagccagactgccctgaggcctttggtattaataggaggctaagaagctcatgcagctaagtctctttatccaacggcacatccctggaaggagaaaatgggctctgttggaatccttccactgacaggaagctctctacctcacataactacagacctgattactaaaaagactttggtttgcctttccaaaactcatatccagtgatcacaattgtggcctctgaagcagtttgattcaatactaattgcactcagtacttggatctatcataactgtaacattaaacaatgttttcccctcgcagggttcttttgaggatacagtgagtattaaaatgggctggtacatagtaagaatttgcccaatgttaattataaaaattttcctgatattacttggtaagttattctgttaaatggaataaacacccatgaatgccacatataaaccaacagctttgaccctcataatgacccccatctatccatgttgtcctcccccatttatcttcttgtctccaaggtcattatgttcctgagtgccaggttcatctttcttcttacagggttttattgcatgtataattggtcctaacatgctttataatctaagctgttttaaattttataaaaaggattccatccttatttaatcttatgctatcctcacaaacttattttcccccacttgatattttactatgaagaaattaaaagttacctacaactgaataataatgaaatgctacatattaaaatctgtacttataatagaagatagcctcaatgttaataaggtgtcaatcttaagtatacaaaaactgaacaaaataagttcatatttagcaaaagaaaaaccacaataaatatgagcacaaattgatgaaatagaaaaatattttctagaaaagatcaaaaaagtcaaaagtagattctttgataaaataattaatagataaacctttttttgttttttttttttgagacggagtcttgccctgtcgctcagtctggagtgcagtggcactaacttggctcactgcaagctctgcctcccgggttcatgccattttcctgcctcagcctcccaagtagctgggactacaggcgcccgccaccacgcccggctaatttttttgtatttttagtagagacgtggtttcactgtgttagccaagatggtcttgatctcctgacttcgtgatccacccgcctcggcctcccaaagtgctgggattacaggtgtgagccaccacgcccagccaatagataaacctttgacaatatcgattaaaagaggaagatgttttgaatgaaaaagtgaatatttattacaactaaaataataaatggctattgtcaacaactatctgtcaaaatttttaaaaatttagatgaaatgtataaatgcctaaaaatttataactaaccataatggacccaagaaataacaaaaagtttatatagccctatggctattaaataaattaaggtaattgttaaaattttttttgcaaagaaaacatcacaccaggtgattttacacgcaaatttttcccaatgttcaaggaagacatcattccaattttatgcaaactcttccatatgatagaaaaaaagagattattccccatagattctgtaaatcagtataaccctgttactaggaccaggcataaaaatcacaagggaggaaaattacagccttctctcacaaaggaatatagatgcagaccattcttcttagtagtatactcaattgtaaggcataacaaattttatttccaatatacaagtagcagtgtaacattacagaaagatttcattagctttggaatgtaccatttttctagctgtataatgtagcaatgttatctaatttctctaagactcagtttccttctttgcaaaatggctttttataatatctatctaattctgtgggaattaaggaagtaaacaatataaagcccttagctcagagtctggaagtaacagtaagcaataataagttacagcttctatttatcaagtacttagctccccggctgagtattttttttttttttaactctcctttaatccccacaaccaccctgaatggtggagattatgctcaattagtgaataaagaaactgagtcaagtggaatttcaacaactcacccaaagtcacataagttgcaaaaagtcacgctaatgtaacaatcgcagtctctgaatactgatgcctggggtcctttcaaatgtggagctgatattaccagctgctatcggggacacagcacttcctctgaggggcactggagttccttccacaaggcatggaatgtgttcaccttttcaggggaagcagttttcaagttggggtttgatttgtgacatgtgagattaaattgcagcatttctaatggaaaggcttcagagggcaggaatgagcgatacactgtcatttctccatctctgcgtgaggaaccttaagcactaatgagatcagatatgtcaccgcaactctctccactctgccacagattccaggtcagaatatttttttttttaaacattctggccacttcactgcctacctgcaactctctaccacgttcctgacatataagatttatgataatttaccttaggcagggcttggagttttattccaccaggttatcaaaaatgttgccaataatctctttcatattttcataggacaagattatacaaataatattccaccctattctttccctagagaaacttacatatcgattagacagggaggcctaacaaagattcaagagtcagtttgtcctatgagcgtggaaaacaccactcctgttaaagattacagagtgacgtcacttatgactatgctgtgcaaagtgctgggtttttttttttttttttgtatcctaaggggctttatgcttgtctttgtactattggtgccttgggaaggaaaacaagaatgcatttctcaacatttatgtctgcagcgatactgggaactgtgaatgctaacatatttttaaagagctctgatagagagaaaccaggtggtgaaagaaggtagtgaacaagcctggatacagaaaggtttagagtagaacttacgggcgccacctgctggtcccctgacaccactgcccagagcttccagttcccctaattggagtctcagctttatggccagttggctcagctgaatattattaaatgatttctgtcttcaactatgcttagacacagccttggagacaagtaagtaatgcagagagagtaaaagggagtgagtagatgtcaaagaatggtttgcccattcaacatatgtgtgactgctgtgaaaggtgtatgggagtttcccacatcatctatcagcaaaaagacataaatggtgatcttccttccttttcccaccttctttttttttttttttttttttttttgagatggagtgctggagtgcagtggagcgatctcggctcactccaacctccacctcctgggttccagtgattctcttgcctcagcctcccaagtagctgggattacaggcgcccgccactacgcctggctaattttttgtatttttagtatagacggggtttcaccatgttggccacgatggtctcaaactcctgaccttgtgattcacctgcctcggcctcccaaagtgctgggattacaggtgtgagccatcgtgcccagccttttccctttctttcttggagagaaatgatagcatctgaggaggcaggagcgaggggtgtcttgtggaggtgggtagtgatggcagcctgctctgtaactgaacatgcagggcaacgtggggagaggggtgctgcatggatgggggcagtggtgtttctagtgtgtgaggaagcagagcagaggatgagatgtacgcaggtggtgggcagtgaaggctaatattgaacaaatgagtatatatattaaggataatgggaaccaagtttctgtcagagaaggtatttataaatgtggaagggggaaaagacttagatttgaattgaagatactgatatgaattcatgtggcttatgtgtaaacatatacacatacccagatatggaaataataataagtgtgtgtttgtgtggacttatatgtacatatttcctagctctgtgttgactgggtctcaaagcattgacatcacaggaacaataagcatgctaagcacccagatcttgatttctaaaatcattctacacggacaggaaccagagctgcttggagaagtggctgattccaaggctggacagggacagtataagatgatcctggagcatcttttttgtaccagaatataaagaaatgctcaaagaatgatggggagatctggcaagtaccaactggaccaggtgatcaagtggggatacggtcagtgtggttgccttctgatgtgatatgctgagaagagctcagcagcgtttttgtggaattcctgccaagatggcatggaagaatacatgacttgagtctaataatgaagaaacagtggaagctccagagaaagagtcatcctacaggaaaaaaagacctatactctttaaggcaggaaaacacgagacagggaaagaataaaaatccattccaggctgggtgctgtggctcacgcctgtaatcccagcactttgggaggctgaggcgggtggatcacctgaggttaggagttcaagcccagcctggccaacatggtgaaactccgtctctactaaaaatacaaaaaattagccaggcatggaggtgtgtgcctgtaatcccagctactccagaggctgaggcaggagaattgcttagaagctgggaggcggaggttgcagtgagctgaagatcgcgtcactgcactccagcctgggcgacagagggagactctgactctcaacaaacaaacaaacaaacaaaaccattccagattggaggaaactgatgaaaaataataattaaatgcagtgtatgtttctgtatagcatcctggaccaaaaaagaaaatgtcatcactgagacagttggcaaaatgtgaatggggcctgtggactgaatggtagtgctgtatcagtgttgattcctgattggaagtgtttttataatagtaatgagaagagtgctcttgttttgggaaggtaatcaaacacctgaagagtgatggagcatcatatctgaaagggaatatctatatattgatctctctgaatgaaagagaattaaaatgttgcaaggtggataatcagggtgaaaggataccgcagttcttgctacccttctgtcggtttgaaacagcttcagaattaaaaaaaatactaaaagtgctgagctctgagaagaagaaaatagcataagtttaatgggaaaattatgttatacatgattagaatccttctttgttttctgagaagaccctttgttgggaagaattgatgatcaggaatgcaaatgagaatggccaaaggacagctagctgacttacaaaaagaaaaagaagattcggtataaagaaggagagaagggtgaccaggtatgcaaggagaaaaactgattgctagatattgagagagagtacttgcaaacaagcaaacagttgccatagggaatggaacttgtagggaaaagaaggatgttggagaaaagttgaataaattttgaagtgttaggtgtaatataattcttctgttattccaaatcaccacccataacatccacacccttcatcaacacccttaagacacaggtatttatttgtttaccttgtttgtttgatttaatgaaaagtatgagactgactggagaacaggtgcttggtgagcacagggcagtcagtgtgtatcagtatgtttgtgtttattatgaaaagtgagataaaacatctacataaatagttctaatacagggtagaacagaataaaaaggagccaccagagagtgtcagataaggtgtgaggaaacttcagaaaatagaaggaaaaagaatatttacattccccaagctccttctctgaaccagaaggtgggaattatacattgaaatagcacggtatgaaaatccagtaatgatccatgatcccccagctagtaaatggcagagcccaggtccatagaacccgaaagatctctttttttcctactatagtgggctgccttgtgcctgggtctgaagagaagaggaagaaagaggggagtctgatggacaaagctctgtggaggacgtggcactgagcagaaacttgaaacagagcttgactggctggcaggatgagaagaatggactcttggctgaaggggaagcaagcacaagcacatagagatgaggaagcatgggtggtggtatatagggtaagtgcaatctatttcaaagacagctaaaacacaagatgacccattccatggcaaacatggacaccaacaccatgtacaaagatgatgagggtgaggaagattgagacgtcagttatactgattgggaggctgtggaataggcagcactggcaatacttctgtgccctaatgtcattctctgaagctcaaggccaaacccactggggccaaactcacacagaaacatttattttcagacatcatttaaggaaggcaacacctgaaagatggaagggctcagtgcaaacttccagggtgctatttttgaaaatgcagaaactcccagtttggaaatattttcttaaaaatttccccatcattattagcacttctgccaaataatcactaactaaaaatattccctccttgataatgcacagataaggtctctgcactgaggaggaacaataaaggaaggtgatgaattgcaaatcaatcataatttatgcagatactctactgaaaatcacattcatcaccttttccaaatagcgccacatgaatttcctgaagtacaagaagtctattttcataaattagaccttaatttctttctctcatcaatatatttttatgccaaaaagttaaatagtaaacaatacagctgaggaagaaattatgaactagaagaacatgaaacatggtattcagaaggaaaaaaaaatagtcaaatatattttctatggcctttgctttgtgttaaagtgtgtgttttttccccaaaggattatgtgatgtaattggtactagttggatgatgaatataaacaaaaaatgccaaattatcacaagatgcctttgggaaaaaaaaaaacctgtaactgatgctacagtgtaccctgccagtatttttgaaagcaaaactgtactagttcatttttacactgctatgaagaaatacccatagctgggtaatttataaagaaaaagaggtttaatggactcacagccccacatggtgggggagacctcacaatcatggtgaaaggcaaaggagaagcaaaggcacatcttacatggtggcaggcaagaggccatgcgcaggggagctgccctttataaaaccatcagatcttgtgagacttactcactatcacaagaacagcacgggaaaaacccgctcccatgattcccaccaggtccctcccacgacacatggggattatgggagctacaatttgagatgagatttgggtgggaacacagccaaaccatatcaacaatcataacagcaatcagccagctaagaccaatgaccatccagcaagactcacttgctatttctctgtgttatctatgtcaaatggcaccttttttcttagcatcccgtttgtagaagagcagacacagagaatgtttcacaggtccccattctggggattattggctgggtatttaaatatacttttcttaggctgggttcctctaaagcaaaccctgaagacaagactttgaaggcaagtagttgatttagaaggtaattgcagaaatcaccactagtggagtgaggaagtaagatcgggagggaagaaaatgtgtgttattaaacatgtgattgctgtgggcaagagggactccgtttcactgggaaacactatagatacgtttcccagttattcctccacaagagcaaaggagcctgggtacttactcaccaacttccatgagtcattctgataactgctaccaaggggtgacggggtaggatgtgggctgggagattaaattcctagcactttcaggctagtttgcactgcacaaacacgaagtagacaccagtgactagaaaaagacaacagccagaatgtaatagtatttaaagatggaagccaggggacaatgtgtagaggaatagtcctatccgaggaatagtcctatccaaggaatacgggcagtacactgcaacagggcccttttaaggtgagatatttagaaacctgggtcaatgcttgtctccatgccaatgcagttacccactccctctcagccccagccactctacgataaagtcttaatgaacatcagagggacgtttcagggcctgctttgtgacgcacatcaccccttagactactccagtgctcactgatgtcccaaataacaagtcctctaaattattggtggtttggtctaattatctgctgaaagcattcaaaaccattgggtatccctgaaggagaaagtcacaatgctgcataagaagaaacaacgcctgcaacggataacttatttgctgtcatatgatcctatagcatcctacagatctccttccattagcatccatcacatctgtaattatttccttttcattatctgtcttccctgagtgaccataaacccaatgaagccagagaccatgcatgattattcattcacagctctactccctgtgtctagctcatagtagggagtcactcaatacttctgaatatgaaaacaagtgaatgaattaagattattaccgtcatccagcaggcaaaatggattacatagctaagggtctgttcttctgaagtaccttcttataaaggataaaaaaaggtgctccttcttccaggcagatgaagctctgagccagagctcattgcttaaccaaagcattgcagctcaaattcagctcctgctcacccattggcaaggtgcctgcggtagttttaagagccatcaacaaatatttctagcttgtcttcttcctgctgaatgaaaagtttgcccttccctgctcccttgaaattagatgtggccatgtggcttgccatggccaatgaaggaaaacagatatgatcccattctaggtggaagcctttatgagttcgtgcacaatttaccatatttgtttctttctgccatgacaaccagcaagatcgcagatggcagacagtgatcggcctatattcttaaaaggaagagacatatacacagtacctagctaacccacaaaaggcatatgatatgttttggctgtgtccccacccaaatctcaacttgaattgtatctaccagaattcccacatgctgtgggagagacccagtgggaggtaattgaatcatgggggctggtctggcccacgctattctttcgatagtgaagaagtctcacaaaatctcatgggtttatcaggggcttctgcttttggttcttcctgattttctcttgctgccaccatgtaagaagtgccttttgccttccaccatgattctgaggactccccagccatgtggaactgtaagtccaattaaacctctttttcttcccagtcttgggtatgtttttatcagcagcatgaaaacagattaatatagcatgttagaaatatacttgtattgtttaaatattggcgctcttcattcctgcagcatatctagcccactctggctgatctagtatacaacccgcagccctatatcctgtggccctgggcaggttaacacgacttgcagtttctttgttctcatgaactggtgttcatgtcataccctcatgcatgcattaccctctctctgcacacaacgtgggcctctaagaagcaatgcttttctgtggaagaaggaagagggggcattcagacttaaccctttctgcctaaaaggcccttctgaaattatatgaaagagagagagaaaaaaaaaaaaacattttgcatgctgttcatttagaagggaggcctaattctttcaccttcctataatctccagagcagttcctataccatcaaggctgcctctcctgagggggccagagcttcaggctcataattagttgtattactactactgtcactgctaattaatgatccacattcagcctaaattgaaactgcccatttctgactcctccactctaggtcaaatagatggttccttattttcaaattatgtacttcatcttaattgtataatttcaatttcatttaaaaaaagaaaaaaattaaaccaaggaagaaatgacattttctaaactggtgagttgggttatcaaacttaaaagcataaaaaattaatactgtgggattagcattattatagaaatacattaaatcttatatttaaataccagtcttttaaaccatggctgtcacagtgaaaatgttaatagtatttaaacataaatccttctccccatgaagaatcattcatcgtgcaagcacgttagctattctattcactttagagatgctgcctagcagagcattttaacgtaagccttgtcagtgttaatcctaatgtctgatgctgagatgtgtgttatattactttatgtagctgaaaaatgggaagcctttatgtcagattacaggctgaaataacgacctccccttggagccagggcctgggatataacgaggtgccaaatgggattctaggtcagagcctctgcaggacataaaagggaacagatcttttgttaagacccattcactcactaacagaatgcttttaccctttgcaatctactttatggctcctctgcaaagaagagtaaccaagagagaaagtcttgattcacagtggggcttaccagccaagctttggattcaggcaggcgatggtggaaatgtacccagccactccttcacctccacaaccaacagtctagggctacggtgttcaaattgcattcatcaaattcagagtggggagtgagagcctgaggttcggcagaggcaggaacggggagagagagcatcaaagtggatccagtgccttctccatcctcactgcatccagagcagttccctctacatctgttttatataccacagttttatgaaagatggcacatgaaatatggttctcctgttaaagtaactcattaattcaacaaatatttaccagccacagacaataaacccctgaataaatgagcacatttcagagagtgatagacgatacagagaccagcaagcatgatgatgagatagagagtacctggagtaagggccacttgcagagaggacagggaaagcctggctggggtttggtggggaatctgagctgagtcatgaataagcagaaacagcaagccatgtgagatccaggaagaaccattccacgcagaggaagtggccagtacagacagcctaaggcagaaacaagcttaacgtgtccaagaatagaaaaagggcaatgtaactgctattgggtgaataaagagaggcatggaaaagatgaggaaggcagatcattcggggcattccagactcaaacaaggagtttgggtgtcattgtgtagtggttggaagccaatggaaggttgacaacgggggcatgacaaaatctgttttgcggagttcttccacacagagagtagattccaggcacaagaacataggctggaggatcaacaagaagactgttaccttccaggacctggaagagagttgcagtgaagatggtgcaaattatctggatctgggatatgtctaaaagtaaatctgatgggactaaaggattacttgaaatcactaaccagaatttgagaaggggagggtggaacacgtggtatgtggggagggaggagatagtgcttagaaagaatagaataattgccacttctgtagatagcttctggccaactgacttagcaaagagcagcacaatatccttgggctgagaccagcgggtttgccactgtctctcaccggcaatcgcattcttgcttccaaatccggctgataatttaggaaggttttatgtcaccgctgctcggcttctttttgtgctttgattacctattctcatacaacacttaaaggtggtcacagaataatctctaatgttttgctttctatgataaataaggggttcgtgaagttcattaacagggattgcatcaccctccaccctcttttacaaccacaccataaaagtagcctctaattagttaaaagactacaaattataccatcaacgtgaggtatggcaaaatctgatggctctaattatcttaataatcagcagaaccactctcaacctaataagagaatgagtcattagtggtagtttatgaagatcaccgacattctctttgttatggagtttgtccttcctgtgttaaaatttggacacactttctacttgaatctaaaaaggatgatttctaagaagttactgaagcaatgcaagatcaaaacataataaccacattcattcttaatcagcattacagtgaaagtaatttaccaaagaacacataattaagtcataaatgaaatctcaagacagaaattgctccccttttaagatttctcattgtccatacactcagaaatgagaagagggattttctcattctgatcctaaatctatcactgaaatgatgacttcacttgcatttatgcattttgctttattttgtgattactttatctcactatcctcccctttttctgcttgtgtgattgccttaatccttttatctagaaccagggggagttccattagcttcagctttttggtatgccttagccacagaaaactattttgtgattcaaaactgctctaaaattcaggaccaaatatcacatattatgtactccctagacttttgagagtttcactctagattatagaggacaaaatcatctccccacctccaccttagggtatgtactccccatctcaagtcataagataaacctattgtggtcagaaggcagagtactctaataaccttgttatagttgaagagactgagtccatgaaaaagttacggaccaaggttatacacagagctggtgacagtcttgaggctaaaacccaacgttttactcttagctaatgttcttttgggcttaatgaatgaactactgctgtggaaatgtttttttttttttaaaaaaaaaaaaaaaaaaacctttcattgtgttttgccagaataaagactgaacatggccctagcggaagagctaaattcattatctttaaaaaatgaaattttctcaaatcataaatgcagtcaccaagtgtaccttctttctctgcattgcagtacaccaaaatgccagtcctctctacaaacacattttatggatcccaaagcagagagattgacgttgttccatttcctgttcacagtataatcaggacaaaggaataagattagtattgtgccatttccacgcggaaaaaaaaaattgttttctccatgtgactgtcagtgtatgtcaaaatgataatggggaatgtgtaatacaagatattgctacttatcaatggactctgaaaagaaaattagctcaagcatcccttgatataaaaagcaaatatgaggtcttgaatcacaccatcctgctatcaacatgttttgttacaagtcagtttatgttccttgagtaccacgtggtttacagtgcatttctctgacagcaatacagaacctcaaacaaatattacccttgcctccaataccaaccaacattaaatacaagttctattcctgaactcagtggcattcagaaattcaaaatgcttagatgccctctccatcgatttgcttctctgggtattgggctgacttcctgttcatcagggggtggtggtggtggctggaggaggaagtagatggttttaaccatttgtaggtctaattactcaagctcagtgagcccacattgaagaaggagaaggagaagaagaaaaattctctttcctattgttcatatataaaatcccagggaaagattctaatcaactctgtttggatcacatgcttactccttgggccaatcgctgtggccaagggacagtgtagcttaattaggcaagcctggttacattcccatcctgttggcttggaaagggggatactatgaccagtaaaccaccccaaatcatatgaaatgtaggagaacggttatttagtgaaaatgaagcactattatcagaaagagttggaagttatactagcagacagaaacaacaacactccactgcctttcaaataagtttattatgaaatgaaactacggctcctcttttctaacagaccgattttgtgattagaagtaataggtttttctcaaccaacaagctcaactagtttagctctttctaccagatgagccaagaataaaggacacataagggtctcaaagattatgctttctatcctgcccaaattctgtaaccattaccttttcagtaggtgatacatttcccaatttagacttcacattatagaaaaaaaccatccttcactgagttgtatttgataccgaatgcctgcattttcatgtactagtcattattccatctttccttaaagaacatccttttttttttttttttagacagagtctcgctctgtcgcccaggctggagtgcagtggagcgatctcggcatactgtaagctctgcctcccgggttcacgccattctcctgcctcagcctccctagtagctgggactacaggtgcccgccaccacgcccagctaattttttttttttttgtatttttagtagagacagggtttcatcatgttagccaggatgggctcctcctgacctcatgatctgcccacctcggcctcccaaagtgctgggattacaggtgtgagccaccacaaccggcgaaggatacccatttttaaaataccatttaatttaaagttaccagatgaaagctgcccactgtaattccagggaaattttactcttagttttcttctttatggtcacccaaatctagattatttgaattcttcttctgcagtaaaattaattataatcatagcttccaatttttagctgctacttattgagtgctgactattcttggcatcagctatattatcattaatcctcataccagcaattattatcatctccattgtatagctggggaaactgagatagagttcaaagaatttactcaaggtcatacagctgagaagtgacacatcttggaatcaaacccacctctatttcactaccaaatgccttctcctaactatatactctacccctgcatcgcgagcatcaggcaccgagtctctccaaggctctgtgataaatactactcttgtgtgacctcatgtcaccctcacttttcactcggaatataaggattcccattcccatgtcacaggtgaggaaactgaagcttaaagaaattcatcaacagacctagtttgccctgtatatagaaaagctcaggtagtctcatattttaatctctttttagcctccttttgttttgtttcactcagttcagtcttaacgagtcttaatagtcaagaaaataaaatcatagtaaagaaaacaacaaaggtatctcataaggacaagaactaatccatcccactcctactgggctggctccttttggcagtggtgattgctttctcagatgtcttaatagaagagagaatttgtgaaagcagagagccccattaataaggaaggaagaacctgcaaggtgcaaataactaatctcttgttgctttcctgttaaggtaccatgcatgtgtcaaaaatcaaaaccagggagcccagcctctaatatgagaagattccagatttcaaaagcactaggtactatttgataaaccaaacattttccctgttattgctagaagcagacacacataggcacatttgcatcctctatattgatacttctcaaatcatccatagtaaagggcgtgtgtgtgtgtgtgtgcgtgtgtgtgtgtgtgtgtatttaacctctatttacggcagtctgattcatgaccctactgtaaatgactactacatagttcataccacatgtgacttgccacacaagtctgatcacattggaactggtcttctccttgttcaataggataaggccaccaattatatacttggatgtcatggtgacttcaaattgctataaagtttcttatccaagactgacaacttgcatttcttcaggactggcactgatcctccagcgacattttgaatggcctactccataattttttgatacagggtagcaaatactatgcctatagtggcaaggaagtgtgtactctgctgaggaagtcacctctgcagccaccagaatgacatttctgaagccagtgagagcaatatcagagagcatcaatattgtaaatacgttttgatcttatagataacctgaattttgctgtgtgcgctattaataactaatatttgtaagaatctcaacaattttcaaaatgctctcttatatgttaacaaatgtagccctactacaatcctgtaacatagtatccttacccacccccccacacacgcacacatacaaagaccaccacctccaccccatttttcagatgaggataatggggcttagagtatttgggtgacaaggctaagctcacataataagttttacaggctagcaggaataacaccaaagtttcattttatttgcccactccaaagaactgataatgacagccagccaggaagctacttggaggctgtgtctgggttcagtgggtaaagagtctttgagagattagcaatgtctgccgggtaagaccagatacactggatacccttggatagattccaatccaggtagcctaatttccttttccacatcctttagcactccacatagagttgtttctcacaagtatccacatttaaaagaggtaacctcccagaacagaaactagctgacattttggaggcaaagtctgtttctcttgcgcactgaagacaagaagagtcaatttgtgatacgtgttacagagataatacacatctaaacagcggtgataaatgcatgggaattacaggcaaaaccaaggtgatacaaagtttccaaagattagatgtatctcagattaaactctccagattatactaatcaattacagaaatggggctgagtgggagtagtcactgaagccaccgttgatgtactttccctaaccattttatgcaggcattccttcatgggggtctcctcaagtcactggagtcctcagcaggggaaaggaaaacagcaatagagaaggaggttaggatcttgggcttcattttgggagtcacagtactaaaacatcacctcatgattagcagataaaaggtgctgccctgggctcaggcaattacaggaagaaacaaccctaaagcagaattcacaacatactgagttcatgaggagggcgatgaggctgatgtggggactggcttttcttcttggtgactcaaagacaaagccagcagtacttatttaaaacatgccacgtgctcatgtttatgtgaggagtagaagacaacggctttggtaaaggagaaaattcactgcataattgaatctttgaaattccagagggaatggccttttctgagaacaatgtctgttattaacagaagaatttcgaggccaaatgcagagttttccaccaggttgcatagtgagagtcatattttgaatggatatatagttttttaaaaaaagaactctgaagagttatggatgtttctcaatatctttctcaagaaggcaacagattttggactcagcagataaccctttatcctatagctgtagtgatgatgacatgataagctgtgtagcctgagcttagatgcagaagtgaattctgggcaagggtcccactaacctgtcttccctgggctccagacccacatccctagctccttgttgggggctccaacttgtacagccagcacatcaggctcagtaggtacaaagttgacatatcaattttcccatgaaaagagatcttgttttgacaacactagtctttcagttacctagactcaaaatctagaagcagccctgctcaccttcatctccttcacagcctgaactgagtcaagggtcaaatcacatagctgggttagagatatttttgacacaattccttccttcctttccacccactttgagttggcacttgcttaaacactccctgttttacctctggatagttacagtgcccctcacttgtttcctcatctccagtaattatccattccaacccatcctttaaacccatgccaaaatcactttcataaagcttacctccacattcaaatctcagtactctaccaggcacatggtggctattcaggtaatattttctggatggatggatgggtagatggacaatgtatttactcatcatttactatatgcctgacattgtgctgggtattaaagacagcaggaaacaaaccaacttctaacaaaacacttccctgctcatgagccttgaatggccaattaacataaatggttcattccagcattcaagcccttctgcagcacagccccattctaattgtttcactggtcacctactctcccatctgtcctctagccaagggtttctgaccttagcactattgacattttgagccagacaattctttattgcagctgctgtcttctgtattacagcatgttgagcagcatccctggcctctacctacttgatgctagtggcacacagccccactcaagttgggacaagcacacatgcctccagacaatgccaaatgtgccccgggggagaagagtcgaaaagaacccaactgagaaccactggtctagggtggcgcccaatttacacccactgtcctagggaaattattaatagtactcccctttcactttcacatgtgttccagtttagaagacaaactagattggttccctgcttaaatctcccgagacagcaaccttgctctgttctcatgcagattgaagaggaaagcaacaaattagtatgaagccttcagcttccaagcaacacttttttttttctggtgaaccggtctcctctttaaagattcaacttctctcttcttctttcagcacatgcagtactgggaagtaaaactggcccaaatgctctgcagggaaatgtgaggatcataagctatcctcgcctctcaaaaaagaatcacaaaaatatttacagcttttctcaaaaagtttcatgttccaaagatccccttctacgtcattctaaccccaaatgcctcaaaaagaagttcaaagctctcaagtccatcgatccaacttcttctctggccaaaaaacaatttcgtgccatgtgttaatgcaaagggctcatgctgtattcacgaaatgccaagacacctggttaaaaagttcaaaaaagttaaaaattgatccataatttcgactagcatggtagttctcaagctttactgtttcagaattccctggagtgcttgctgaattggaggttactgagccccagtcagcagagttgcagatttagtaggtctagggtgaggcacaataatttgcatttccaagttcccaggtgatgctgatgctgctggtccagggatctagaagatgcccgctgctccctgcttattccctcacagactgaaacgtacgatattacggggttaggacagtgggcttgggaaagaagggagggaggtcaggagacttcatccggctgcttgcttaggttttgtgtttttcattttttttttttgccagttagtcagaagaaaacgattttaccctggcctgtgctgggcaccatgctaggcactagggatgcagcaagaaccagacagaccttgcctcctgctgttttcccctttagagccacaagctcttctatgggctccaattccattccttctagcactccctttcagttcatcagctgctaatcagcaccttcaatcactctccaaatccccacaagacagcttccatttttcaaaagcaaagccaaagggaaaatcaagagtttttagaagcatctcctatttcggcaagtgcttccctttttgactctgatccatttcatcaaaaacccttattagagtggtccttcccaggtgtatctttttagttacctctggagataggaggtgcatccagtttattctttctgctttgtttcctgtccagaggagaagagtgctttgatccaacactgacaaccacgtctgcaggggcctcagacttgcttccagggaacaatcactcagcctatgattttgaatgcttcttttgtcactgtcaccaaagcctgagggaaagcaatctacacgctggttgacctctgaggcgactgccagaggtgccagctgtttcccctaaactactactcactgttgaatgtctaggtttccatctcccagggaagacattgccccagcttacctcttcatcatcatttgggaaggccagagaagtgtgggcgaagccatcctgcctggcgtcctcaagactcttgtctgataccagggctctctctgggtctataatctttgttcagggaatagggaaaatgtcctgtgatttgttaatccctcctgtgcagtgagggggaagttttagagtaactatttatatttttgtgatatcaggagcatctagatatctttgcttacaagtttttttttataattttagcaaaggaaaattttatagtttttagcaaaggaaattttacctttcatcataataaaaaatgtattctagaggccattattcatgggttaatattatcagggagctaacgatggcttaacaagagatgggaagccattttggaagtgttctattatggaaagagggagggcctgtgacatggattcatatatcatattcatatggattcatatgccagccatgcgtcagccatgagtaacatcatttcttaagatgtcagagtttttcccaagcacatatgccctcaggatgagaaacaactcgtctgtttgataaaaaaagaaaaaaaaaagaaaaaaaaaagattttagttcaagaattttatagattacaaatttcagagattctttattccagtatagagacacagaaatcaaaaagaatcatcactcaaatatacataggtctattaggtggggacacctggtagatgtaattatagtttcatatgcctgtatttaatgccactgaactgtactcttgaaaatggttaaaatagtaaattttatgttatgtgtatcttaccacaaatatatatatgtatatatgcagaaaaaacatatataaatatatattcattaattaggtatctgaatagggagctatgatcttaaaaaagattattttttcctaaatggcaatgtgaatttcatgtggcttaaaatcttctagtatggatttttggtgtttgataagctacattatttaaactagaataatctggaattatagagaagtatttggcttctggggccactgggacaggggcagggagggagtgtgggagcagcacccctccccagcccctgctgctgtgggagttgggatggggatggcacttccctcaaaggagaccaatgttccattgtcagtcaacttagggcacaaaacagtcttcaagagagaagaggtggaggggactcatacctttggtgggagataagcccctgctacagggtaacacaggtgaaggtcaaaatgactagtagagaacacctcctgccactaaggggtaagagtagtaacatgtaaaatccagctttaagctttactttcctgtgttagtatcagacactgctggttgtctacctactttctgttcccccttcttacctcactaacgtaactccaattttgagaggaagctaccctttttcatttgttcaacttcttcttgggaagctaatcttacccttgacccaactggcctaagccactgataggaataggaagatgatacaattccggtcattcacatgctcagctagctgaggagacatctgtgaaacagttccttgtccatcaaaagagacacataagaagaaatgagaatcattcttttccaactgttaatgggtctagataggatggctatactactgtagttattgtgtgaccatgaagtgtgctaaccttgagccagaagccaatgcagggaaattgaagagtagaaagaagggaagatgttatattcttgagtatgacatttatgcaactgatgtaaccattcattatctcaaaggtggaactatcctacccttaaactccttactattggaactttttgaatcatgatttctataatgtgctgccaaaatcattctacttaactggttcagaattgtaattctttcaggtttttcctaaagccattgaaaaatggtttgtcataaatgactgtgtagagttgacagggcctttggaaaactgagtgggtgctgatgaccatacagggataaagtggtcatggaacaacctctgcgacatgaagatatggctgcaagcagcaagagataacaagcaggaaggcccagagcagtgatccatagcataaagtgacaagtgacaggagggacaggcttgtgggacatgtaaacaagccctatggttcttcagaaatacgagtggagaggaggtcatttaagacattgaccatgttcagacatgcagagtagaggcttgggctatgatcatcagataccaaaagaaaaagtaaaaagatgaagattttagagggattcagataatactggctataaggaatatcacaggatctcctgccaagaaaatgagattcctatatgatttcttatatctctccatatgtttcctataagaatactagccatcaaaatgacaaattcaaattggtatattcagacaaatagaaagaaagtatttccctatccctcaaatgagttggataaccatgaatggtgagtcagatgagaaagaaaatgcaacagctctcactcagacctggacaaaatgttaaaagatttagtaggatggtcaaaaacatagttttcaccttaactgcttactttcaactcttcattggaataaatgcatataggccaaattaataaggaataagtagttatattttaggttaatagttgtaccattattagaaaaaatctgcctcatataaatgcagccatgagcacttcctcccctttaaaaactagtataataaaaggaatgactgattgtacttggcatatttcccctctctgtggttgcatttcactgcagttatgaaaacataatataatttttcccaaggccatggttacctgacagaagcatttaaaaaccaactacactttggacttccaggcacgtgtgtgtgtgagtcataagacagttcagaagagaaattcatatttgacatccagagctccatcttcccgcctcaagtgtctgtgtggatgtacttactccagtcttacctgagtttcaataatatgggtttgtcacaggttgttatgggctctaactaacagctgtccactgcactgagaactattattttcagaggcaggtcagaagcccatttctgactctcacgcattgtaaagaaatgctgaccccaaagtgggattctttctcaaatacactcaccctgtaagcaccaggtagagccaggagctttcaaaagtgctctgagtttaaacatttcacagcatgaggaacacagccgaagagaaagtgcaagaaaaacaatataaagacattattaactgtgtgatcacacaagagtgaggcctccagatgggccacctcatagttattgacgagcgtttagagaagaacattcattactcgatattgacgctaacgagaaagggtttgagagcaagtttaaaatgtagaaggaggaaacacccaaaccccatccccatggcagctaattcactgttcccaacaattctgcatgctattttttttactccccttgttcatatcttatactgtgattaaacccaagcattctgactgtaaaccctttttttctgtctatttcgcataggcttggtgtgttaatcaaactgtcagcaaaggaaaaaaaaaagaagaagaagaaagggcacattctatccaaatgaagaaaaatctgagctttctacaacaaacacattttccagtggatgagcttctcacacagtaattatttcacttctcccagagattactgattacatcacacagaaaaactaaatgagggctgttttatctttctcatctctctgtggttcttgtgcaaacttatacttgttatcatgaaaaatgacaaatttgccatctgatcaaaatgttaacaaggtaactgtcagtgagatggatctctgactgtcactgcaagccagaacatgaggatacattgatatttctcaatacagcccctgcttccccaacgttcactaactacatttccacagtaaggtaataaatcactcagaaataacgagctatataggatctctggggtatgatagatgtgtcctaacagcactatctgcaagatagaaaacaattgataatgatctaaagaaaaccctaatcaactgccattttccataatggggtagatgaagcaaagatatgaaatcttaactatgtgatgcatgttatgacaaaaccggactgctccaaaaaaaacccacacagccccaaacaaaacacaaatgacctaacattacgtagggtcgaataaatgaaaaataaagttaataacacagtctggatacaaacattatattggacactggcaatgatgggataatcacagcaattgctgggtccacaaacagctaaatagtggagggttcctcatataacatgaatgaagactctggctcagttattggtttaatgaactctcctccaatacttttatgttctttaagactctttgggccacattatttctgagcctttaattcaatggtttaaccaatcatttcccccacccccccccccccgccccttagcaacgtggccaagtgccacatccaaaggaaccaagagagaagaggagaagtccatatggaaataggaggtaatcaaagacagaacacaagatagaaaacttctgcaagaagatcatggcttcagatcacagggacaaagaagcatggcatcaaactgccaagaagctgcctcataacgacatccctttaggttttaaggttaagaagtctcacatagccacagttggtctcctgcctgtcccctctgctcgtttgtctttggccattcctgcttctgctgtttgtagaatactccaagcgccttccctccccaagaccttgtgcctgctcttctctctctctcagggatctctctcctccctggctccttcccttcatccagcttaaatcttccccaaggaacctgccttgcccttcggtttcaaagtagcctctactaccacccctttggtctctatcagcttcatcgatagcagaaagaaccatgtctgtctggaccactgtaatttccaggcttctagcactttctcttctctagtagggattaagcacagtcccaatcctgggctctgggatacaggactgactagccttgaatctagtgccacaactaagtacctgtgtcccactgtgcaagcactcaatttctatgtgcctcaggtccctcatttgtaaaacagagagaatagcaatgcctataaatgacagcgttttgaagactaaatcactttatcaatgtaaagagcctgagatagtatcaggcatacaggaatccatcaatcagctgctgtttttataagagcaagaacagaggtaattcagacataaagtgaattaattcatgattatagacgttagatcaatgagtcaccttcatcattccaggtttttattttaccattagccaaaacagtattgtgctccttctaattccatattctcagactacatggaatgaatgggtattggtctttaagcctctttgagcaatgccaataaatacagtcacttccaatttgagggcacttggaatagcagtgctattgttcctttgacatctcaacagcacttgaaagtgaaagaaaaaaaaatagattaatggatgtattccctaaagcaacaaacatgtttgatgtataaacatatgttatgggcaatgacgctgtacctttggtgccacgtctcaacaattctcttttcatctatcccctaatcatgcaactgaatgcttccagtaggccacacagtagggacaaaatgatagtaagaccacctggctatagatacctgcttctagagaggccaggttccaacccattacaagctgataaccatatgtatgatttttgctacactggccaagtatttggatcttttttaaacatatttgattatttaccctttgattagaatttgtgaataaaaatgtcttttaagagacacaaaggaagggggtacgggcaatagctcattactaaaaatcattttagtgtggaaagtgggcttcactattcctataaggcagtcattttcaaacttcagagcatcacaagccccctgttagattctaatagaaccctgaggaaaatgcacatacacataaatgttcacatataatttctacaggttgaaggacctcccaaaacaaaacaaatctatcaaccacaaactccagtgtaaaaaactggctctatgaagacttcaaatcaccctcacttcctttgcatataaccatttttttcttcagacaaataaaaaatacaattaagtttaatacaagaagaggctaaaaacattaggatagaatattagagtttaaagatctttgcctggttatggtctaaagatatttgctttgattaatatatggtgtaactcattaattaaatgcaaattgaaataagataaacctgtccccatatcatttctggtagacaataatgtgccagttttctctccaataaattagatgaggcaagctttctgttactaaataatagcaatatgggacaggagaaaaaaatttaccatgaggtgctttggaattattcacatgaagaactttttatttcttactttctttttcactaaaatagtactttttctcattttcaaccaatttttaaatatgaggtgtttacattgcttactgttcaaattagcattgcatactttcaggcacagacatgctcaaaataggagtcttttgaaatgcctgcattcagtataaaacacactgctggtaggaaatgcaaaatgtaaaagtcttaaaatacatttagatatggaaaacaaaacatttaaaacatattcacactttaacatgtttggaagtataaagttaatatcgtttatgaaacaaatttcaggaatcatactattgaaacaccctcacatcttcaattagctggattaaggaaaaaaaatattaacaatatttaaatgcagaaaacagattatcaggaagagagatcgttatagcaccttgttttcactaacaagcagagcagactgtaattgagttttagaaatccctgaggtggtaactcggtagagaaatccagacttggcaaggaaatcaagtttccctttaattacattatctcaatcaaagagataactttcacatccctacaaagcaaatgttttaaggagaagtctggcaaggaaagtaggtggaggtacagaggggttaagagtttcaaataacttcatattggtaggaggaacatgtagaaaactgaagtacactgtgaggaagaagacagatgccctggcaaatggtgctgctcccaaaaacatatgacacctaacaccttggtccattggtcctgctttcctatatcagccttggttttgcctttgtcactgaagaaacatggcatgttccttagtgttgaacacataagcctaaagctgatctacagtttcttaagctgataaaaggcaaagctaaaatgactttggccatgactatgctgttcggaggaggaaaatgagaatgttcagtggaaattattttcttggcagtgtccttactaggtcagcaaacctccattctttccaaattttccgggtctcctgcttatttcaggacccatataaggaggatataagcagtgatgtgtgagagctggtttgtaccagatcacaagagctgtttgtataattttcagaaattttgtaagctggtagcttaaaaagccattaaaaattaaattgtgtaatttgaaagtaataaatattaaaaacaaagggaagaaaatattaaaaactctgtaattcctcataatgtcactacattttactattgtctatgctcttaggttatatacatctgtattagtctgttttcatgctgctgataaagacacacctgagactgggtactttaaaaagaaaaagagatttaatggacttacagttccatgtggctgtggaggcctcacaatcatggtagaaggtgaaaggcatgttttatgtggtggcaggcaagagagaatgagaacgaagtgcaagggttttccccttataaaaccatcagatttcaggagacttattcactacgacgagaatggtatgggggaaactgcccccatgattcaattatctcttacagggtccgtctcacaacacatgagaatcatgggagctactattcaacatgagatttgggtggggacacagccaaaccatatcaacgtctattgtatcttgtggtggaaatactctcagtagtgtgctaccgcacgtctctttccaagtctgtgcagtgacatcaggtttgtagcttcaattcagccatatgaactggaaactggaaacactacagattaactgttttcttggctatctagatttaagaaagtgatgggggaaaataatgattatggagacaaagcttaaaagcatattgtgtcaatagctgttacatggtgaatagtacaaaaaattaagaaaataccctttagtgttctatatctattatctgatttggcaaaaatgtcactcatatgattgacaaatgagtaaagttttgacatatattcttaggcttcacttttgtcttgtttatgtaaacaaaaatgtcaaccaatattcatgtctgaagcacacctgttttgtcagtgacatgagcaactttgcttaattgggtagtaaccaagcatttattccttatctgaattttcaaatcatggctgaatcacaatcataagttgactgtgattacaggaattcaacaaacattaacaaaagcattctgtgagaatcaaattggctatatagaatctatgataaagattggtgtatattttatgattactcacaaattgtgtggtgcacattttatatcagtaaaatttataataagcagtcagatgtatgagggtatgtggatatatgtttttatatatacacacatacatacacacacatgcatacacaaaaaccagttgttaatatttaccagcacaccactggatatcaacacaataaagatatactttattgtgtatctcagcaaaaactgaccactcaacttttctagggacaactttattatggttggaaactagaggctaagacatttattgtgtcattgttgaagttccgtaaaaccatttcctatctctaaagttatttatttggctataatgccaagctacaccagctacttccccaaaagcaaggctaccagatggtgacagatttgaaagctctttctcatattttgagggtaggtaggggagtcacgctatgggacagtaggaaaatccacttttagcaggcaggatagaatgggagaagtcaacaccttgtcagttgccaatgagctgctgagaagtagttacagggtatatagcaggatagtattaaactgaaaggtcattaatgtgagatccttgggacaatatgcactctgtatgtctcaataatgttaaaagattctgtacaatatttgattgtatccaaatagtttataactgtaacatttaatttcaaggacaaaaatgaacttaagtcaactattcctgtggttttacatttcagagagcagtaagaaaaattcaccaaaacaaaataaagcaaaacaaaaatggagtgccaaaacagatttgctaatttttaaaaatgtgttcaaataaagatattttcaaatccttccttttattatcacccttatggcgcaaaagaaagctcatcagtttgctattaggatcatttggtagcacacaaagtccattttctatatatgttcagaagaggaaacaggatgagcattgggctcagccactggagatcacagcttcatcatggttcaacctcatcttcagacactgaaaatattgctgaagaaacaggaagcagcattgagcacggggggctgccatgtgtcctctccactgaagatagtctgaaggatacagtgaccgcaggaacaaaaatgccctcagaaacagccctaaagggcttctagaaagtacatgctacctgatgctttttttttttttttttaacgattgatgtctctgatttgatttggtccaagctattctgagaattcatgatggaatgagaacatcagcaactgcagcctattggatttcggtttagtagagtacagtgctctgtttgatcatccacttttcaagagccagcttcacatcctaactgcatcatccttgcaaagctctgctactttgaatgctgctttttttcagtccctgaaatacatgtgcctggggtgtcaccaacaggtgggttttttcctctgacttctttccatgtaagcctcaaggcatgtataaaggacatgagcgctgctttcattttccaaaagaaatcagctttatactgggaattgcaagcacgtgccaggtttcccatagtgacttatatgaactcgcacatactcagggtgagtaaaactagcaggcaggcaggcctcaaccaagagcacatttgctagtttttcttgaaatgttcagaactctggccctaagagaagctaatgccaggcaatcccttgcaaggataggagggttatgggatcaaggcaaaagacacatttggggaacaccattccattgggcaagctctgatatgcagaatctaaggcagctttctggacctctgaatatcatagcatcgcagtggcttcctgtggctctgtggttacagaacaatttctaccaaatgaagagaatgacagaagcaaggacctccacattcctatcatatgtgacagtctggaaaaaggcagtgttcattcttacctctcctaacttcactcgctcattcccaggtgagcctgaggccacatttcacctgagcatcccagctcctacagtcagaggaaagaacaaacttcactcccactgaattaggaccaactatttactagacactgtgcaggtattatgttactgtctcagtctgtttagttgtcaccataaagaaatacctgaggctgggtaattcaagaagagaagaaggtttatctggcttatagttctgcaggctgtacgagaagcctggtattggccttggcttctggtgagggcctctggctgcttccactcatggcaagggtgaaggggggctgtgtgtgcagagatcacatggggagcgaggaagcaagagagaagggaagaggcaccacactctttttaacaaccagctttcatgggaactaacagagtagggagtaactcaccaacagagaggtcattaatctattcatgatggatctaccctcatcacccaaacacttcccatgaggccccacttccaatattggggatgaaatttcaacatgaggttaggagggcacaaacatccaaaccacagcaattactagtcaattatttccgcagtccagtgagacagttttctgatacttgtttacaggacaagaaattaagtcttttttgtctattagacattcatttattgagaaccaactatttgtcagaaatggtgctgcagggctaccagagaaccagacaaatgtggcccctgacctcatggaatttgcattcctgtggcactcaaagaagtgagtacctaagcagtcagtaaataactttggctggctggttggctaagtgtgtatggagcagggaggcttggaagggggaaagtaacaacatggaaagaaaagcaattgtgcagggattcctagataataagccaaagacccagaatttgaacttcagcctaattcacttttgactttatcaagtgacatagcctcgcagatcccccatctcttcctatctcatattaaaaacgaaccagagcaagaacagtagcagtggaatctttcccatggcccatctctgttcgctggagtctgagcaccatctttgggccaaaagcctggggaagaacaggatctaaattccacatttgtggtgaggactagaaagtttcagaacattgcccttttaaactcatctttattaatattctttaagcgcacaggtaatgagaaagtgcaaatacagccccctctggctgcagcagtcagagagccaagaaaaaactgcatgtcatgccatcctattataataacagattaaaagggcacaaacagggtactaattagcagtcataaaaacttgaagctccagattgctcatcttcatatctgggcagtaaaagtaccacgtgtgcagataacatagaagtaaaataccagggtgcaattgcccagagctcagccagcatcagctgagagaagcagttgcatccagcagcacatcctacactttctcaagaatccaaaggcattcaggtgactgcccaagaattaaaaatcagccagcccagagagaggcaagtgcctcctaactcagcaagggacagcgggagaccttgccaacttctgattgatcgtcttcaattccctttctccaagatgtattcctgtccatggtctctccctggattttatgcagaaagctacttctgagaaatgagagggttttattagcatgcaggggccaaagtttagcctgaaggagagataccttcatcaataaaatcttttttgattaaattcagtcttttttcttgggtctgctcagagcttggaaaataagacgggtgtactttctaacttttatccccaatttgttccctgaggatttcaaggattctgttgccatcggggcactctgaaagaagaaaggaaggagtatgctttctttaacaagttgtctcttaacaaattcatacccaataattcaggcttggacattcactgtactcacctagcttggccaagtggctctgtattctatgttaactgtgatctataattttaaaagtagtcatgcatagcttatatagagaaccatcttttaaaaaatactctaaattttgttctaataaggagaaaagtgtatctacattgcatgtgatactgaaactagacaaattccttgtagccttttatctgacaacagctaaaaggcccaaattgaaggcaaagcaatgatgcaagtgaactatacaataagcacaattgtattcattttatttccaacattataataaggaccatatattattcactggtatatattctcttcactgtacagtgaaatatatgggaaaaaatcaagacccttctcttttaaacattagctctatatcagaaaggaaatggtctatatttattgattttctttgagggatctaggtaaatatcacagggctatgactgggtcctagtctccataccaccagtgatatggcttgtccaacatgacctttagaaagactcagagtttggctttgtgtttctcatctgtcttagtctgcttttgctgctttaacagaatacctgagactggaagatttataataaacagaaatttatttggctcatggttctggaggctgggaagtcccagatcaaggggcaagctgcatccagtgagggccttcttgctatgtcataacatggtgaaaggcatcacatagccagaagagagggtgagaagggctgagctagtgtttacaagaaacctactcccatgataacaacatcaattcattcatgacagcagggccctcataacctaatcacctcttcaagttcccatctgtcaatactgttgttctggggattacgtttctaacacataaactttggaaacacattcaaaccagagcaccatcctattctcagtaataccctttgtcttaatttttccctactaacctgggatgatattcaaagatattcaacaatgcttgggcactgaccaataaaaatgggactagacaccaggcatcaagaggcagtccagcctttctaattcatactgtctgacatccatccagtcccaattgtttcaaaggttctggtgataataggggccacctctcccaaatttgccttcttaactggattcctaaaaggacaagtcatgaatctctaatcataattctagcacacgtaccacaggccattaggaaaactatcctcagataaatgaagcctccccataccctcaaattacatcatgaaggtgagacccttagcatggtctctgactcactaggcaaccatggccaagtgatttgcattcttgagaaaaacttaccctccttataacagagaggaggatccctcaaagagatcctgaaagctcaagtaggagaagacactacaacgtggttggaatgcttcaaaagataatactttctaatcctaagacataattgctaataaatggtttcttttttacgtaaggtcaaagaatttttaataaatacagtctttggtgctcattaagaagacactaattcttcatgggttcataagcacacacataagaaaaatctgcagcaacagtacagtaataaatgtaaaatcctaatgagagaacatacattggctggaaaagggtattgttcttttcttccttcttttcttttgcgaatgatattgtaatgaattttcttcagaggacttattagtgtctgtttaatattatctctctctttcatgtgaaaactttccttagaatcttaggcaaagctttaggccttcaatgaagacgtcattaaaaaataatatctaagcagtgctcaaaatatcacattacaacaagttaacagcactgtcataggatatagagatgggatgatattaactatcagagattccagcctgatctatcagtaatttcattatttccaagtacgaaattaacttctttgagaggataaagcctgcagggctctggaggcctcttttgatctaagcagattattgccctgtggggactccatggtgggaattagatctgcgttcttggtggtgtccatagctggttctccattttctacattcctcatgttagaatggccataaatacggactgagcatcaatctgggactctttttcagattgcctagagggccaaacactggaaaagaaaagggctgcccgtgaaacttctggttcctgccttactgagggcttcaaggaaaggctgggtttagggttcctgaacactctgtgctgcctcggttcatttcctgttggggaagttctgaagttcatctgttacattcccaatgcttatgttaattcatatgcaaaatgggaacccgcttaactattgccttttattactctgaaatcagccaaaccagcttatgcatcttagcagtcttaaatcagcgtttcccaagtatgatctttgaaacactattaccaaaaagctgctcaaaagagagagagaaattataataaaaatatcatagttcaaagtactttggaaatgctgcttattatctctcttccgttagtttcacgtacaatgctaaggtcaaagaagttcttcaataaagaacagtatttaattttgcttagctgagcatttttcaatgttacttgccatagaatttccttcatttctcccccccaacactggctctcataatctgttatcattctgaagaacaaagagcacacactttgagaagagatggccctaagttaatcagcacactgcattaggtggctgctatcaattttgatttaattacacaagcatgcactcagcatttatgcaacgtaaggtcagaataagggttatgtactcctcaagggtaggttcccaaattggtgggatatgttccagcccctccaaggacttacacactttcctaagacctgaaaagctatggtttaaaaatagttgatcaatccttccagttgtccagctggggtcagttgccaactctggcgggcaaaatatcaggaaccaaggacacaaaatatgaggaaggcgtggcctcttccctcaaggaggctaccatggacaactaaccacaaaccaggaaaagcatgatatggaaaagggagtggtttattctgcatgaagggaaaaggaagattggtaaagacacaggctgctaagcggggctccagtgagaagaattcccattgctgggtagaagaggacagatgggtaagcaacctgagaaggactgaggctgcaaatgtgcagggcatggccgttctaagccagtcatccccccgacatcacagatgaaccaacaggacaaaaatttaagagttccatgatagaggaggcaaaccttagccaatttcttcacaccaggaagccactgtgcctatattctgaaccttgctgacggtaggtctggagtgggcctttgtgtctcccagcagcaggcatacataggagtcatctcttcgatgggcattcacatagggctaggtgtgcccttgctttataaaacatatgggttcttaaaaattggatattcctggatgtcttgtaagtaaaatcattttacatgaccatgaggagtgatccatttaaaggatccttgcagggaagactctggggaacaaggaatccacatgcactctgagatttctgtttagatttttcctgaagagctgcctcttaggggacttctgaatttaaagagacgttagaaagcagacatgatgaaactgcgttgtctccaaactaaaaacaaaaagatgaaagtaaacttaaaagctacagatgccattcgacaatgatttgatgtaaaataatagtccatctataactcaatttagccaagtccataccttctgagatccttgacttacctaaaggctctgtctaaatagtgaccctatatcatacaagttgaacaacaacaaaaggagaaactagcagatttttacatcatcgggagggacatagctggtcaaacaggcagtaaagtttgagcacaacaaagcgagctttgaacctcctaagcaaactgacaaattgcgctcaggagtccagttcccagcatcagcaccactttgccacaatggcttgtctcctatctctcctgcctaatggctttccatgccaaggagggcagtcagtgtgatgaaaataaccatcaacaaagcatttggtgattagtcgtctgcttttttaaatataatgcctgccagccaagattgataaattattttggtcattaacaatctatttaacaactgtaaatttaaagtgatcactttcctgaggcttagtgttatagaggttagggggtagaatctatttagccagagttaagagctggaaaattaagccagaacacgagaaacaagattacaaagtagtattcctcagtgagtgctgtgaagctatatggaatcaggctattaccaatggtgggggatatgtttaatcacctcttaaaggaaaaacaatcttaattaatgttgtatgtcataaaaatataatttagatggggatgggaaattgctaaagacgaaacccagagcaaagtgaagacttggttcaaaatgaaccacccacccatcaattataaaaatattgcccaacagcaaatcaaagaacatgctctttggtcatatttgggcagcctgaaaacactgatccttgaaaagcgttttcatactttatacaaaaaagataggaaatatttaaacttactttaaattagaattttaagtgccatatttaaaaagctgaattactcatagacacagtcaaagttaacacactatattttaaaactatatctaaaaaactcataaatatgtagtcagttgtgttggtcagtgaacaatattattatctttatgctgcaacatttggaccgaacatttcacctgactaaagtttggcattggtccacttgttttatttgatgcttataggacatccaaagggaaacatagcaaattgtttctgtagcctattcattagtagcacagagaaccaatcccagcttcaaggtgtcaactggtgttgcatcccaggccccatctaccagtagttcaataaggagcaagatggcaggaataagagggaaatgcatctcccttcagctttcaggttttagactactgtacatggctctttccaaacaagaagaaaagaatataacatgaactgattggtgcagtaaactaaactggatttatatgctctaatatggaaaaaagatccctagaactgatcctcaaaagcatctcccattaatggagaaataggagaatgtccccaagggtgaaagtctgggaccagcaatatggcaacattataagtgcgctgaacagcatttttgtaggaagtgtgttctaactgcctttgtaaaaggaaaaaggaaaataaaacaaagcagctggacaataccatttccactgattaaagttcaggggagcctgaaaagttacttatgagatatagttcaaccattttcccccttgctttcagatttacgtgatattaactcctatgcgtccacagcagccccatgatccgcctcagaggaattcagtgcctaatacttgactaggaagaaacattaggtattgatgggcaaagagttttcatctcaaatgcctctctgatcaactagcagtagctcttgttgaggagtccgaggccatatttaaactcagtggaaaacagcagcatgggaaattagcagtttggcatagagattaagaacatggattccagcagggagcagtggctcatgcctgtaaaataccagcactttgggcggccaaggcaggcagatcactttagaccagcctgggcaacatggcgaaaccctgcctctacaaaaaatagcctggtgtggtggtgcacgcctgtagtcctaattatttgggaggctgtggtaagaggatcacctcagcccagtaacgtcaaggctgcagtgagccatgatcataccactgtactccagcctgggcaacaaagtgagaccctttctcaaaaaacaaacaaacaaaatgatcatagattctaaatacatatggatgtttgaatcctggccctattccttaccagcataacaacataaccttatgaggttattatgaacattaaataaattaaggcaactttcacaatgtctagcacataatttacacttcataaacattagcatcataaccaggaggactaattgccattgttgctaattggcattgcagagtagagttgtggcttgtcttttgcccatcaggctatctgtgtttcagaatctgctcctcaactcaagtgtaaaacttacaagcagtggtggagtgggacaagtcaaatctacacagttctttatatgattgaatcagtgaactggatagactctaccaccaagatgtgatgtgttgcgatggtggttctgtagtatgtttggaccgtgaaagatcaaaaagtctttcaatgattcatattttcagggcattgcaaagtgatcaatttggtacattcttgacttaaaacaatcacttggacttctccaaacttcccagactgctaataacatgcaatcctacttctaaccaaagtgaataaagcatcaaaaggaaaccttggtttcatcccaagtgctaccagctgctttcacatattgaaagtttggctctaccactaacaggaaaggaaacactttcaaacctggcaggtgatgagaacagacttcagaacttggctacactgtcatcagacatcaggggctggaattagggcaggggttctcaactggtgacaattttgtcccacaggggacatttgacaatgtctggagacatttttggttgtcacaactgggtgggaggtgtttctggcatctagtgggtagaagcctgaatgctacaaaacatctcactatgcatactctcactccccaaactctgaatcttcgggtacaaaatgtcagtagtgccaagactgagaaatcctggattagcacggaacacagagcagtgtggactcattgctaaatgttttcctcactatactggaggctccaggtaagtaggaatcattgtatcttcagtgcctagcacagttcccagtacttagcaggggctatattaatttttgtggagtgaatgcactataatagcagatattaatgcaggtcagctaccatttttcttcacagcagagcaaatatttcttcaatattaaagtcagaaagcaaggtgaacagagaagacatatcagaacatgactttgcttatttgggcatctagcacatcagacacttccaataaatctgtcccacttccttcattccctatcttccctagagaagtaactgatgccacatccagaacctaacaataagttacgtcaacttgaccagcaccaacatatttctagaatccacttgcttctctccttccatgaagcctaagccaccatcatcaacatctctaatgagtcactttgcttttgctcttgacctctaacttccattctccacagagcaataaccatatgtcctgttaaaggcgttaatcagattacatccctcttgtgtttaaaacttgctaacatcctcacgggggcttaaaacatcttacaaagtctggcacctgctcaactctgcactacaatcatagcggtcatcttcctatttaaccaaattgtccaattcctttgcttctcagagcctctgcactggcctgggaatgctcttcatctagatccttacatggctggcactttcacataattcaggaagtggtttaaagtcaactcgtcagagaaattttttgactgcacagaatcttcacctgtgtagtcagacaagttttcttgtctttagattatgaggcacaatctgagagctttatttgctcatttacgcttgtacactggcatccctcccagactggagtgtcagcttcatgaaaacagagaacctgactgttttgttctctgctgtgtcccaagcaagcacagtgcctggcacaatgtaagaagtcaatacacatctgttgaatgaatagataactgaggaataaatcgatgaaataaacagttcatatacatgaactagtcagagaaaaaagaactcatctaaaagaaaatatgtgttaactgtcacttacaaaagagttgcctagaattttcaaattaaactccaaatagcatcctttatttaactgcgatcaattcaacataagactgaaaatcagaataatagagggtagttagtgttcatctagcaccaagagtaactcagaaattaaattaacagtttgttagtataaatctccctcgttctctttatgagtactaaattaaagttcatcctatatttttaaatctgttacaagcaaagagacaatgaaataatgaaagtataatgaaataattttactaattcttaatacataaccatagcaatgattttgtaagtttccaaatatggttcagcagtgtggaccagcatggcatgaaaataaatttaagtgtgttttccttttataatttttattactgtgaaagaaaataattaaggtatttaatattcacaagcagtatcagaggcaagaatacgagtatgacattactgacgaaatctggaacataacgcaagtgtaatgttgctttttttggaccacgtgatatatctgaatgcaacaaggaaagaagccagaaacatgttagcaacgattgggagggtgagttgatggtagcatgtagagtcaagcaaagtcagaggctgtgacaaaccatgctgaattagcacatgcagttcctcttggtctgcctcccacccacctttccaactgcagttcttatcactccaacaacatccccaaaacttgcagggttctaaagtttatatagtcttggggtatctgtgtccttatttacaccacagctgagtctaaaagaactttctgcaatgatggaaatgatctaattctgcactgtctattgcttctgtatcgagaaactgaattttgcaaagcatttaatgttaattaacttaaatttagccacaggctgccaaattgcacagcacagctctagacaccctccctatagtctgcaaactcctgctcgtccttcaagacccaattcaaatgtctcttcctccagaatccccttcctcttcctgttccctaaatagcaggtttcatggctttaatgataaccatttatcacattctattacaatcattttatggtatgttggtccttccaactacatcaagaatctctcaaggggacagactctgcctgactcatctctaaatactcagttccgtgcttggcacatgagaattatttgataaatacttgttggatgctcaagtgaaataatgaagccatctttagacatgaacaaatataagcacagcttaccagaaaagttcttcccaggggaaggtttactccatttatataagaagctgcaaaccagatatagcttgagcatccctaatctgaaaatctgaaatgctccaaatgctccaaaatctgaaactttttttttcttttttttttttgagagggaatctcaccctgttgcccaggctggagtgcagtggcgcgatctcggctcactgcaagctccgcctcccgggttcacgccattctcctgcctcagcctcccgagtagctgggactacaggcacccgccaccacgcctggctaattttttgtattttttagtagagacggggtttcgccgtgttagccaggatggtctcgatctcctgaacttgtgatctgcccgccttggcctcccaaagtgctgggattacaggcatcagccacggtgcccagcccaaaatctgaaactttttgagcaccgacatgatgccacaactggaaaattccacatgtagtgttatgatgggtcacagtaaaaatgcagttaaaactctgtttcatggacaaagttatttaaaatattacatacaattatcttcaggctatttgtacgaggtccatataagacataaacaaattttgtgtttagacttgggtcccattcccaagatatctcactatgtatacgcaaatatttcccaatccaaaaaaaatctgacaactgaaccacttctaggcccaagcatttcagataaggggcagtcaatatgtatgaccttcagatttgatagtatttcaccatatttgtatatatgtgtgcgtgtgtatgtttgtgtgtgtgtgtgtgtgtgtgtgtgtgtgtgtatttggtagacactgcttaccaatgttaaaaacagatttccaacatttcttgaaacaaatattagatctggcaattttagtcccatatttgggcttggcaacaatgaactagaatgtaacaagcagctgcatcatttagataataaatatcctctacagaatctttttttttcttctttttttggtacttttagtccactgttgtcatttatggtctctgtctttctcctgcagccatgtgaccttacaacaccagacaatgaatgaagagacagaaatttcaagttcagacattgatttctcaccgacattagtaaaataacaacagtgacaataatagctgcaaaaacaacaataataatggctggtagtatttattgaacatgacatgccaggtattatactaggcaattaatagacattgtcagatagaatcctcctccatgacctagaaaacagccttagcttcattttatcaatgaggatagtgagatgctaaggggcaagctgaaaacaaacagaaaggtcttcccctagtctgcccaccatcagagtcctcactgccatctcttcattacaaggcgacatccctcttcactcctccatgttcctcccagcctggatttagacccagagcacaagacaaagtgggaccttgggcaactgacataacctttctgcattttgctcctccactcacaatggacttcagaaataagagctgacattacctccagggtcacatgcgggcacatgagatgatgtaggtcaaacactgaacttctcagacacttttcacaaatggaaaatgatctcatctgagcaggcagagaatggctggacaaaggctgacacatctggagtagggaggcatggaaaggactgaactctcttaaggtaaataatggccttgtggcttttgctagcacccaccctcaaggagccctcatctagggagagcatgtctttgtggaactaatacaaatttggctccatgaggcttgcctagcttcgtgccagttaggtgatattgaaaggatgcaagtcaatggaaggtttaagaatcagctattgtaggccaggcgcagtggctcacacctataatcctagcagtttgggaggccgaggcggacggattgcctgagctcaggagttcgagaccagcctgggcaatatggcgaaaccccgtctgtactaaaatacaaaaaaacaaaaaaaaaattagctgggtatggcagcatacgcctgtagtcccagctactcaggaggctgaggcaggagaactgcttgaacccgggaggcggaggttgcagtgagccatgatggtgccactgcactccagcctgggtgagaaagcaagtctccttctcaaaaaacaaaaacaaaaaaaagaatcagctattgcaggcctagcactctgccaggccaggagttggcaaacgttttctataaaggtccagatactaaatattttaggctttgccggccataggtaaacaaatgagtatggccatgttccagtaaaactttacttacaaaactaggccagggcccacaggtatcgtttgcccacaacccctgtgctaggcaccatggaggcagagcagaggctcttcacagtcatccggcacaatcaccaggggcaaagcatgaagcagcctgttggattccccactctggtagccacagtcctctgaggtaaaggcctggacagcaagaatgacttaagcaacagactttcttggtggctccagccccagactcaccccacagggcatgaggagagtgagcctctctttcccatgaatggttcctcccagcagttgtgcaggcctgtccgcagaacaggtgaggctacatggccttcaaccacgtgatgtattggctcctctgactaaatcaaagtccacagatgataggcctacaatatccaagaagttgccaaacaaagatgcttaaattgatacagacaaaactaaatacctctccttcccttgtgcctgctttgactcccctagatgccatccctggtgccacttcacactgagctatctccttgcacttgaatcccccatgtctcattaccatgtgtatatcccaagacggggtggctcctgttgtaggccacatatgtttggttgttgtttgttttttttgagatggagtttcactctgttgcccaggctggagtgcagtggtgcgatctcagctcactgcaagctccgcctcccaggttgaagcaattctcctacgtcagcctcctgagtaactgtgattacaggcacccaccaccatgcttggctactttttgtatttttggtatagacggggtttcaccatgttggccaagctggtctcgaactcctgacctcaaaggacccacctgcctcagcctcccaaagttctgggattacagacgtgagccactgcgcccggccaggccacactgtttaaaatctatgcagtccttctttgatatgataaccttggggttgtttatatttcttccaagtgtatgaccaacaggatgcagagaagcaaaagttttcttactgttttgtctgttaacgtaacctcccattgtctttatgcttttgtttctgttctcatttaatcctgttttccttcacaggattaagtctgctcatttctaaactattgtctgaactttaatattctaacatgtcttagtgtcatgtttactcttcactgtttgactttctgagtgaaatagtgaagaatatgagagtggaaaaggtatttggaaagattctaggttttaaaatttcagctttagttgatccttcctacctgtgggaccttgggtaaatgagtgaataatctgaacttgaattgcttcacctgcaagacaaaggtaagtatgccaatctcgggagaggtatcatgaggattacgagttaaacatggaaaattcctcttccaactcaataataaaaacacaaaaaatccaacttatatgggcacagaatctgaatagacattcctccaaagaagctatacaaatgaccaaggggcatgtgggaagatgctcaatattagctatcagggatgcctcacccaaacaaaaggacaatgagataccacttcatgcttattgcttattcggatgactataataaaaagttacaaaataacaagtactagtgaaggtatgaagaaactagaatcttcttacactattggtaagaatgtaaaatggcaacgctgctttgaaaatggtctggaagtaccttcaaaaattaaacatagggttaccttatgacccagaaattctattcctagttatataccctagagaaatgaaaacatatatccacacaaacacttgtaatattaacagcagcattcacagaacgattattcataagaagcaaaaagtagaaacaactcaactgtctatcaaatgatgaacagataagtaaaatatggcctagccatacaatggaatattatttagcaataaaaagaagtttgtgaagagcaaagaaaacaagcaacatagtgaagagacaatttacaaaatgggagagcatatttggaaaccatatatcagacaggggattaaattccaaaatacataagaaacccattcaactcaatagtaccctcccctgtaaaataacccaattaaaaaatgagcaacggacccgcatggatatttttccgaaggggacatacaaatagccaacaggtttataaaaaatgtgaaatatcactaatcttcagggaaatggaaataaaaaccacagtgaggtatcatctcacacgtgttaggatggccattatcaaaaagtcaaaagataacaagtattgctgagggtgtgtagaaaagggaacccttcttggtagaaatgtaaacttgtacagccattatggaaaagagtacagagtttcctcaaaaattaaaaatagaataccatatgatctagtaatcccactcctggatatagaaccaaaggaactgaaatcccccatccaaaagagatatctccactcacatgttcatcgtagcattattcaaaaccaccaagacatggcatcaacctaagtatccactgacagataaatacagacatgcgatgtatatatcaataatggaatacgatttactctttaaaaagaaggaaagaaaatcctgccattcgcaaaaacatgataaaactagaagacattatgccaagtggaataagccagacacagaaagaaaactactgcatgatcttacttagatgtgtaacctaaaatattcaaactgttagaaacagagcatggaatagtagttaccaagggccaggcatgggggaaatgggaataatctggtcaagggtacaaactttcagttataagataagtaagtgctggcactctaatgtctggcatggtgactaaggctaatgataatatattgtatacttgaaatttgctgagagagtagatctttactgctctcaccatgcacacacacaaaaggtaactacgtgaggtaaaggatatgttaattagcttggttgtggtaaccatatcacaatgtatacgtatgttaaatcatcacacagtatatcttaaatatatataatttttgtgaatcataccttaatcaagctgtaaaaaaagaaatgaagtgcggatacatgccaaaagatgggtgacccttgaaaactttatggtaaatggaaaagacagtggcacacaccaccacataatgtatgatgccatttatatgaaatgtccataacaggcaaatagagacagaaagtagattagtagtttccagggttatggaaggggaggaatggggagtgacagctaataggcacagggtttcttttgggggtgatgaaattattctggaattagattgtagtgacagttacacaactctgaatatacctgaaatcactgaattgtacattttaaatgggtgaactgtatggtattttaattgtatctaaataaagctgttactatatggaaagttcttagcttcatgtctgagacaaaggaagaaataaaaatggtcactacggttatcattcattcacctgcattttaaaaatgcagtcggtttttctagagacttttcacccctgttattctgagaattaaaatactcaaacatatgtgtggtgaggtctagaagaggaggattattgtagcctggagtagttagaaaagccctcgagaagtttaaacagaataaaggaggaggcaaaggagaaatcaccaaaggcagcaatctgaaagtgaaaaggtgggaataatttggttccctgtgagagccataaggaggcaattcgattaagcaaatggctcatgaatgcaagggataagttgaagagaaggcaaagttagatttccaagggtcttggaagcataggccaagatgtttgggcttcctccagctttggaatgtcaggaactgaatttaaggaaagccatcctgccagtttatgtggtacaaaagggactggctgaaatcagaacccaggaagtatgagttagttagggcctgaagaaagataataagaatggaaataggaaagaaatagcacaaaatagtggctacttctttttttttctcccccacacccccccgcccccggacagccagttgttctaaaggggctatttctttatgataaaggtgacagaatacagaagaaaaaaaatctcccttcctccttcatcaacacctaacaaaaggaacaataataaccataaaatcatggttaaaaaaaaaaaagggaaatttaccagtaagctctaaataaggaattaagcacaaacttgtgccataaaattcaaaagaggaaactaattaaaaaaaaaaaaaggaaggcaggaaggagcgagggaaggtgaaaaagcaaataggagatgattttcatgcaatttgaagttgcatcaaaatcttccacctcaactgtcagaaacagattggagaaagtatttgagttgacaaaattatgggatttcccttcaatattccccacaatcaggagacaagtagactgaagtcatgattttgatgtaggatttttcttctcagtcactttgcaagctgggaacccctggccagtgatgcccgtaccaggccttgcttggccatgctggtgtgctccagcttcttgtgttatagcttgtacccgtgtttggtggttccctgagctcttgtaccatgcccaagaagaatgaggatacactggacattgaagggtgaggagggcagggaagaattttactgagtgacgaaaacagtttttagcgaagaggggatatggatttggtctccctacctgaaggtgagaaagttcccctgtgtggctgggcctggggccttttccagacttagaatgggaagtgcctgctgatttgtttgtgagtctgcaaataagtctaaagcaaagacaccactcaaaggtgggcacaacagtgtagaaaaccaattaggaaagcgcaggtatatgtaaaacaggtgaagggtggggaccaatcagaggagagcttaccaaacagaaagggaaattctcaatccagtctgaggatttaacttgtagcttggctttcaggctttaaactctcttccacttgaggtggggtttcactggggacccacccctatctgcctaggcatttgcctgcctcctgttgctatcaatttggaaaccttggtgaagccccagaaaaccctggggagtacaatcccagaacttcagcccagccaagaatagcaataattatgacaggggcttggcaggaaaaaagaattgatagaactagagaatgacagcatacagaggacgaacttcaagaataaactggagatgacccaaagtttctagcctggatttttcagaatgggggtgataccagtaagaccaggggtcagaataggggaacattttatggtagaagggcatgcactctgttatcagataaattaagtttgagcaactcatcccttgaattcgtatgtctgtataaacctaacctagtgcctctcacgtagtaagccttttataggtgtgtgcaggagggatgaggcatataaaatttaattaaatatgaacaaatgatggtaacaataaactcagattttaaaaaatggttttgtttcaaccactgtggagtcaatagactctatgagacttaaaaattttttaattttaagctgtctcttagatattataaagccacagtgagtcatcttgcacttaaaatccagaaaagcctataaaagaatagaaaacccgaatacgtaacttcctcctgtgacagaagaacaaaaacgtcaacgttcacagcttaaagacatttagcacctcaaaaagatgtatcataggtaagtttctatacttgaatgatattatataatcataatgcattggaaattaagtcaatttacaaaaaaaacccctcagaaatgcaaataacagtgctttgtaaaactgtatggcctgttttctggaaggtactgtgtgattctgggactggacttttcattaaaaagataagagattcaggcatcagacatgttcaattattggctccctaatgaagttcactatcctgtctaatggatctttccttttcaaaagaccccttcctccttgtgtattctggcattgcgtgtctctggcatttgctctatgagaataactggacagtacaatgctcttgaatacagagagctggagcttgaatggacaccatagccccaaggacatgaaaactattttttgattgtgtgtgtgtttataaaacttcttgcataaaatcagtctttgtaatttcctagacttcaagggcattcttttcaagttggggcttcttaatgtggcccttaaaaatcctaaaattaaatgcatttttaagctatctgtgtaaatatattaaaaatttccctcattaggaagttgccagtttatggcaaagctttcagaggagtctgtaacacaaagtggatccagaaccacagcatgtagacccctaaaaattaaaaacattgaaacctatttagcaaatctgcatgaaatgagccaaattcatactgcttctgtggagttggttcctggaaatctaggcatttagtggtggagttacagatggatctcaatggcctgcgtgattttcccagcctattgttttcgtatctgattaattattctcttaaaatttccatccataaaaaatttccaaagatattaggatctctcttcacatagtctttccttcttttgaatgatgctattgttgtcactttgaaaactgtaaatagcattcaagatgatatttaagtttgtgccaacatttagtggaaatgtctaagttttgaaatagtagggagctcacattccatctggtgtgttttcattttatctcctattctcagtgaattttaaaagtcagctgcagtgtcaataccctttctgctatgctaatgtgacctccacgtggaaatcaaaggaaaggagttctcagggcaagtgattctttctcaattgaactatttagtgtcatagaatcacaaagtatcagagctgaaagcaggcttacaggtgaccatgatgaatacctctcagtttgaagggaaactgagcctcaggcagagggaactgcccatagtctcattagccacagggacaggagttgaacctcgataggaagcctttctgatggccccatatcaggtggtcacttccttccccacacttccatggccctttatcagagaccaccatcccatgttacttagcggtttcaactttgtagcacagttactgtcactaatttcttacccatgtgtagcaggctaatatttcaaagtaatcactggtgtgccatttccttcctgaccatctcttggctaaagggaagtgcatctattgcttagcagtagtctccttcactcaccagcttagcctttaattcaaaaggcgctgccccagtgtgagagagaaatgattcatgcagggataaggacacagaagagttctaactgcccacccccagagtttaaaatagagtttcaagctggataatggacagagtcaagagagataaagcaagaaagagtgcatgtgtacatgagtgggcacgtgcatgcatgtgtgtgcatgtgtgcactggggcagggtgtgctctacccttgccttttccccaacccccaggctgaatcctgaggttgggtaatatatgagttttctatttgctactataacaaatttccacaaactcagtggcttaaaacaacacaaatgtattatcttacagcactggaggtcagatgtccaaaatgggtgtaatgggttaaaattcaggtgttggccagtctgcattcctttttggaggctctttgccttttccagcttctagaggctgcctgaattccctggcttatggctcaattccatctttaaggccattgatggccagttgaatctttctcatattgcatcactctgacactacttattttgcctctctcttccacctctgtgattatattgagtccacttggataatccaaggtcatctccttatcttaaagttggctgactagcctctaattgaatcttctactttaattctcttttaccatctaacatatttacaggttctgaaagattggtacataggcaccatttgggaggctattatttggtcttccacagctgactcactgcaagccatccctttgaatttgagactctaagagtagattgaatgtgcattcagctttttccatccagaattctggtagtacacagctttgcaaagagaataatgaaggactatagcagcaacatgaatgtctgctggaggcacctaatttcctgcaggtcttagcaaagtatgtaagaacagacaagttttttttgagcccatgagaagaactctgacaagctggcaaaggccaaagagtaagtgtccttcatgtgcttgtgacaagagactatgtcaggaccatggacacctctaggaatgtaggaggccaaaggtcaccatcctgcaaagaatgatggcattccttacgggtatcagaatggaccaaagatgcacacaaggaccaggcaaagtggattacttggacaccagaggccaaggaaacaacagccaaggacaacagaatccctgcctaccccacacgacatgttgctcattaaggccccagaatacagaatctgaattgagagattataagccagaatatgactgaatgaattacaggcctgaactgacagaaacggcactgaacttgctgagcaaaacctggcccagggctgatgagatggtttgctttcacagccagaaattcaactgaactttgggagtcaagaacatttcattttttaatagtccaactggtgactgtgaaagtaatcattgttatacttggcactcaaatgaacctcagacacagcaagagttgacttggtgattgagaagaaactggagacaagacaaaacaaatgggaatataaaactgtagactatcacatcagcacaactggctagtttatttttatttatttatattcctttttatttttttgagacagagtctcgctctgtcacccaggatggaatgcagtggcacagtctcggctcagtgcaaactccacctgccgtgttcaaacaattctcctgcctcagcctcctgagtagctggcactataggcacgcaccatcgacccagctaattttttgtatttttagtagagatgaggcttcaccatgctggccaggctgatctggaactcctgatctcatgatccgcctgccttggcctcccaaagggctgggattactcgcatgagccactgcgcccggccctactttttatttttttaggtggagtctggctctgtcacccaggctagaatgcagtggcatgatctcagctcactgcaacctcctcctctggggttcaagtgattctcctgcctcagcctcctgtgtacatgcgattatgggcacgcaccaccacacctggctaatttttgtatttttagtagagacggggtttcaccacgttggccaggctggtctcaaactcctgacctcaagtgatccgtccgcctctatcccagggagtatctttatttttttttctaacaagtcaaagagtagaaataccaaaaaagtcacctctttgggtgtttcagctacttagctagctcacacacacatgtatttcccatgaggttttgatcaaaactaaagtcaatttttttcactaggttcaccaaacaactgccagtaaatattggcttctgccaatgaatgaaaaagaacacaggatgtctgctcttaaaaagtgacccctgatgtttccttcacattatcaaattattgcatactcattatattatgtttgggaaatgcaagagaatatgaagaaaggaacaggagtgtaacattctatttgaagctacaatctctcttaatttcaaggtacatgtgcttccattccattctccatttatatgccactctttccattcaatattatatcccaatgtattttttcccagtgaatttagaaagcttattttgccaaggctgaggaggtgcacctgtgacacagcctcaggaggttctgaggacatgtgcccaaggtgatcagagcacagtttggttttatacattttagggagacatgaggcatcaatcaacatacataagatgagcaatggttcattctggaaagatgggacaacttgaagcaaaggcaagaagactctaagtggggagggagcttccagggcataggtagataggagacacatggttgcattcttctgagtttctgactagcctctccaaaggaggcaatcagatatgcatttatctcagtgagcagaggggtgacttttaatagaatgggaggcaggttgcccctaagcagctcccagcttgacttttccctgtagcttagtgatttgggggccccaagatttcctttcacatttcccccccttctctttgaaaaaatcttttggaggaagcattttagaagaaaatgagtctctggtctcaggttttgtctcatctctcatggctaggatggcttattcctagatgggtaggtcttgagttattaggtatgttcatttttagcaggttgtaagtctcatgttctataaagaaaaaatagggggaggaaggaaaaaacaacaacaacaaacaaaagaacaagcctgtaaaatccatataggccatattactctgaagtccatacatcagtaggcaggtatgaaagtggcttatgtatgtaaataggttgctgttatctttttctgaagtttccgttgtctagcttcagttcacttggctttacgaaagcacagcttagtttttggtgactccaaattaggaaagatgggaaaaaaaagaaggaaaaaaaattgaaaacattgttttgcagacttgtagcccagaaaaattagaattcattccaaaccacagaaaataataaaaacaggcaagactagaatctaacaacaggtatactacagtttttgaaatataacttttctctctccagtttcccatttttactaatgataaatcatggtaggactaatttgctttattattcttggtctgattatttgtgtacagtgttatatcattaatattattcataaaaactcatttgatggctacatagatgaatatatagtattaaatatattcctctattatttggcatttaaattgtttcccaggtttagatttttcaaattaattagatcagttgtccaagttttatagacacacactcacacacactctgatgtaaactggaaccataatgcaggtaagagcattttgaacgtagaggggatgacacagaaatgcctggtattctctgggttgggtgtagacacagttccatacatgaaggtgtgtgttgaccagcctattttggattgtctatcttggagagtactggtgggccttttaggggagcaatttatcaagctaattttcagggagattccagaaacgggtacaggggacagagctggccttggtgatttgattctggagttacccacaaagttccactgtgcctctagactaagcctcatattccagctttaaaatcccattcttttctcagcaggctttgttggtttgaaaaaataccttggcatctcaggaaggacaacaatttgaactactattgtaataactgaggtaaaagttctttctcagggggaggttttgacaggaggcaggcagtgcccaagaagtggggagacttgcagctgataaaggaaagccacggacctgaggattcggagaaccaggctttgaatgcagggggctggggaagtgccaggttcagctcaacagtcatttcttgacaacctactctattatgaagtggtattttttgggtgccgggaggcagagacgatgaagatgagtaagatgcctctggtagttcataaaggcagcagagagaaaagaacccagactctggagccagacagcctaagtatgaatctcaggtctgtttcttactctctctgtgtcctcagaaaagttttcaagtctgcctatgcctccgtttctacacatgatggagataaatgtaccttaatgcccaaatgagcacttcattgtatctactaactcatcagtatgctaatgtcattatcatatcacagtctccctccacatttgaggtatctccaactaatgaaaattttgtttccagcctctttcaaggagtccaattcagccttatcccagatcaccaatagatgaaactagcccaatgccccagggaaagaaggtaaatggtagacaccgcatgtggatggaaaataatttaggaaaacaagtgcagttgtttattccaggtcacgaaaaggaaattcagcctcagtcttcaatatcaactgatagggtcaagattaccagagaagccagctgaaatttcatatatagatttgacctaaatgtgcaatgtcctttcaataactctgaagagcttactaagagaaacaattttttagagtcgctaaaaggaaattcagcctcagtcttcatatcaactgatagggccaagattaacagagaagccagtgaaatttcatatatagatttgacctaactgtgcaatgttctttcaataactctgaagagcttactagaagaaacaattttttagagggaaaatatatgttggagcaaggttacatttccgtgcaaagggaatattctatgagttccttagttaccactaatgtaagaaggatttccagcaggtactggtgcaactggcctacaagatatttatggtccattaagagttgtaagcaagactgtttctttttcagaaaaaaagcaattttctcttaaatattttagtgtgttatgacatgaatacactatagggcaagcaaaagtatttaagtggttcagcacacaaaaccagctccaaaaggatgaccttgggaattttagaagcttggctagagcatgttgatgacttccttgtgtttaacaaaaactataaaaaggagttataataaagtacctagatggggactactgggccatatcctaaaagcagagaaaattcctgactttgtaaaatgtcatttctttcactgtaagtctaaattactggtagtgtgtctaggacttataaatttattggaaatccagtgtgtgtgttgtgtgtcgtgtgtgggtgtgtgtgtaaatgtctctaaggttgaacagggatatgaaaaccatttgggatttagtactggaagtcccagtgtctaagaaaatcgcttttctccctatacatgggttttccataaaattgaaggataatattttccttaggctaaagcaaagggtgatagaaacagggacggctttgtagtcaaacagactttgatataaacaagctttgccatgagctggttatgaggttttgacatagatatttactctctgcaaatttagtttcaattcaatggtatgaatgatatgcttggcacctagcagacagtccagcccaatgtgtattctcattgacagtaataatttgattattattctcaaatattacatttatttaaaatagatgtattactagtctcagtgtattctcaatgacaataataattgtattatattattatttttcattagtgctctccctaggagcaaagactgcgaactatagttgtttatgaccactaaccttacactagaagcccagtatgattgggtatttttcccccattttaaatatgggaaacataagatactgagatttaaatagcaagttaaacattaaacagtttgcaataaaccactatgttgactcaaggtggagagaatttagagctacacaggtataccagctatttcttgatttccttgattagaaagaaaatctggcatcattcaaattcctattctaaatctggggaaggtcataacagtctccacaaacagctgcttgccagtaagctgaagcagtttgaaagcattctagagcaaaaccatccagaagaaatctaatgcatgatacatatgttattaaaagtgtttggtagcaacaccaaaacaagtacaaagaaacaggtgaaattaattttagtgatataatttttaactcaacattaccaaaatattatttcaacatgtaactattataaaacattattaatgagatatttactttttttttggtagaaggctttgaaatccaaactggattttacatttacaacgcatctcaattcagactggtcacaggtggctagctgctaccaaattgaacattaatggtagacgtcaccccgcagtgacaaaaatataaccacatttgaacactcaagccgggattctaaacatcaggctatgtttccaggactctatgtctccaaaagcaggcaacttggaggccttaggattccttcctgctggcatgtggcacatgaatgaaccttgctccaagctaagaggttacgggatttatttatacaggttgtttgaattacgtgtatcattcttttgtctaaagaatgacaggtgataatttaaaaataaaaacatttacaaatgctttgggactttaaaattgtattaatttttatcttctgtttccccctaattcttgcttattttgattttcttcattaaaagagagataaagttaaatgtttgggggcttttcactttggggccattataatttatattgagggaatcgtgtcaatgcttaattcatatctgttttatctttacctagtttatccatttctgatcataatttatttttccaatagtctttttttttttctatccttaatccctatactctcatttctctaagtaaaatagatttggaaaaactactgaggtcttggtagtttgctttagcaggttaactccaaacttatcaaaactttttggacaattttaagtgactgtttattaatagctatgtcaagaaccttgaatgtaaacctaagatttttttaaacactgaaacagcccattattcaagcactgtagttaaacttaggtttcattgcagcagccactgtgagactgagagcagaactgtgagaagcaggtaggaagacagatggactccagcaacaaggacacctcggaggaggcattttcctccttcaccggcaagcaccttagagctttctgatggaatgtatctggttggagcgagaattcactgtggagggcagataggactctgcacaagaaagcctgattcgtgaaataatgagagaggaccacatggagtggtttgatagagtggatttactatggatgctatggatagagtgacacgtgattaaatttttcttatttctcactaacatgcgattgaacgtattcaaacaacataggagagcaattttgggaaactaatctagggtggcttacctcaaagcaaactctaggaaaaagccatggcatcctttgccttgaagctcaacctgtagatacctgcatcctcctcatcaagcactcttcagccttctttcattacttttcctctttagtgtccaatgacttcatgatcttccttggaggctccagctcaccatcactaccattatagccctccatgcttctcaacattcctcatttgctcagctctagcctgggctgggcacagtggctcatgcctataatcccagtactttgggaggccaagccaggaggattgcttgaggctaggagtttgagaccagcctggacaacattgcgagacctgtctctacaaaagcattagccaggtgtggtggtatgtgcctgtagtcctagccactcaggaggctgaggcaggaggatcacttgagacccggggtttgaggctgtagtgagctatgattgggccactgctggccagcctgggcaacaaagtgagaccctgtctcttagggaaaaaaaaaaaaaagagttaataaaatgactaacctgaatcatatattgtgacagttaatattgagtgtcaacttgattggactgaaggatgcaaagtattgttactgggtgtgtctatgaggatattgccaaaggagattaacatttgagtcagtggactgggagaggcagacccaccctcaatcttggtgggcaccatctaatcagccgtcagcatggctagaataaagcaggcagaaagtggaaagagctgacttgctgagttttccggccttcatctttcccctgtgctggattcttcctgccctcgaacatcggactccaagtttttcagcttatggtctcttggacttataccagtggtttgccaggggctctcgggccttcagcaacagactgaaggctgcaccgtcagcttccctacttttgagattttgggactcggactggcttccttgctcctccgcttgcagatggcctattgtggggcttcaccttgtgatcatgtaagtcaatactccttaataaactctccttcatatatacatctatcctactagttctgtcctgctagagaacactaatacatatattatctgaatatttgtttctgtgagaaaaatgggcacaaataacttttaaccagataaatgcttttctgctaattttgtgtctctcttttgaggaacatagagatttagctcagtaataatctgacataggatagggtaaaccagatgcttacccagctttctcattactaaaataggtagtcaaagagcattcatagatacagagggagcatttgaggtcataggtcattaaattagcattactatatgcttatttgttagttttatcacatctggttctttgaataaaaagtctccattaatttagaagaacatatcaagttgttatcttattctgagtgagagacaccaaagttttcattccaaaattctgaaatacccagaaacttaccactcagtgggaggacatcagtaaacccagaagacaaaaagctaattaactgtctcactgaaacattccttcctttttgaaaagtcaactagggacccatggactctgagcccattgtcaaatgccgtgtgaaagagatccaagttcaacaacaaatatcatcagcaatataatggttctctccagccctcagggccaaatggcctgcattttagcaagttgattttgctcatgaattgtgttaagccaagcaattgtttcccatgacatgcttgaacccacagttgctttgtctatgaaattcatggttgaatttgtccaattgctgattgctattcccacttgctttagtaatagtcacttccttcatcagtaatgggttttatatacagtgcacagtcacaaccattcaatgtcacccataagcatttgatgaattgtccaatacagttatgagagttggttatttgggatacagctagggtaagtcttactgagttaatgaaatgatatgacattaggccatgggtgtttcctcccccacattggctatacacactcttttatctaaggacgcatttgggtcattaccataatcttcatcaacttgtcaagataatgaagggcccattgagttcagggaaggcttggcataattcatgaaaatttaaagaacatagatgtagaaagagtttgggagctacagataaataagatctgcatagacaaccacaaaggaagagcttcagcagacaatctgctttggaagggggagagtttgagctcagttttgagacagaagagaggctcatactctgaaatgtctaagacatactgctggaggaacagaaggtgaaaacaaacttagagatgataatcaagattggaaagaaaggaagagtagctctcgagcctgctttcagcaaatcctacatctgtatttgttatagccaccacacaaatctaggtttggtgggagggggcaagttagttatcaacttcgacatgtgcctatcagacttgcttagcaatcagacaaggtttataattgcttccgctaacctttccagagtaccacaatttgtagccttctgcacactgatttctgaccaaaggattctgttccatcaatgccccattaaattcacctcagatggctgatggcaccatgtcgaagtctcacccagtgtggctatgagttagtgaattgaccgtctgaagagcaatatatagtctccttttaaattatgttagaactagcagagaatttcaggttcttctagttcaacaccttgtttttttttaaatgtgttcattcattttcaaatattcactgaaggtccaccctaggccagattagatccctgccctaaagactgtaacacataattgggggatgcaggtattgaataataaagtaataaattatgtcaagtgtgggaggtgttaagaaggaaataggtatggcgatatagtagagttactctagaggggacagaggattaactattacagatgaaatcagagaacagtgaaaaggaccctttgaggaggttctgcacatgtatcccagaacttgaagttaaaaaacaaaaaaaactcacctggggccagagcactgtaaatgaataggcagggagattaaacagatgtttcagttaaacagcatgcccagtataccagacagaagatcctggggaatagtaatctttgagtagcagagagaagaggagcagcccatgaaataggcaaggatcttaaactccaatgccttcaggagctatgcatgcaccattagccagtgaagcaagcctaggtagaaggcagtcgtggcaactgtataggcctagagaatgagcaatatgcctaacagcattcaaactcattaaaaaatactttacagtcacaataaagcaaatcaccaaaaatactttgcaggcaaaaataaaacacatgtgaagaggcaagcaaagcccaaggaccatcaatatgcaatgctgagctgcaggaaaagcaggaagtaggctgggaatgagaaaaaaataaatacagtgtggtttcctctaagttaaaaagaaaaggttttaccttttatttccatgaacttaacaatgaaaacaatatgtttcactaggcagtcacccaaacattgcaatactgatcacaaaaaaccccccactatttgttacagaacttgtaaaacctgaaaatggcggtaatgatcaaatgggtcaaatgtgtaaagagaggcaccacaaatccaagtggcccatgcactgaccaaatgtagatatcctcttgaagaattgtggccatgtgctctgtgcttgagtgaatccagggatgggaagctcacccccttggaaggcactctttaagtgttcattttttttcactttgacccgttattatggagagctaatgatatctgccactttgtagtccgatactcacagatctgccctctggagccacatagaatgtatttaatatctttccacctgccagcccttcagatatttggaaacagtgactctgttactatcttccctctacaagtcttcctttttccaggcaaaacattcccaccatcaattagtctccaaatctgttttcagacccaaccacctttcttatgaaccttcttatttgtcactaaccatcttaaaacagtgcctagaaagaacacaatgttcctagccaatttatactctggggcttctttaggcataattttctatgtctgcagcagtagaaatacaattacattttatggagctcagtctcctgctgttcctgtttcctacctcccaccctccaaggcagtctgtttgttgaatgtcctgaacagatgcataatctagagcaagtgctcccatcaatataaagaatgccatccctcatcactccatcgcttctgattaagatcatttggtctaatgtacattaagttctattccaataatgcctgtgcggtactgcatgcttttcatgcctctttctggacactgtgttattagatactcagcctggagaaacatttccatacaaagaggaagataaaactgagaatgaatggttaaaggcaaagagaaaattgggaatctcacccttggaaagaatggtagatgggaacatccaatgacctggctttgaatctggttctctatttactaaccattgctacttaaagaaaaatagtaataataacagtaagaacagaaactactatctattaacaaattcttggtaagtaccaagccctgaaataagcctttcaggctacaatatcatatggttagtagatgccactgggatttgaacttacttctgcctgtttctagacttcaatctctacatagtcttgtaccacaatttcccttagtggatactgtctatactacatatgacttataccactgatttttaaaaaaagaaaaactctcacagtaattacttctcctgagatgatcctccaaaatgtgggaagtagaaacatgtgttttcttttctgtggggccatcagagcatgcagacaagggcaaaggaataagacaggagagagaggccatacaccaaccacagcactgtacattgtgtcttgaactgggctgaaaagtaaccatgcagcttcattttaagcacagttggaacatcgacaagatttcaaggtgactgttcagcctaaggaaacagtgttttcaagcacttttatgctactttagcagtatttactagtatataattcacgtgctaatttattcattaaaacagtcgtatttggcaacattaaccttagtttacattagtgagattggtatttgtattttaattacatctctttataattactctataattctgattttcttccaatgtgaactaagcccttatcaatccccaaactgcattccacatccaacgaaaatgagttcaaattatagttttacagaaaatggctttgtaaaacccagagagcctattcccaaaggtagtcatgcatcagagtctcctggggatttccttatacaatgactgattcctgagtgctgtgcaatctacttgatcagaatctccagcgacgggacctcctgggaattgagacctgcagcaactggtccacaaatcagcacttagggactggtgactagactatttccactctacacacatccagtacagctcttggaaaacatacaaagcaaaagatagtaagggttatcctaaaggcagaataaccagccacctcacggaatccaatgtgttccagaaacattaattatacgtttcattattaactgctgacctattgttctttattttcagggtttgagttgctgttttaatttcatcactgcaaagaagccctatagacacacacacacaaaaagatgcatagattttaactggtccctggaaacaaggtagagataatcatgtggtttatttgatagagccacatgataaacaatcgagataaacaatgtgttttaaaaagcattctcaaagagttagaacaggaatgtcaaaaagacggcaaatatgatacctacctcctatccaatgcccttggcaggcgttgctaatcaatcacagcatttttccttgcatccacaaacagcctcaaagtccatttaaccaatcactccagggcactagtgctatctaatctgctctaccgtgtgggggacatactttctcctctttggctacaataaacaggtaaattgaaatcaccttataacagcctgatccatgacaggctgtatgctccacaaggtggaaatgggcatctgaaagttctcatgtagacagggctttaggcgcagatcacctggctcttgctggttcatgtttgtagtggtttcacacttgtatctttgaatgggagtacttagaaataaattaactgctttaatatttatgatatgtgagttacacttactcaaaccaacctagtttttgctcatgataatttacagtttcactttgaataaatgctgttgggaaagacaagctgagttccaaagtgttttaaaaattaagtgtagcatttgactaaaagaatcatatatcaatctgcttgatttccagtggtagcactgtaggttttcttctatggagattctgggccatatctccatgcaaatatttactgtcctggtaaatgacaggatagaaatcacaaggacacttggtttctgctggttttcatttgaaaaagaaaatcattataattaattagtcatgggttcccacgatggccattcttgactccttggcctctattgccactttccaagtctggctaaatagaattccatttcagaccatatctagggtaatacttgattcattaggttgatgtcatcccaccgacagtccccgtgatcaaacaataagatcagagagaacagacccacctcctcatagatgctgtcattcctgtgaaagtctccagccttcctgggaagaacatggacgtgaacgtgctgaaaatgtacaagaaagaaaaaaaatgtgattatctccccatgtatttttagacttgacagtgatgctctcatgaagcccaattactccacgatggttcctgctgggttatttttcagaggaagttgatatccaccttcggtaactatacctgaaatctgccgagaagagagtgcactaagcaagagagaacaacttggggtatatatgagagttggtgcgaaatgctagagtgtttcagagtctctgtggaattattcatggttgtcagtcttggttgtagttagccagtgctttgaaatgacagtgcatcttcaaaggtgaccatcatgactctgaaactgacaagaaataagaattggctaacagagaactgcataagtaaagagcgagtgaatgaggtagcaagtagtatgggcagaattacagacttggggcttcgaaaaataatcatataatagtaatacaaacagttctcatttagtaagcatttatttcctatgataaggaaagctctgtgtttggcattcttcatttagtactcttaaaaatcctatgaggtggccgggcacggtggctcatgcctgtaatcccagcactttgggaggccgaggtgggcggatcacgaggtcaggagatcgagatcatcctggccaacacggtgaaactccgtctctactaaaactacaaaaacaaaaacttaggaggctgaggtgggagaatggcctgaaaccaggaggcggagcttgcagtgagctgagatcgcgccactgcactccagcctgggcgacagagcgagactcctcaaaaaaaaaaaaaaaaaaaaaaaaaaaaaaatcccgtgaggcaaggtctactatgatctccactttacagaagaagatatcaatgttcggtgaggacagggcgccacaggaagtaaaagtcagcaccggaaatgaggttgcctggctttggctcctgtgtttcattagcacatgcactgattctgcgaacttaatcttttaaatagcccatttctctagtctactaaagcacccaggtaatatacatagcaatgctattatgcaatgatggtgaatcagggctcagagcatatctaattcaatatattcttcaaagctaaactgctatttgaaagttttactttccaaatagcctctattgtacctcggctgaagttaaacctcatttctgcccttgagctatgttccacttttattacaaaccgtggggaggaatgcgaaaatgaagagcttaaatagagagaggcagacagagggtcaaacctcatccctgatcacccaccccttcctgattactgcgatcgggttccgaggctccaaaaggcctcaagagaacgtaagatttaagtgtccctgtggcttcgctgtacaaggagggggaaagtgacacgctattaaagccgaggcagggtgcaacgtggtccaaggtgaatgaagcagagaggagcttcaaagcagcccctgagcacagttcccaaagagtgacacgcttttgccagaatattcgccagtcaatgataaagccagtcacggatctctcagcaattgggccaagtgtgcacttcagtcacaaagattacgtgagcatggagagagaaagtgaaagaacaaacaaggaaaaaataaatcacaaactacccatgaaaccaaattcttaggagaaagccaggcaggtgggcctgggctgaaatctactgaaatctccagatgggctgacttaaaagcaaaaccaggaaaataacgtagaacaaggatacagacaacccttagaaggagccttcactcactctttaattccagaatctcctgccatcctttcttcttctcctctttttgtcctttcttctttctgtccccctcctcctttcttcccctcttcctccctcccatccatccatctttcatcatctcccttatacattctaggaagttccagaccagtgtcttccagtcaaacttcctaacacaaatcctggacctaccacaaactaactgtgtgaccttgtctcacaaagtctatgtgtcagtatcttatctatatggggattataatggttgctacctcacagggttgttaagaggattaagtctgctaaccatgtgctgagcattcagctttgcatgtagttagtactcattacctagaactgtacaagaattagttttattatttaaaaaaacaaatttaaacctgaagatcaagtagacatcacattcagggattgatttctgcaccagcaaaaaaataaaataaagatattaagaagctccttgaatgagggcattgttcaagcatctcttttgtgaaagctgatttctgttgctttgactagccattctcaatcttccacctgtacttggggcttattaaaatgcagactgcagggccctaaaagtctgcatttctaacaagctcccagctgatgctggtctaatgccacactttgagaaccactggcttacaatatccacctggtttcttaccttgcttctgccagtgtgggcacggaggtcacttgctgttttgcctgccctactgcattatgtgtagactctttgtctcttttcttgttttttcctcttttttttccttctttccttctatcttttctcttttttcttttccttcttctttccctccttcctatttttttcccttcctttccttcttttctctctccccacagaatctcactctgtcacccaggttggagtacagtgatacaatcatagctcactgcagccttcaactcccaggctcaagagatcctcctgcctcagcctcccaaatggctgggactacaggtgcatgctaccacatcaagctaactttttttcatatttttagcaatggagttctcactatgttgcccagtctggtctcaaactcctggcctcaagcaatcccctctcctcagcctcccaagtagctgagattataggtgtgagctactatgtccagtatgtggagacatctttctgaatgcttctctggctttctgcactctgaccactctccttgcgtggtcctcaggaatatgcctgttagtatccactactaacatatggggggttgcgaacctgcacttgggaacctccagggtccaggtctatcccctgcctactattctttaccctcgtcttctcgatttagttcagggctatctctataggctgtgttaccactaagttctagaaaagccactcttgatcactggtaaccacttgaaattcgccgtgacacactgaaaccgtaaatagctcactgtacaggtggttttttcccgagggcatagatctcaacccaccctgatatcgtgacataaattcttaagtgacaggctgatcacacgatgctgacaacccactcagcttctcagaacagggaaatcacgatagagccagctcaaagcctcattgctgtgaaaaaataccatcactatggacttctaatagaatgacattctgataaaaacgctatgaatagcagagatgaggataatttgatataatctgttcttactgctttcatattaagctgtggtgatcacaacttacttttctaagtgccaacaaaacatctatttaataaaagccttccacaaatttgctaggggttgcagttgagctgcttgagctagaagagtatctttttaaagtcccatgacacattccacaccaaaaatgttttcatggtcaaataacatttcacaatgctcattagcacattaaagtatgagaatttccacacaaaagatgcttgtttaacttcatctaatccagcattccagaaacttatttgattgtggagtcctgattttcctgtttcattcatgtaacacttctgtacacttttctaaagtatacattgattcactcaaaaatatctatttctaggtgctattctaggagccagggatacggtaatggacaagacaaagcctctgtccccatagagcttatattccaatgggtgatgcagaagataagtaaggaaatgactatacattctaattttggatagaaataagtgtcctgaagaaaaacataacggtataaggtaaatactgagcactgggccactctaacgtttgaagtttgggaagagaagcaggactcaatttaaggctgtagtaaggaaaggggcaaaatcaagagagggtaagttccaacagcccagagaacaaatttcaaagagtgtatcactaacggtgtgaaatgtttttgaaagcttgaattgtttcagtaaggctaggagaacaaaatttaaaaccccatgaaaagatgctccacattattagtcattagggaaatgcaaatcaaaaccacactgagctactacttcatacccactagaaaggcaataatcaaaagacacacaataacaagcgttggccagagtgtggagagctggaaccctcctacactactggggatgtaaaatcacacagttactttggaaaacagtttggcagttcctcaaaaagttgaacatggagttaccttgtgactcagaattctgatcctaatacatacccaagacaactgaagacatatgtccacacaaaaacttgtacgcaaatgtttacagcaacattattcacaatcaccaaaaagtataaaaaactcaaatgactatcaactgatcaatggtaaacaaagtgcagtatatgaagacaataggatatgatttggccataaaaaggagtgatgtgcgctgagtgaaagcatcatgctcagggaaataagccagacaaaaacggccacatattgtaccatgccatttacatgaaaaagccaaatgaggctgattcatagagaaagaaagatttgcggttgtgaagagggatgcagggtaactgctaatgggcacagggtttcttttgggttaatggatatgttctggaattatatagcagtgatggttgcacaactttgtgacaatactaaaagaatgaactgtatattttaatagggtttcttttatattatgtgaattatatctcaataaagctattacttaaaaaaaaaaaaaaaaactgaaggccgggtgctgtggttcacgcctgtaatcccagcactttgggaggccgaggcgggcggatcacgaggtcaggagttcgagaccagtctgaccaacattgtgaaaccccgtctctactaaaaatacacaaaaagttagccaggcgtggtggcacatgcctgtaatcccaggtactcgggaggctgatgtaggagaatcgcttgaacccgggaggcggaggttgccgtgagccgagatcgtgccactgcactccagcctgggtgacagagcaagactctgtctcaaaacaacaacaacaacaacaaaaacccaaaacttaactgcagtgggtttcagagcaagcaggaggtgaaatagagacagcatgcaatgccatcatttttagaggctctgcctcttctgcgctgtctctgctccttccaccatctctttgaacacatctcttctgcccatactcacctgaggattgccagtgtggttgtatcgatatcctttttccttgtcagaatatattgtaattcaattctaagggatagaaacatggctcatggcgggggaaagagcaaggaaggctgaagagctaccctgctccacagctggtgtcctgcaacctccaccagttggccctgtgtgaatccttctccctcacatgtgccaatgagcaactgcagaaggcaggtctgattctaaagaacaacagacgatactgtggtaaaacgataatggccaccttcaaagttatccatgacctaatccctgacctgtgattatgttaagttacaaaagataaattatggctgcaaatgaattaaggttattaagcagctgaccttaagattggcagaggtatcatagattttccaggttgccccaatgtcatcaggagtccttaaaactggaagagggtgaacatcatcaaaattgtaaactttctacttcaaaggccacaagcaagaatgtgaaaagccaagccagagactggcagaaaggatttgcaaatcacctatctgataagggaagtatatctaaaatacataaagaactacttacaactaagtaataaaaagacaaaaatcctaagtaaaatgggcaaaggatatgaatagacatttctccaaagaggatggataaatgaatacatgaaaagatgctcaacatccttagcccaaaaccacaaagacaataccacttaacacatactagggcaactgtaataaaaaggacagataggccgggtgcggcggctcacgcctgtaatcccagcactttgggaggccaaggcgggtggatcacaaggtcaggagttcgagaccagcctggccaatatagtgaaaccccgtctctactaaaaatacaaaaattagccaggcatggtggcacacacctgtaatcccagctactcaggaggctgaggtaggagaatctcttaaacctgggaggtggaagttgcagtgagccgagattgcaccactgcactccagcctgggcgacagagtgagacttcatctcaaaaaaaaaaaaaaaaaaaaaaaaaaggacagataataacaaatgctggcaaggaagtggagaaattggaacccttgtacaagctggtgcagatgtaaaatggtacggctgctttagaaaagtttctgcagttccccaaaaggttaacaataatgttaccatatgacccatgcactgtttccagcaatttgttatagcaacaagtagagaatgaatacagatgccttgatatttttaatgcatagtttacacatttttcttatctctacaacacctgtatgaagtattattctaccaattttataggtaaggaagagacaaaattttccctcagcaagactcagaaatcttcacgtattgtttttttggtttttttttttttttttttttttttgagacagggtctcactctgtcacccaggctggagtgcagtggcacgatctcggctcactgcaacctctgcctcccaagttcaagcgattctcctgactcagcctcctgagtagctgggactacaggagcacgccactatgcccggctaatttttttttgcatttttagtacagacggggttccaccatgttggccaggctggtctcaaactcccaacctcaggtgatcatgcccagcatctattgttctatgtttgtataatcaccaacagctctcaacttggaataaccaaatgtaatgtaacaataagattgtttccatttgctgaatatcaacatcaaaaacttacagcatagaaaatctggaagagacagaaaaacacataggagaaaatttagatcaccagttaatctcactaccaagcaataacaatccttttcttcatgtagagtgatacaaatatgatacacgctttttttttttttttagtctcaattgccccagacaaaaaccctgaagcaaggatgagagtgcaagtagtttatttggtggatgatccctggaaacacgagtaagggaaggaaacaagaaaggaaaggaggccaatataggatgtgtgatcaagtgagttattatttcatgtgactggagcttataaaacctgctagagaactctgagaaccagtgaagaatatgcatcccagagttatcccagccaaggtgtgagggaactagcgtattcatacaccaacttttgtcctcactggttgagaactgctcctggggagacatcaatactccagcacttctgccttctcccacctggagagtgagaaaagccaggtttccagggccagtcagatgcaagtcaggctaggtaggatgcattgcagccatggtgggtgggggtaacacaatgtgggcagagcacagaccccacttgtagcaatgctttgcacagtgctgtctcatttctgacacctggagtctcataatttgctgctgaaccgaaagttcaagtatttagtctccttttcatgggtgagataccagacagataaagatctggttagaggttcttaaactgcaaatcccaaagccctagagcttccagaacaagcctggtatggccaaggagcagctcatgatggaagtaagaatggggcaccagaaagggcggcaggcttcagttccccctccgtgattcaaacagagcagctctgttttatctgtttctatgttgggatcccatgcacgatttcatttgcaaaaagaatttattactaaaacaaacaaacagaaaatctttgaaaactactaggattagaattaggaaacgttggggggtggtaagagtgattaatttcttcatttcacagaagaggagagtggcttttagaagaccaataacaaagcaatggcagggctgggactggaaccttgagaaccccgaaaccctgacttgtgttccagtgctttctacctcatcttgcccaacctacctttcccagatctcagaaaggtagaagcccctacaattaagcagtttggtgttcagtcactggagatgggtggccaaggttcagatcctacctattcttttgactgagtcaattccttaacttctttcatattccctcatttatcaagtgggcataaaaccagtatcccaacgcataagacttttataccgattatgtgaaatacataggtaaagtgcttaagctaatgctgcacattctgaatattcagtcaattccagcagtgactatattacaggacattagttttaaaaataattttgacaacctgcttctgttctaaaccagaaggcttaattctacggtgagccttgctgaatgtattctacttcatccagaccatcaccaaccccaaagctgtgtgttctacatggctggatttcgcctttcttgatttggggaggcctcatcttctgcaactaagtcgagtcaagggtcagcatgaaattactgacagccacttagttctaaaataaatgtcactggaagtaatgccacttacaggactttgaggatacctcagcatgatcaactcaagaatcaaattagtggcctgtcaaaatgcacaggcacactgatggtttctgatgctactgtcaatgagctccttcacttagaatattagcaatgctcaggcagttggtatgcctttcaggaaacagaggaaacatagtgcttttcatgtgttcaaagtgtcccaatcaagttgggaaacttcgaggaaaaaaataaaataaaaaaaaattcagtttaaacaaaaaaaataaacagaaaacacctcctagaatttgtggagactctgttgagtttcgtggcttaacaattgtgtttttaagccatacatcactggtggtgctccaattgtgagttataataatatatcataagagggatggtgatctcctgatatatgggtgccatacatcatctaagcaccatggctttgatgatgtattgctccaagccacaatgagagtttaaaggagcttttagcagccagacagctttaaatttcaaattttcaaaaattaagatcttttcaagtaaaaaaaaagcaagataatggaatgtgatgctatataaagtgtcactgaactctgagagcctgggtatatgccttttccttttggctttgagctcacaaggtggaaatcattggcaagttcttcttcaattcctcctccatgagcacagaggtgagcaagtgtcaatgcatccattttgccaatcaatttcccccatcttccacactgcaagcctgagtagctcatcatcatcccaaagactggatcacataaaatgctgtgataggcactggataaacccaggagaagttattttttattttttattttttggtttgttttaaagagctcttccactgagattcagaacaaaaagaacagataaaaagtagatagacttccttcctcattgctctcaaactcaaaacagggcatgtaggaagaaaacatgccttgtctagcatttgtctttgtaaagcaaaggaagcattgattgcagatgaggagaaagaggggaatggcatatgggcttctcatccagactaggaaagggagctgttgtcatagttctgtcacctttcctattttaacgatgggtttataagacggtaatgtggcttaagagaatgtacccacttcgtttaaaagccactcacttttgggggcaaagtaatcacaatcaattaagaaaacaggtgttgagagaactcctccctttttttttaaatcctactgcaataaacagaacaaaatgagaaatcttcctactgtttctgtaatagacctaaacaggaacagtgagagacgattacacttcaagtggcttcttccattttcctttactaagtgaattaaaggaaagaataagagtagttactgccatgtggagggaaacatctgggcataaggaattaacagtcttccctcccattctcctatctctaattttttgctccttgggcttcctccagtagattctaagtcccaaattactgtagatattttgcacccggctccctccttgaccacttccaaagggcaaaaacatcttatttccaccaaagaaaaccaatggctgtctcaaaaagaagtcccaggcttcttttctcctgtagtagtaagttaactatataatctgggtaacaaagacatggaaataaatgcatcacccactattctgaggctgtcagttgaaagatgtgaatgaggcaggctttgcatctagagaaatgtgggttctttcacgggctggtaaataaatcccccaaattcagtcctcttcttctctataaagagaatactgacacaacacttaattatttctttcacataagccaaaaagctttacttacgtatttatagtaatagcacaccattcatccacccaccatttttaagtcattatcagttataaaacttgctgccatttacataagaatattatatgttggaatggtacttagtactgtatattatcacatcctcaccaaaacactaaaaaatagaaactgttgtctccttttttttcagtaagcacactgatgcttactggaattaaataaattgtgcaagctcaccaagctggcaaaagtggccgagttaagattctaagtcaggttgataggatgtcaagcgtaatctgtattttgctatgctccttcctgagtaaataactaatgtctgggtgaccatatgccccagtctgtttggaaccatccagctttaggcctgcaggtatgaacaggccagtgtaataacaaacagcatcttctttcactctcctaagttctgctgtggacaataaattatatggtctccctaactagtagtatagttcatgccaggaaattttatttctgctcattctaactattctcatctgcagatagcaggggaaaaacaaagaagaaaggaaagaaagaaggctctgtgaaagtttttaaagaatgggctactaactcttatctatcaatacctttcatgaaacctccaacatgttcagagtagagctctgggagggaaaagaaatactttagactaaaacagggcccctcaagctctaaagaaaaaacctcaagcatgctagaaacctctccagttgagcattctttacttattatcatcacaagaggcaacggtaatagctgttgctatttattaagctcttactatatgccaggcaccatatgccaggaactgagctaagcactttctttgtaagatctcaattatttatcataaaactgcatgatagatataatccaaattattatcatcattaatttatagatgaagaaactaaggccgaggaacgtggaatgaggaggtctgcccgattccaacatccaagtgtgatactactatcaacactctggtacagttgaacacagcctagtaaaagttctaagcccactgcccctgcaccccctgctattcaaccttatgacagtaagctcttctgcaagaggggcccattagagagaatggacttctaacaaattgagatcaatcttgtacaaatattctgtattatcttttggcttctgattggttttcagtgacataacagctttaaattcttaaagctatttaatgagaagagagtagatgtattagtctgttctcacactgctaataaagacatacctgagactgggtgatttataaaggaaagaggtttaattgactcacagttccacctggctagggaggcctcaggaaacttacaatcatggcagaaggggaagcaaacatatccttcttcacatgggggcagcaaggagaagaatgagtgcccagtgaaggggaatccccttataaaactatcagatctcatgagaactaactcagtatcatgagaacacgatgggggaaactgcccccatgattcaattttctccacctggtcccacccatgacacatggggattatgggaactacaattcaagatgagatttgggtgcggatgcagccaaaccatgtcagtagaatttataatcactgcctctagagaagttgacaaacctaaccaacagctataaaaccaggataactccagatgtagggctctcagatgaggtcatctctactgccttgggttatggacaggtagaaccctgggaagaccattccaagatagagtcttcctgttcagttagacatgcaggagctcagaggttcttgtaaaattggttctgcttgctgctgggtgggaagggacagtgccttagtaatgtctccatctgaaaacgtatgaaagtttcaaaatgacttttaggagatacagaggatgtttcaagatttgtcacccttgtgcttctcagctgttgttgtagtcatggagtttatagtacatgtgcttggtagaaaaaattataagtgttcttccttccatgtggagttcctttctctttccttttcttcctctgagttttaaagagcatgctcaaatgccacctcctttgtgtactcttcagactctttcaggcttttctgattcattatacatatgtccatgacagctttttaccacaaagtataagtaattacaggttttctcttccactagtctggaactctgggctatttattacttatttttcccctgattatttcttttccctaaccctaggttcctaggttagaagacatattttctaaatgttgaatggatggatgaatggatggatgggtggggtggatgggtgatggatgggtgaatggatgggtggatggatgaatagatggatgagtgggtgggtggatgggtgggtagctaggtacatgagtgggaatgtggacagataggtgcatggatggatgaatggatggttaaaaaatagacaactacactgctcttaatttcttagcttgcttaaaagaagaaatatatgcactgattttcttcgccattcttgtcattttcttttgcttgaaagttcttgtgcatacaaagatatggtctatgaagagccattatgatcacattgtacacacctttcttccccactgaaaagtatctttttaccaaaatgtaagtttgaagttcttgtgtttctagcctcacataaatcccttttaaaaaactcctcagatatgctcaagtgtctggagaaatagcttatcctaaaaacagtcagcattgcaagggttgccaaggggatatatttgttcttcagtattaacttcattaagagctactgtggttctctctcaggagagaagaagaaacctaacctttctttggatatcttctgatctttacaaattatttccagggtgctgtctttgttagacaaaatatgaagaatatctatttttttatttatacatcatatcagaacattaatttgtagagtgattccctctgggtgcctttctgttgggtacacaaaaaaggatttggatgcaaatgaaacaatgatagcatttttccttgtcttactcattttgtgacaaatgcacattgctttactgtttgctatacacataattacagttctttaatttatgtttcaataaaatgtataataataaacatttactgctccatgaataaacattcgagtgaagcctctaatggaggttacatgtttcgaggcagctctgtggctttttcagaaatctgccttctacttaatgagcatcatttccataatctgtgcattattgcttaagcctccctttaaaacatttcaaaatgcaaaaatttgtgaaatatgatcagtccaaaggggaaaaaatgttaagggaattagcaacttgtcctgttaaagggacaggacaagctttcatgtccctccagagacagtaacatagtaattatggagacagcacttcctaattatctcactagctgagcgcaatactactgtggtttttgcctctaagatctggtttaaataaaagtgataagaaacctggagaggtcagccatgaaggacaagcttgtgctaattctctttccagtgctaacaaagaaaccagaaagtagaaccagaaatttggggaaggtcaagatacctgtggtatggacattcctggatgtagagacagacaaatggtttgattaaaacggtcaccccaaagtaactgaattcagacaaaagcctatgctgagctttatgtcgatggtgtcacacattattttcagtgtgttatttcttaggaaaattacttacataattttatgtcattatcactttaaaaggttaatctatttcagataatctttgcaaattgtgttctaaaaagcaggtgcttttaaaaataactaaaacatgatgacatatttcttttttctttgtccaacagccatggctgggttgtttaactagagagaaaaaaagatgccaggagaaatgaaggaacaaaggacccttcacagtgtgataagatacagatagtcagcctctgcagagcggtgatgaaatgtgttaaaagtgatggctgtcacttcatgacatgtcagcgtgctttattggtgggttggcacaatttatttaaacatcgtcaggagggactcattttggtgtagttagaagttgtgtttctttagtgtgaataaatatctctgggcccacgtgcaacattttaaaactgtgctgttgtttactgtgggaattggagcaaggagctaagagttccaaagtgaagctctccttctcccaccattttatgatttgctataagtaatttgctccttgctttgaccgttactacaaaatctttcaaaggaacattattctccttaacaggggctaaatttaagatttttcatcattcaatattgctattttcacatgtgacttcaacaaaataaaacattcggcataaatagaatttagtgtaatccaaatcctgcttttctcttggtacatatgctttgttgcttcttgacattcctgaattacaaagtattaagcagaatcatctttttaagggttacattttccttctaactcaagtgagcaggtatttacgtcaaagtcacacatttaaaaatgacatcctcttccagcatggggcaaatctcaacctacagggctgccaagtggagctgcaactttttgcaagggttctacccagatgtgctacaagtccatattacctttgaaatcaccatcttgtaaagatatctgcaccctcatgtccactgcagcattatctatagtagtgaagatatacaaacaatgtaaatgtccatcaaaggacaaacagattaaaaaatggtatataataaatacaatgaatattattcggccttaaaaattaagagattctgtcatttgcaccaacaaggatgaacctggaagacatacactaagtgaaataaaccagacacagaaagaaaaatatcacatgatcttacttaaatgtggaatcttaaagtaaaatatatagagatagagaataaaacagtggttatcagactgcggtggaggttgggagggcagaatggggagatacaggtcagagaatagtaagcagcagatttgtaggaagaaccagtctagagatctaacatacaacatgaagactgcaggtaaaactgtactgtatttgggattcctgccaaatgagtatactttagttgcccttgtcacaaaaacaaacacccaaaaaagtgagtaactatgtgagatgatgaatatgtgaatttgcttcattatagtaactattttactattttgtatatatgtcttaacaccatgttgtatacctcaaatacacacaataaaatttatttaaaaaccaacgaaaaagcacattcccttcataaatgagattcttttcaaaataagtttgaaaatatacattgtaaaatatactagaaaaaccaccccctaactaactccccacaacccaggagctctgatttgatagcttaagacaggataaatgactccgattaggacaatgagccccagttttatggggacctcctaaatcatatctcggtttgggtctagaatgatggtgctgggagcacccagagagctgcatatcatctcagcctggcttccacacagggagccagagagatttatggggccctgtctggtggctttgaggcacaaacgatgaatactgctaaagcaataacaataaaagaggcaacagacagtgggggaagccccagcaccaaccctcatttttctcataatatactctgttgtacaatgagacagagtgattccataggtaccagccagaaattacatgaaaaattgatcatgtttctttttctgggtgatatcagtgattgaggcccttgatttatgctggccaaactttttcagtgcagaatggaacccttcctaacttcagtctccgtggctcacacagactggccattaacagaagacacactgcatcataccatttagtcaggaccctacactaacagagggaactgcagcagagtcttaatagcaactccaatttgccaggaatctcaccacagatcagaaatttacagtggcggagaccttttaggaactttcagcatggatgctccctcaaggtgtgggtcagaatttgcggcgcaggaggtgaggtgaggtgaatagtttataatgatttttctatgccttttaacctttggaattaacatttggtcaagaaagccaattgaaggctaagtgtgtacttgacatgtgaaaaaatgaatgtgtcttctaggcgttggcttaggacactgctgagccctggctacagccaactcaggcttaactcattaaggtgattagccaacaatcaattctttaaaattagtaacataaaacaggccataccaggctcatggatataaaatttgggtatcaagttttgctccagagaaatgtcacaccctcaccggcaaaaagtctatagaggtagggagtgtcacaggtaaggttgagttaatgagacatcctctagctggcatgaatgtgtaaagtgcgctccatggtcatacatccagcaagtcaggatttcacagcaagcatagctttcactttaagctaagtgacatggaaggttcaggtccttaaccttaggtcacgggatgacaatatacagaatctgcagcttgacagcctgggcttaattcctagtcctgccactttccagctgtgggacctgagatagtcaacacctcagagcttcagatttcttgtttgtaaaatgaacccatctcagagggttgctgtgaggatcaaattggttagtactgcaaaatacccagactagtacttggaacttagtaagcatagatgtaaggtgtttgcagctatcattgctgctgccgctgccacgattattagtactacaactacttaaccacaaaatctgtgctacttgaccacaacatctttcagttaaaaaaaattcacaatttatttttttaatttaactttctcttaaggactttaccattgttttaaaaattactctactgaagtctaatttactaaatgggaacaggtagaagaaccattctcctaaaaactaatgtggagtcaatatacttatcctgggcatgaagaaaccctggagcttccaaagaacacagtgtgaaaaactttgcttggggagggagatggaaggcagagaacgagggtttctcccactggggtacaaatccttaggaagtggagcttggtgattaagagcatcgagctctaaagtcagatgagctgggatgaaatccccaccccaactttcatttcctgtgtgacctgtgaaggcagtcgaatatcttaattctttgggttctatatttataaaatgcagataataaagtctattcttcaaagggcttctgagaggattaaatgaaataatacatgaaaacctcttagcaccgcccctggcaccattagaaaatgccttataaatgtaagctgctcttctagttacttttacccagatctctgctcaagtgttacttccatagagaggacttccccaatttctatattacatataaacagttccggtcctatctcaaattaaaatctgcatttattcactttttcattttttgttcccatactcacggccatgatcccagcatctgtgactatgactagcacttagtaggcacccaataggtatgtgttaaatgaatgagttaaaaaggagagacaggaagtatctctaactcaatgttaagagactgcaaaaactctattaggctgaaaactaggaagtataattcttcaaagtaataacagaaataaaacttgaagacatgttcttttgtgtatgcaatagtgtatgctgattgttctcaagctgccaactacccttaacagtgctctgctgtgaagacacaaaaggggcaggagggtggatcagacagacttcatatgagccacaatgcaggtccagccaaagtagcaaggatacagttggaatataaatgcctttacccacctctcactgttttcttctcctgaaaattgctctacattatgatctctctctctttctctatctcttgtctcatacttggctttcctctgtccatgcaaagggcctccttgtgatatcccacattctcttttatcctgacacattgcatagactcctgttgtgggtactgtgtagttatataaccagagttgggatgttttactgccttgatgcttgcgttgtgggtctgtgtaatctttgcattcaaagtgtgataacagacactggacatagcgcataacactcagagctgcactccaggtactaagatgtcatgaggcccacgagagagatgcacatttctgcaagggcgtcaagggacccaggagaggaaggtaaaagccactacgaggtcctctgagggcaaacgctccctgctctctcctgacaatgatccccaatgcatgaagtaggatatagtgtgttaaggtgataagggctgaggatgaagtgggttggctcaactggcaaagcactgtgaactggaaatgtgttagtgtgtggaaaagcaatgttaccttggatgagagctcactcctctcgtgaactagacttttccctcaagtgccttcccccataatacagtcagtaaaatcttctaaagccctgagaactggaatcatctcacgatctatagtaacccaaagtggcctagcaactaggggtggaccctgttaactattcacatcgccaccctgacaaaagtcttcctgctcccatttcaaggctctctccacacttggtttctctgacctttctgaacctttcaccgtatcttgctctctggactgcagcccctggctgtgaatacatatttagtctctcagcctgcccttcctatagacatattatttgatgcttatgcaaagatcacccttagccttcatctttccatgcctttgccatacactaccttcctcctccccacactcctgtagtcagatgtgatgcttcaaactcagcttgagcgcaggtctcattttcaccctcctcatacgcctgtggacaagtttgtcagaccattggttaaatattcgaccaagagtgaggttggtaaaaggaaggcatatttacgagacagaacaaaggctttgcattaaacaaaacaaaatggcagttttccttcttgctgaaaccctcacttggatattcctccagaatcagagctttccaagactccacatgattcatcccctctcccatacttagctgtctggattacagcccttagttctttttttattttttagagacacggtcttgctctgttgcccaggctggagtgcagtggtgcaatcatagctctctgcagcctctacctcccaggctcaagtgatcctcccacctcaggctcccaaaaagcttggactacaggcatgcaccacattggctaatatttttttaaattatttgtacagacagagtctcactatgttgtccaggctgctctcaaactcctgggctcaagcaatcctcccacctcggcctcccaaagtgctgggattacaagcatgacccactgtgcctggcttcctagttctctataggagtctctaggttgttctgcctgagagattctgatagttcagctagtttcaaccagaatgctgaacccattattttgagcatgaatctgctctcctgttatattactaagaagaaaaacaaggtattccattaaatctgtgggcacatcctcaaaagcacatagttttgccgagatcttacacctgacaatggaagtgcttgcacgatgcaggtagtaaaacggaaaataggaatcaggaagctgatcaggaaccagctcagggctttgaaaaggagaaggccagtgagcgcccaccatttgcaggttgacagagtcaattttttttttaaacctgggctcaaagagagattaggcagctggatggggagcagactaaaaaatatgttcacctttaaataaatcagcaacgaaattggaggaggattatacctcagggacaaaagaggaagaagaacatgaatacctgctttacttgaaatgcctcccttctcccagcctttcctgcatggagtatgacaagagaggcccttggtaaccttcactttaattagaatcattaactgcaaatggaagtaagaacaactcaactctccttgtctaattacaggggctaccttactcctgtctgtaaaaggcaccaatattgtcctatgaggccctggcatgaagactttgctactctctcaagtaccaagaacagccttggagtggaagaaagaacatatttgactctaccatggaaattcttctatacctcaacatcattccttcatcatactcacatcctggcttgacagaacttatgtatccctgaaagccaaaggcagcttaagggacaggatagtggagaaaaatgcagccctggaactagactccttgtgcatgcatcctcatcacaccactgactgctacctggagcaaattacttcatatctccagattccagtttcctcatccgtaagaaaggcacaacaccactgtctacatctcatcatagtttttccctgacaattaataatacattacataaaataaatctttaataaagtcctaggactcagtactaggtactgtctaaatactagctatgatttaacatttttattggtaaagttttagaaacacttgctttgagattatggattcaaaggaaggtacaaaatagtacagagagatccctggtagtgtactcttcatctagtttctcaaagtactatgctgacatagtttataaaatataacatacctatagtacaatatcaaacccaggacactgacattggtacaatgcgtgtgtatagttagttcaatgccattttatctcatgtggagattggtataactaccattgcgctcaagatacagaatgaatccattaccacccaaatcaccattgtaatcctttggggaggcactcctgttccttctcctccatccattacaagactggcaaccccacaaccactaatctgttctccacctccacactttcgtttatttttcttgaatggtgcaataatatgctgccctttattaaacatttttttcttttttttttatttaaacttttattttaggttcaagagtttaagcgcaagtttgttatatagggaaattgtaagtcacaggggtttcgtataaatattttttcatcacccaggtaacaggcatagtacccaatgggtaattctttgatccgctcccttcacccaccttctacactcaaatatgtcctggtgtctattgtttctttctctgtatccaagtgtactaaatgattagctcccacttataagtgggaatatgcagtatttggttttctgttcctatgttaatttgcttaggatactagccttcagctccataaatgttgctgcagaggacatgatctcattcttttttgtggctgcatagtactccatggtgcatatttagtacattttctttgtccagtctaccttggatgggcttttaggttgattatatgcctttgctattatgaaaactactgcaatgaatatgtctatgtatgtgtctttatggtaggatgatttattttcctttgtgtatatactcagcactgggattgctgggctgaatagtagttctgtattaagttgagaaattgccaaacaaccttccacaatggctgagctagtttacattcccacaagcagtgtataagcagtccccttcctccacaacctcaccactacctgctattttttgacttgttagtaatagccattctgaatggtatgagatggtatcttattgtgtttttgatttgcatttctctaatgattagtgatgttgagcattttttcatctgcttgttggcctcatgtatgtcttcttttgagaagtatctgttcatgtcctttgccaacttttaaatagggttgtttttgcttgttaatttatttaaattccttatagagtctgaatcttatacttttgtcagatgcatagtttgcaaatattttctcccattctctaggttgtctgtttactctgttgatagtttcttttgctatgcataagctctttagcttaattaggttccatttgtctttttttttttttggtcacaattgcttttggcatctttgtcatgaaatattttccagagaccgtgtacagaatggtatttcctaagttatcttccagagtttttacatttaagtcttcagtagttttaggttttacatttaagtctttaatccatcttgagtttatttttgcatacattaaaaggaaggggtccagtttcagtcttctgcatatggctagtcagttattcaagcaccatttattgaaaaaggagtcctttccccttttggtcagctttgttgaagatcagatggttgtaggtttgcagctttatttctgggctctctattctgttccattggtctgtgagtctggttttgtaccagtaccatgctgttttggctactgtagccttgtagtacagtttgaagtcagataatgtgatgcctccagcttcactttttgcttaggactgctttggctattctggctctttttagattccatatgaattttagaataaatttttctaattctgtgagaagtcacgttggtagtttgataggaacaggacagaatctataaattgctttgggcagtgtggccattttaacagtattgattcttcctatccacgagcatggaatgtttctccatttgtgttgtctctgatttctttcaggagtgttttataattctcaatgtaaagatctttcacctccatggttagatgtattaggtatttttttgtgtgtgtttgactattgtgaatgggactgcattcttgatttggctctcaccttgaatactgttggtgtatagaaaaagctactaattttttacattgattttgtatgctgaaaccttgctgaagttgtttatcaaattaaagagcttttggacagagactacagggtttcccaggcataaaatcatatcatttccaacagatggtttaacttcccgtcttgctatttatatgccttttatttctttctcttgactgattgctctggctaggacttccagtactatgttgaaaaggagtggtgagagtgggcatccttgttttattacagttctcaaggggaatgcttccagcttttgttcatttggtatgatgttggctatggatttgtcattattattttgaggtaagttcattcttccaatgcctagtttgttgaggatttttaacaagaaggatgtctaattttatcaaaaggcttttctacatctattgagataatcatgtggtttttgtttttagttctgtttttgtgatgaatcacatttattgatttgtatatattgagtcaaccttgcatgccagggataaagcctacttgatcatagtggattagctttttgatgcgctgctggattcagtttgctagtatttggttgcggatttttatatctatgttcatcaaagatactggcctgaacttttctatttttattgtgtctctgccagattttggtatcagaaaaatgctggcctcacagaaggagttagggagaaggtcctcctcctacatttttcagaatagtttcagtgggaatagtaccagctcctctttatatgtctagtagaatttggctgtgaatctgtctggtccgtggctttttctagttgttgggcaatttattactgattcaattttggaaatgttattggtctgtccagggtttccgtttcttcccggttcaatcttaacaggttgcatatttccagaaatttatccacttcttgtacgttttctaatttgtgtgcatagaagtagtagtaatagtctctggggagttttttggtatttctggggggttggtggtaatgtcccctttgtcatttctaactttgtttatttgaatcttcttttttccttattagtctagctagtggtctatcaatctgattaattttttcaaagacccaatttatggttttgttgatcttttgtatggttttccatgtcttaatttcattcagtttagctccgattttatttgatgctctgagggtttgattatggtataagaggttcagttgatgagcttcatttctggaagatttcagggggccacggcttagctcagcactcctgggggagtatgctgcaaccctgggggggctggtaccagtcccccagctttgttctctgcccctcaaggttaagaacctgctgtgctggaggggcataggtgttccccatcttctggaaacaacactctgacagaggatgctggccaaagcacttcactggggcagtggcagcaggatccatgcttactagcatgtgctggcaacagtggcagaatggtgggtgtatgccaattttgtttttttgaaaatctatataaaagactcctatattatctgaccttttaaagtgggcttttgtcatttaacattaatgcccttgagatccatacaagctgttttgtgtattaatagtttgttcctttttattgctgggtaatattctatggtatagatgtaccactgtttgtttaaccattcacctgctgaagaaccttttgactgtgtccagttttcagctactataaactacctgtgaacattcattcatgtacagatttttgtgtacacataggtttccctttctctgggataaatgcccttgggtgcaattgttgggtcctatgataagtatacgtttggtttttaagaaatcactcggccaggcgcagtagatcacacatgtaatcccagcactttgggaggccaacgtgggtagatcataaggtcaggacatcgagaccatcctggccaacatagtgaaaccccgtctccactaaaaatacaaaaaaaaaaaaaaaaaaattagccgggcatagtggcatgtgcctatagtcccagctacttgggaggctgagtcaggagaattgcttgaatttgggaggtggaggttgcagtgagctgagatcatgccactgcactccagcctgggcaacagagcgagattctgtctaaaaaaaataaaaataaaaaaaaataaataaataaaaaataaataaatcactattttccagagtagtagttgtcttctatatttccatcagagagatttggtttctgttaccctcaccagcatctggtgctgtcattttaaaaattgtcctaatgtatgcagtgataactcatcatggccttaatttgcatttccctatgggctggtgacgttgagtatcttttcatgtgctacgtgccaccctttattatcttcaatgaaatgtctatttatgtcttttgtccactctacttgtattgttcattttttctatcataaagttttttttttccccacagttccatgaatactatagactttttttcctttttcaacttttattttagacttgggggaacatgtgcaggtttgttacctgagtaaaggtaactactgtgtgaagctgaggtttgggggatgaatgatcctgttacccaggcagtgagcataggacccaatagttggtttttcaacccttacctcctcttcctctccctctactcaagtaatccatagtctatattgttaccatctttatgtccatgagtacctgatgtttagctcccttttgtgagaacacacatataccagagttttgagaattcattatatcttctagatatgagtccttcatcagtaactttttaagtttcagagatcctctctcattcccttcaactacgagtgatctcttctttccctaacttctttacaaattttcacataggaccttttatcctgtctatcttgagtctgccatagatggccctccctaactgcctcactcatctatgaacaggctctatttctgatttgtcatcactcagtgtcttgctaacatttgggcacctatctggcattccactaatgtccaccaagtgactgaatcaactatacctggattttcattcagttactataagacttcagcctaaagcaaaagccacggttaccatggatacgcaggcttgggatagatatgtatcctaagcatttaatactttggaaaggataactaattacaaaaagaaatacacacactcagatgtgttagtgattaatttcttctcagctaccacacttctagctaacgctgtgacacactaacgtttattgaggagtttctatttacgccaacctggggctcacatttggctaattaagaacacatacatttcagaacttgtgatctgtgggctgtgtttacatatgaacatcatattcaatacacaggcaattgtttagcacctctaacctatttctagccttatatttaattagtgagaattgctgatggggaacgcagggtatgactttgcattaaacaaacagctatcctccttacaaatcacaacaacaatgcataattaaacaatgagctacctgagctttattcagtctttcttccaaaggaattaaatctctaatgaggaccaggcctcaggaggaactgcagaaggaatagaggtaaggagacataggggtcaattctagccctgcttcctggcctttctgggtcttaatgtccttattgtgagatgaggaaatgaatactcctccctggctccccatccttctcttcttctctctggtatgcatgttctaaagatcacatgcaataacagaggcaaatctctttgctaaagtaaagcataatataaaatataagaattgtcactgctgtgagttaagaggatttcattatttttacactggagaagaaaaacaattgccattaaacaggttctccatgacctgtccccatctcttccctgccctcatcacctgtccttcctctccctgttcacatgtaccagccacctgaccttgctttgctccttcccatcatatcaggcacatgccagccttgggcaaatccccctcctcatcaaagcctttccatgaccgatcctccaattgaaactatcactcactcccctcttatatcacttcttttaatacagtcagagtacttgccactgtctaaaaaaactgtttgtttacttgttttcttttcttttcttttctgcttttcctactattctctcctgcttttcctactactctccaccagaatcaggagcagtaaactcaatggctctgtcttacttccatgctacaaactcaggtgagttcactgtagcctccaggagggaaatgtacattatgttctctgggacaaagctcccaggcaacaggcaaaaatgttccttttattctacacaactttggaaaacacctctgaatccaacgttgagagccatcatccttatgctgagtactcaagagctcccaggattctacagcccataaatgagacaatttgacaagagtcactagtggtgaccacagtaatagtattaggatgaaccacatgaaatcactgagattcactgttttggccctaaccactttcatatggtttggcatagtaacaacaatggcagcaggagcccttgctacatgccaggctttgtattaaggctttaatagatactagttcattcacttcccaccacaatcttataacctaagtattaattacctatgtgttatgcatggaaacagcaaggcttaggaaggttaagggatttttccagaggagaggtggtagcatcaggtcacaaacttaaccccgtattatcctggaagagctaatgtgtgttcccttcctagggaccaccatgaacccacctgggttctgtgcatggaaataacacagaaatggaagttgctgttttttgctttattgcctccacgactttgtagccattgctgttgactgggaatctctaaattacaccaacactcagggtcatctgagttgacaactttcatggccacggccactacgcccaagaaaaaaataagttggaggtaaaatggggtataaaactatcttctagcactttctgctaattgtcttttacccagacaaggaactctgaaggactctgacatcagtttgcgatgcctcagctacctctgtcctttggccatctctgacccttcagccaacttgggaccctcagtcctggtaagagatcatcaggccttgtgccccccaccccaccatcttggtgagctgactctttcttgctcacaccatacctaagttccaaatagaactttagggcatctgagatcccacacaggcctccccactgctgggatcaatgataaccatctcatggaaagcctcttcattgagatgtccccagttacatcaccccaccagcccagcattctcctggctcacctctctccagccacagaatttgcatctcacagctgagaaatgggattggtcttctcctctctccatgtctctgaaaacatcactcaaccaccttggctcaatagtctcctgcttcaaccagtgccactgagcatgccaatctctttttgtcatgttgacatcatgtgtggccttgatttgcctcccccaaattcctcctaggatggcccttctcacagccttgatctcatcctgggcacctaaaggggtactgagaatggtccctcccacagctttgactgaaagttcttggattccttctatatccagtcaatttcactaccttctactttagctacttagtcttgcggatgtttgaattttttggacactggatttttttcatcgtataaatgatttcacatcccaaatctgacattatgtaacacctctttcctgaacaacctgccgagtttgtctataagaccacccacactgtgcattaagttcaccaggtataaaacataggtggccattgcaccaccaaagccagtatcccagacacagtgggttggagaccctcgggacatgcagacatctccccactcccagtcagccatctgactctgtggagtctcctccctctcttgttaccattcctcagttgtgccaatgtgacacgccacttccagactctcacctcccctgaccaaagctagaggcatggcctttcaatgatctcggcttgtggtctcaccatagagtctatatgccacattcctgctcaacatctagaggtgtcacttcaagctaccctcccattatagggtattaagctctgaagttagccagtaagggggaaaacatggttaaaccactctggaaagatcccttaaactgaccaaccttcaacaaatctgaaaagtctaatttctttttcttggaaccaagcgctggttctgcatttgaacacaagttggagtcctggttaggatttggagggctagagggtgcaaaaacgtccttatccattagggtcacactcatcacagcaagatgctccccttgtggacagctgtgtgggacggcagccagtgaagaggagactagccactctgaagcctacgttccttgagtagaatggtccacaatctaaatctaggggttcactccttctctccctctgcatttgtctctctttccatgtctgcttgtgtctgtctctccaccccccgaagtgtgtgtctgggtgtttctctctgaatctcggtcccctagcgtatgttgtgtctgtctttatgtacgtatctgtgtgtacctggctctgtgtctctctcagcatgttactgtgtttccatgtgtgtaagggtaaatctcccctgtctctatctcttcttgtctttctctgcatctgtccctgtctctacgtgtgtacctctttcttggtttctctgtggctgtctctctgtttctctctcggtcttgatgtctctctgtgtgagtgtctctctctccttatgactgtcttcatgcgtgcattgggtccttgtgtgcatgtcctcctcctccagtgagtgtctccctatgcacacatttcttgaggtgtagggctctgcaaaacacttagagttgacccatttcaaatatgttagccgcacatgattcccggccaggtatgccagcgctgccctcttctgcattgccacgcagacgcctaccttggtcgaaacacttgcagacatatctttagcaaggtatctttcctcgtttttccccaacaaaactcatgctgtaggaatctccaacatatacaatgaaagagtattgagctgccatagataaattaagtactgtgctcggcctcccactcagcaccaagaggccaaacagaatctaaaaccactgctgacacctagcacaccaaacctttccagcctctgcaactggcattctctgcatgtcaaaaacctctgaatcattctgggtcaagcacacatgcctcctttcacaaaggttctgcaaacaggtagcatcctgtaccccgagtgtgtgcctggtacctactggtgtacccccttctcattgagaggtcctgatgcctgtggtgtgagtcagtttgagtgtgttaatggagtgttctgctttcaaggccaaactgcataagcagagcccatccttttcccttcttttgtgcccagatgggaggaatttgtgaaacttgtattccagtgttaatgctgaagttgggaaatggctcaatcaagcaatggcagtttaacttgaagagtgcaaaggagaagagcagggagaaaaccaacactggaagcaaatcagaaggccagaaaccttcatgggcacttgcactattgtttacagccacaataatcatgtaagggaacccagcatttttcagaagttattttgttctgtttttttttcttttttttccaaatgtgtgtttgtattgctttgtttaaatataggcctgattcattcaggcttgggtctgaagatcccaggctttcagaactcaacaaagctttcatcatttgcaaataattcaactcaacaaatatcatttgagaaaagctctgtgctagtgcttcttgtagagacacaatgaagaaaaaatcacggtccctgctctttggagacaaataacttaggggaaaacacacacacctctcaactctcacctaaggagtgctgtgcaaagtgctgaaggagatggagactcctctcctgggaaaatctgcaattcgaaactcaaaagaagatgaggctaagggccctccaggtggaggaacagcctgagtaaatgcctagaaaggaatggcacatagtaggcacttgcaatcaaagctttgctaaatgaatgcatgttgaacatgttccagaaaactcaagaccagagtagcactgagaagtagaggtgtttcagggcttccttttagaaatttcttatactgaaggtttcagaatgctaggagggaccagggagatggtttattccaactggtttcttttgaaaacgaagaaaccaaaaacccaagcttacatgctagggccagaaatgagatgagaactcagaactgttccagaaggtaatcactttgaatttaaatgcctactcttctgatctcaatttaaggaactaaaacaaaatcagcagtactgtttgctagttttctgtgaatcattcagaccctggagaagccagcttcacttttgaaagctgagctgatccacttacaactgtgtggctaggttcccattactgagtctcagtcttcacaactgtaatataggaaaaacaacagtagctatcgtacagcgtagttgtaaagattcagtgagatcatgtacaaaaacagctcttaacaaggtcatcagtgaccttcactttgccaaactcaatggacattttttgtccccatctcactagacctctgggcagtggcatctggcacaaaggggctgctccttccccaaaacaccccggcaccggctcctgggatagccttctttcctgctattctttctttctggatgttcctcggtctccattgccaagtcctcttctatccaatttctaaatgttggcaaactgcaagagctcaattctatatcctcttatcttccccagcgacacacttttctcattgaacccattcagcccctccgctttacacaccatccaaatgttgctggcacacacttttatatccctagctcccacttctccgctggttgtcagactcaaatatcaaactacctgcttgagatctccatgtggaagtcatagaagagtctcaacccaatatgtcaaaaactgaactctccattgccccattcccaaacttagtttttcctcacctgcttaaatggtattgatactcaaccatgacttaagccagaaatctaagagtcattcacagcacctcctctccccctctcccaacatctgccatcaggtcctaaatttcatttgtgatatatatgttaaccgtatacgtttttctttatttctaccaccagcactgtctctcatctgaatgacggcaatcacctcctaactccactcctgtatctccacagtcagttctctgcccagcaaccgccatggtgtgtaacaaatgaaactgatcccagtactctgtgttccatccatcagtggcttcctcttgttcatagaataaaggatgaaacctgaaatacttcttcaaacttctccaggatctactcacaaaaatcctctggcacagctctcttcttctatcatttggctgcatttctacttgcctatttttcatactcggaacaatcatgctttttgtagagccagggccctcacatgtgttgctcaggtctttagtcagcaaactcttcttccttaatctagtggttaaaagccccagctctggagtcaaactgacaggggctgggtgactaaagacagtcttctggccaggcatggtggctcacatctgtaatcccagcacacagcctcccaggaggatcacctgagcccaggagtttgagaccagtctgggcaacgaagcaagacctatttgccaaaaaagaaaaagaaaaaaggccgggcatggtggctcacgcctataatctcagcactttgggaggccgaggcgggcagatcttgaggtcaagagatcgagaccatcctggccaacatggtgaaacctcatctctactaaaaatacaaacattagctgggcttggtggtgtgcatctatagtcccagctacttgggaggctgaaccaggagaattgcttgaacccgggagggagaggttaccgtgagccaagatcgcgccactgcactccagcctggtgacagaacaagactgtctccaaaaataaaaaaaagacaatctccttagtaaaactatgtaccttactttaatcatctgtaaaatggggataagaacagtagccacctcacatagtggtgaatattcaataaaacaaaatgtgtgaagcactgaaactactacctggcagaagaaaaacactcagtaaacattattgtcaaaaatccctatcatcctttagttctcatcttaaatgtttctgcttaaagcactctccattactctaaccctcagttttaatccattttatttcctagtactaatctaaattggtcatcaaatattgattttgagacttattgtccatttctgcctctcaaattacactctacagaacagggactttgtctgtgtttccttcagtcctggaaacctggcagaggagctgaggaactgagctttacaggctgagttctgtgaccctgtgattattatgttgaagccctcatccccagtacctctcaatgtgactttaattggaggcaggggctttaaagaggaaagtaagttaaagtgagaccatcaagttaaaattatgccctaattcagtctgtctggtgtatgtataagaagagagggaatttggatacacaaagagaaaccaggggtgtgcattcgagagaaaagattgtgtgaagatagagcaagaaggtggctagctggatgctcacaagaggggcctcaggggaaatcaactctgctgacaccttggtctttggcttccagcctccagaacggtgagaaaataaatgtcttttgtttacaccacctaatctgtagcatttttgttatatctaccataaaaactaatgcagtcagtaaagactgatgagtgaatggatgaatgtgtcaacccagtgctcagcacaaggtaagtatgcacaaaggttgactcctattcctgaaataatgatgatgaatgtaataacatctcaggagcaaatctaaccaatgcacattgaccaagtcactgagaaaaatatgtctcagtggcacttacagtgcttttcacctgtaatactgaagtgaaatgtgattagctatgaagatctgagaccttcctttaggagccagcacatactactctatgacttctgtttacttaatttgtacatgttggaacttgactgttttatggtagactcttggctatacaacatggaacactagacatttccatactcagtaaacaaatatttctcagacatgacagcaaaactagaaatgagaatattagattaatacttccaaaataacagcctcatcgttttaatcaacatgtccttgaacacgtttgaatgtgtgtgtaactgtgtgggaatgtgagctacatgtgtatttttccactgaaggtgaccataccatatgcaagagcaggatctcaaattagatattcagcataggtagccatattatccacatctaccaactgtcttcaaattaaagcccttctctagctggaacatgtatctgtcactggaaagtaggcagtgttgaaaatcatgacaaaattggcacatatcttgatagttgcatcatcttttctgtggcagtccccagtaatagagcttcatctaattcagcaaactattagctcataataagaaacagcatgtgtattgattcttttaatagatcttggaattaatacacatgattcctataaaaggactgtataaaaaaaatcaccaagttgattattgcacaatgaggtctcactcaaatggcataggctacggcagaaaggtaggcaattcctcttttgaaaaaaactctccatcttacagactgattctctcctgaggaagaaaaaatataatgaagtgctataattaggtatctcacatgtaagggaagataacaaaatcaggaacagcaaataggtttttactgagtgtcaactccattcaattagctgcagctacctagagggttgtattaagaagcccaaggtcgacagtaaacaatgccttggtgaaataatgatgttggctagggttgcaaaatgatgagtagatggccgctatgtaatttctactctgaaacagatgtcactaaagtctcttccggggccaaccttctatgactctctccttttttctcctcttccctcactcttgctcttggagttgggatgaataagttagcatctcctgagaatcccaactttctcctcttatataaagtggtcaggctcagttttcagtatcaggattcaaagcagcaacctctgtcattacaatcatgtgtcgctttggtataggcattgaaaagctgtaccagggtgctgactgtcacttaagtaattagactaaactataataaacaagaagagatcactgctggagacccacatttgttaatgacctccagggtcctctcccctggcaagagatagacagatgaggtaccaggagtgcaggcctccttgcacgtataatgacaacagccagacaacaatgcaacaaaaatggtcccatgtcctgttctgtgtgtatagggagagtgatgacaatcatcattaccaccagaactaccaaatttcctctccagttctttgatgcttctcaatcattgtcggagctaccctttaaagatgtctcaccatgaacagttactatgacaagatactaagaagagagtgtttcatttaaccccttccatcactacccctatgagacatgattgcctttacttgacaggaaaatgaggttcagggaggttaaatgtatgtagaagattttagcaagaatattctgacttgaaatctatgttcttaatgatttaggataccagctcacaactcaaagcatgaagcatgtggcaatactataggaggtaagagatctcatgacaggaaactcgggttattcattcattcatccatctagtcattcatccatgcatatatccatctctccactcagtcactgtgtcaacagatatttaccatgtaactatctctgtacttggtactggggcagaggtgagcaaaacagataaagcccctggcctcacagtgttcacagtctaatgaaagcacaaacatcaatcagtgacattactgtgcaatcacaaattgagataatacttgaaaggaaagtaatgggagcctatgacaaagatctggatttggggtagggtcagatttaagaaaatgagacctgagagctgaactgataggcaagttgacattaattaggtggaaggcaggtgaaagaatggggctagagaactaataaggagataataacatatgtagaggttcatggaggaagggaatataaagtattcaaggagctatgagccagagcacatcgagcaggtcaatgagggaaagagtggtatgagaaaaacctggaaaggcagagaggaggtggaccatattaaggtgcatagggtggcagtggaaaccactgaaaaatttgagagagaggaagacagtgggtggaagaaaggggacaactgtgattgttcagacttcagtgaccacaaacaatacagggagcatggtgagatcagaatggagatgcagcaacctgtaacaggtcacttagttcagatcagagacacttggtagctttgattaggtgatggtggtagagatgagcagaaatggatggatttaagaaatattgtggggtaaaatctaaagcacttactgataaattggatttgggaagatgaggaagcaggaggcaaggataatccctagatttctgacctgaccagatagatgttgctactcactggctggcaacttcacaaggtggccttgttgactttggaataccttttgggcatcctagtggagtggcctaaaagggagttaggttttacatgttaggagttcagaaaagaggtctggggtggagacattatcttgacagtcagttttatagctagaaatggttgaggctttgggatagatagagaaggggtactttggaaaacaatgttcatggaaagcaataaacattctcgtcaatcactatattcttctaatacacttcttccttttgttatgagcatctgcatctttcttcctcttgcgtttcaataaaagcttctatttttaattacacttcccttggttctaatttttaaaagtattttgcatatctgttttatactatgtatccctataaccactccaacttttgtagaatgaggagagaggaccaattactagttttcagaagatccacatgagactccaaatggtcaaattatcctgacagcgaacccagcaaggaatagattaaatttgaatagtgcactcaaaaggactatctttgagactctaagacgattcttgattcattcatttcgtgaaagccaaaatgtccgaaagtggtttgcggatgaggggactgaatcgtgaatttgaggcctaaagaatttcccaatgttcagccttatggtggattaaatttaccatgactaattggaggattcaaagctgttaggaacactagctattagggccatttttctcatcttcgatcttactgcttgactgattcatagctggaactgctaggccgttatggaaatggaaatgcagagatgaagcagttcccaatgtcaaaaacttccagggacatgtaaatacaatacacgtaccaagtaatgagtttaattacttaattattagatactgagcactaaaatttaactaacacctggttccataaggaaaaaaatacttcatttcgctgtacttatagctctttattatgccttttgaattatctgaaatccactgatgtacgggtaaaaaactcctgcagctagctcagtgtctgtccaaatggccacccagttttgtgcttgaaatccaggaccccactggtgtaggcatctgtggggaatctcctggtctgtgggttgtgaagaccatgggaaaagcgtggtatctgggctggagcgcaccattcctcaaggcacggtcccacatggcttcccttggctaggggagggagttccctgaccccttgtgcttcccaagtgaggcgacaccccaccctgcttcccctcgccccctgtgggctgcacccactgtctaaccagtcccagtgagatgagccaggtacctcagttggaaatgcagaaagcacctgccttctgcattgatctcgctggaagctgtagcccagagctgttcctattcggccatcttgacagccaccaccccatttttcaattttttttatgacaggctaactgtgggctttcctaagagacatgagagtagtatccttcccctacaatcctcaggcctagcatggtgtctggcatataacaaataaatcaatgcagcctctcaaggaatcctcaaaatacagcagaatcattctagaaaacaattcatttcgattaaagaaatgaacaccatagagatgttccattggaagacttttgaaccaaaacatttaattcgccagtcctgaccatatctataacaaaaggaactatgtctttaacgtatttttcttgaaagccagttcatatggttgagagagcttataaggaatactaaaatagggaatataatcagccttctgtttttgagcaaaagtgctgtcaactagagatggggctcttggaaaatactttatactgcctgttctcagtttttttcttcttaagagctacttcatttcattgttcaaagtttagtgagagccaaaagaaaatacaatctatttacaataaacctatactttccagaatcaccttaaattatttctgctaactctaagcataaatcaaaagttctgaaaagcagaatggcctaaagaggaaatatgtcatttgtgtagttttgggaggggagggagtctgttaggaaagataaattattattgtcctaagcaaaaggacagctaatgaattcctaaatgacagggtttaatcctcaggcttgttgactacaaggttatagagctttcttcctttccattgttaaggagatatttaaatgtaaacatcttttctaaccttggaaggaaactgatggaaaacagtgagtattttcttggtgcaatttaaatattaaattcaaacttaaagcaattgttcacacatgcatttgctagctcaagaacacaaacataatctgtgggaataagaatcacaataaatgaaataataatagaacaactgaatccatcaatttttctagcatatatacactaagcaaatagtttgcactttgcataggattcagcattgccaatattttatttctaataagccaggtataataagaaaagcaaaatgtattggccaggtgcagtggcccatgcctgtaatcccagcactttgggaggccaaagcgggcagatcacgaggtcaggagatacagaccatcctggctaacacggtgaaaccccatctctaccaaaaatacacacacataaaaaaaaatttgctgggcatggtggcaggcacctgtagtccccagctacttgggaggctgaggcagcagaatggcgtgaacccaggaggtggagttcgcaatgagccgagatcacaccactgcactccagcctgggtgacagagcgagactccatctcaaaaaataataataataataataataaaagaaaagaaaaatgtattgttagtcttaaatattttctggttttaaattgagtcgaaaactcatggctcaagttcatttaaagtccaagtctgaattctaaaggttaaatgctagtaccgttagttcctcaaattattcacttgttttttatttttgttacatgagagagagaaggaggaggagagagagagagagacagaaagagatatcacagaattagaacttgaatctcattcagtggatagggatgagaagaaaaatgaacattcacagagcgcctaacatgtttcacgtatccaagtatcacatcaggaactttcatacttatgatttcatttattcctaaaaattaagtaactaagtttcagaaaaatagagtgacttgctaaagataattcagtgactgagtggtggaatcccagttttgaagatagagctctttgactccaagaagaattctcaatccataaagctttactacaaattagggaaaatggcttatctttaaaatagcgtgtgaataaataaatgagtaaagtttccatggggacataggcagcaaattaacagaacacaatttaaaatgttggatgtaaactaataaacagatgcatgtcactaaaacgtcacatttttcatcgtaacagtgtattatctgttggcaaagacctcagtaaagctgtttttatacaacagaagcacagctggctaaaaacagaacaaatgtggtcaaccaactaaaattttcaattcgttcaatgccaagaatctgcatggaatgacgttttaaataaaacaacctgaaagtaagctgacccataacaatttggtttttatctttaataactttaaatttttggttaatgtctctataaacagcctacatattattcagggtaaaggctcaaatatattatactaaaattgcttttagacccagaaaattcctttgcatggaggtatgaaaaaggaacatttgaaattagcttgaaatttgggtgtatttcagatatgacatgccattcacattcatgtgtttccattccccatgaacaatgggctgcgtgggccagtatcaatcatctattaatccagaactttccatactacctattagttaataaagtacattgacatccattaccccatgtgatgggatatttaacacacttccagaacatagaataaaaataaaggggtttatactttacctagaaggctagtgacttaagaattttggtgggaagtttcatccactagaggaaaagtcttatgattatgtggaaattatttatcacatgcccccaacaaaccccacaacatcacaatagacaaatagtggtgctcaaatagtgaacattatggaaataagggagaacatacatctctacccattcccaatagttttgaacttaggtatttataaaattaatttcatgatgctgcacataaatcttaattctaatgtgcataaacagaaaaaagcaagttgtataattattctgtgttattatttttaaaagccctatatatcaaaccaaaacaaatcaatataatgccaccaatgtgaatatcattaggctcagcatcttaaactcagcatgatatccatcgggccataaatttgaaggaaaatattcaataccagtttcataaatcatattaacattaggagaaaatctattatagcacaaagtcttattcaagggaaaatcatgttcataggaattaaacaaacaaaaaaacacttgtggccctctgctctattatccttaaattttaggaaataactaattataggagagttttcagtcatgtaaatcagagagttagcaaaacaatggttatattatgacagcaatcaataatagcatgcatttttattaaaacattactttctaaatttgtagggctttaaattgtctagcagaacacagcttgaagtatgatatatggatggaggttcatagaaaatatagtgtatgggaaatacagactccactcaggagatatatctgatttaaacacatgcatatatatgtgacaatatatatctaattatatactaaatctcacagaactacataaatatcttcttgcttgctttctacagtttctttaagaaaatattatttaagaggtgacaagtttcttgttgttgttgagcaacttgaattacttagtttcttgcagaactgtgtcttcttccagctagagtgtaaaatcacttggaatcataacatattcaaagagttttgtcttaacaaatccatgagtgatcaacttccttccatcctcaacaaagctgagaggtagaccttgccagttctaacctagcactggagtttaggtttattagatttagccagaaccttcaagtgattcttgaaatgaactttttaaagagaattaattaagcccaatttctagcctacatgattcccatgactatacatttatattagaattgatattcaaaactaactataaatatttaaaatccttttatcaacaaatgaaactagatcagcacagagaaagttgaactcaacttctaatttcctcctcttggctctatcaaacaagagcaaatcaaactggctgctaagagaactgatgaccaagacagactgggaaatgagacttctagggagtatgtcaccgtcttaaaggcctttctagactggatgaatagaaataactggcagataaaactgataaactgatttgaaaacatctaagtaaacatggccacatgcaaaggtatccagagaaagataattctagaatttgcagataaaactgctgaattgctttttggagcctgtgaagaattacagcagaggtattctaacaaagcagaggtattcaaacaaataagactcttagtattcaacctcccattgggcaaaaactagaagctggcacccaagagagaaagcacctctttcttgtcccccaagcatgtggcttggactggattttaccccaagtcccactgtagccagaaactttcatgtagggcataacctgtgcaactcacatatggttgtcctggatctaaatactgtataagaataaatatctctttatcaaaagaactaactacagctagccatgtgttacttaacaatggggatacatgctgagaagtatactagtatatttcacccttgtgcaaacatcatagagtgtactcatacaaacctagatggtacagctctctgcacagctaggctatatgctatacccttcagctcctaggttacaaaggtatagagcatgttactcacttaatactgtagttaatggtaacataatgataagtattcatgtatctaaataaatatagaaaagatacagtaaaactatggtataaaagataagaaatatggtattcctatatagggcacttaccatgaatggagcttgttggattggaagttgctttgggtgagtcagtgagtaaggggtgactgaatttgaaggcctggggcattactgtacatttctatagactttctgtacactgtatacttaggctatactaaatgaatcttctaaatttatgtaataaattaatcagcttactggaactttttaactttatcaactttaattttcttaactttttgacttttgtaataacatgtagcttaaaacacaaatacactgtacaggtatacaaaaatattttctttctttattctatttttaaaaccttttattttttactttttacacttttgtgttaaaaaccaacacacacacacacattagtctaggtctacacaaggtcaggatcatcagtatcactctcttctatgtccacatcttgtcccactgaaaggccttcaggggcactcaccatggagccgtcttctcctatgataacaatgcattcttctgcaatagtccctgaaggacctgcttgaagcggttttaaagttatctttttaaaaaaataataaatacactctaaaataacaataaaaaagtatagtatagtaagggtacaaactagtaacatagtcgtttattatcaagtattatgtactgaacataactgtacgtgtgatacttttatacgactggcagcatagctttgtttacaccagcactgctatgaacaagggaataatgcaatggactacaacgtaaagacagctacgacattgcaaggcagtaggaaattttcagctccattataatcttatagggccaccttcatacatgcggtctgtggttgactgaaattttatgcagtgcatgactactataaccttacaagcttgataaaaggcaggtaaaattctaaaatgcactgtttcagaagggttggtggaagcttggcaaaggtgttcacgaagagccagcatggctcccaaaggcacctcagtttctatgtttgttggataagcccagtagatccaaagaatgctacaaaatacaacatatagtatataaagctaccataattctgctttaggggaggatggagaagaaaagattagatgaacaaaggaagaaaagagtgaagaaaatgaagaaaaggagaaggaagaagaaagtctaagaaacataaaagaaaaaagaatggagaaaagatatcttagaaaatggaaaatgaaggaattaagaagaatcaggatatctgcaagttatatgacatactctctcacaatacctttgcgaagcatgtcattttcatctaacacagcagggctcaagcaagagtaatatagtaatattcaaaaagaccaggggtaggtagtcagttttccacctttaccaatatggaggaacactgatgtaaagaaaactatcacctatctttttagggaggcatttttagtgtataatcaggactttagaaggcaaactttctttaggctgtacccaccattgaccttaactgagaacacctctaccaaggtcagggggccaagactctccactccaggtgatgaaatcatacagtttcgatatgatttcacaatatgaactgtagatttttgataaagtaaaggcctggccagaaaaagggcagaaacctatatgaactttaaggtggtcagaaagctcagctctacttaagaaacacttttagactcactttagtaggctatcaaaacaaaaacaaaaacaaaaacaaaaaaagacacaaaaaggaaaaaaaaaatagttgtaccttcaagatatctcttgcaggaagcctagtccatcaagaaataaaccttcatctcccgattccaaaaatcagataccagcagttctcacaatgcctctagtggtaattctgtggttttatatcaagttctctatcctccccagagactcacagaaatggcatctcagcacttttaatccattactccccattaagtccattagttacataagcctagaagataccagtataggtcagcatgtgccaaagtgtgtttccacaagcactcaacgctgctagatgctaaaacacgctctgtgaacaaaagcgcttgctgtcaaatgcttttgagagatgctagagttaaacaaagctaaagttgtttatttgctgccagatttctgggagcctttcagatgccaatgcagcctgtggcagtgcaggaaagagaccaagaatgcaacatttcccacacattcttcactagggtctcttcatcttcgaattttgctgagcatcatcacagtcaactgctctaatgaacatattttgggaaatatacaaagaagaggtcagctaggtcatgtgagaaatccatgtttcgttcattgctcacacattaaattttctgcacaaacacattattctctgtgaaattatccttcactcgtagggaaaacaacaatagaagtcctctgcatctaaatccaaagggatctgagctgttctacgcatatttactgtgttgcttaagaatgtctcatggttctttcctatggcaatctccattccattattcaaaaatacaaattaatcacattctaagcaattgttcagtttccttcatttgtatgtggttgcagtctgtaagtgaaattccttaatttcttttctcaaagaaagcttctatccatacaaaacagtccccaaacccccaaattttgggctctaatatgagttaagtagaaaggtaaatgctaatgtttcattaatcctaacgcttgaatttcaccccaacctctgcagtgttctgctctctctgaagtgcttgtttgcttttcagttccccaaatttggctctggtaaaaacaaaacaaaacaaacaaacaaacactaatgggaacagtaactgtgttttgtataatttggggccattaccagctactttatgcttcatttgcgtacttgcgtgtattagatacattttgttaagttcacctaaggatatttccctcaatgggcacaaattcatggtgcctataaggtgactttagtacagcttcatcatctacactaatatttccagcagcccctcaaaagcgagatattttcttgaaagtaaaataacaaaacttactgtatgtctgatactgcagaggccacttaaattgtctataataagtccaaggaaaggatcgttgaagttaactggccttgggaatttcaagtacacctccctttgaaataaaaccatttccaaagaacgtcatgtcaaatgcacatctccctccagaaaattgtgttttcttttcaccccacccagaacataactgaatatcattttgctgggtagggaacctccctaacctgccttaagtctcatctatttccatttaaccatagttcccagctaacactacctctttcccaagtttacctctggcaagacaaaaaggatggtctttatgaacagatggtcttttcaaggtaaagtagttacatttaaatacagataaatgtactgtaaaaaacggctttaaaagaatttaggtctttaagggggaaaatatgagagcacaagacactattctttaattacatgagatttcttttttcttcccttgaagacaaaaccaattcctaatgaagcataatgaatcgtaaagaggcaccaatgctcatcccaacagatgtttattgattggtgttgactgaacacaaacacaagggtgttgcttactattgtcagtaagtggtgggaagcagcaccagttccccctggttattttacctttcaaagacaagctgacaaatttattttgtcacgagcagctgtgttcttatttttataagggttggcttacaactaagaaagcaagcggagggaacagccttttggtgtccaatgtgttatctggcaaggacagattgttttagggtgcaatggaaaagatttttaatgaaactacatttcaaacgagcagcatatgcttgattttcccttctgctactcatcctgccatttgttaatttttgttattgttgttctccgggactcctaaattttcatacaagctgtctcgtccggcactaacacagcttggggcgaattaatgcttgggatgcaaaaacctgcacgtcccactccagccatttttttttttttcatttctaaaatttctacattcaatcagggtttaaccggtgaactagttgacggaacaagcagggattaaaaaaaaaaaattcctcctctttgtgagtccttggagccccagagccagaaaatgtgacttcagaatatgtgtggacttgtcagcagctcagctgcacacaattatggggtcagagcccagattggaggtctggagaaactctgaaattgggaattaggacaaaatttttttctttttaacaccgtaatgccacatattaatttaaatgattctctcagaatgattctgtggcccagttaaatgaagttcaaggaaatgaatttcagcctttgacactctgagtcctatttgaaagtagtcggctttacaagattaaaaacaaattacagggaatacgaaatctttgattagcaggtgctttgatagctgcaagaatattttttctcaaaaatgtgaacacacatgggagaggcaccactattattatctttgtgtggaaggccttataatgaggattccattgtgtccagagactgaggacatgaattgctatgtctgaagggtcctggttcaagaggtgatttcagtaagacacagctgatagatagaacctaaggtttcatgggttcataaactctctttttttgctaacctcccataatcaattgaagaatttaagggactcacccctttctgtaggattcccttcataactaatgggaggcagaacttttcaacagagaaagagaatgctcgacatttttcaataccatgtgcatcaaccaatgggagaaaagggtcttggaagtttagacagagtctttggtcagctctgagctcaggaagactgaagtccatgtccaggttgccccattcactcattgtatgaccttgggcaagatacgtcaattctaaggagttcagttttctcgtctatactgtgggcatttcaagggtcactgtgcagatgaaacgagttaccacagggtgtggcatacagtaaaaacaagttaaatggcaacaaaatataatcagaaattgcaccaacgtcagtgccttattccatctcatttctcccattcagttagtttccaagttataagggttcaaccccttcatgctaggccctgtgcagacatgccttgctccatcacatgttcagccttgaatggataggaatgtccactgcttggtcactgttacagaactacacatatgagatgctccatcattatgtaactcatggaccagctagcaagatggcactagtgtcctagtgaggatgggtactcagaaccaagatattagagacagaatgtgccctgttaagttcagaacatataaagtaaatactctagagtttcagactaacttgatggaatattcaagaggcttgataagccctgaatggggccttgtgagacatagggccacttaaccttggacagtaagaatattattgccagcaactcaagtgtgtctctcatgaagaactggggctacctgtgaagcttggttcactagccatccccagactattccttggcatgtttggctgggaaggtatccttggcgctcactgtagtatcatacatttcagtagctctatgggtcagggttgatattctcaccaagcctccagcctaaacctctgagggtgcctattcttcattcctccagtgtcacctgtctcacacggggccagtcagctttttcctgcaggttccatcctgccccagattctgaaccaatcaaactccctgacaagtggaatccaagtcctatgagttcacagcttaaagtcttcacagcaagtcagaccaatgcctgaccctgctctgctcctgcaagtggcttataccctagtttagctcactgagtttctcttgtcttattcagtacaggtctcagtagtactcctgttcatttgggattggttttctaccttgtctcctcgaggttctctggaaaacagaagcaaaccagtatttgctggcccctacctagtgctttcatcaaattgatctacatgttgctcttcagtcacaggctccctcacttccgtatttttgctcctgacttatctcttcctcaaccccattctcaatctcagctcctctactgataaaatccctcccagttgaataccaactcttccatgaacctcagctagacagggtgtgtctccctcctctaactcttaaagtacttggtttctcaattctggtgcttctcactgcttcccatgatggcaattactgacatgtcttctctttctggttaaactcttgactgtcttccaaatgcatcttgccttatccactcgcatttcctctaatctgtcttccatcctaaccgtatagtgacgctcttgaaacacaattctgattccctctgtttctggccttcagtcatttcctaccatattaaaaatagagacttggatcccaaacgaagcctagaaggctttagttggccccattatctttactgccttatcttgcatttttggtcttctcttgccttgtgctcccaccacaccaacctctctcttctgccacaggccctctgcacatgctgtatccctccccaacctctgtctctgccttcactgacacctattcatcccttacaacccaattcaatcatgttttaaagaagatctcttgtggtctttccaactaggccagttttccctaagatatcctaccacaaacatgtcttctttatagcataaagatgtaattttaagttttttattaatttcctgctatcccactagattgtaacctccctgatggcaagaaccatgttagattttgttcaacatttcatccccataagttctgagaatatttatataatagttgctcaattaaatatttgctgattgaagttattttgggccaaagaccaggtttcatttttcttctcagcccactgatttctggcacaaaggagaggttccataactaactgttcaccaccaatgaaaatacaggtataatgtttaaaagcttcctatttcttcttgtggtactattaagtaggaccagagcagcagtacttcacaggggtagtgtggcatcttcaagtacaatgatttgtaggggataaagaaaagaaaaaaaaaacccacaaaactagtttgtgccacatataaggaagaatatggttctcttgggcaaaaatggcattgttttcaacaactgatatggactgcctcataattgctatagccttagcaatctatactggccataaaggcaagccaaagggaactgttatgactccagagagttaccattgcctgtctattaggccaagttgtaccccaaccccaaaatgacagatgatttgctacacagtgcccaagagaaggaagaataataaaagaaaagccgtgttctcattctgtgcatagttttgcctcacttcgtacagtaagtccaggagtcttattttccaaagtaaaaatggtgaaatttgtctttaaacactgcttctaaatgtgttggttagatgcttcatttctacaattaaacacctacctactggcttcagcaccaggtatttaggccatcctggcctagttccactgactattccagtgtctataaaacaccttcaccaagcatgagaaacaaacacagactttattttctacctcatctgtcttgcatttccttgtgcttaatactgtgacatttaagtggcagtgacacaatcagcaaacctagtgaaggatgagtctatgtaaaggcaaccatgtttgcgggcagagaatatcaactttatacgtacctaaatgactgctgtgtgcacagcagccaagcccaataaatgttaaatcacaaaactcacactataagctgaaagtgcctttaggtgtgtgaattccagtttcatgttgcaaagctacctaatattctaaggttgtcgggggagatatggaaattgagtctatagtagagagaaaagttctacaccaactccagaccttatcagtggtcaatataccaacccaacaaaagcaggttgcattctaccacggctattcattacaaataattttacttatattcagtgccaatgcccagccttctctagtccctgttctagctttacttttcttcattgcactaatcgccacttaacatgtgcatattttacttatttttttgtgggccctcattcccctcaaccaaaatgcaaactaagaagacagagatttttatcagttttattcattactgtatcccaagaagctaggatacaggggattctctctgagattatttgctggcaaatgaatgagattcttggcatttgctaggcactgttcctttcgctttccatgaattagaagaaggcaacataaatgaatagccaaaagcttgggcctcagagtgagataacctaagtcccaaaccttatgaagtgtttatcttgggcaagtctcttaaactctctgtgtcccaagtggctacctctaaaagggagatgataaaaaggacactacataaaagggctactatgaaatgtaatgagattataaatatactgtaagatgctttgcatagttcctggccacacagtaactaaacaacaaatgttagccattatttttattttctttctattatttttataattattaactattaaaataaaggtaggaactattatcattctctttctacaattgacggtacaaagaatgcttctgcttgaagttgcaaaatgttacaaatggttaaaaaaacattagagaaagagagcaggagagaaggaagagtaagaagcgttacaggaagaatcaagagatactagcctagaaataaaaagactcatcctggagaacttggttaaggtgggttctgtgagcatgtgggagcctggtaggtccagaatagacacttcttatagcagatctagaactggcaacgaactgtagtaagccaaagagtgaggtaggacctaacagattggactaggaatccaacctacatgacctagatttctgattatctggctccacttcctttaccgtcacagagagtaaggtctccagttcctcccctgtactagaatgctcccagacaacctaggtgattagtgagagtttaagttctctactctgaaggacttgggttcagacacaactcaatcacttataagcttagtgaccttggactgacccttaatttcttcatttgcaaaatgaggaaactaactgcatcttatcccatagggttgccatgaagataaaatgagatggctcccaacaagtactggatgctgtctggggggtaaaggaagctttcaataatcacataaacagaagtagcattcaacctggctgagcaaatgctttagataaaatcgaagttctttctcttccctgccctgactccccagaagagaataatatatggtataagcaaatccaaaaatacccgctaaaggaagttaacaatcagcaactatcattcttaatgtcttgggcaaatcagcatacttttcaaatacaaaaaacacaaacaaacaaacaaacaaataacacctcaaataattaagtactttatgaaaataagtcaaagtttctttagaaactttgtcttaagaatcagacaaaggccagcccaccacctatgtcatggaggggtcataaggaaagagaatgaagaaagagaaaaagaaaaaggggtgaaattctaatatttaacatctccaggcacacgccccagcctctcacgcagccctacctaccacaaccaaccaccacatttgatgcttgaaatctacctaaatcaaatcgatatttgccttagcactttccaaatatctaggcttcccctagaaatacttacaagggagatgatattcagtttagactcaaaggccagttgtttcaaatgtcaagtgaaataatatctcctcctccttcatcgtgctcataaacttatacaacaaagacatcctgaccctcagaggtcagagaactcaagcaagagaacgagaatgcaagatatctccaaggttattttggaactaggcatggcttgaagacacatctaatggtgaagggcttttaattgagatgctgcacaccacctggttggggttggggtctctgggtgggtggatcaggcagtgggggacagtgaaaactggtgaaattatcttggaatgtgcttttatccatagagcttggatatacccttccttagctgatcagagagggcccgggaaccaaaagacattaagatcttagaatgcattttctactctctcattttatagatagcacaactgagtcccagataaaataaaagtgtttttcccaatatcatacatctgctgatggtcctgacttagccactaggcaagtcccccagactccagcctgcggttgcttccatctatcaaggcctcttttcaagctacttggaaggctctcctagcaaagatgactacaatttatgctcccttcacaacattttgattgatttttggtggaaaagtaggcatccctgaagcatttctttaaaataaatccagcctgccaaaccagcactgatgtacaaccctagtagaagaatccaccattggccacaataatagcaaaaagggtaatgagaaataaacgtatttaagtttacaagcctcgaagaggttatcacacacaatgacaggaatctttgtgtcaggactgaacaagtaaccctgatttaactttacattttgatagagtcagccgcgttgcagtcattgtttcgtctaacaattaaaagcggaatttgaaactattcctgtccatagttccccttaaaaaatctaaagcaaagagattctctcatgccaggattgaatgaatttataattatctatctgtagctccaggacaaaagacttaaacacaaaaaagccaaataaaccaaggacaaatttctgatagttctagttaccctgcctattaaatgatagacacattaaaagaaagagagtgatatttggaatattcagaagttggtggtccatttctcatgctttgttttagtatcactctttcttagacgaaagacagtcatgaagttgtttgtgaagactctcatcagacaagagtacagtgttaataaatgcatttagcaagcatttactatgtgccaaacactatgctatgtatgggctgtcatgtacaatctcagttcatcctcataataaacctgtgggtaagtattattgctaatttcagtttaaagaaattagcaataatacttgaggaaactgaggcctaaaacaggcaaagtaacttactccagttgcatggctaataacttgcaatttggactcaaattccaaagcctgtatgtttttactcgctaaagtttgtggtcttggccagcaaatttcaagaaggcctgtcataaagccgtgctgagagggccaccttacatgccaattacaaccttatttaaaatttaaagtacgttatttcttcctgaaatggaaaataaaccattagatatctacaatattactatgctttagagtcccaaaatcactcatgtataattagttatacccatgatgtaaatattttaaatattattaaatgccttactataaatattagaggctggaatagttaaacagccaattaactagctagtggccatctctttacctctcagcatttctactctgttatctgaaacaacccatacaagtatctaagtagaagtttagaaacaacggggctttggggagctgctgaggagggacactttgcaacctccaaaattactgcaaaactatgtgcatatgcctatccaatagtttttcagtaattttggaggtttcaaagtgtccctcctgcccagctccccaaagcccatacagaaacctatttgagaagctttcgatctaagaaatgggatctgggaccttaaaaaaaggctaaaactcaatggtctggatatttgtgagactatattccaaccagtacaccaggttactgcttcccagactctgttcttcaaaagacaatgtgtcaagtttccaaattatggggggcaagggtagtgaaaagtgagtgtgaacctaacagacaactaactgaatacttccctctgcatctggaggcttaggaattcagcagacagacataagcaaaccattctgtgaaattgttagggtgctattctttctgacattgtgttggtttcctattgaacatctgaagactgttttaacatgtgtgcctaaaaatgtcacactgaggctgagagagcacagagccaggggccacccagactttcaaatcagctctcagaagcagccagggaaattccaaccttggtcttgtggtcctcaagaactacagaagcatggcagaattttagattcacaggttgtttgtacagttagtgcatttatacctaactcctcaaagccagagatattttttataactcagcattgccctcattgctttcttatcacatattttgcatgtgtttccatctccaagattcagggaaaacaagatacttagttgggaatgtctagagtggagaccttataaaaattacttgacagacttgggagaggaaagcattttgcaaaacaccagctatgagaataaacaattttagagaatcccttggggacattttttttcctatggatcccaaaatcttttttaaatagaaacatctcaggcaggggtaagaaattattggttaagcccatttagaacgtgtacgctgtcatggaacattcctatcaatggggcacattgaaactctacactaagatatggtggggctgtggtgctttactggataaataagaaggggtttggtcgctatactcccaccctgcccataaatgagtaagcccgtgtgacaagagtacatgttttcgaaaagaaagaaactgtgaaactgagcgtcaccatcctgccacataaaaagcaacagaaatgagaattaaattcagcactttcttaatgggagactgaggaaatctgggagatgaaacagtagctcttctccagtccttcccagcataataaggtcagctgacaacactgttcgacagagaagacttaatgtgtctgacagatggcaaatacaccatattgacttttcttcctaatttaacaaatttgaatcttttgtcaattttctttccccagtgaaaagatattctaaaacaccacttaagcttacattgctcttttccccctctccctcttacacattaagtttgacactatctaaagaaactgaagctaactcactaaattaactcacctttccagctcttcatgatcatcacaaatttgggcattggcatgaatgttaattcctcatctctgccaactgtaaggcagatactcacttcaggccagaggaaggtggctgaatggacaacaaggattccttgaactcttaaaaataacacacaaaagtgtgcatctatattcttcatacttcaaaactatgtatctatgttcttcaagagtccccagttttgcccagttcctgaaggtataatgcctctggctttagctataggttgttataattagccctcattctacagtttctaaccggactttggaattttatggggtttgtctatataagatggatgggatgatagcagagaagagcttcaaactagtggagctcctggatcacaaagctgtgtaagtcatcccaagtgtgactcaagttcagcctggagaagccatggccaggccaaggatagcttgtcccacaaggaggcaaggggccgtttcccaccactgcctcatcccttccaccatgtgaggacacagggagaagatagcatctatgaaccagaaagtgggcattcaccagacaacaaagctgccagtgtcttgatcttgaacttcccagcctcaagaatgtgagaaaaaaatgttggtcgtttataagccacccagtttgtggtattaccttagagcatcccaaatgaactaaactactgttttcataatttacaatgtgtcctaaaattaattataatcctaactatgaacatgaaattctgccaatgtgaaaataacattagtttctcttgacaacctttgtagttatgttacccaaaagtatctatagacaaagcatctgaagattttagtggttattcactattataaacaacaaccacaaaaaacccaccaccaacaaaaaaaacactgggtccatggagaaataagtttgaaaaatatttcattatgcaaagtaaaatggatttattacaaaaaccttcttagagcatctcatggaaatggagtttagaagaatactatgctttagattattcctgaatccagacacattttttttaaattttaactcaaaggattaaaatttccacacttggaatgcccctgtatgaggaagaactgaacgctgtcctgtcttgtctaagtttcagagtaatccctatgtttctagctgattagctggtttcataaggcaaagggccttctgaaaatgggccattgcttctgtgacaaattcaatatccaaattctattgctgcccttgaactgtgctctctgatttcctgctgcaaaaatgtaggccatcagtggggacgtgaaaaatttgttcattacacacagattcccacagtggcagtgcctggccacattaccgaacctatagataacatcacagcacctgacatccagcccacatttcctcagcctcagagtaaagaacataccacggtgcccgcacattaacgcagagagatgcccttgataattaacagttcttatggagtctctcgaatgctaaatggtcaaatagagaagttaaacacacataaaacatttaatgtgaaatgaggcaaatatgccaaattaacctgaaatgcacacaaaagcctttcagctctggaatcgatattaatcattttctggaattcaagaaaaagtctgatgtggttaatttaaaattgtattttatgatagagaacaaaaatatcccacaggattcaaggtatcagtttacactactgccactcctttttgctgccagggtcagcaaaaagaaaaaaaaaattattgatctggtattaaaaatcagttgacttcacttctttctgaacaggtattctttgaccactaagcactggctagtcttacctctctctagtgacaacatgaagagataaatagactattcaaacagagctcttcgcgttacattagctgaataaatagtgatgtatggtctcttttctcaagcactgccttagcttgtgaagatgagagtgaggaagatggggcttatgaatcctatttgaatatttaaataaacacaaaataacatccctgaagatggttgtttaagtggaaaaagaaggtatgaaaatctgtcttttaattgtagcttttggggcaacaaaaaatcccccaagaaacttttgagattccagtgtcaagtgaaatcacagaagaaaaaaaaaattaatttgtggttttataagcagtatccagaggaaatgggatgccagtcccacagggttttcaaaggctgcaaagctagcacaaaccaattcacctaaagtgaagtatattatcaataactaactgtgatcactttttggccttccagctaagatcaagtgtaataactaactttactttgggaatatttcacaatgaatttttgccctctttaatctgctttaagatttctgtgctcaatttccggtatatgccgtacttgcagaaagggatgaagttctgagctaggttaagtgcttgtggctaactacaaatgtgttaacacaatgtaattaggtcatcaaacagcatcatgtttattaggtaccaatagataaaaaaagggagcaggcctagaccagcacatcagccccagtccctactgtcttggaactgggattctgagacatctccgtggcttctacacattactggcataattactaaatccaaagttttctatttgtaaattagagattctagcaaggaaaagatgaagtcctatgcatcgtgcattagccaggattctttttttgattttttttttcattctgttgcccaggctggagcacaatgccactatctcagctcactgcaacccccacctccctggctcaagcgatcctcccacctcagtcttccaagtagctgggactagaggcatgtgccaccatgcccagctaatatttgtattttttgtagacatggggtttggctacgttgcccaggctggcctcaaactcctgagctcaagcagtcggcccacctcagtctcccaaagtgctaggattagaggtatgtgccaccactcccagcaggtcaggactcttttggaacaaaaagaaggggtatatttattggttcacataaacacatcctcaggaatgttaaggcagaaccagtacagtcctaccttcctattggcagttttactttctatggtttcaagttgcctacaatcaactatggcctgaaaataagtgactagagtacaatattctgagagcaagaaaaagaccacaattattaactttgtactacaatatattggtatagttgtactattttattagtagtaattgatctcttactgtgtctaatttataaattaaacttcatcgtaactatgtacatataggaaaaaacagtacaaacagaatttggtaccatctgcagttttaggcatccgctggggtcttagaatgtattccctttagataaggcggactaatgtatagtcctttccctctccagtgttggcttcattctctcagaataaagatgacaacctggctgtggaaggtggcctcaggaagctcccaacctagtaatcagagaagaatgagaggattgccccattagtaccagaaaatccctatattagcaaagacagggacctgatttggtcaagtctccattcctgtattacccctgtggccaaaggggattgagtaactataattaatccagtcatgagggaggaagagttgctgcatagaccaaaaacaagagcctctacgtactgaagtgatagggcaaagaacatatatttacgaattataaccaagtctaaattgtattcgaattcctagaagatcaatgttacttaactttcctgtgaataatactcttgcctcttactaagtagcacactatccctaatattccaaggtgaaactcagtcactgagaattgggcatgctgcaccagactgttttcccagtagtagcaggagatatgctgaacctcatattctttctctttactgctttattatcattaatgccttagactgaatttctccagaactgatcatgagacaggaatctgagtacaaatggattatttgagagatgggcccaggaagcaccattaggggagaagtggaagtaagacaggggaaaaaagaaatctactacaagaaacatttataagaatattagtgcttcaagcaattggggctcaaatccactggggggggctctggaagacagcgtggaacatgctaccctctgagttttcgcacttacgacataggaagctggggaatttatcctcaaattcccactggtattggctaaacattgttcctaaagtcaataattcctgacactttaggcctacactctacaccagcaagagaaagccccagagtgcagagtaaaaggcatgtgaaatagaataaccttagcacatatgagaagggtgagtcccagagaatggaaccaaggcacacagccttggctaataccagtaacacacacttatgaaaatgtgccttcatttattcaaatacttaccaagctcctattaagtttgagttttcttctagatgatgggcatacactgagggacaaaacaaagattattgtcttatttaatacccagcacaactgggcggggcaggggcagattccaggggctacatgtcataatcctcttcacaacagcaacttcaaatgtggtccctaatcttaagagtagcagcagggtcagcagtattgggcttcaccattactaagccaggtgtgttgaggtctatgatccagtaatgaacctgaatcagaaatggaatctcagataggtattggaaaagtgggagagttcccatcgtaggacagtgagttacattttgtttaggaaactcttcagggacatcttctctgtggtggcttgtgtccagaggcactgcagagttgcctgctctaactcttgacagttgagtggggcatgcagcttctggacatggaaaggactaaagttaatttgcccatctggggattgaactggcatcagtgacttcaaatgtgccctgcagagcccaaatgatctccattacaaacacagaatgctccgccttccaaatgccacagaattccattttatctgcactggcagggtaaggcagagtatttgccaaaactccagacatagggggttatttgtaaaaccttagagtattatcaggtgttgctttcaataaaccattacacttgtatagaaagtaacaaactacgtggtctaaggaccagttatccctattccaaaaaataaagtgtaagtaagtaaagcaattttacattgaatcttgaacatctatgtacataatttagaatttgctaaaaggtaattttatctgtgctgattatctttaccatttggcatttcccatctcagggcaatgagtacaacttcacaagtccagctccgcttagctgtgagtactcaatttcactaaagacttaaacagaaaattaaaaatctgtgagaattgggatgagtcctgtctgtcttaaagcagggtgagcaaatatatgtggcacatgcccttaagagacattattaattgatcacctctcactttcacactgagcctaggctgaaccttagaatccgtcacagcgcaggtgtccactcagtcatgactggccttccagaactgggtactggaaatgaaacctacttgacacttaggatacatttatagagcctggtcccctcagtactatactcccctctcacaaacagagagagagaaaaaaaagaggaagaggagagcagagaaaggatgggggaaggaatgagaggaagaaaaaaaactctgaaccaagtatcacttcctttgcggtctgcacatgtcaaggaatactccattttaagcatattataacggcaaaaagaaaaaagcactatcaatagcggttcacactttatggctgctcaccctgaaactgtagcagctaactttcttgggaaaactcagacagactcattctttccaaaaacaaggaaagaagaaaaagaatttcccacatccttaagataactgagaagctctcagtaggagtaaactgtccaaataaaattcaacggcaccccctttggaaggatagttaagaaacaccacatgtacaaagaaggattaagattccaaatactgtcttttctccaactcgatttttccttcttgtgcccttacttctcaaacagttattccctttgctatatcacccagaagtctgtgattggatctcccttggactccaaagggctctgggtatgagaaagtagtccaaaatatatatatatatatatatatatatatatatatatatatatacacacacacacacacacacacacacacatatatacacacacacacacacacacacatatatatgtgtacatatatgtctaggatttactatagaaaatttttaaaatatttttatgtatttatatttataatatatttacatatttagttttatatatatttatataaatatatacatatatttatataaatatatacatatatttatatatatataaatatatttatataaatatataaatatatatatataaatatattttgtattatatattaaaatatatacgtatatatgtgtatatatgtataggatttactatagaaaaatatttcatatttttatatattcatatattttatattatatattaaaaatatatgtacgtatgtataggatttatatacatatatgtatatatgtataggatttactatagaaaaatattttatattttatatatattaaaaaataaaaaaataaaaatataaaatatataaaatatataaaaatataaaatatatctatatatatctatattatatatagatatgaagatataaaaaatctatatattttatatagatataaaatatataattatataaataatatagacataaaaatatatatttatatattttttctataggaaatcctatatatatttatttatttatttaggactgcttttcctgaaactctgtaaaagttttcatcatactagctatttcttgtgatgagccagatcatcattcacctggtataaatgagcttggctgtgaacacggttagaaattagagccaaggatgatctattagttcatcgtgtgtgtctcatgggacaaaagcaaatgtgtttctctaaagagttttcttgaatggtttcccaagtccaacttgaaatcacattcacaatcttgtcattttcctctttcttgcagcacaccagtaattagatgttttaacacgtcatggcaatgatatctaacatgaaggcaaactgtattaagacacagcatcacccagttttatactgtaagctcatttccaaacattatttgtttttataaatttgagcgaggctgactctttcctctctgcctttaattaataaggaaagcttaatatgcacttttttttcatcaatctggcactaaaaatcctgaattccttttgtagtaatttgaaagaagagtttggggctattaggagaaattcacattaggcatttccctacatggcctacttatgtttttcaaagtgaagggatatttcaaggaaagaaagacttggggtactagagatgtctgccccatctaaagtcttatttttctatttcctatatcaagaagccttaggtacattttagtaacatagcttgaaatatattttgaaaaggggaacaagacgtaacctgacccactacagaaaaatgcctcatgtagatccttgaatgaatttatgactgtaaaagtccctctcttttgtttcctgggtaattatttcacacatttgggaggtttatagggaatgcgtatcagcttttcaagtaaaaagtgtgagtctctgactcttcctggaaatctggaagcaacagagaatgagaaattctcaggcagcctccaaaattgagcaagagatactgcaggtcaccttcagtgctgaatattccaaagttaacttcgttaaaaatgcacaaacaacctgataaaatatctgattttaccttttaaaagtaggattaaaaatttaggaagcttcgtgacttactctcgcatctctctttgatatttctttgtttggtatttctctcacctcttatgccctggtggagtctattgttggtttatgtgtaacatgatcgaataaagcaaaattgtaaacattttctttttaaataaatagacttttacctgaacattataatcacagtatctcattcatccattcactcattcattcatccatctattcattcattcacccattcatttattcactcaggtattttctgagttctttctgtgtatctggcgctcctctaagcagtggggatacacatgtcccctgttctcatgagcttacagtctcctggtgaaggattttaatcaaatcatcacacttgtgcctaagggtttcaaactgagataaggatctcaaaataaaggagcaaacacccgaaggatcaaggacgacttccctgtgggggtggtccctgagccaagggcttcagcagaagcagaggttaagtaagtaggaagtaggacaagccctccaagataggggaatgcagttagggcctcgagcaggaggaaacaggggcaaagctctgaaagtaaaggacaggtagtatttgctgagctactctaagacagattctcccacctatgctgacagcatgcacaatttcagctcaatgaatacaaatgaatgctctaagtattttttagattctctagattatgcacattgaggagcagtttggggtagggatgatggaggtctggccattagactcaggctttaaagaggttctgggaaggggagccaatctgaagtacctggaaattggaaaaaatagatgaacagtgattttatctggcttccaatggcagataaatttcctttcgggaaaggcagatattctcatttcaagccaggctcctctgccctcactttagcatatgaggaaactgagctcttgagttcctggaaacctttgagaatatggagacagccttttcactaggtcagtttagcttcagagggaatgagatggctgacttcccccacacattaggactttcattccaaccctcggccagcacctagggaacaaagcaaggccccagctttagttctacttaaagtgagacactgcttgctctttcacactcaggttaacattcactccaacaatgagttcagaagtgaccatgggaagacaagaggctttccaaataactacctcaccatggcacagggtctctgagggctgggcatgttagagtctgagatataaaacacagtataaagaacgttctattttgcaaaacaatcacattctacaatctatacctaagtaacaggaagagagcagatctcattatgtcccttctacaagaagaacatctgcattgagttgggtgtcttcatagggagtcattctcagggaacgtgaagcttcctccccatcaccctgacctcccttcccctgtaaatttccacattgattgattgtaaacaaattgtgttcatctgcccagattccattatatcaaaaagacatactcctctccacaaatatcggagatagacagacagataaagaggattactttccagtagcaggggttcctccccactcttcctccacagagaactttatttctagtacatagtagaagaaagagtcaagagacggatgagaagacaaactcagcaaagccttatttttatgctgctgttgtttttaacctttagtgggaagtaataggagacctcatactttatgaagcctttttgtatctggtggtagtttttaaaaagaccatcagctaaaatataaatataaatttaaccatggatgattgtaatttcctgcattatatttttatgtattttcgaaaagtatctgtaatgagcgagtatcatctctgtaatcagaaaagaaactatgaaaatatccccagtgagatctgtgtttgctcacagggcactatttggcatgatgagagtgaggggaatgatctgaatgttttcagtgccaagcaccatgttggcctcaatcggtagcaattctaattctttttcctgtggatttgtatcagttgctggttcatttaaatcagctattaaaggaataaacatgaatcttaaaaatacatttagagaaagtatattgttctaaattaagcaagcagttggcatttcaaatcatatggaagcagatgaggggaacccgctctcaccagatctcaatccactttgcaaactgcttactccttaacttggctccctaattagggcattttatctttgtgagcatttaccattactgcatcatgataactcttggctagtattctgtgaagaaataattaataataatccacaccagccaaaagtagatagagcaacatgagcaaagaactaggttggtgtgatgtggctcaataaccacttggggaaaaacaatgagagggtttttattgaccaaagtggtttaacaaatgacacttaagtgatctactggcattttagaacagaggcaagactgctcactcattaagtcattttaaaaatagtcattatagagcttttgccataaatcaagaacaaaagattccaggaaataattttttataattcataaacacatagtaatgtggaaagaaggactctatagagttgaacagggttatcaattacattttccagttgtctatcctagagacaacattccttccgtgagttcaaaccttaaacatccagatgaggtattgtgggtaaacttgaggattgacacacttcagcagactaccagctccatgagatcaagggccacatctgttttatttagcgagaagcagaattaggccatgtgtgacagtgggtgttactcagcaggtgctcagtgaataatgaatggattaatgacattgtatagtagtgtctgactttgcaaacagaaaatcacagcctttgtgaatgtaaatttacacagtaaacccaataccatatagacttttagtgatattttggtatttagaaaaaagactaagatcttctccaggtagaaaggtattttgtcaagtatttgctgtgtgtgtttgacttgttttggcctgcaatgtaaatgatcctgatagacatctagttctactgggttccacagcacttctttagccagtggggtcttgtattcaacttgtatttatcacgtccttctaatttcacttgtctcaccctggctgttattataatcccaaacagacagatacattagtaccccaggcttaagtctcatcctattcattgctatcgggttattctctaggaagcatctttcttttcatcttagtcccttcttccttccttccatcagtcctgaatgctttctgagtcaaattccgagagcagaccctggctcctgaatctttttatgctcagaccctgcaactgctcaacagtcgttgtctccctgatcctcttcacacagccatatgtcggccaagatgctcaactcactactgccacctttatacctaggctcatgccagtccctttgcagagaaagagaaacacagagggagagagaaacacagagtcttgagtccctggatcaagccatacctgaagtcagaaacttcccttgaactctttaattatgtgacccaataaatcatccatttactgtagccagtttgggttttctgacacttgcaactgaaagagtctttaacgtatgcagggaagaggagatgaggaagagaggaacataaaaatgaagtaaaacgaaacagaggaagaaaacaatgaaagatttgtccaaggctgtagaactaaacagtattggataagaatatagaacatgaagcccagagcccaagactctttcccctactacttcccttcagaaattagtactattactcattgccacacattgttactttaaacctaaccaaatgagaagtgacctgccatcaagctcccgcaggtttaagacatatatttgtcctgagtaacttatattgttttcctggcgtagtacatttaagaattacttttacaattaagctgcccaaggggtctatagatgcccgttttaatttaaataaatactaatgctaaaatcaatttgtaggatatttcaattggaccgataagtacagtcttcactaaatccaaagtatttccctattagcgcatctttagaagcgtataccaacaacacatcaggattttcagaaacctgctacaaatacattactcccagagactggatcaaacagctgatgatcaaaacataaggcaaaaactagtatttcatctttgaattcggagtacctgatttctactaaatattgattagagtttttcccataagagatcctgctttgtgcctccttaattttcttggtttcaatagtgctttgtgcagagaacagcagaagtaaggcagaggatacagctgtcatctgtgccacagacattgacatgcagcttagtcacagaacagagagaacacgtgaaagtcaccatcacaccctcgcaacagtgtcagtgtaaagactcaggttccagatatgaagacaggactgaaaatgcttctggctacaatgaaatgaatctaccacacacttgccaactttattcaaactgatgatatttttctttaaacaatggatttagttattctacccgtaagaagtccaggtcgttaatgaaatgataattttctacaaactaaaaacaaacatatctcatcctactaatggttcctgcctctccaatatttcacttaggccatctcccttttctcttctggtagaacaacttcaataggtaagaaagttttcttacatccgggaaatttctttaaccaccaaaatccatggtgtttgcttttcatcttcaactcactccttggtcgttacgacatgttgcctcctatttctggttatctatgttagtttcctgctcttcctacagaattgcaaccccggaaagagaggtactgagtctcacacaccttcttcacctggagcttgtaacaacatcctacaaagcaagtaatcaacatgtgttttacagagaaaactggttatccctggactgtattaaaacagtggtatgggtactctaaaataacaccaatgtgagtgtagaatgcatttctcatttaagagaggtgttcattcagcctgaggatgggagaatttacgaaacctcaaaccccaattggcaaacagcctctctaccttcccagtttacaaaaccctacctgagagaaggtgtcttctctcaaatgaagacttccagatcctgttctccacagacaattaaatgtggtttaaaagttgctgctgggagctgaggttattacccactttctgatgaggccggcgccaccaaaaccagcctgtgggagctgatttcactaggactcccccaacattttcttgatgttggaggtgtaacggggtctcagttcctgttcaactctgcctctgactggattctaggtcttgagcaagtcactgcttccctctgaacctcagttaacctcatctttaacatggggataaaattcctggcaccatagctacctcactcaatgctggggaaaattaataatattgatagtgttaataattaaataatagctaacatgcactgagttataccatattctaggcactgtgataagtcccatacctcccttaactcttactattctcataactactctatgacaccaagcaccatcattatgtctcttttacagatgaggaaagtgaagctcagagatgttaaataacttgtccaggatcacagagctaggaagaagcagagcaatatttgaacactggcattgtgggttacaaagcattactcccagaatactgccttacaaaaataagataagccatgtgacacaaaaatcttcacaaactgcaaaatattaagccactgtaaagtactgttaccatcaatgcaaatagatgctcattacatttattgtaaaaagcaggtaaccaccaacccgtttagggaaggtgcataaacctctgtcagcaatactcaatccatctgcagagaaacaattagaactgcattagcacataatcacagaagaagttctcttgacaccatttctgccaaagaactcattcttccctggaatttgaaaaggcaaaaagaaaaaaatcccatgccgcatctgacaataggaacaaactcttcttgcagctctggtaatgcaacacttctgaaagaacaagttaaggaacgtacttccactgccctcattagctgacaacctctgtggggactgcaaaccagccacacattcaaaacaaatcccagggaagaaatcacaccacaaagcctgtttctatttgcaagtaaaatgacggccccaagtgtctttccataaagctgtgtggtaccaaatccaaagcccaaactggttacaaagggtcgccattgataagacatggcatttcaggtccacccaccatgggccaaggaggtataaagctcagaacgtgacatgcaatttttaagccctcctttcaccttgtctatgcactaagttactttgacgccacacctgtttctattctgcctggaagccctgtctgcacaacagatggcagagtgtttgcctaacaaatgttcttgtgggtcagtataagaaggtggtggtggggattgttgtgggtacgaaaggagagaggctctgctagagcagcaaagaaccatcgatctccaacttagctagggaaacttcccacccaatgagggtctgggtatgtctgagctctgaatgttctcacctctgttcatcccttctgacaatcttgtccaggatagtacaaatctgctgctgcaaccggaaattacaaagaaaatctgatgtaggcatttagaaaaaaaaaacaacagaacaaaaccttatcaaatttaaaagttaacttcaaattcaattctaactctatctccaacttagctctcttgaatctaactgaagattcaactttcttaactctaaacttaacccttgaatcccaactcctagctttcacctctcaagtgtcttaactctaacttaaagtcaaacttagtctcttgaggaggtaattaaacttcaacaactaattggaatgagttcttgtgaactgagagcttggcttatcaacacatctggtcttcagaggttaagaaaaaactcactttctgttattgtaaacttaacaccagagtaatgttttatttcagctatgatggtaatattttttaaattatgctattatccacttaaaaaatccatgatgtaaggtataaagtaacataatgctccttgatggtgaaagcacatcttaggcaccatgctttggagaaaaactgtggatctggagggaatctcctcctcccaccctaaaccacacatacctaaaccacacacagcaccgggtatacctcagtcttcaacataaagaaccaactcggcacgttccatttcatttgactcacttgcttagatagcttaggaaaccaatctgctcaacattagtaagtctgggcccattaaaaggggactgacactaaactgaaatccatttcatctcttctccagggttttcctcggactctctgatcagcctttccttcacacaggggtgaggccaaaactactatagatgaagaagaagagagtgagatgatgttctttttgagggccaggatgacactggctttgtccagtgttttcatcacagaaattgaagtgggcatgtagtaggttctcaaaaaaacaaaacaaaactggtgaataaagacgatgtgtgctaagcactaagcagagacctccccattcgtgctcttatttaatactcacaaaatcctaacagcagggggtattattattccaattttgcaaccaaggaaacacatgcaaatagctaacagtggacagcatcagatttaaatacttaaagcatgcatttcccatgagtgagagagacattttgcaaacatgggtagaatgtggctttgtgacttgcctcaagattcaccccatcaatttaggcaaaaaatacaatcttccctgactatttagttggaagataacaagtcagggaaattcagtctagcagtccatgggtaagcctcaggggaataggaggcccctgaaattaaatgcgacattttgtgtgtatgtgaatttttccatggaaaaagtctgcagctttcgaatacttgaaagattctatggtcctcccagcccacaaaatttaatgacttagctgcttttaattaaagttatgcttctaattctcatccccaaagagtccaaagggctccagacaccctttgtatgcctactgaaagaaaaatgattagcatgaaagcctggtgggtattagacatgagaatagtcaaacaccttaggtatggaaagcacccacatagatcattacttaacgaagaaaagtaattgagaatgtattccattgctagcatttgtccacaatgagattgagaagccattctattgctgaccagatggtcctgaggatagtgaaatgacagaacccctgtatcactcatcagattcactgctcttcaaaatatgaaaaagaaccaacaaaatcctcattatgacagtgcctacaaacaagatccttctgaccatttcacattctgcaaacttcatctgcaataagaatgtccagacctgaggctctatacttggtgaaaccatgctcatgttcaaaaagcatttattgagagcctactatattctaagtaccgcaataaatacttgttcctataccatctggatgccctcatgtgattctaggcaacacgtttaaaagagaacagtcaccaaatagagaaccctgagatgggaggaaccagtttgggaaagggataaaaatcatgccatgtacacagccaaaggcattgatgattctttaaagggaaagtaatacattttctttcaacttctacaaagtttctaggtagaagaagaaatagagaatcaatccaaattgccagagaagtctgaaagaggaccacaaggtaaatatttcagagaagcaaagtgttggttcacaataataaaaagaaagaaaggaaatgaaaaagcaaactattatagctggggttattcaacaatggaataagacagctggtaaaatgttagtcgttgctggaggaatttgaaatgcatttatatgttaaaagcactaaagctaaaactataaaaccaaaagatgggttagtacaagatgattgtcctaaaatacaaagaaacacacattgtcagtatgtgaaccttaaaaactaatgttggttattctgtttaaagagaagaatgtgatgttcacaaatcaacttatcacaaattacatgcttactctagtaatgtaatgaccttgggagctgactcatagtcttccttgacctaatgagcatgctgagtataatcaattaggtttgcaattaaaattgcaatttatctaacacccccctctacccccacctttttataaggctcaggagacagtggggtgataaatataagcccttctgctgtggctatcttttattttttaagcatttctattacgtataatttattaaaccttaaatttcttccctatttgtaagtttcagcaaaatttagtcaggtttcaacacagggtatcaagggataattaggacagttagcagtaatttatcatttctcagctgggttttcatgctttcgctgactgcccgtagaaatctgttagccacttctacacagatcactatgaaatctgctttatctttgtgcaaattgcttttctattttcctaaagtgagctgaaagatgagccaatcgactcctgaaaatctagccaccggtgtgcttgtcatcagagtgcagctgaggccagggccgcagatgaagggctacagtggctaatggatgatgcaatgccatgagaggcttttttccagcctgctgcgggttagaaatttaaaccaggcagcccgacttcaggttagatcttcacaaaatatgcccaggaatctatgaacatgccaatacacattttatggagcaaatattgcctagtaagccaccagagaggaaaagcctagaaaaggcagagacactagtactataccacttccactgaaaagagggattttatgaagcctgaaccaaaaagggaggacctcgtgttctttagagagattcatttactagatggtgaaaaatgaatgcttcgggtaatttcattttgaattgatttatttctaaatggggggaaactgacacttggtgaagaaagtaacaagtggttctctggaaagagccagccagtctcaggtataatccaattattccaacacaggaaataaggacacagagggaagggtggaaggtcacctgagaaagtcattccttgcaatgaataccttcctgtccccttccctacagactctcagagaagtataaactgacccatatttccagtttatttctgacacctaaacctaatcaaagtccactatttagaaatccaatagttattcgcaattagactgcacggcaaattaaatcataaatttctctatctcagccctggttgtcacattcctaaaacacaacttgcctccctccggcactttatttaaatctctgaggccgggctccaaagcaagttatggatttgataatttgctaatgtggccacagtaattgttttgagccatatttatgattttattggatcttacaacaatcaataataatccattgatgtccctgactcgggttttctcgcagtcgacaaatggggcagcagattcatttttaatgtactcacttagcactccctccctgggagagagagccctgcatattttaaaaaagggcaagaaatgaatggcactggtacacatactttactgtgaaaaactagctgcaggataagatttaatgctaaaaagaaaggagagaatagactaacagggcccattttgtgcagcaccaccatcgttaaagttaatggaattaccgtgtggtcacgcactagagggaacctattggaagttaagctcttctagggccattgattcacagactttcattcaaagattcccactagcatgtgatgagtattgcagatatgcagaggcactttagaaactgtttactcaaactgccagttaagcatattaagaaacaacaataactgaatattttagagtggatgatctagtggaacgtgtcttctgttagacatagtaaaaacttcaactccgactggcttaaacaatagaggactttattggtcacctaatttttttcaggctggagtgcagtggtgcaatttcagctcgctgcaccctctgccgcctcccaggttcaagtgattcttgtgcctcagcctcccaagtagctgggattacaggggtgtgccaccacacctggctaatttttgtagttttagtagagacagggtttcaccatgttggacaggctggtcttcaactcctgacctcaggtaatccgcccacctcagcttcccaaagtgctgggattacaggtgtgagccactgttcctggccagatcacctaatttaaatgtctggaagtaatgcaggcttcaagtctggttaattcaacaatccaataatgtcacctagtgtccagcttctttctgtctctgccatgtcagcctcagcatctgttttgctctgaggcatgttgccctagaaaatataagatggctgctagaagctgtcagttacctgctttcttgttcataagcagtagtggagaaaacagcccatccacaactaatgcatctaagtcctccatgatgatgggactccgatcctttagagtgtaggattcctaaagtcaagggaatcctacactctaaatagcttaggaaaggattaatgaaagtcattactgtggcagagacaactgacttagactgggatgggcaaattatggccctcaggccaaatttggcccaccatctgcttttacaaataaagttttattggaatacggccatgcttatttgtgacaattcattttcatatattctatggcttcttttgtgctgtaaagtcagatacataattatgacaaagaccatctggccctcacagcctaaaatgtttactatctggccttttacaaaagaagtctgccaacccctggtgtgtaccaaacaaggtctgcacctggagctaaagatgagttcaaacccatcctaattttgtggctactaaatcaagagggagggtaggaagaatgctagagggacaaccacagtgcctaagatagacatgagagaaaatccttcaagtctagaaaaatgggcttagaaactaaaaaaaaaaacaatttaggaaacctatcataagcacatgtgaaataccctctgccctgaaatacactctgagtatcatcaaaacatcaaatatatttaaaattgaattacaattccttaccacagcataagtcccagtgtaacggctccccgcccactcttcccacttctctcctgctgccactctccctacactaaatttctgccacctggtcttcaattatttcctagaatgtgccaagctcattcccactgccatttcctcttcccagaatggtctttcttctccagctcttcgctggctaggcgcctgtcgttccctgttctgggtttatgggttatctcttcagtgaccaccccatctaaagtagccataccaccccattccccttccaccatgtcattccatttcataacaccttgttttagtctttctagtattaacccaaatctgcaatattttatttgttccctttcacataaggggaagaagacaatacactgagagtttttcctaggctgtcttgccttccactttaacccagtgcctgggagcacatggcacatagtaggcactcaataaacacttattggagtaatatgttaatattaactatagaatttctacaactttttcagccttcctgcattatggtgttcatttcaaagtctgtacttgaaaacaaggactacgtctcattcttcttaggttctcagagcctgtgacgatatctggcacatagtaggtgatagaagaataaattaatgaatgaatgccagatagaaaaacatgagtaggcaggatactcatttcctggaagggaggaacagactactttggtagtgaggaaatcgagatcagagcgattcagaactggaagcagctacctcacagtgctttgagtttccaggtatagaggaagatgaaagacagacttaaatgctacaggggtgattaactgtcaagtagtggatgatgctaatgacttttaaggtcacttgctcctctgggattttcttgaattatcccgtgctctgagtttcttccttaaagagtgagattcatcgatggtcatctgatagtggagcagagcttggagtcacatttattccttccttggccaaacagtttcatcaaaattatactgctagaacctgattacgtctgggaatttataccatttacaaccaacagacgaatttaaacgcaaataaaagcccctggtgagctgtttgtcagggcaccaggatggaaagcatgataagaaaatattttgtgggggaacacgaactgatatatggaccccagagtgggagacttgaatgtgaacgttaggataaatgaattccaccacaaagtaaaagaatatttggtgtgttcactttgttaactcaatgttgtttattcttctcaaccaccctaggcagggtcaacatcttaaagaattccatcttcatttttcatgtaacgtcaggaaccaggaagacttgtttaaaagaataaactaccagggaaagaaatggaagttttcattactggaatccaataatattatctttatgttgaataagcctagaatttcaaaccactgtttgtgtgtgtttttttgtttgttgttgtttgtttgtttgtttgttgcccttccctcctgaggttttggattaatctgatggagaaggcttccgaagatatatgtctcaacttccctgattttggtgaacaagaggcttctttggagaacggatctattagacaataaggtaggatggatgcctcatgacatgggaagttaaaatttcaaaatgaccctttcccagcactaacataattgacttagaaggagggaaaggattcctcaccatgtttggcctgagggccattatagagtctcaccatcccaacatttttcactcaaatgtcctcaggaaggtcattattctaattcttccacatctgtggctctgcaggttgccttgtctattattcattaagctggtttccatctgaccctggctcagccatgaaatctttaccttttccagctgctttttgtgtcttgagacttactttattaatgactttggcataaagggtaaagagaagcgcctgaggggactgaataatttgagatgagtatcaagaaagaatcaagtccaggtcatctagaccaagaatcaaaatatatttataaaaataaacaaatgaaattgcagttgatattctgggtaaccatcagaatcaactgtggacctttcaagaagctacttcatgggccccaccctcagagattggaaaataggaggcatgagaactagctatatgctaaagataataaagcaaagagaatgaattataatagtcatttcttaatggaaagtgcttcaaatggggcccttggtttttcttttaaaatgcactttaaataatagaatcaacaaccatgtacacattacccaatttaaaaataaaacactgtaaagccgaaaccctcaggtacaattcacatcccacattgcactgcttcccctcactatctccacccagaggcagtaagaatgttatctgtgtccttccttctaagccatatatagatctacatgtttataaattatatggcagcctataagcaacctgttcttttattttattatttcctgctgttaataactactagtcaaaagtttgtagcatttggatctgtttcagctaaaaggcccaatttcaatcaaggcacacattattgtatggtctttcattccccattctgtatttaaggatgtggtgtagtctaaaacaaatggttccagagcactttaagaggccaaggcaggaggatcacttgatgtcaggagtttgagaccagcctggccaacatgatgaaacctcatctctattaaaaatacaaataatagctaggcatggtggctcgggcctgtagtcctagttactcaggagggtgaggtgggaggattatttgaacccgggaggcagaggttttaataagccgagatcacaccactgcacttcagcctgggcaacaaagcgagactctgtctcaaaaaaataaaaataaaacaaatggctcatctactgaggttgaattggccactaatatttaatcaaaagtactgaatctttctcacatgattaattgggctgcatttattttacttttttttttttttttaacagaattgacagtttggccagccaagtatttggatatcacaggtttaaaattttgaaattagaatgagctgattacatggagttagagatttttatatttgatttcctaggcttgaaacacccatagcaaaatggtgaggcagagtagtgctccttcaatgattagttattgagcactagtatcctatagcaaaatgacaacagtgagtaaccggccttactacatcaacaaaggtaagactctgactgaataataacgccttacatttaggtggtattttagggtctacaaaacacttgcctttcacaggaggtttgacttcacagtgattaagtagaaattacaggctctgagcctcaggtgtaaaagacagtttactgaatcctataaaacactgaatgtccctactatatgtgccacgtgtcggcattacaaatagcaaaataaattaaacagccaaatatccactttgctatatgtcagggcctctaattactgaggggatttgtttggtagtactaatgaaaaattaaacactaaaagcatataattctgccataaattgacatacagcaataaagcagcatttaggttaagcttcacctgtgtaataaacagggattgtcctctggatatttttagatggaaaccaacattattccaagcagagcaaaataatacagattaatatgtggtaagggtgacaaaatatttacaaaacctgtgcttgagtttcttctactgtgattacaggatacaacatatttctttaggaacagcctggtcatatgatataatgaagagttgaaattttggataggcttgggtttgaatcccaattccactatctgtcaactgtgcttttccagtatgtgattttttttctttaaacctcagtttccctaagtgtaaaatattaatgcctacttttgcaggttgttgtgaggactgaagtaagaattataaaactaatggtgaacatgtattgagactttactatgtgccaggcactattttacagggatttacatgcattaatccatttggtcctcacaacactcccaagagacaggatactcttaagacctccattttctaagtttatgaatgaatgtgggggagctcagaaaggttaactcgcccagggttcatgcacctggtaggcgacagctctgggtttgaaaccaagtagtctggccccagagtcctccctcttcatcagtatgctttaacttccctgcattttcttctcaccctcatccctgcttcaggatctctctcatctctttcaccttagctgcctttgagtttgaatgaacagggaaaaagtaaataagaacgtgaaaatactagggagcttggttaatttttctttcagtgctttgatccaaatggtatcatgcaaatcaaagttaacaaactagaaacggaaaaactcaatgatttgtatctacttaggaaagggcctgagggtttagtaggagagaggaagtttcccaaaggagacaggcaggcccccagccccttctgcctggagagctggggactgggggttttgcctcaaatcaccaggagcgggagagggaggggaagtcagagatatttacatgccagaggaaaagggcttggaacctcaacacttctctaaggcgtccactcccacatgtacacccaaacccatccccctgagcactgcagttgtctttggtttaccaacccagtcaaactggattcattctgagggcagagatgcaaattttaaggcaattatacaagataaaagctacagcatcctgaagataccaattcttcatgcaggaaatacatgcattaggtattaacatagtcagggcactgttcaccatggctgtaatgaaaggataaaagtcctatggcaaatcacatctctcttggagtgtctttccaaatgaaaataataagtaacggtaaaagaaaatcattttcatcctcaagataaggctttctctctttctgtacacatcaaatctttcctagaaattggtttgggttgagagcagcagccccctacaagtgcttcttatcactcctttaggaaagcagcttcagaaaagtgaagtgtgcatcagaatcacttgtggtgtctgttaggacagagtcctaggccccacatcagaactaccgagtcagcaaagcatggggcaggcaggcttctgtcctatggctaccttcttcaggtaactgtgaagtactctatcgatttgtaaccgcgacttactcgtgatcatctgtgcatacaccagaggctaaaaatgttcggacagagagggccagtattattttccccaattaagaaggcagatttctgaattttcaaagtgtcatttttataagttcagataagatatttaaatagcacaagtcatataatcagagtaaagttttctcaagaatttaaccaaaaggcagtcattcgtagcgagagaattcagtgtataataattaagggaatttggcagcaccacaaaccatctcaatgctagttacaaccccttaaagcctagccacaatctattttatagatgagaaactgagattgagattaacgttaagaaacatgtacgaggtccaagggccatgatgtggcagggccgggatttgaactggggtggactggtcagattctatatccatgtccaaatcctagccaatctctgctacatataccatgtactgaacatcaatacgtcagtttttctccactatcattcaatataatagatagggtttccgcattcaaaaaaaaaaaacaaggaaattgatgttcagagaggctaaaaggctgatccaaaggtgcacagttaggaagttaatatggctaatattcctaacggaacctctgatgccaaagtatgttaactactagacttaattaagagataaaatgtcctcattttcatgaatctgaaagattaccaaattttcaggtggaaaatttgttctagaaccacagaaacttctcagtgaacagaagagcttcctttttatctcatttaatttttgaattatacttctacaaataattatcttcttcttctagagcaatctaaaaagtaatttctaatatcttaaaagttattaacagctacttcccactgcgttaatactataaaattaaatttctaagtagaagattcaagtaccataaacatagaagagtgtaagcaagcataatctataaacagttcttacaagattccagattacctgcctggaataaatctgtccttaatatacctaaaaccgcctcccacccaaagatgaacataccaattgttctaaaagatagctcacatttaacttattaagcagcatcgcttctaaagaaatgaatattgccttaatggttagattagatggaattacattttggaacatgatttgagaacttgattcgtggaaattttagtcttcgttagtaacacctggaatatagaagacttttgatagagattccaggaatattgctgactgcatgctggaatacacatacatatcgtcttctacttcatgttaactaaagttagaaacttatgagattcgttccaacaagcaacaagcaaagttccattatcatcatcattctcttccccacacaaaagaggcatagaaaataaaccggagaaaaagctgtgtcatttccttacccattgcccggttcatggctcagacccctgtaacacaatacagattaacgagaggaaagcctaacgaatatatttaatataaattttatgtgccatgggagcctttagaaataaagacctaaagacaactgtgtatttttacggacagtcatgcagaagtatgattggatgataaaagagtatgacttgatggtaataaattggggaaaacttagcaaggcctgtgtgttcagattcttcttggcatgtgagtagagggcagaactcctctggaatgaaggtcttatgacctacttgcatgggtgttaggtcagagaattcttttatggcacacttgagggtagacaaatggaaaaaggtcagagagtgatgttcctgcttctgtagttttctcagtttccttcaccttaaaatactcagtatgcagagctagcatattttgggggtagcgtgtcctgagacctatcataaacaatgacaaaatccaggtcctcacaaagcttaccttctcaaagaactagagaaaagacagaggtacaggtgcatagccaaacaaacaaaagacaatgaagaatgcctcgagagaaatcaaatcatgcaccaggacagagagtaggggctttaggagagctacttcagatgaagggtcagggaggctgtttggatctgtatggttgaagatgaaagaaaaagattatttctcaagcctgcaggacatcaaactgctgcaataatcaccttgtggatggcagggttctactccttttaaacccaaaaaggagagttaataatcaattgtgaaataagaggtcacttttttactttgatatttccctttcctgactacaagtgccttactgagtaagcaaggccacgcttgttctttgcaaagcagaatttaaagcccctgaaacaaaaaaaccctacagtggtatcatgttcaagaggctaactcagtggtgcaccttcattaacgataacaacaggtgctccaggggaaaagaccattactgggcttattgctattaccactcagcatgagacaaaaatggtttagaacccagggatcaggcagaatctcaagaatgagacacagaggcaaagatgaagagaacagtcactgtgctttccatggcaggttgtcaaatgctgccttaaaatgtgcaactgtgtgaattccaaaatatgaaatgctcagaggcttgaattgtagtattcacaactggacagctgaatattaaagatgctgctttgtcccctagaggggctggctactgcaagactggcttccaggggtcataattatgtggccattgccactcaatattttatcatcatacaatactgaggctggcaaatatctatcacgggatgtgcttgttaataatgaagattcccaagccccagtcacagtattctaaataagtagatttggaataagaactgagaatcaactttttgttgttgttaactgataccaaagttaattttcatgcaggtgatacaaagatcgcattttgaaaagcagattcaacaactttagatatggatactttgtctaaaaggacagctttggaaccttcattgttctctgggattttatgtgtgtgtgtgtgtgtgtgtgtgtgtgtgtgtgtgtgtgtgtgtgtgtgtgtgtgtgtgtgtgtatggtggttttcttataaccaccatattctacaaacgagtcaagatatccccattatttcatatcaggaaacttctgtgatcaggttggaaacaactgaaagatgtgcaaaacagcataacctgctgatttaaaaaacagaatcgttttaaaaagttcaacttaagctaaataatcagggtgatgataacaataaccacattcaacaattcatatataagtactatatgttaagaattagtccatcatcatcaccatcaaaggtaacaaaaacattacacattttggccagataattgggacatcaaaaagtaattactattggagttacacaatctgtagccatagttatcagcccagctaggctcactgcttatttgttttgtgtgtgtgtgtttattatttttagtcaagagataattcaaatatgataaaattcaccattttaaaacgtacaattcagtggctttattatattcacaatgttgcacaaccatcaccactaagtccacaacgttttcattaccctaaaagaacctgtatccattaggaatcattccccattccttccttgtcccagtccctggcaaccactaatctactttctatctctattcagagcctgttgcatagcaaatattttctatcccgctttagaatggctaaatgaaattttgagatcatataacctatctattcatataagttttagctatgcttactatgcacctattatcattctgtgcatcccacttaatacagtttgtgcattcccccatgtcactagctatgcctctacagtatcgctttcaatggctgaaggaattccatcaaatagatattgcatagtgcatctaactaatccggtatagttggaatttacatttgaatactgagttttaaaaaatcttggaaccaagtttaaacatttgtgttttgcatttcaagaagtgatttcaaaaagaagccacaggtattaaatcctttctttgcatccgtatatttagagcctcacatggaggtgagacagtgggacagaggaaagctgaaagcctctgtgtctatcaccataccctgtgtgtagagcaattaggaggctagcccttttttatgataaggaatttggtagcccatatggtggcagtccctacataaactttcactgcttagaagtatttcccagagattgtattttaaaagtcccagaatagctgtgttaaagacaaaagtaaagtaagatcaaaagggaacttacgtttatttggcattgtttgtgtgggcagcaccttatccactcacagctagtcttcgaagcattaaactttatttcaacaaagtgtaacattaacatcccagcctgacttgcttctgacttctagcaccaaaaatagagccttttctatgacttaggtgcagaatctacccgtataggaattagcatttgtatgaaaagagctgaaacccagcttctgaatcagccaggattttattattttatttttactacagaagcagagactatcctaataaatcctcctttcttctcctagcacacttaaaaacccatctttgagctccactgactccattaggtttgaactttggtattaagtacacagggaggaaaagagtaggtgtgggggtgacgagaaggagaacagagagaagcacaggagaacagaaaggaagggaggcagcttgatgctactgctgcggttattgcttcactcaaaaacaatgaagcaaaagcagactatgtcaagaagcaaaggtgtgtcaaagacaccccaggcttaacatggggctgcacaaacccacaggaagctcacatgctatttcctagacactctctcacatgaaccactttgacttatgtttccggactccttgatttagtttctgttttagcgtttgcacaataataattttactactaaaagtaaatgtcttgtaaaccaatgggaaacatattgtttggcagagtttataatgtcaggatttacggctctaacactgagggtctctctgacctcgaagataacataatgaaacagcaatgtgctgcatatgactcgttgtgattttttattagttctcataatcgcctcttattaatttgtatgcacataataagcactcaccttcacagtctgtccggcttcggggccatcctagaagtaggaaaaaaccaacagaggtgagaatagatagatggtatctcctgcttattcagaaatatcacccattaataatttagatgcaatttcattgtgtgttaatttatagtattctcatggggaccattggcttcaaatgtgcgggattagacagttctccatttccgcctgagagtaagtgcgaagttatgtataaaaatgatataaattatccagcaagccaactccttgctacttttcatgctctttgctctaggctatggttttaattgcattaaaggaaggctgaaaatgtttggggaggtgaagtatcacaccttctggttatgtttagaggtggtttaattaatgtctgattactttaagcttctactcaggaaatctgctataaacataagccattaaggaagaatatggggtatttcatatgggaagagtcctctggctattctgaccttgtgggagacaaatggtagtgttcattgtagctggacccttttcccaaactggttccctttctctgtttctgaagcttagttggaaatgggcaaactcaccaagtcaccagccataatataaagcaaaagcagatactcagctggttgagatggccaaacaaagcaatggctccacaatcagaaattccaaaatagaatttcacctctgcaactttagccaggtttgtctacctctatgagcctgactaacggggtgagaactcccgccgtaaggattaagcataactgtgtatatcagggattttcaaacttagagtcacaatccattagtgggtcatgaagtcaacttaatgggttgcaatcagcattacaaacaatgtaaatcaggtgttttttttgttgttttttttttttttttttttgagaaagggtcttactcagttgtccaggccagagtatggtggcatgatggcggctcactgcacccttgacctcctggactcaagtgattctcctgcctcagcctcctgagtaactgggactacaggcatgcaccatcatgcctggctaatttttgtatttttcttagggacagggttttgccatgttgcccaagctgatctcaaactcctgagctcaagagagctgccggtcttagcctcccaaagtgctgggattacaggtgtgagccaccacacccagccagaaatcagatcttaatagaataaaaactattagactgcacagaatgagtaaacattgttttgtgaaactctggtttcctttatcaatataggcatatgcatatatttcatatatgtgtgtcaggggagacaggcatgattttgaaataaatatgtatcttactgtaggttacagtaaaaaatagtttgaccacattgcatatacgaaagtactctaggtgctaacacaagtcagctcttacatttatggaattaactttctagtgaaaaatgttccataaccagcaatggccatttcctataaatgtgatttttattcttgtatctcactaaacattaacagaggttttcattcactgccttcatttagtctctccagaaacacggtttgcaacataagcttgataaacccactctgaactgaactacctgcctgaaggggactcaaatggtttgacatacaacacatacacacaaagcatttgggggaagtttagctactcttaacacagacatggcagcaaaaaaagaaagaaaaaaatctgtttgagaagaagatgagcacttttagtcagagccttcataacctgaaaacactggctttctttatctggtctctttgaagctctatggtaaagagctaaggaggggaggaagaatggcaaacattcagtttaactaacaggctgagtacagagtcctcacattttgaaagtgtgtccttctaaagggcaattacagagtcatccaatttcagagccatgaaggactttatacattgataccccagccctttccatagagggcctgaaggagctcatggtatgttactacggatttactcaattccctactgatgactcaccatggacatccttctcccaacctgacaactgttggctcaacctctgcctaaaaatcttcagtgactggggatctgatttcttcactggtcagtgggccacacccaaccagtgaatctagcttctaactaatctgtgatcaatctctgcatcttgaattaaagacagacaaaaggtaaggcccaacctaagctgcatatcactgccaccctggaattagagcagggcttagtctatgcagtgctcaaaaattagttaccatggaatgaaaatgatttttccagtcccagttccagtaagcaatttggaatgtctgaatgtccattaaatcacttatccattactcccacctgcttggtaaacaagcctcagacatcaccttagacactatcccacggtccatcttggggccaatggacagtagggttgccctgcattagaaatctctttttttggctgctacctaaaatacaaacaatcacatctgccctcctggtaagatatcaggaggagcaagcccaatgccgggatatgaaagggaagaaaaatcatttctgagaaatctgtacactcacctgcatggaaaaggtgagagaggtcccatggaaatgtttttccaccactgtcccgactctctgggtcgtctgaaacaaatcggccacttcatcaggacgcaggtcatggaagcgctccactggccgcagcgggcacacaaggacatctgtagcaaggtctgttaaggcccatgctgctggctttgggtagtgttcttaccaagcagttcatacccacaggattgaatcctctcggaccagggcctgaactctcaaagactaaggaatgaagaaacagatatttaccatccactgaactccagagagttgaaagagagctcccatacatggataattacactttgaaggagaagctgtggtatgcagaagaatttcttgcaaaagaaagggacattcgtgtacagacagactcaagtgtatggtgagataattatgcgaggaggcaagatctattctagatcattctctcttgacccctattctaaagctgtgtccgcttcagcagccaaaggcactaggttgaaaaagcaactggaatatctacttggtttctctaggtagaacatggggataaatttttaatttaaattatctctttagagaaataagaaaattatgcaatgaacatacaaaagtagatgtttattttatttttaaaagagtatagacattctgaaaatgtacagtgaactttatccataactaagagaggtgccatgtggttaagcaatttatgacaagagttcctcagactaattttttttttagaatccaaaagaagacatttgaaggtaaatcatgaacgaaaggttgtctgtttattcaaataaagcattcttaatgcattctacaagttagacaaggcaacgtatttacactattggtctcagcaacatataagatctgagaaaaaaggatagaaatttgattacttcttgataggaaattaatattcactgttacaccatcaataacatttcagtcactatacacacatgtatgcacacatgtgtatatacacacactatatatataaatatttgtttagtttttagatactaacaagagaaacaaactcttgtacgtttttctgtttcttttttcttgttgttttaagacagcatgctcctgcctggagctaagcagctgaggggcataataaaaccataattctgcaattgctagtctcactagaatatcaaccccattccgctattggtagaactcagagcccaaggggaaacacaactgagctcagctggtcaggcctgatttccataagagagaggggaagagaaagaagaaactgattaattttgctcataatcaggaaattcatgtcaatggtaaactaggaaaagaagcatttttaaaatcagagttcatttttcaagagaggagaagggaggcgttcacccacagggcatctgatacttaaaaagataattatccatctttggcaggcccgctttattatcatgggtcaatgaaccatttagaaatgaagaatttcctttcatttcctttgagcagattgccagcctccactcccacgaagctgctttttctgtgttaaaagggacccttccccatattcctcctccctgatttgaattacaccctcacttaggcctgacttcaccaaaccacagcaagggtgacaaccatgcaagcttccaacgaagtccataagtgctatgttaggctatgttcacacacagcaactcggtgggggaggaagacatttcacttcaacaatggcttactgtgaaaactggtggaataaatcagacaacctatgtatctaatgtaaatttagtaatatcaatgacatccaaaaatgttttttttcaacaccataaaaaaacttattgtttgtcaattttgcttgtttgcatgttgctcctagaaaaacaactcagggaaagcaaattaattagaagaacagcagatagcttttgtaattctaatgccactttttatatgccaattgttttaaaataatatcacagatgcaatataatttaatttggagcctcttaggccttgttaatgggtaaattccatattatacataggctatgaagacacatttacttctggatcctgtttgcttgggattatctcctctgtcaagatttcttagccaacatgtaggataacctttaaagaattaaagttactatattgaattgaataaatgttttatccagtacatatcatgtgtgaaaacttgtggaactggttaccacttctccctataatctagagtatagagtttttttagcaataatattttttaaaggaagcgaaggtcaatagttataatttaggttgtatagctgacaaggagatttctcacagtagatgaaaaccaaaggcgacttcttagagcagatgagatttaaactggactttaaaaattggggagtgatttaaccagtggattgggctggcaacctactcactcatccatcccaacactgcagtctcctctcagtccagggtctatgctggaacttaggatgctaagatgaccaggacagagtagctgaccttgaagagttcacattctaatgtccgcaactgtcatgcagtgtaaacagatcattacaacacagagagatgaatgctattggtagaaatcagtatagaaagctgtgggagcacaggggaggtcagatctaattctgcctcagggtgttagataaacttttccatctcattttacatttcaccttttaaagtagaacaatttctccacacctagaccaaaatctgtccttaaaaatggtccagaaacttaaggttagcttcaaagaaagttgttaagcgttcctcctttggcccaaatcaccatttcacttttgtacgtactcttacttactcaatctttccaacaaacccataaactattaatactattataattcccatgttgaagatgaattataagcaataatttcttatagaaaattagaaacttgccacaccagcacactcaaaatgagattaaaactagaattcaacccgtctgtccgattctaaagttcatgttattaatgacagtgctgtgatgtcatgcttgttagagctttcatgactccatttttgcctagcctcttattaaaactgtgccctgcattccctagtcactctgttcatagaagggaaccactgttttcattaaatagaaggctatgatgcaaacatgctgaacgcttaagaaacacctaaccttggaaaaagaaagcagacgagacctacaatcccacaatgaaaggaggcctcagcactgggcagtgagtatgccttcatcctaacagagaatcgtaagatcaaaaaggggggagagtaccagcttgcctgaactggaggaagtaaagagggatacaaagctggcattttgccccttctcatcctgactttgggttgcttcaaggtgacttgggctccatcatgggccagactcctgagaaagtttagatactgcagcctctatcactgggtcaggttgtcagacacactgaatccattgcttgttggacagtctaattactgagaattatggaccttctcacaacacatgattcatatcacaagagactaccagaaacttggcaatcctttctttttgttttcccttttcgtctcctcctcttcatgctcaccaccagcccagaactgactatctctctttttgaacatgaacactttaggtgtttttgctgcattaaagtggtgtgaccacatgccaagccctatgctgaactcttgctgacacactgccaactcagaatacacacaatgaaagaaagacatattcgcattagtcaggtgcctagagctggtgtggtttgctatttgcaaatgtgaccacaagaatccctcccatcctacacatgctgttttgctctctggctttcccccactttccatcaagagttgcagtctatttcccctccccttgagtgtctatcttactttgtgtttgtgttgttataaaagaacacctgaagctgggtcgtttacaaagaaaagaggtttatctggctcacagttctgaaggctgtccaagaagcacgatgctggcttctgaatttggtggaggcctcaagatgcttccattcatggcagaagtggaagggaaaacagtttgcagagatcatatggtgagaaaggaggcaagagagacaggagggaggtgccagacccttttcaacaaccagctcttctgggaactaatagagcagtagagagctcactggttaccacaaagatgacatcaagtgattcatgaaggatctgcccccaaacacttcccattagaccctaccgccaacatcagggatcaaatttcaacatgaggtttggagggtcaaatatccaatctatagcagtgttgctgtgtgactttccaaggttaggccttaagtgaccttgaaacctctgattattgctctcttggaagcctgagaccaacatgctataaaaaatcccagctagcctgttaagtggcaacatgaagaaagaactaaggcacctcagctgatagtcagcaataactgtcagagatcatctcagaccttctagagtcaggagagccactgacttccagtttctatatcacttatctactgctgcataataaactaccccaaatcatagagccttaaaacaacattgatcggccgggcgcagtggctcacgcctgtaatcccagcactttgggaggccaaagcgcgcgaatcacctgaggtcagcagttcaagaccagcctggccaacgtggtgaaaccccatctctactaaaaatacaaaaaaaacagctgggcatggtggcgggcatctgtaatcccagctactcaggaggcagagacagaagaatcccttgaatccgggaggtggaggttgcagtgagccaaggtcacgccattgcactccagcctgggctacaagagcaaaactctgtctcaaaacaacaacaacaacaacaaaccaacattgataggttttactaccataagtctgtggatggtttttgctgagggtctcacctggactcactcatgcaactgctttcagatggaaggtaggctggagtctgggctcagctgcatccactaggcccttcactctacatgctcttccatcccaatagatgcagaatctctgaatttgcttaaggcttacattgtcccacattctatcggtcaaagaaaatcacaagccaacccagattcaaggtagagatattctgtcttctaaaaggaggagtggaaagatgacagtcaaaagggatatggacactaggaagttccagggatgtttaaaaattaacaggggcccaaggtatcttggctgtcctagtgagtaaatacaggatggcattttagagttgagatgctcctttttttttttttttttcctgagatggagtttcgctctcgttgcccaggctggagagcaatggcacaatctcagctcagtgcaacctctgcttcctgggttcaagtgattctcctgcctcagcctcccaagtagctgggaatacaggcatgcaccaccatgcccagctaattttgtatttttagtagagatggggtttctccacgttggtcaggctggtcgtaaactcccgaccttaggtgatccacctgccttcacctcccaaagtgctggggttacaggcatgagccgccgtgcccagccgagatggatcttaaacatcaactactccaataccttcactgtcagattttaaaaatagggagagaaaggttacttaacttgttcaaagtcacacagttaggagcacagttgggattggagctcaactggtgagcttccccaaccaaagctctttctgttacactgagatggcaaaacattgcacatctgccactattttccaatggtaaacttatggcagaataatcgaccacagaattctctcctttaaccaaagtgtccccaaatacttgccaatataacctctgagcagtcaacaccagtgagaatgggcacgcgacatgagatgcatgtgccatttctgtggcctcccacactgcctcatgaaacacagaaccaactgcaaaggactggtggagtcagaacaaagggggatgctgcaaaagggagaatcttcccaactacataaaatttccattatgttgccacatttttattcaaaataaatttgataagttcaaaatttgctcatcaaggataataattgattaaaaatatttttaggaggatttccatgacaaatacgaaatatttaaacatggagcactgacagataaatggaaatgtactgattcagatgattaattaaagatgacagcagaatattatgatcggagttgctcagactcgcccccatttagttttctatatctgatctattctagggattcagaatatagaagtcaccaaaataaagcaaatcatcaaaatatcactgattttgattaggctgattagcctgtgtatatattaatatgaagtaaggcagtatcagataatacaacacagaattaatcattcttctgaactaataaaaaagagtctgtattcatctcgactgcagatctgtgtgtagtttagtgataagcaaggaacattccagcttgcaatgcagacctcagcagaccctgtataattcattatttgctctaacaaacactcctaggccttgtaaatgtttaaaataattcttaatgtcacttcacaaaacaatagcaggatggactgtcagctacttttcaagaaaatattcaatttatttgatttaaatagcacaattacagagctttgagtcaaagtaggcggcatctcaaaaagtaatctattcacaacgtaagcactttgatggattttcatatcagaaaggcagaaatatcacccttaaatattaataaatacaattctgaagaagcatcttgctttgtttgggccacaccttttttcagtggggattaacatactcatttcagtaactcaataaagggttcatgggatattcatcaaccataaccataaatgacacagatgtaattttaagcaaatgtgatttccagaatatgataaattccagagcagtgtgattaagataatgataacactctgctcagagctggttctcaaggcaagcatctcacaaatatccactatctcatgttttgccctgggatatgctttgggtcagagatatgatgagaccttgttcatctggaggaagagaacccaggtatccttgtctaggcaacatgccctgagctgccctcaaaactccggtaccgatctggatgctcaaaagtaagaatcactttcatcgagagaagcaaacagttgcctttcaaagaaagtaaattgacaggggagtccgcagcccgatagcattctggtacagattctttggttgaatttcacatatttttctgtgaacttttcaatgcaaagtaatcttatactgattgagggaagagcatcatatctggaaaaaaatatgctcatataaactaagtatgtgggaaagaagtaaatgatatcattaaaggaaagaaacaatatataacatttgtttgctgcctagtatggtctagtgataatcaataaccctttgagttaggataatatcacctcccaatgtccagattcagaagttgaggccaaaaaagtttaactgcataaccaaggtcacgtagctattaagtgaaaatcccagccaggggcatgtgctacaacactgttacaatgtccatgctgtttcaatgcctctcaaggttataaaaacctccatgtataatacctactgcagtgtttactagagtgggatagcagagccctgcttccacgggatgctgttatacattatacagaaaaaaaactgtgcggtcaaagaagattgagaaacactgcatgaaatgaagtaaaatagctctctttaccgcagtattcatcagcatatttactgtactactatgcattctggcttctcaaaaataagaaatagtatgcagcactgctcaaatttgcttatctacaaaataataatgattattaattattagtaatattgtagaacactacacaggacacatgtttcagaggatgttctttggaaaccttgagcatcatttcccaaaacacagagaggcctgagtaatttttctgttttttcaaacaaaaagttgagtacatgtcctattaatcacatgggcaaagaaagagagcattctgtgaaatgaaatatgctgagaagttgagcattaaaatacatcaaatgggatatggcagtcattagtgctgtttgccaaacagttcaggttactgccatgtctgggcatatggtaggccttctggacccttgcagttgggtgaagctcaaggaatacaggtcaaagagttgtgagcgaaaatgatatacgtcacttctgggctaaagcccttaacttctagtatgtgaccgacagctttatttccttcaccaagacaggcagcaatgctttgcaatggtagctgctctggcagtgagaccccgaattataggtcagcaggggcctctgagcatcgtggtcacagtgactagggcaagtttgttcttaaataggttttacctcttttgctaaccccaaccaacttgtagtagctatttacagcagcatgttgaagaggattctgaagctctgataaggagcaggaggaaagaactgaggaatttattagttttggctgccaccagggaggaaaaaaatattagcgtgtataccaagtacctgccattcttcaattagacggcaataaaaatgttttttcaagaattctctctcccccattcttaatgatatagaagtcatttctgggacttgcaatgtctctcagtaaccgttatgaaaatctattattattgttattgtcctagagatatacagaagtgtctagaatttagataattctggttaggagagtactgaaaaggaaaattaactgtcactcgaaagagtctgtccacaatgtgtaaacatgagaatgggaacacaccaatatgaaaatgagcatgttgtaaaaatgctcttaggagttaagacttgaaggagtatggcaatagaagaaataaattgcactcagcagctgaagaaatatttaaagataactccaatgagagattattttaaacttcagatacactttgctatgagaatcatttcaaaaactctgtaaaaagctttttagtgaagtagagatgagaaagtaatactaaaaatctgcaattcattgcagatctagaaaaccacatgcaacataaataatttaatagcaccctcaccatatacacagtttcatttcaccagtatgtgaatgaggggagtgccctgagcacatacctccatagggtggctagagtgaaacctggggcccaaactcccacatagacaggattcttccagtgcaagctctatcaggttttgaaattatggattccaaatttaggtttgcttatgtcatttaagagactaaaaattccagtttccctcagatcttccatatagctggccaagccaatggagcaaccagacaacacagttcagatgccatctgaaggcaaaaagtagccaaactataaatatgaaaggaaagaaataggaaatgagagaaagggagagaggagattaaaggtaggggtggtatttagcagatgaagcctccttagaagagaggaaatactcctttatagataggctcaactaggattcctggtgctacacacagagcttaacatagcattggcctttaataaatacttggtgaaaaaataaatgtcatgtaggcttattcattgtttaatctgggaaacaattctttctaatgaataatttcttcaaaatgctccccaaactgtgggttcttaaaagaccagtgaaccagtccagactcaacttacttaaatgtaaaccattaagaaaaatatacttcatggtaaaaaaaaaaagaattatgaattcctaatacaaatgtaacatacccagctaaagggatagaaaaataaatacaaactggtctttccttcacacatcaaaagtagtgcatgtgttttaaatggaaaacttcagaactattaactcagtgaagcttggaaaagttcaaagataacagtgttctatgctttttaataacaatgaggaaccctcttctatgacagatactaatgttaatagaaacatcctttatttcaaataaatgaaagagagtcacacttaacactaatttggcattctcacagaatatgaatcaacgtctttctctcttaaaatcagtcctccatgagctagcaacctaaaataaatgtgaagatttcgtagtgagaggtattcatcatgtgttcagtgaatgaacttctgaatgaattagtgaaagatcacaaagttgaatattagagaaaaggataaagccaaaagactttcaagaactctgtatttttttgtatattcattcagtaaatatttgtgaattaagagccgactacctggcaagtactatataagacactgaggatacagcacaaccaggtacagtcatcctctcccttccaaagatgtgaaatctagagggtgagcagacaaaggcaactgacatagtaactactgtgaaaatataaggggtgagatgagaaagaaaaggtgcaagaatgcaagggcaagaccgtaacaagccaaaccagctaaggtggctgtgaactaggcccagttcacttggtctaactggatcttcaggaaagagtgcaggcccttgatagccttggtcagcagtctgtatttattcgccatgcatggagaagccactgaagcatttcggagagtggagatgtatgacagattctgggttctctttgcaaagctgaaggccactgggaatatctttattgcagactaggtaaaagattcaaagcaggcctggcctgtggtggtggcagtagagatgcagagaatttgagatgtatgtttgaggtaggagcaacaagacttaactaatgggggcaaaaaggaagagaaggatcaaagaggattccaaggttctggcttgggtagtaggtgaagagtgatgtaattttgagatacggtgggtgggacagtgtcatgtagctcaccatttggagacttttctttcttgaatttatagaattctccagaaataactagagcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataagaaatctagatttaaatcagaagaattctttgaagattagtccccaagagaatgattagaaacaggctcagacttttgctcactttggcttagaatctaatatacccagtactaaagagtaagaaaagaagttcactctgtctgagcaatgtgccataattcacaagcatgaagcctccataaaagacaaacaaaagattttttaatgccataacaccgaagtcattttaatctgattcagcagtgaacaatttaagacatgtctcctccaacaaaggcagctggacacataaagatgattgtgtgatccattcaaaattaaagaataagctaaatcatttacaacaataaaaatgcagaaaattctaccagaaaaaaaaaaaaaaagagagagtgaaaactttcagcagcaagtgatttccaaatgtttccaaaacaggaagcaaaagacattttaatgtcactgtggcagcttccagaatagagtaagttaatcaggcagcctctaaaaacaaagcagcaattcattaaaaacaacaactgctactcagcaatgaactgtactgccagagtgtcaagaaagcaaactttttcaagatagtgatttgtatgcaaatatagctcagcatttatcactaaacctccaaggcctgtaaagggggggaaagaaaagttctttccatctgcttacacctgtctcctaataaaatcaactgccaatcacaggggaggctggggcattttaaaaacagtcaaagaaatacattcacaaatccagggtttcaaacaaaaaactcctgtctactctttcttcttcaaatctcctagcctactgtcctcttcctaaattggagttaatatctgtacctacttcattgggatgttaaaagtgttttttcaaaataatagcatatttcacaccaacaaataaaagctgaacgaatggttggtttagaaaaaaaaaaaatagtcaatggaaatgaaatccttcaaagcttccctcaatccagcaatggtaatgcggttatgtgattgaaacagtgtctcactagcaccagtgttatcgtttggaacccagatcttcattcatctcatgtttaaaatgtctgtacttttctacattccactcacccacccatctccattttctcatttgatctctgttttttatttccccctcataatgtaagcatcactggtagcagagtctaggaattaatcatcttataatcatttagtcttcctctccagttctaacttacgactttttcaaaatatggttgctaacaataaaaaaaatctcaaaatgtgaaaacaaacaatggaaaaatattgtaaatatttaaacgcatttagaatttgcaagtttttttcactctaatgtcatttttcaagctatgtttagacagcacagaacactatatggtttacctaatgtttaaattagtagatctggccaggtgtggtggctcacgcctgtaatcccagcactttgggaggccaaggtgggtgggtcacttgagatcaggagtttgagagcagtctagccaacatggtgcaatcctgtctctactaaaaatacaaaaatcagctaggcatggtggcacacacctgtaatcccagctactcggaaagctgaggcaggagaatttcttgaacccaggaagcagagcttgcagtgagccaagataacgccactgcactctagcctgggtgacagagtgagtaagactgtttcacacacagacacacacacacacacacacacacacacacacacacacacaaaattagtaaacccaataatccacaaagatctataaaaatatgaacttacaagatttctatatatttgaatttcattttgtatataactgaaaaaaaatatttaagcatgcctaaggaaaaagaaaactgtggaaacaaaacaaatgttctggcaattctgcaacagtttcacatttgtatattgttattcctcctgaagaatcctaaaattcactctcattttctttatatgcttagatattaaaaacatgtctttgacaaccaacagtcttctgtcatggggaatcagacatcggccccataatctctcattaccaacatcaccattgtcactgtctttaccatcatcacttaaaagaaaatagaaactgcttaaataaccacagctaaaataagtgtcacaagtttcttactgattaaatgctcctccgcgagactgcaacctcgaatactacgccatagagttcagattccaacacctttaatgtttctataaggaaaaaaaaccacaagcgttctccctgaaaacgtactcttaactcagaatctcttctggttccatttagtttataaaaaaaaaaaaaagaataattcagattgaaggatagtattttggattttcagtgttattgatattcctcgatccatcataatttagctaacatagatcactgcctatagagcagtgctgtctagtggaactttctatatcctatactgttcaatatagtagccactagccatatgtggctactgagcacttgaaatatggctgatgtaatcaaccatatttaattgcattttgttttaattttaattttacatttaaaaattaaatttaaactttacattttaaataccaccctgtagctagtaatcacttgtagctagtagctattacattgtacagttcatcaggagaggccacaaatttatggtaacaaggagtggtggaactggcacaactggaaaacacatgccccaaggtgggtggccaccacctagagatttttttgttcctgaagaaactagaaatttgaattgctatgtgtaattctcttctatttaacttttggcaactataggcagtccttctcatggttccaatatgcacatatttcagttactccagtttaaacaacaccaattccccaacaacacggtttaaatttcagttaccatgtcacattaactctgggtcattgggtaaagtacaagctccactactagctcttcaattcacaaattaccatgtagatcatagatgtgcatgatgatcagagaccagtcacatcacttcttccaaagtctgtcagtgactgatcactgcacatctggtattcagtcagaggcagccagcaaagtatgtagttttgtatcccactgatcttccagtgatgaacccacatatttcaccaaaatggataatcgaaagagggaactggccaagaaatatgaaacacaagtgaccaaaaacaaaaacaaaaaaccaaatgtgacaaccccagaagtgcactttgaatcaaatgtaaataaaattatagaacaaataactgactttgggaatgccaattgcgctgatgttcaggagattctagatatgtaacccaaggaatttagtaaagacaaacttattaacataaattaccaaagaatttatgatgcagaagaaaaagatgtaccagaggaagtgacatcaaaaaagtcacattttaaaaaacgtcctatttcatgacattgaaaacacaaaggatgaaatattggaaggagatccacactttaggagggattatgacaatcagccaaagcacagaaaagatgccccatctgtactgttagttgcaggataagaaaaacaaggcaagaattgttcaagagactctcaataagtgattttcaaagaaataaagcacttcaattcttagtgtttctaatgttttaaattacagtgtactaaattagtattagttcgttttttacttctttcattatatttttctatttctttatactctgataacttatagagggtttttaatgattagagaaaaacgttaaaggtcatagaacagtcatacgttttcccattgattactaagtggacattgcatggtttccgcttgcgtggtcatttttatagtcccacactgctgtataagatgaggggtacttgtacttccaatgtgttaaaaaatattgggtggggcaaataaaacatataggtaacaggccacaaatttaaaacctgtgccaagaactagtgtcatatgtgatgtgcatcttaatattaggagagagcagatgaaggaaaatcaaggactgtgactttaaaaagacatatatatgcagtctctctccagaaagagcagacccgtcgtcatatgctcctgaattctcccaccacactgcctggcaaaattaaagtcaaagttctcttttgtttcccaagtagcctgagaactgcatgttactgtctacctaaataacagaggctctctaaaagaaaatgatatttattgagaaatgggccttgtcttgggaatacatgtgccacagtaaattatgagtattcagccaggtgaaggaagacaaaggtttttaaagggcaagtgaggagaattacctaattgttttgaggtaattatccttggttactaggatcaataacattgtagcaccagaaagaggttggacaggcagttgttgggcagatgtcctcatagaagcattgtgtgtgtgtgtgtgtctgtgtgtgtgtgtgtgtgtgtgtgtgtgtgtacaaatgtgatggccttggtgcagcgtggctttttgcagagtcttttatgatagtttttgttatcaggcatttgtacatgagaacgctcccgtcatggcctttcctagctctatttgtcagggttttgtttgtgactccatttgattctgacaacttttatattatcaaacctcctgaactctgaatgcatcattaaacctggctgttagcattaaggtttccccaccaaatgttctcttgtacatcacaatatgactgaagggagattacataatgagtaacatcaataccatgcatgttctatattccatatggataatgcgcaacaagcaaaattcctgccaaaatccttattttgacacaaaaaacagaatgcagctatagctgtatgttttccttcacaatgttccactataggccctttctgtagtgcattatctgccgctggtccagaagctctttaaaaacagaggccacttatttttcatccttggatccaaagaccagcatatggagcccaggttaggacagatgtcacctcttagtagacttatcaatcccatcccatgaaggtatccctccttccttttcttcccatttgtttgtatccctcatagcttatatcaatcttgaaattttagtactcatttatgattacttgttttctattgagaatgcaaactgaaatgagggcagaaatcaggaatgtctgcttctcagctgtattctacctggatacagtatactgcccatagagcacttgctaaacactgaattggtgggtcaatggatggatggatggctgggatgcatggacggatggtagatgactgggtgggtggtttgaaaaaatgtctaagggaatgactattagaacgaatgactgttgaatgaattactgtttcattaataaataaaaataaataaataaaagctaaaactattattttagtaagtagagagtagaaaaaataactgttattttcttaatgttttataaccataaacataacattctctgggttgtcttccttttcccaagttatgtcctcagataaatctaaaaatgagaattcttccaatgggtgatctcccctggtccagtccactatttgctgaactacaagatggagaagtttcactttgcagcagcatgtgtgaaaacagcttggaaatttttgtagagaataagctcaagaagagtcaacagagaaatgttgtttctacaaaacacgttttatctcagattgtgaatgcaagtctggtgttgagttgagggaggtgatttctcactctgatcttattgacagggatagtcatggagttttctgtcaacctgggagccaccaggaacagcctatagcacattcacaaaagagatcagtatggctgaagaaaatcaaagaaaagagaaatgaggaaacaagggtcaacctttgactatagcattgcaaaggcagtcattctaggaaggaggaaagatgcaggtgaaccaactagtaaatggtagaacagaatctgaatccagcatatgacctgtggagtgactcagatctggattccaattccatttttgccactttttagccatttgactctgggcaaataaactcttatcagtaacctcacctgcaaaatggggcttatttattctcatggaactgcatttcagagtaaccaaacagcaccaatgatggacaattcttcaaagaattctagcattaaaagcaaaaggacccccaccattttaaatccctaaaaatataactgactcatgcaaaattatcaacaggtaatttggggcttaggtcaggagttcttaacctgggggtcccacagaggcttagcagagggtgcatggataaaaggaaggaaacacatgaacatgaatgaaaaaaatgacacacagttatttttactaatttttaactaaaattttgtatcttattaaatcacagatgtaggcaatgaaccactgtagtaacagcagtacctatgagttgtgtcacagtataaatcacaggtatttaaaaaatatgtaaagtaataacttgatagttattgcagttaccttgaaatatcatttattctagaagtacttatcattacaattactatcacacaattatgatggtcattatagctgctaccacttctcattatttaatatgtaataaagaaatgcataattcactgtatcacaaatttgctgttaatactgtgttaactggtattaaataacatgaatttccttggtacttctctatacttaactgtccttaattaaaatcattattgggtgggagggttgctcgaggctaggagtttcaatccagcctgggcaaagtagtgagaccccatatctaaaaaaaattagctgggcatagtggcgtgcacgtgtggtctcagctactcaggagactgagatgggaggactgcttgagcctaggagttcaaagttgcagtaagctatgatcatactactgcactccagcctaggtgaaggagcaagaccgtaccttgaaaaaaataataaaaataaaaaataaaaacattattgggggaaaaggtatacaagcgtcaccaacagccaaaaaggtgactgaaccaaaaaggttaagaactcctgctttggatgaaagtgtgacgggaaactttataatggagaaccaggctgtcactacctaaatctgctgatcaatttcaggattctaagagcaggacatccagacattatgcctccctatacactgtgatttgaagcacataatactactactacaaatgcttatatctgaaaataatccatagacccgcagctgtctaatagaactttttgcgattgtttacactatgcaacacagcagacactagctgcatttgaaatgtggctagagcaaagaagcaacctgaatttctaattttacttaagtgtataatcagccacctatagctagcatctaccctggagcccaccttagagctaacttactttacaccaaacacaagatagagaaacaagttaagtaacactaaagggaagcaaacagacaaatccgtactatagaacagtctacaggacaactgactcagttaaaaaaaaattcaatggcataacaatattggattaaaacagcactaaaacaaataataacctaatataaggtgtggatcttttttggatcctgatccaaccaagcaatgataaaaagacattttaaaacagtcaaagaacttgactactgcattaagaaattcctattaattttgtgaaatatgataatggggccaggtgcagtggctcatgcctgtaatgagcactttgagaggctgaggcggggggatcacctgaggccaggagttcaagacaagcctgaccaacatggagaaaccccgtctctactaaaaatacaaatcagccgggcgtggtggcgcatgcctgtaatctcagctactcaggaggttgaggcaggagaatcgcttgaacctgggaggcagaggctgcggtgagccaagatcgcgccattgcactccagcctaggcaacaagaacgaaactccatcccaaaaaaaaaagagagaaagaaagaaaagaaagaaagaaaaagaaatatgataataatattgccaattagggaattttcgtagtctttaaagatacatgctgatgtgtgtagagctaagaaaatacttctagcaattgccttaaaatatttcagcaaaaactcaagtggataaatgaagcaagtgtggcaaaatccgaatgacatttgaatctggttgaaggtaaacaggccatcctttgtattgtttttggtgctttttctgagtatgtctgaaacatttcaaaattaattttaaatgggataatgcattgggtacagtgaccaacacatagtaaacattcagtaaatgttaattagcaagtattagcatcatcaacattatcatttatgttctcaaaagtcaaaactaagatcaatcagtaaaaaatacaaagaggtagctttcagcttcatctaagaacaggctctgggaagatgaaaatacaccgtctcgtgagggagtagccaacagcatattcaagataacaataacagcagtgacttacatgattgagtacttataatggggcagatgtggttctaagcactttccatataacccctcactcaatcttcacaacaatttcataaggtaggtactctaactgtccctgctggagcagagattgatcacttggtgaggatgctgcagaagagggtcaaggtgaatggctttgctagttgccctttaacatccctgataaccctgaactcctctgattcaatgaacatgtcattcagatgaattgtgcaggttggccagctggctggctcacacacacatacagggcaattcttgcttttacttactgaaaggtctttaaacaccacctttccctttcaagtaggagactaaaacgtcacaggaatttaattatctgtaggcaagaagatgatatgatcaagaaaatgctacatttaaactactccatttacccactttcaaatttcccatcaattagaggggaacatcttccctaggcagccatttgaccaagaaatgtccgtggtatatcttcgtcaacatgtttcagaatataaatccagattacacaaactaaagttggtataaaggctgtcatcatatattatatcatttggaaagaaatattggtgaccttatccagtatgactgttataatggtaataaaattgaatctttgaagattacacttctggtcaaagtagtaaaatgtgaccttattctattcaacattgacatttattatattaatttacatgtaaaaaactgcattagaatgatattaaagccctggttagaaatgttagaaatgggaatgttcaagaacttcagaaataagatttcactttaccagccattcacagcattgagtttgtttgatgcaaattaaactaaatttccttcaccaatctctgattcggttctaattttattattatcactatctcattcatacaggagatatttttcccaatgcctctttaaacattttataaaccttaactcattttcatcatgctctggataaaaagataacacagagcactgaatatataaacctgagtcagaggatcaagccatctgcttatgacggggagagtctcctcagcccagtaaaaatgagcttagcgatgagtatacatcagatagtgcactaggtcctagaaggataccaaggtccagaggtgagaaaagagagtcagaccgccacgtgggtttcacagaatggccaccatgcagcaaaaagatcgctcttgttgcccaggctggagtgcaatggcacagtctctgctcactgcaacccctgcctcctgggttcaagcaattttcctgcctcagcctcccgagtagctgggattacaggtgcctgccaccatgcccagctaattttttgtatttttagtagagaagaggtttcaccttgttggccaggctagtctcgaactccttgccttggcctcccaaagtgttgggattacaggcgtgagccaccacacccagccaaaaacatttttttatactggtcaaaattttatagggaggtccctcccttaaatataagttttgcaaactttcagtttgggggtagaacatggaatcatgcaatgaattaaggacaagattcagccacacctcaacagattattctattttcaccattagcccaaagtccaggcttgctaggatgggtcccaactgtccttccaattttgtttctcactattctcgccagcacttcaaggttccaaccaaaattaactttttgctatgtatttcctcatatgccttagttaatattgtcttctactctgaatatcttttgactttctatcaataggttaagctaggtgttgctatgataacaagcagtcccagcatttcagaagcttgtaacaaaaaaggtttacttcttgcctgctatttgtccatggtgggccagcagatcagctctgcccatctctggcactctgatatccaggctaagagagcaaaaaccagctcaaatactgttaggaaccatcccaaggggaagagaaaactgcagggtcttacaccagaagttaggtgcttagtccaaagtgacacaattcactgccataactagtcatgtggttccaccaaaccacaagaagcataatgctaccatacacctggaagaaagaagaactaaaaatatttggtcaataccatcaatgactccctatctccatgtgtcccaaatctgataatttttccagatctaagttagattccacctcctcctaaaagaaaaccacagtccttcctgctaaaaggaaaccgttcatatggttaatatacagagcatgttattttacctcataagactctcatgactctctgagaaccgtgtctctattggaattccgtgtttcccataatgccttgctagataaatactgcttgaatgattgaacaaggctgtctgtataatgagagtttcatctccaaagacttcgaataccctggaggctagtaatacgtggtaagcaataaaactttattttttcttatttatatcataaagatacttaaaacaatattaaaatgatcataaagatgaaataaaaatgagcccatagtcccgccaccctaaaccaacaaatgttttcatttcttttcctcctggtcctattcaaagggcatccatttcctttacatagctgtattcagggtgcatacaaagagagaattctaaatagaacagaagtaactgcccagtcaacaggttttgtttgtttgtttgtttgtttttgctcttccccaagatagagacacattgggccatatcctaatactgagacttattttctgcaataaaatttccgttaatttaaagcttctaagctgtttaatacagtcaccatcattaggaaatatcagtgtagtcttcaccactacttcctctccttggctcaacactggaagaaattgcctctagtgaaaggagattgacttccaacatgagaagaaggaagaaaaggagaagtgtgtgctaaatcttggacagttctggggaacatcgtagaccaacgtcaccttgtcacggtccgacgttaagacatcattaacaagagctaacaaccaacattgaagttttaacctcattcgtgaatttatctgattattattttgctccatttagctcatccaattcttttcattttatcatgcactctttttatttgtgtagtctgagttgaaccttttctaaaacaaggtagaaaatacatacataatgcttcaaaaaaatgttttccatactgccaaataggcactaggaagtctcaccagagttgataaacaatctagatggccatttaacccactcagcttacttaaaaccaagtctttcttttttttttttttttgagacggagtcttgctctgtcgcccgagtgcagtggcgaaatcttggctcactgcaacctccgcctcccaggttcaagcaattctcatgcttcagcctcctgagtagctgggactacaggcacgcaccaccgcactggctaatttttgtatttttagtagagacagggtttcaccatgatggccagcctggtctcgaactcctaacctcaggtgatccgcccgacttggcctctcaaagtgctgggattacaggcatgagccactgcacccggcctaaaaccaagtaagtcttaaaatttgtactcagaactactttttttttttgagatggagtcttgctctgtcacccaggctggagtgcagtgacatgatctcggctcactgcaacctctgcctcccgggttcaagcaattctcccgcctcagcctcccaagtagctgggactacaggtgcatactgccatgcccggctaattttttgtattttagtagagacagggtttcattgtattgcccaggctggtcttgaactcctgagctcaggcaatctgcccgcctcggcctcccaaagtgttgggattacaggtgtgaggcactgtaccttgcctcagagctacttctatactgagaataaataaacacccaaacacctttcaatgttattaaatttcagagtaatgactttttgtctattttctattttaatagctgatagattagtaggttttcaagctatattttaaaattttatgttcagtttcctaaccactgccacatgtacacataatttatactcttacatttttgaaagggtttattattttatgtgctatagttattgatctgaatcaaatctttcttacttgattcaacagactatagtgggaataaaatgtgactatttacgaatgttaaccactgctgtaattcatatgaaatctgccaagcctattatattaggaataatgttatatattttatctaagagtctgataacacctacctcaagtctaaatattctctgaaaaatttgtcagaataaaacaagtgcccttaaataatattttcaggtataactgcagacagttgcttgtacgtttgtctttaactttaatactgtctcaatatgcatgaaacgcttgatagttcaatagttgttttcatgagttgtgccttcattaaggtacaaaacattaaacacctggaatgctgctcgaactattcctaagggagaaattttggtgacaaatgaaagggatacatttttaagctgaaaaagttgctcgctactgataaaagaatttatatcagaatattccaatagagcagaagaaagcaacatgaaaagaaaattaacattcattaagaaacagctaccatggtgcgaaacaaagatcacaaagccaaaactgaacaacaatcaaatttctacacaaaaaataagacacatacaatgcctacagttccgattgtctaatgctgtgtaacaaactaccctaaaactaagtgacttaaataacggtcattatgtactgcctcttatggtttctggagggggtggtcaggaattttggatcatctcagtcagaaggtctggctctgaactttcatgacactccagtcataccgtggctgagactagggccatctcagtggcttctatatgtatgcctgaaacctaagctaggatttgaatagttaggggcatccctctctggctccttaaggtgtttccatgtgctctctcccatacggtggcttcaaggtagccagacttatcatatattgccttgaggttcccaagacatatatctcaagctagaaagaaaaccaagaaaagccaaagttcctttaaggacctagtcttaaaactcatttggccttacttctcccatcatctgagcagctccacttttatctgtttcatacatggggctttggcataagagcatgttgaccaaaggctgtcaaagtaaccaaacataaaaagtttaaaagctagtggctgggatgaagtctaatgccccaaacttcaacaaagctaggtgatggaaaaatactgctgaggggaaggctgcttaggtgatgggcaagagagtccttggagaatgcagataatcaaaacagcacctaattaaggtacagataattgagagctggattatcactaagattgtatgtataaagatgcactaaatatcttattttcaatttctcttatttttctatactgttataatagaaataatgtaataacagcaaaagcaaaaaatagtcctataaagtgttcacatggtgaattcaatactttcacactgggaagatgatggtggaagatagtatctcaggcagtgcagtccaatggaagatcttagaaccaaatgtattgagttgaaaacattaatgctgtcatttctgagccatcttaactttggcaaagtaattaacctgtcagagtctaaatgtcctcatctgtgaaatggaagaaattatgagttcacaaatttacactgaagagtcactgatccaccattctttaattcagtcataaaatatttatggagagccaaatatatgccaggtatgatatggtatggaaatacaataatgagccaaatgcctacaataatcaatcaccaaacaaatgtttatcttaagatgacacccataaacatgtccaacaaagatagtgtcaaaaaattgatgtcacctaatgaataatttccttctttctttttatttatttatttatttttttgagacagagtcttgctctgtctccaggctggagtacaatgatgtgatctcggctcactgcaacctccgcctcccaggctcaagcaattctcctgcttcagcctcccgagtagctgggattacaggcatgtaccaccatgcccagctaatttttctatttttagtagagacggggtttcaccatgttggtcaggatggtctcgatctcttgacctggtgatccacccacctcggcctcccaaagtgctgggattacaggcatgagccaccgcgcctggcctttccttctttcttgaccttcctttcttcataccataactcagtgataattagtagggggtgaaacagagccataatacattcatttgtgaatctcccctgtcctcctcacacttaccttttctctattcccttctcccaagcctggttctggctctctcatgcttcagaatctgtgaaattggttcggagggcttcaagagaactgcggaggctaagcctgtatcataaagatttaggactaggggagaggaagcgaacacaaagaaaagttggaccatgtaagaactagaaggagagactggggagctggtcctggagtgactccagggcaccaacatgtaggggagaaatactgctgaggggaatgacatgatttctgtttctttgagagattcaagactggatttccttttaattaacatggggtggctgatctatacttcttgaaggcaactctaggtgggggtaaaccacctggggcctcaagatttattaggacctcacaatagcaaacctgttgctcccctaaaagctagaaaggggggtttacaaaggagataaaccacaggtgtcagatatgtatccaaaacatctctctgaaggacttttctcaataaaaaaaagctactgatgcatttaaaattaagtaataaaacaagaagtacctgtgcatgaaatatttttacatctcccacctccaaccctgaagccatcctattagcaacctaccctatgatcctgacatgacccgacagaaggagacttgcagatccaactgctcctcagactctcacttgcacagggggcattttcaacatgtccagggagcatttgctgccttgataatgacctttgaggagaggaaaccaactcagaagtaccttcatcctccttttagtttgtcttttatgtttttttcttgagccaatgacttctttcagacagcaataatttacacttcaggaaaatgtcaaagtatagcaatgccctgaataataattaccgccaaggttggaatgaagcctttcgaagaaatgctaagttaattagccacacacttgtttaccattaggccagtggagaaaacaaggagcacaggatcagaacatgcctgcaacatatggtctttattaatggcggcatctcaattagtctatgggaccccacttctgtcaacccagagatgatctgaataaagaaggagaagaaatgttcacaaagctgtcatggggagaagatgctacctgagaccactcaggacacccacaaaagaaacttggatttctgttgttttctgtcataccttcatacatgaaattgcctcttttaatctttccacaatgcatttgttttgggacaaaggtcaagagaagggcagattaggaaataaggaggtttacccattattaccaaaaatctatttaaaaaatcatgtttccatgaatatctcaatttatcccttctaattcttattctcatttctgaaatatatactttgtttagctttttggaaaaatccacattttaaagaagtatacaataaaaaaataatactccttatttacatgcttctgcaatcatggccgcctttccacagaacactctcagacgaaggcccttttgtgccggcctacttagatgttaccaaaggtgtacaaaaacgcatctcttgcagatggctggaagatagctctgagctctttgtgttcaatcaatcccccaggaaaaggcattagaaatttattagaagcagctccctgttctcctcagtttctgagcttggaaaaagcacactacactgaaaaagcattttgaatggaaaatgtaacctgaagtatcttacttttttctttcctccatagtcctaccatcgatatatcctttgtaggactctattagtttgctaggacgagcataacaaaataccaagtaccacaaactggctggcttagaaaagagacatgtacgatcccacagttctgaggacaggggcctaaaccaatgggtcaccagggttggttccttctgaggactgtgaaggaggatgtgttccaggactctctccttggcttgtggatggctgtcttcttgatggatttcctcacactgtcttccctctttgcttgtctgttgctatgtctaaatttccctttctttaagaatacaagtcatattgcactagggcccaccccagtgacctcatcttaacctgattacctctgtaaaggccgtctccagatacactcacattcagaggcactagggattaggacttcaacttatctttctttgcaagggatacaattcaacccataacagagatgagtaaaaaaaaaagatattaatgttcaaaaaattaagtaaccaaacataaaaactttaaaagctagtggctgggataatgtctaatgccccaaagtggaaaggtaccattgtcacatatttcaaagaggaaaggtaccattgccacctatttccctggctgtttgttaccttgatgaagtgtctactgtggcaaggcattatgcatggcactgggcaacagagggaaaaaaacatggagcctctatgctcatgaatttaccctctccttttatgccagccttttcaacctgggggaaagtggactggctagagtactaatcaagctgtgaaggactttgggcttctacttcattctcccttgcattgacagctggacagttaaaagcagcaacaccaacagctgcacagcacccaactcatcaacccacaacaacggtgacatcacctaagttagcatggaagtggccagtctgcttttgccaattctttgggacattaaacccatgataatacttttaatataattctgtgtgaaccaataatgatgacaaactattcttcttgcctggttggagataataagtaacaatacctcctattttctacgaactgtactttttttctagcaccgtgccaggcacttaccatgataattttatgccattttcacaaggtgagactgatattactagctccattttacagatggagagattacatgtcttgctaaagctaccagctaatacagagtaaaggttaaatctgaaatcaaggtgtctagaaaatcaaccccatgctcttgagccttacacaatagtgtctctttcaaccttttgaacctgagcacttatgacaactgcccagtatatgtgtacacatattctgtgcatgttatagatagacagatagatagatagataaaatatctattttctccccccaaaatctatgactaatgcaataaacctcccactgattagacagttatggctttttctcacatctccatcagtgacataacatattaagcaaaaaagtccgacccagctgattagtatttgatgtgctgaagagcctaatgtttctttatatgaaacatcagacagtggcagcctacttaattactaggttgactttatgtcttcaaaataataaaacagaataatccaaacgacaggccaacgtggtgagtgatatttgaacatctactcgaccctaaaactgttaaagcaaaagtacttatccaaaatccaatactttccatttttcttttaaatgttgtaagtcaaaaccagctaaattgattttttgcctttgacttctgctgaaaagttcattcctaagcagattacatgtgtggctttgcagctcagaggaaattttacagccaagtaaaaccctaaaatcaggaaaacatgggtttgctgaatacagtagaaagacgtgacagatcttaattataaaagaacaaatatatcttgatagatgaactgtcttttgtgaattaagactcaaaagttttaactccttgattaaccgttacccattagtaatatagaaagttgtgaggcaacgtcttcaaacttctaagtagaacagagcactcccaaagcatgcagaaccccctgtaacatcactcaacgcattttcagcatgagtgcccagggtaagccttcctcacaatgttgcaaagcaaatcgtgtccctcattcccttttctactcccagcactccttggttaagtgttttaacagggtaagtgatgacggtacaggaagagaagaaggaagaggaggagaaagaacaacaatgatatcatggtaaaggcctgtagaaattgatctaccagacaaaactcaagagctcatatgatacaggattttgcttgcacatggtcacaattaaataaatgatgaaaatgagactcaaatatagattgtatacctcattccactgttacaagctttcttctaaatgaggaatcatcaaaaccaaacagaagtgtctatcttaggtcaccttaccctcttttctgattgttgaaattaaggcagtgcaagaaacctggggagacactggaaagtgtccccatgccaagccctgtgagcacaatgagctcatgaaagaaaagcccagagccaacaactaataatcgtgcttaaaactcatcatttaagaatttcaaaataaacactgatcaattgaagttattttgacccaaagtcttacgtaccttcttttgcttgtccatattggccatcataaaaaacagcaaaaaaaagaaagaaagaaacaaagatggggagttgttgcttaatgggtatacagtttcagtttcgtaagatgagtgagttctgaagatctgttgcacagtaatgtgagtatgtttaacactacagaactgtacacttaaaatggttaaaatgatgtattattccattaacttaaaatggttaaaatgatgtattattctcaggtatgataaagacatacctgagactgggcaatttacaaaagaaagaggtttaatggacttacagttccacatggctggggaggcctcacaatcatggcagaagacaaggaggagcaagtcacttcttacatggatggcagcaggcaaagagagagtttgtgcagggaaactcccccttacaaaaccatcagatcttatgagactcacccaccatcatgagaacagcttgggaaagacctgcccccatgattcaattacctcccactgtatccctcccacaacacgtgagatttgggtggggacacagccaaacaatatcaaatgataaattttatgtttttttaatggaaaataaaatttaaaagaaggaaaaagaattctctccccttccctctctccctacctccctaccttgctttctcccctccagggaagacatgtgcctccaggatggaaacaaatggattgatctggaaaatacttaggaggcagaactgaaaaaatttgaatgtgaggatgagaaacagggagatcatgggtgatttccaagtctctggatcaactgaaatggagaatggataaggaggaacacctggaggagagcacgcttggaaaggcatggtgagtttcatctaactagagatcaccagcaggagtctgccctgtccatctggagcccaggaaggagggttagggtggagattctgtacatttctacagccaactctaatttttggttacaatcaaagcctatgcccttctaaaacctttttcttccatcactaatgatcagctgtgtttccagaagtatgaatggatttatcctatatttctgcctaatatttcatatatgaatacttctaggcaggcattgggtcatatgtgtaaaacgaaagcaagtacttaacacaatagaccattcaataaagctgcttttcacatgcttcatttactactttccattgcctttttcgcaagcaattaccatctcacacatgcccagtttcaccattctgcagaaccaaatgttgaatttaggcaaacatagggtgttcaataaacaggtggattttgaacagaacaccaatgaattcaggaagcacggtcaaccagctgcgtctgtcaatggaataatcagtagctggctgcatctgtgctggctgggctgccatcggtgtttacaagctggaattgaagagggctcggccagctgacagcagaagtttgcgcagcacctgtctaaagtatatatgactgcctccaggcaatcccattagttctccactttcatggacactaggacttgttcacaaatttagggggaaaaataaaaaagacaaacagagctagcctctgactgagaaaggacacctgaaagagaaacaatcccatatggagaaacagaacaagggggtgagaatgagaaagacaagaaatcactcaagaaagccagtaatgtttacagatagtagaaaaattttgtctgtaaacagtgggcttggtagcatttttttaaatcagagatgttctggagaaatatgtaaagaactcagcccaagctttctgatgccaggcagggcataagtagtttacatggaaccttctgacttgtttatctgacatagtaaacagctttctctgatcccactgtcccttttacgcattacaagataacaaaaagttatgcgattttaggaaatcaagtatataaacagggctattctcagcacatccactgaatattaagtgcccacttttatctgctagaacttgatgtgtgaaggtaaccaacttaaatgcactgaagagattgcattcacacagtgaatagtgacattttgctaggaatttgttaaattttataatgcaagcatactgccgtaatgttccacaaaacgtaacagtcggtgcacagcaatactgccctctggtttgtgagggctatttccatcctcaattcattctagcaggaaaaagaaattaaagatatgatagaatgctatccacattgttataatgctggttctttctgaggttagtggtcacacacagtgctatagaggcggttgttctttcttgtgcctgtaactgctgaggttaatctctcagtgcttccaaatgcatatggacatttacacatatggacactgaccaatcctaaaagaaaactcaggataaatcatgttcaacttcaaaagtccagcagctaattcaaagccatgctcttgtagaaggagccattgaaaacaacagagaaaccagacaacagtctttaacgtcttatctttgtttatgattcttaagaccacacctggcgtgaaccgatatgctaggtcaccctggttcctcaggtgcattaggcatatgtgagcagtgaaactatgacaaccagaatgcaacatccaattataatgattagaataacaacaaacacttaggcaataattatttccattcattcacttcatctccccaataactctacgaggtaagtacaattattattccccacttcatggaccactcagtgccatactaagagtcccagagccagtaacgagcagactagatttaagatcaaccccatctgacttaggggttctgctcttactgttgttctgtacctaaagctatctgatgtattttaaaatgtaggtgtatcagtttggtggggttgccataaccgtgagttgggtggcttaaacagcagaaatttttcttacagttctagaaactgaaagtccaagatcaaggcatgggcaggtttggtttctcctgaggcctctctctccccttggcttgcagatggtcttcaccgtgtgtgcaccttcctggtatgcctttgtgtgtcctaatctcctccacgtataagaacatcagccagaccagattgggacccaccgtaatggtttcattttaagttctctctttctttgttttcttcttttgagacagagtctcactctgctgtccaggctggagtgcagtggcgtgatctcagatcactgcaccttctgcctcctgggttcaagctattctcctgcctcagcctcccgagtagctgggactacggacatgtgccaccacgcttccctaattttttgtatttttagtagagatggggtttcactatgttagccaggatgggctcgatctcctgacctcgtgatccacctgcctcggcctcccagagtgctgggattacaggcgtgagtctctacgaccggccttaagttctcttttcaaaggccttagctacaaatgcggtcacattctgaggtactgtgggttagggcttcggtgtgaatttttggggaaaccacaacgcaccccataacagcaggtgtgttaacgttctacaaaacgcaacggtgggtgaattgtaggacttccctctgctttatgagggcttaattgtatagggccttattttggatctttccacattcaacaagttctgagaatgtgatacttggaaaccatgttcatcagaagagtgaaaggctttcaggtaaacgtcctttgatctttttcaccgtgatgccctccgatgacattaactgtggtagtaaccagcatcattcagttgctgttttagaaggaacttaaaaatggaagatttgaaaacatgattgtgaaaccataattttgcactgagtccagtattaacagtttttcaacagagttaactcttgctgctttttgttttaaccctgagtgtctagaactgagttgggcaagctccttaacccacagcacaccagcagcctagaactctccaagatgtcacttggattttccttctgacctgcctttcctgatcccttgctacctcaccctatagacataggcttacttttccctaatattttcctgtactttaacgcatagctgtgtttttatgaaaaataaaatactggggttttatgctcaacttatttaaatgatatttcactacaaattatgttcttcttctatttgtttacatcattatgcttttgaaaaccaccagaatatgtatgtgtacctctggatctaagctgttaaacatagtagccactagccacatgcagctaccgggcatttgaaatacggctcatgcaagtggaaaactaaatttgtaattttaatttatctttaatttaaatttgaaaacctgtatcttaattatgagaatacttttaaatatttttggaatatcttgatgaatcttcttttttcagttgtacattttataaaacttaaatatgaatcaatcagttccaatgaaaatttagcctctgatttaagatgtactataaaatacacatcagatactgaaaatagtacaaaataggaatgtaaaacatatcagtaagttttatgttgatgatatactgaaatactactttacatatattaaataaaatacagcattaacatgatcacctaattctttaaatttaaaaaagtaaaaataaattttcttggtacttttttgtgtggctactaaaaatctttaaattacacatgtggttcacattatacttctaccagacaggggtgatctaggttttaattcctctaactactacaagtattctataataagcataaataataattttacttcattctcttatcagcaggcaaatagattgtttctaattctttaccatatcaaacaaccctccaaattcctgtttttatgcatcctcactaatacttattatgatctttcttgttgcttttggtcaacttggtggttatagagcagtgtttcttatttaaatattcatgtctcagaatactgaaagtgtacatattagccattcaaagttcccctttcgtaaactgcccatttatatctttgcttattaaaaattttgaattcacatcttttatttaccaattagtagaagtaaaaagatatattcccagtataaatctcttgtccactgttagacgtaatttttcagctattatacgtatctccaatattttcttagcttgtactttgttcatttttcccatagtttatttcattgaacacaaatctttaattataattaaattccttaaattttacctttattatttcaagaaattctaccctagtaagaaattgtgaagaaatttcatcttttctactcttggtttatagtttcgccttccatatttggatcttcagtccatcatgaagccctatagcacttagagcagcagatggttgccaacatcctaggcttaggtacttgccatttgagaatctgaacaaaactgaagactttcttactgaaagaatgtatgtgcataaaatactatatatataatttcaggctgttcccagacctctactgcaagccctttcatgtatccttatgcagtccacagaatccaggcgcaggatccccgagtctcacagattctactctctattcaaaaacttcattgtatttttcatggctttgctcaccatctttttctgggttatctcatattctcaactagtttatgagctccttacggacagagacctagatccaggcatctccaagatttttcatggcacctgagagctgggagtgctcaataaatacgccccttagcaagtgatattccagaaatcagactcagagaagagaatgtggtgtaaggcccaggggattactctaaagaggcctccattaattcatgcattcaatcaacagtcattgagcttgtccactgtttcaggtcctgggctacatggaagataatcaagggaaaggccacagtttgtgtcctcagagggttcctattctagaggggacagcaaaggagaagtaattataacacggggcatcaatgctctgctaaagtaaggaagtagggagcttctggtctgcataacaggagggtacctaatggggcctttgaggtaggggaaggttgggcctctcagcaggagtcatgtttaggcggagactcacaaaaatgcatagtgttaaaaaaattaaatttagcctgaggctgtctccgtaatttgagtccctacctaaggaactgcagcctaacctaacttagtctattaaacacaccgaaagcctaatttaggatgctttttttttttttttttgtaacagcagctgagcttcagccaatcacaggctgccaactgatcagaccatgaccaaataaggtgaacacctagacataacttaaggaggaggcaggatttgactgaggaggcagggctcggacaccagatcaaatcaaagactacctagaacagggacagagtggaagtacatttccgtaagatatgcccaccactggtgccatgccactttatctctccagcacttaatagattctacctgaacccctcaccctcaactgctattaactgaacctggaaatctgagtatctatatctgtagtgcattaatgattctatattttgcacccactgtgtattaatgacacaaaagtggaggtttcccttcaatgctttgatccaactctaagctgccaagtccccaaggctgtaacagtgtatacaggattctacttgtgagcaaggaaacaaaccatatatggtgacttctctcagataacaacatacaggaaaaaaataaaacaaacaaacaaaacaactgcctaatctgggaaggtaggagtactgacccactctgtgaaacaaagattggttgggtatctccattggaacagggcaagaatatctctacagacccaatttggcagcaatggatagatatcagatgttgtggagcctctatttgcaccccaactggactaatttttgtttgtggccattaatggggaaaagtcataccccatattcactcttgactaccccatgagccacttgtttttaggagtggctttcccttgtatataaaaaacttggaacagaggtgaatgtaggatggccactcttgcttctctaggggtcacagtctataatcccataagaaccaagaacaccagaaataaacaagcaacagcattaattctagcaggaatcagagcagcaatagaacgagtggcatcctggggcagctttgcctatcacgagtacaccctgaaaaactagactcaaactctagaatccctagccaccaacacaggtcatgtactaaagggaatcctagagtccttagaatctttggcaaatgtacttcttggtaactcattctgagggctgcccgattagttgactgctctttggtcaaactctgttaaattaaacttgtctacagtttttcttttaccagtaggcagctcatctgaaaacagtaggagggaaaagagggaatcctagaaatcgatctgtcataaacattgtgaactggctagagtgctcctgccttttcctgggaatcagaaagtagcagccagacaggaaaccaaaccacctgatcttttacaaacaggaatcagatcactgtactgccacatttaaagccaccaggggcatcccatctaggatgggatgggaaaaagtatgtctaaaatatatatacatagtgtatataaatatatattatatataatataaatagtatataaaatatataagtatatattacacatataattttttcttagtataagtatgtcccgcgtaatatttgcaatgtaacttacactaacaaagtatgtgttatttatcagaaagtcaaatttatggcagttaaacctgccagcccaaagcacttaaaatataaaattacacttaaaatagagtcttcagtattatattttctctggctttcatcttagtgtgagctctgcattgttccccatgcttcaggcatgctgaccagtgagaatgagaataagaatgccaagctccatcccatcttagcaccttggcttctgtatcttctttccatttagaatgtgttttccctctttcttagcgtggttggtttcttctcttctttcaaataccagtttagatgtcacctccatagagaggccttccctaaccacaccacctaaagtaggctatcccaattattttctctctagatacatatatatatgtcagtccataaacattttattctttcacttctaaactgttgccctcaccattatgtcagagacttctgccttttgcatctttgtgtccctagcccttagcaaaatgtctgtcacatacgagatactcaacaaatttttatcatataatggaaatcttaagttagtattttctctggtgcttccaagacatgcattttgcctagacatgttattgttcgtcatgtgaactggctatggcaaaacacattgccttcagagagaaagagccacacaagttggaaaggaaaggtcacaaggatgaaagaactctatcaacattaatgccttataaaaaaatctcttaagagataccaaaagatggaaagaaattgagtctatcatttgaagacatcccccacccccgcttttttgctttcctgcaagtcatatctgagtcatacctaaggcactttggctgtgcctccttgtggtcctctccatttcttactacttcatctcatcactttaccaccttcaaagagtcctttcctcatataacctcacatgatgttcacaggattaaaaaactccaaacgttcaatagagaaacaacattttcttaaaaatatacagacagacatatgcgaattctttcaacatgcttataaatctatccacaaccctactcagagtatgcttcaaatgtaaatcagaagccatatatattgtattcttccaagtgattactctggaaaagaaaaatcacacatatttattgagaggagaacaaatttaataattttgctcaatcatcaaaaacatttctaaatatgagctatgataggaaaaaaatcagtttaactttacatatgaattattttcctgttttaatcatagaattttttaaagttttggattagattcaaatttcttcagagaactaaatgataagtttgcaaacaattactggaaagaaataaggacaggtgagagcaaaagaaagaaaaacggttacagagtgtaaaactattttcaagcacaaagttaaaaacttctaatacagaacctggaaaacactttatgtgtgtgagataaatgaaagcgttgaggtcagattagaaaaacaaaacaaaacaaaacatagcttctactgacaaatgtaaatgcaccctgtgatcctgttgccaatgaagtggcattgctctgatgtaccactcccatcccaacccaagcacacacttgtcaatgagcaccagggttttcaaattatccagaactctatcataatgatggagctaggaagttctttcagcctcttaacagcagcgcattattttccctatagataatactgagaacatggcaacacttctgcctgatctgcttattaataatacccaacacagcatttattagatagagaactactagatgttaggtgctgggttaagcacaggaaaagaatcaacaaattctacatcattttctttgttgtgttggtggtggtggttactgttgtttataccttcagatctctttctacactaaatttttgggtagaaatgtttaaatatcatccttagcctccgcaataataatagcatttcatcactatcactggtgagaaatttgtgttttatttttgtttacattttacattaagaaattaatgaagtgggaatggctacctttgctgtatactccaaactcccactgatctgtgtgtgggttgcgtgtttgtctagagaggacagttgcccaacacaggaaaaaaaataccctgtcattatatgatttttcacagaactaaaaagaaataaactacccccattccaaagcgtggcctcctatctttttgctacacctcatatacttttctcacatggcaagaagggtacccttgactgctcagtgcctctccctcctcttgatgctgagatgctccaaaacaccactggggttcttcaggagggatttcattgtcaactccagcttgcagtacagggaagtgacatctagagtgggcctctttttgtcactttccccatactaccacacacataaaaatgcctgtcaaacactgtcctacatacatggatgagaaaaagaaataagcactctactatgaaagactctaactagaaaaagcaaggagatgccaactgacaaatgtatggtgatggactttctttttttttttttttccaattctcagatttatttctgaggctctcagccaatttctgtgtcataaagatggtgcagttcagagcttaattgctttagcacttgcaccaagaaaaactgtattgcaaacaatgaagaaagaagagaggaaaccaacattttctaggcactggccacgtggcaaccagtgtacaaggcatttagagaaagctttttgattccattcaatcctggaaaccaacatgttgaagggccagatttttcaccattttatagggatgcaaactttagctcagagaggttaaatgacttgccaacagtcacacaactagcacttagaggaacgggaaggctaactcggagctgatgctgcagcttacactcactccccactcccacgcaacacaaactctttctaggcagcttcgaaggtaccaaacaagtggctcctaaggactcagtaaacattcctgtcagctggccaagatgaatattttggataatgtccagacacgtgaaataccagctttaagttgtggaagtgcttcaggcacaaccaagtctcatttacgtcctttaaaaaatagtcatgacctgcccccttcacacactgtcattcttctggaaggtatctgagagcacagctctgcaaatgccaagagcattatgcagtttccatacatagggcttcctgagtcaggtttggcagggcaggggttcagtgtacaatatttctgccttatttctttaagtttctcttggctacagctcttaagagacacacagagggaatggattctgtagaagatttctcccagaaattttggtgtagattagaaagcttggtttgcttctggttctattacttgagatttatttggaactaaaaggttttctgcctgagagtaaccatttaatatattggggaggggggaagaataaaatgctccttttgttttgctatttgcaccaccctgtcccgattctattgtttgcagtaagttttgtaagagaaactcttctgcactccttattgtgttacaagtttagatgtacccaaaccatcagcagttagattccaagtatacgcttttgattgattcaagtgcattacccgggagggtgtgtgctttgctctgttgttcttccagccaactcccttgccagctgctgaaatgatgccaccaccggtctccatgtcatgcagattttacaccctgataccaggaaagcagaagcatttctcaaaagactttttgctggcttggcaggaaaacagaaattgctttttatcaaaatgaaaaaggttttcttcatgggaaacagcaaaagcagtttgaaagaggggccaatacttttatcctagataaggtgttttcagcagagcagacagaaaaacatgttttccttcctttcatgacatcaatcagatccccaaagccagctacctttattcacagaacagatggagcggtaatggtcccagaggccactcttcctggtctggggatcttgccatccctgcctgaaagttctcaaatccaagctctgggaacttgggatgcttttttctgcctctcccacactccaagaggaacacatccactattatgcatgtcttcattctttgtcctgggtggaacttctgggggtgggagaatgggtgataaagggggaagtgggattcactttgtgaacacctactagaagccaagccaggtacatcctatgcattatttcatataaaccttaccacaaaactttgagtggtattattatgtccatatgacagacgccaaagaagtagactaggggagttaaatgaaatcccaaaagtcatatactaatatgtggaatactagtaaaatctggaatgtgaaccctgcctggtctgttgcttcagagctttgatgtgccaccaacaaacacttccatgcctctctgcttagaggcccagtttaaaatgctatcctctggataaatatgtggtaggtccatacaatggaatattactcagccatgaaaatgaaattctgacacgttacaacatgaatgaaccttgaaaacataagctaagtgaaataagccagtcacaaaggatgatattgtgattctgaaaccaacccaataatcccatagatagttttttggatagacgtagaaattgacctttgtggtcttaatgcttgaagtttatatttgttttaactgagttccttcctcaggaaatgaccttcaggcctctcgaaaaaaaaaaaaaagtattggcaaactgaaactcaccagatcaccacattttgacaatgagatgctggacccctcattctcaggattgcttccttgcctctccctagttcctgttttcttatacattattacatttcttcctggctatataaacccctggttttacatagtctggttttggtcagggaaatggatttgagactgaactcccttcttcttggcaatactcatcatctcagtgactggttttctgcacggcaaacagcaggacctagaccgaacccctagtgttttggtaacaattccacttctgtgaggtacctagaataggcaagcttacagagacagaaaagtagaacacagattaccaggggctgggggagggagaaagtagtccggggaatagggagttattgtataatgagtacagagttgtgttttttttttttttttttttttttttttgagacagagtctcgctctgtcaccaggctggagtgcagtggctcgactcgatctcggctcactgcaatctccgcctcctgggttcaagcaattctcctgcctcagcctcctgagtagctgggattacatgcccagctaatttttgtatttttagtagagatggggtttcaccatgttgggcaggatggtctggatctcttgacctcatgatctgcccgcctcagcctcccacactgttgggattacaggcgtgagccaccgtgctgaccgtgtacagagtttctatttgagatgacagaaacttctggagttggatagtgtgatgactgcacaacattgtgaatgtactcagtaccactgaatgacacagttagaaatggttaacatgctaaattttatgttatgtgtagtttgccatcacacaaaaatgttccctgcttttccctttgaaagatgccacatctgccctgattccaaagctctttcttagaattgactcccactagctgtaaagtgacacaaaagatgatctactccaggcatgccaactcaaatccactgatagtgacagctagcaacactgtgttaagaaagattatgaggatgttttcagggccaaaaaagataaataacatgatcgatttgtaaaaatcccctcacaatgagacatcgaaatgttggataaaatacaacaaaatattaattgttctgggaaatgtgaattgggaaacacagaccaagtggcaaaagcttgggcagagagtcatggtattcagaggccatgatggtcaaatacaggttgatcttctaaaaacataggaaccgagtgagtaagaaaatcaaggcaactaaaacgaagaaaatgttacagtaggtaggtagtcaggcgtgatggggcaggagagggccctcccaacacccccaccaggaaagccacgctaccatcaggtgatggtcaggtggttgttaactctctttaaaataataatttgtcacagccagcaccagggaaagaccgtcttcctatattgataggaaacacctgtaactggtaatcagcagttttcaggagttgggcgagtgagcacaagcatgcgcattaagagacaaaatggcagaatatggttttctggggcattccactggaaaagggaagaaagcctcaggtgggcatacatacaacttcttaaacacactcacatgctcacctcccacatgttagcaggccacacacatgtgggtggcccaccttaagagaagaaccatgggaaaagggacacaaggcccagaagtacaacaacatataaaacccacgtcaaaaggtcaaacgttacatgtgaccttcacagtgcctgcttgggtctcttccagatatactttcctttctttcctgtgctaaagctttttaataaacttccactcctgctctaaaacttgtctcagtctcttttcctgccttatgcccctcagctgaattctttctcaggaggcaagaactgaggttgctgcaggcccatatcgattagccgccagtaacccaaatattcattgcccccaacaaaaagagcagaggttttctgtgcctacgaggttcatgaatgagggctgcctagagctccccccattcttgttgggtctccccttctagtacaagactccttgtagctttgcaataagtttaccttttccttataaaactttactagctattcttcaaatcgacaatggtttgacttcaacaggtcttcatggggtgatcacatcatgtgtcatccatagagggtaatttgaacttataagcattaaccgtgctccatgagttgttgttttttgttttgttttgttttccttttgctttgataaacaacatacccagatacatgggggaaaaatggtagtcatccaatttcttcatattgccagactcacagcaacaggaaagtgacgttattaaccctggggagcctctataacttcttaaaccataaacaaaaataaagaacataatggaaggtataattggtgttaaaaaaaaaaacccaaatgttttctgaattccatcctcatgttacacactcaaaaagtttctctgtaaagaaagaaaatctttgactcaagaatcaactttctagctatctcaaaaccaaattataatgaatttagaccgtagaatcaatactgggggactaactaaggatcactaaatcctgtgttattgattgcttggagaaaactatctttttaaatatgcatcacataacaaagttctttatttctaagaactttctccaaatcctcccatcacatggtttatgtaatgattaatcctttgtattaactactttatgtgtcagaaatattaaaatgcatattaactgttcctgggaaatggttctgcagtttctcctaaaagtatactacctactttgaataagttacatgaaaactgtggcacatttgggaagaaagcagcttagtaggagaaaaatgagatttgcaattataagaactcaatacatgggtgtcttaggcatttccagattttaaaaaagtataatgacttttctcccccagtgtgataccaaaatcaatggaatggttttggtttgttttctactggagtgtaccagttagatttaatcacagagggaaaaatcttgttttgatttctcttattaattacttcttggaaaaatgcactgtagcattcttattcagaatttcaggaacaaaaacttttcacttttcaaactgcaaatgaaggtggggtaaatgtgtgaaggagctaagatctagatatattagagtttctatctctgaatccaggaaggactttgtttatagtggtggaaatcaagcaaggagctattggttggtccacacaatgcctaggtgttggctgtcatgctccattcagacccacaatcccaatgaaacctgtcactttcaagagtgcaaataataggatggggaaagagtgttagagtaggacgttttctaacaagagcccagtggattcctacctttcatctaataaatttcaatggtttaagagagcagatccataggtgccacacagcgaaaggacctgtgtaaaaatcacagtgagactctggagtaagagatggaatgtgatggcccgaggccctgccctccaaccttgagtccacaacatacgacctctttaaaaaactccctccagaagccctacagtttcctctctggtttgcgtcttactgctgaagagtctgtttgtagagatggatatctgactaagctagctttccttttttatgctctttccctcaagaaccaagggtttttcacattccaaaataaaatgcaaactgagagcattttgtatttttgcatttcgattccctgttttgtcagtgagtaattatagcaaataaaatattgcagctgaatgtaaattgttaggcaaccagatcacagcaggatatttttcttccacaagttttacatcatagagtgttaaatattaaaatattgcaagtcaagtaaacagagagggttctttgctcaaaacattaattttaaacaaacatttcactgttattcagatcggatgctaggaaacaaatgacattttctttcaaataaggtgaatagatcatatgaaaggaaagcagacaagggaatcatacagaaggaagggcatttatgacacgagagatgaatttcagccagaagaacaggagagaattcacatgtaggagagaaagcaaaagaaagagaaattggcaaaacaacatggaaaagagcaagaaatgagaaagactgacttactgctagaaggggaaaaaatgaagatacgtctcatgtcagagtacagagacctgactcaaaataaggcagctggggaagaaatgaaattctttctaacatcatgaatttctgtttccttaggttattaccagaaaggtagaaaggagatgaattttcagacctccaaaagatcaccaatcaataaaataccaatcaataagcattgattgagtacctaatgtgtgctcaacaaccaagtacaaaattagacatggccttcttctgaggtaccttactatggagttgagatgaggagatgctgaaacaatgaatgagagtggaaatgtattctatgctgtggagtgaagaaaacacacagctcaggattcaatgataatgacaatgagggtggttgagagtaactgtcgtaacactcttattttctaagcacctcctacattccaagtactgtgctggatgcttaatattttcatttccaacatttaaaacaatccattaagaattatctcctctagtgaagaaaataaagcttcaaaacttaagttgcttgtattacacaatgagtaaatggtagggcctgaatttaaccccaggtctcccaacccaaagatcacgatctttcttctactgaagtgctggatttatcctaagaaggcattcttctgttaatccttacaccagaatgccagctaattaaaacagaaacaaaaacaaacagaaacgctgtttgagaaatgttctttgtaagggagatgacctaacatgaatttttggatgaaattataatggatatggaggagttttgtttttttggtttgagaaagaatcttcaggaaaacatatagaatttgcaggagagtcatgttcattaaaccatctcagagttaaagactggagggaatagatgttaatagccataaaggccttgcagaaaaaggcaaaccttcttttccagtaggagagaagaagtgaaaagggatggaggaggagaagagtcaactgaggagcaagaaatgttccacaatgagaccgcttcacaatatctcccagttcacaactaaattaaaataatgcctggggagaagactgttacagatacatgcaaacaaattgcacatcctgttaagtagggcaaaacagacacttggacagagaaaccagaggaagacaaaattcacagagaaggtggagagaactttaacttctcatgaactgtggaattggtagtttgagtacattatagttagatctccattgagcaacaaggtcccgactgacatctggtctacaagatcaactttctggcaatacggtaaattttttgacagttactaaatgagactgaatataagcaaaataaaaatcatcttgtgtttcaagaaactgatatactccagatacatcaccatagcatatggagatttctttaactagaaaaaatagtccatccaaattcacattggttgaggaagccagaacactgacttatccatgtttaccacagctcatctgccttccctcccttaataaaagcagaggcccagagtgactgccaaacaaaatctacctaaaaaacatgccattcaatttttttagaaggccattgaaagataagcaaattaaattaaaagaaaggaatgaagagattttccttctgtctggttgttgagagagaacatttcttgcatatccagcatttggcaatctcttagcaaaatggcaaattcacaaaccctttaacccagcaaatgcattgctaagaatttgccctacagatatacttccaaatagtatgccagaatttgtgcaagaatgtcctttgtagtattgcccataaaaacaaacaaaaaaatggagaagaaaacccatataccatccattgggttaaacgcgttttgatttatcaatacaaaacaatatgtacagctattaagaataatgaggtaggtctgctcttcaagatatactatgctttgaaacaagctaagtgtgaagaatgtatataatatgccatttaagtaaagattttaaaggctccgtgtcgttttgtttagatgtcaacatgtgcataatttctttttctgaaaagctacagaagaaacttcacaatggtaatatttggaggacaagaggccagcatgtcagagaagagaaggaaaggaaagttttcattttcctcttatacctttccttcctgcctgaagttataggtatggctaatttgatttaaatcaataatattaatgaaacataaaagtaaaataattacctagtaataataaaactatgttgtttataactcttatttgatgtttggattctcagaatttacttcactgaactccgaaatgggtggtatttttgaaatttttagctgcaatgaaagaacacagtataactgatgcaccccacccccaaccaaaccaccctcataccttgtccaccactgccatctctatcttgcatttgaaaatatgcagagaagactctgtttccatgctacagacagtacttctagaattttgaccgcatagtaaacagtcattgtatcatccacaccctgaatgatgagggacagggacagacagaacctacctaccatgtgagcagctctagagctgtcatagctatagctgactctagctcacaaagcagacatgaggaaaagcaaagtttgcatgtgcacatacacacaacacaagcacactgagaatgaaggagaacaatgtgagactatactggtcaaagagtatttaggatctgccaaataatccagttttgtttgtattttcatttacatccctttcaccttaaccattttcacagttatcaactctctaatacactgacacatgctgtgttaggcacttcgcaagtattatctcatttacttctcatttaaaatgccattggttaatatcataatcttcccattgcatatgaagaaattgacacttaaagatataacacttaccctactcaaagtcacacatctacatctagcaagtgggaggtggcattcaaacataaacacagctggcctcaaaggcactatgactcactgtattcattcctgattcaagtctcatgccttgccctgagactgttctttaggacataaattgggcaaagagcaatcaactcacaaaaagagaagaccttccagaccaaaactaggaagtttggaaaaatgagaatcatgaaaatatgcgtattacacatacagccaggttgaagaagacagaaagcattagaatgtggaggaaccttatgagctagaatgcttagtacttaaagaaatgtctttgggatcagccatgctcctgggatgaatcctgacctggccatgatctaactgtcaccttaaccatgtcaccgagaggcttaacctgcacttacttctttcatctgtaaaatggatggcataatagtgcctgcttcacagaggcatggtgagggttgaataagatcatgcacattaagtacctaggacccagtaactctctgtaattatgctgtgtttgagatcataaagctcttaatcattataaaagtacctgagaaattctggaatgctataacaggaaaacttctgaaaatatagactacccctaggcaagccctttgttttacacagcaagaaagtgagacctaatcagttagaggcaagatgcttctcaagtcagtctattgagtttttattttgcactgaattacacatctacagagcttcctgtagcaggaaactctgctcagtttgcccattgctcattcctaacacctttttctcctgcctgttcccatcccatggccaactactcattctctcagaccatcttgaagccagtgaaaatctgctggggaatactcgggggaagcatatgattttccagtagcaacactgctgctgccacctctctccctttcttcctaccgtgaatttgatcatggttccaggaaatagggtggccatcttgcaaataggcagattaaaacaatcactaagacactgcctacctccaggaggtcttcttgttaccaaagaaaatacacccctatttttttaagcaactgttaaaggcagggtttctgttacatgcagctgaactcattcccagaaaatgatagaagtcctttttccatggacattgacacagtctaggatgggatggtggggatagtacagggtactcaccagctgttggagggaaatccccaggttgtgagagctcttttatttaaaaaaaaattaaaatgtaagtcaaactcaggcttagttttgaagttcatttctcaccttgttctcatttttatcttgatactccgaatgaatttcccaacgatatctaagagcttcccattcccaggctggtccagtgatttttagtgaaattaggttttattgaaagtgagttgatttttacttattaatgttctgctaattagagcactttgtcaatatctccatgcatgcattatattctcatgtccacagcatgtgtttagaaatatgtggataacaagatggagagttagactgttctggccctaatgacctcccgccctctcaaaacgccaacataacttctggtcacgtaatcatgggccaccttgtactgttcactgactatttgttataggttgattttaatccctgacaaattttttttttttttttttttttttttttttttttttttttttttgagatggagtcttgctctgtcacccaggctggagtgcagaggcacgatctcggctcactgcaagctccgcctcgcgggttcacgccattctcctgcctcagcctcccgagtagctggaacaacaggcacccaccaccatgcccggctaattttttatatttttagtagagacggggtttcaccgtggtctcgatctcctgaccttgtgatccgcccacctcggcctcccaaagtgctgggattacaggcgtgagccactgcgcctgacagacaaaatttttaaacctgtgaatactgacacagcgcttcatgttttgctagtcactctcagtgcctatcacagaggtaggcaaatcaaaaattctcatgaagtactagaaaatagatgcacctgtcccccaaatgcacagcataagaagatacccagggactaaaagctcccaactccaaaataaacctattcatgaacatgagtctctattcctttgctcagggaattcagtgctaaagtagatagcaaatatatttatattaggggaaatatctaaaaaatggcacttatagatacatttgctaaatagatatggaagtctatctgaagacctagcactatgccagccatacaacaatctcttcacaaatatgtattgaatgaatgaatgaatgaatgaatgaatgaataagcacacatacacagcagaaaaacagactatgaatgaatatatatcctttcccctaaagaaagatactctaaaacaaatgggcagtcaaaactacaatctctcatttaactgggaaaagtaaagaaccctctatttcatctttgatttcctccttacatgatgtacaatgcaaagggcttgctagtcatatttgtcaagagagcccacaggtactatctggctcatcacagcttaacttatcaattgccattgttgtttggtggatattgatctgggaagaccttgtatcttgcgaaagtcacttctacagcaactcatcactttttctttttagtcgacatgaaggctcaagtgttgtggtatactgggaatttccacgcgacagccccattccatcattaaatacccagtgagagcttgttaactagatgaatgtcccaattaaaccagcacgttcttgtcgctgcctaacagtgatggtgggttcagactaacagtttgaagggcaataactaaaatggtttgaggagcctcaagtgtagtttcaatggtttcacacttatccattcatttgttcattcaacaaatcactcaggggcccagcatggtggctcacacctgtaatcccagcactttgggaggccaaggtgggtggatcatatgaggccaggagtttgagaccagcctggtcaacgtggtgaaaccccgtctctactaaaaaaacaaaaattagccaagtgtgatggcacacacctgtaaccccagctactctggaggctgaggcaggagaattctttgaaccaggaggcagaggttgcagtgagctgagatcgcaccactgcactccagcctgggcaacagagcgagactctgcctcaaaaaaaacaaaacaaaacaaaacaaaaagcatttttttggcaggtcccaatgtctatttccaagctgaaaatgtttgctttcccaaaggggcataaaactgtgatttttcttaacagcacagtttaagtggtcttgactctgcatcttaagttcccagggttaagctggagatcttgagaacaagaaaagagtaaaaatagcaacagtgcaaaactccagacatcatgttggctccatacggctgtgtgggttgtgcactgtgcaagttcagtgtgttccattactaggaccatgatacaaatggcagggaagtggtagaaaccccacccaaggggtatcctaggcccatagtgctccctagtacaagggccacaaactactaaatgtccaaaatcacaagtaaaaactgttcattttggtagaggaaatacttgatttcatacacatctaaatttcacaattaaagtctcaaataaaaagctgccaagtaaaaatgctcaatgaaacataattttttcctctacctgatttttaagtaaaacaggcaaagaagaaacaaggcaatgattgaatagaaatgctattcttgttttaaaaaaaattagacggtcctaagaatctatgctaaatgattacattaatatgcataaaatacataaaacatatgtacaaggatgtttattgtaagactgtttctctattactaaaatacagaagtggttatataaattatggtacttccatacatgaaatgctattaagtcaataaaaagaatgagtaaacttgtaattgctatcctaaggacaaagctccaaaacatactctgaaagacaaaaaggtaatcatagaaaaatataatatgatcctgtttataatcaaatctagataatgtacataaagggatattaagtcatgaaacagtgcttggaaagatacacaccagtcatctgacagtaataacctatgaagatgaacgaggaagtagagaaatttcatattttatatattgtaatttgaactacttttttttaaataatgaaaagtgtttgtgtattaagtgtattataaaaaatatccaaatagttcaaaatgacagtaaattacaggttatgtatagtttaatcccaacctgttacaattcatgacaaaacaaatggtttaaagttaaaatttctaatgtaacctatgtcaattacacattctgacaacatatattcattgagcacatacattacataaaacactgctccaggggctgcaggtccagcaaagagacaggtaaggcccctgcttgtatagcgcttttgtccaagacagtaaaagagactcatatattttaaagagattttcagttaaccatcattttcatagtaaataattcaactaactatgacattttgggcactgtggctgagaggtttgctgtgactctagtaaagtttcttcttggaaagacattctgtgccataaagagcattccctgcctatcaaatattcatccttctcagccatcaatcaactgaagttccctcaaacagaatccataaaacagtcatactttccatccttagaggggtttacacctttccaagcactttcacacatctacggtgtcctaagagatgggtgactaagatgcaggagcaaaataatataaatttaccatataaaaactttcttctgtctagcacacttttctcctcgctctttactcgctcaagttttgctggtccttcagtttgcaacttagaagtcacctcttccaggtggcattccaggctggtatagggatcccccctacatgcttttattgctccctattgcctccattccctcacaaggtgtggaccatgctgctttgcaatgaccaacttggtggccacatccaagtcacagggctcaggatcacctggagtgccctgggtccaaactcaccctcaagaactgactcaccaggtaggtgagtatctgacagtcatatttacagaagctctccaggtgttctgaagcagttaatcccaagatatgatgatggaggtgtggaccatgtctgtctctacatcaccatcattgaagccacggcttctgacagtgcctgatatattgctggtgcccaataaggagctgctcctttatctactggttctttcaaaaaatatttactgagcacctcagcatgccagacttctggtgaatgacaaaatgaaccaatcatgcatcatgacgatgatacagctttcattaataagactttttgagttatctgatacctgaagcaactacaggaacccaatccacacctgtccctctgtcccctgctgggtagattagggaagacaaacaaagatttgggagcttttgtcacattctttaggtgcttccgggatgccaccagtgggttccaactgctcagctatgtttagaggtcacaggcaaacagagtgggcccattgcagactgcgaggcagggtgcctctgttcaatataaggatatagtccatgagacagaaggttattacaatgaggttgcctgggttttcctccccagttttattctgtacgccttttaggtaaattccttaatatctttcttcaaaatagttggatggcatttgtcttacctttaagggattcggctaaaatccacttgagtgctggcgcctaggcagggaacaggcagcaattcctacaggtccatctacctgatgacatgaagactagtttatggttaacaaactgtttttcactctctttagaagagaaatctctgtcaaaggtcacataaactttaccgtagtcagcaaagccccttcttataggatcctccctctatatttccaccctcatctagcactgtcttccttgcttgccatgccctagtcctgctgtatcaatagagtagagccaccagccacatgcggctcctgagcacctgaattgtggctagcccaaactgagatgtaccagaagtgtaaaatacaacccagatttcaaacacttagtacaagggaaacagaaggtgaaagaatcctattcataattttctacacagcttatatgttgaaatcatactattttagatatatcgagttttaacaacatattattaatttcttttactttttatggtgactaccggaaaaactaaaattacacaagtggcttgcatcatatttctaccgggcactgcaaccgtgtctgtattggcctcttgatttctgtactataacaagcatttcccccacttctgaggctgtgtgtttttttgtcttcacatgaatgactctctttccatgtctggcatgcctgactgctgttcacccttctaaatgcagcttgtatagcatctctggaataagacttgttgaatgtctatctgtttatgacctgcagcaaagttagccaaaatgctcaaaagggggacagaattgtctgcccagacttaaggctggggctccccgaagctgactttccagtgataataaaatgtccccacccaaatctcatcttgaattgtagctcccataattcccgtatgttatgagatggacccggtgagaggtaattgacccatgggggcagttctttcccatgctgttctcatgatagtgaataagtctaatgagatctgatggttttataaagcggagttcccctctacacaagccctcttgcctgccaccatgtaagacgttcctttgcttctcttttgccttccaccatgattatgaggcttcctcagccacgtggaactgtgagtccgttaaacctcttccctttatgatttaccaagtctcaggtttgtctttactaacagagtgagaacagactaatacaggtaataaagacttgaaggacatgaggtaggaaggaaagacaaaggtagaggaggagaaaccaagagtgttaccaagccttagcctgatgacaacaggcagttgcttgaagagagacaaacactcttgctttaagaggaataaatcaaagtggcttcggatacattaaccctagcttgtcatttgagaagacagccctttatatttagaatggctaggaaagactccttctagatgatttggtgctaatgttaagaacatcacgcaaggtgtccagttcgatggctgtcaacaccttctctaaaccttgtggcccataccatatcaacaacaaaataaagaaaccaaccaagtcaacaacaacaaaacatcgtcaacaacaacaaaacatcaccaacaacaataaaaattagaatatttaagagcctgtgcatgcttacttatgtgctgggcactgttttacacattccatatattaacttagtctttccaattaagtcttcaaggtagccaccgttattgttcccattctatagatggagactgaaacctaaaaaagtcaaggacttgcccagcatcactgagctggtaagtggacgatcaaagatttaaacataggcagtgtggatcccaagcctgtgctcttaacccttgcagcatataccactctacatcttctgtactattctctattgacagtatctatgaagctagcgcttcatggtatcaggatatgatactttcttaattattcattattttgtctatgtatgccttcttttcccagctacagcattcactgtttgaagggagagattcaaccatctccttctctggaccccacacccaacttatcctgttataggctcatggtcaacagatgactgcactgtgttactaaatgccagggaatacacagaagttgtgactgcttacatattcatggaagaaaaccccaactcctatcatccaagtttgaaactaggtcttctttcctattgggggaaatttctgcaggtgtgagtaattagaaaattaaacattaattaacaattcaagtgactgattgtgttagcaagttgcttgctaaccatacaggtaaatattgtgcccccatatgatgtttaaaaataaggtcccttgagcatattaagtagtagagatggttgactcaagattcaagagtttcctgacccctttaatatgtcacattttaagtctgtatataacaaaactattgggaaaggggattgccttactcactcaccttgccttatcatcttacaaaatatcttatattaaaagagagaaaaggatgacagctctgtatctatcacctattactcattatcctgggacaacaaacagccccagaatctttctttaatgaatataggctctcatagtacatgcttatgttcgtctcacgtttgctctctctcatttcaaaaccctatttctcttctgccctttatgtcttcaaaagagacgctgatattaattaccttgcttctctaacccctcatcgttttcagccccaaacaatcagcttcctgcttttaatcttctaccaaatctattttctcatgatctaccgaagtcaccctactaagtaagtgtttctggaaaggtattttcagtgcccatttcccttgaccaacctgtggcccttgactcactggaaaaaatcactccactcctgccctttgtaatattattctcagctggaattctagcctctgtcctgcaacctccagcttgattttacaatataaacactgctacttcctaacaagttcaccagatatacgaaataaccctgtatttcccactgaagtaaattagattgttgttcagtaaatattcactctctctttacttcttattcctgagaggagtatactgtcacattcctttgatatcagacttgatttggcttaagacatgtgaatggagcaggggcttaaaatgtcatgtgcattcctgtctttcactatgagaagcagatgtcttagttttttgctgggtcttggagggtgacagacacatggacttaactcacaccctatagtcaaaacaagccaagctggcccacagacacaagaatcagagtaaatgactcttatttcaatccaccaagtactggggacagtttggtacacatgagttttatgaaacagttaactgatgcacccatacaaatgttaaacctttgttcactggaacaaaggttggaagttttctccaacctttgttggatggaaattttctcttgttcctctacttctatggtattacctctcccatgccacttctctaacttcatgtcctgtattctctcccttattatgttttaaactcctttgaagagcaaagcatcaaaagttcttatccctagacagacacaaattaaaatttgcttattcattcattcattcattcattcagcaaatgtgtggattttagaaatgagtttctgtctcaaaggtatttaatacaacacctggctcagcttcatggactagagacacattatcactgaggtcacgttgttactgtttttgctactcctgctaactgttccaaaggggaaaaaaaaacaacatgcactttaaaagcatgatgttcttgttggcagaaattacaatagtttcttctcttggtgtttactcccccaacactttcctcagctctttatttctgatattcaattaccctttttctgcctggcttttctcactttcccagaagacttaccctgggaaactttactgttttcactggtgtacatttgcactagttggtttaattaccaagtgaatctacagcctctcagaacatttgacacgtctccctttcactggatccaagacatgaagcaatgaaaacgaatgggtgaatgttacagcaaactcaaccaaaatttattttgcctggattcaaggattaggctaacatgctagccagtttctgcccccctaaaatgtcaccctctggaatgacaaaaaccttaataagatttggaaccaaagttcctatgaccagaaactgctcaacatatatgcgtcacacacaggaaataaaggcacattttaaactagagctgctgggtcatctttaaaatagcagactgcctgtcaggagaaccaatggaataatcaatcactcaatttaaagtggggagctcctttaaaatgctagggtgatggggtatgggcacaaagtgaatagctgtgacagtacagttcctcagccaagatccacgaatgtaagcaccagtgggaagagcactagaccaagaggctcaaaaatatactgtgaccttcaactagtcacttaacaagtgctcattgtatcatttaaaaaataatacaatagaactccatgaatccaattaaatttaattccatattattcgagtgtttgtttaaaatgatatttctcaaagcaatggtcaaatgagtttggaaatcagtagattaaagaaggttaagcaggtttctgttccatgcaacttctcagtaactttaatagtctactgtgcaccgtgaagctctcagacctggtggatgtggtatggaacattccccagactaataggaatcaaagatcctgtttgtttaccatggacagccttgtagaactcctattctctataatacatggccatcaattatagaagacacagagatactaaagagaatagttttcttgggtcctggtcctgaggcctggcattctcatgaagctgagtttatgccctcccctgtgatttatgccatacctctgaatccttataatgatgtccctttttgatcttaagatggctttaactggtaactatcatttgtaagcaaaagtaccttattaaacaagaaaaacagctacgtgtgagttctgagtaaatattgctaatttatgtctatctgcaattgttacttgggctgaaacaaaagttccaggtaagtatgatagtcattttgccagaggagcctcaataatccctgagctgaaatactttcatacatcaagacgtaatcatctaatattaggaaagccattaagaaatacaattactactggaaatgaagaccttttacaggagaacagacatgatggttttccttaaaagctcttcccttttccacatccactttcttctactttaaaatgaaagtgacttcattttcaagtgaccttttataaagtccaaacatcaagtgtcgtaaatattctaagtattcagaatgaggtccagtactgtaatattaagttggatatgccagaaactcagaaaagcctatttctctttaaatagccaacttataaaattattcatattgtcttcctggattcccattatgttcctcgtgcaagaaagtgaaagtgttttatacaagccacactgtggggtaatatggccaaactaagagctttcagaaggattcttctcttattctctacttctgcttctgctgctgctgctttttttaaacaaatgagatcagaggcatactgtgattagcaatgcatgtttatgtagtgagacaccagattagaaatgattattatcatgtcacctaacagagtgataataatggtactctgagatggtacagctcagctgttgaggattcctactacaataattattttaaaattaattttgaagagaaaaaggaaagaaagaaagatgattgaaaccattaaagcaatcctgataaataagaaaaaaaaacccaaacactatgttttattcctaaggcaagcacaaaaaataaaataatcaccaaagtgagacacgactgactgaaaggtaaaaggaacattcattttccccatccaaggaaaacaataactgaaaacaatttaaggcaaaaagttaagcttctattctgagcaaaggagagttggactgtatttatgtgctaataatctatttataagaaataactgattaaataagatagataaaacttagtagacagaaatatatttttttcatagcaaacaaagcaatcaaaagagaagtgttgctgaaaatattgacaattaaaaatcattcaaggactctgaagtatatttcaggcagaaagagagcagcctaaggaggacttattacaggattgaaagcatcaccgtgaattcataatttttaatatataaactgagagatatggaaatatatatatagtatgtgtataagtacacatgcatataaatacacacgcatgtattgcctacctctactcacagagaggctgaagcaatgataccccactataaattagcatacctgatgtccagatcttggtttctaaataccattctccaaaaaataaaaataaaaaaggaaccagacctccttggagaagtggttggctccattaatgggacaggacaggaacaagatgagattagaatatcctgtggtgccacaaagttacaaatggctaaaaaaaaacaaagaaaaaccaaaattgtggggacaggtcaaaagaacacatgaaccagaatgaagggattcccctggctaaatagggacataaaataaaataaaaactgataatatcccagagactacagaattaaaaaaaatctacgattttacttcacacacacacacacacacacacacacacacacacacacacacatatatagaggggggggggaggatacaaagtaacatgtaggatgaacaagtctagagatctaatatacaatatgatgactacagtcaataaaattgaattagagttttttgttaaataagtagattttagctgctctcttcacaaaaaaagtaactctgagataacagacgttgatttgctttatgtagtaaccatcttattgtatatatgtatcccatatcatactttaaacctcaaatacacaaaataaaatttatttttaaaaaaatgggaggtgggggagaaaagcccttccttacagaatttcaagtcataaataaggagtaattaaattagaaagttaccatttaacaatcatcacaaaagtaactgtttcaggtaagaatcagtagtagtgaatgcaaaaaaagaatgggtaaaagtataagaaaaaacatactacattttctacaagtatattcctataagatacttattgattacaaaaggaaaaatagcaattttccaatggagaaacctggtagacaccacaccaaccaagtgatcaaagttaataccaagaatgggagaaaggagcatcagtgtctcctgatataatgcactaagaaggatataatactacctctgtaggattctggccaatatgcaaaatctgattctaaccatgaagaaatgccacatcagacaaactcaaattaagaaacattctgaaaagcaataggctgtgcttttcaaaaatgtcaaggtcatgaaagacaaagtctggggaattgtttgagattaaagaacactaaaagacaggacaactaaacacaatgtgtgatcctggaatggatcctggacccaaataaaagacaatggcagcatttccataaggtctgcagaccagaaatagctttatatcaaggttaatttcctggttcagtaattacactatgtttttctaagaaaatgtcttgtttaaatacactaaaggagcaaagaggcatcatgtaacttgctttcaaatatttcactaaaaattatatatacatttatacacatataacatatatggtacacacactcatatataggtgagagagagaaaatataatggaagtaagtaaagtattaatatctggggatctgagggaggagggtagagggattctttacattatgcttgcaactttttttttttgcaactctaaaattatttcagaattaaaagttaaaaaagaaaagagagggagcttgacttaatattgcagctgtaccataaagtgttcttgaacaagtgacttgtcttcattgaggctcggctccccctttgcaaaatagagacaacatgacttcacagggtgatcggggtggacaaacaagatggtgctgcaaagctccaacccaagagctggcccctgaagcacacagtaagtatagcttgtttttggtaaatccaaaatacaacaacccattagagggcgttactgtctgaaagcagtttgggggcacccgaggtgatgtgcaggccgcagagacaatgctgttctaggtcaggagcagaaacacaggctcctcacacatgcttttaaatggggctttttactttctaaaatgtgtttctacacaattgaaaacaacattactttttccagagtgggaggatgaaagcaatcgtgggtgggggcttcttgagaagaggggttattttttttacttttaaaaaggtctcagaacagttaaaaatagtttttccttaagcagcctccctctgctccctgctcccaccagctgctccttctctcagcctgcccttctctttgtcccttcaccattttcccctctctcctttttgcttccagtcactcatatgccacccactcctgagaaccctaccttctcttatttttttgtttggctttgttttgaaaaaaatattaatcccaaatgaacaaagaagatacgtgggaaggaaataaatggtgagctcttccttacttcaccacctgtcaagttttaagtttttcctccaactcacactaacctcctgcgcaaccataaacttcagtgcttgccaaagcccagaaaattctaagtaaaaagcagaaaatgaatgcagggaagggggtgcattcttattgttcatcagatctgaaaaaaataatgcccagaatgtcaaatgatattacactattaaaaaggtacagtaaagatgtgctaatgatagattttttttctactccaatatgttgtaaatattataaactatcatttactgtcattactttaatgatgtagaatgttgaaaactcaatctgggttaatttacaaataagtaattttgaaaggagaaaaaaatatcttttctatttccgtgtaatgtcccattacttgacagtcaaaatgtggatacagccaaaagaaaaataatgaaggtcaaggaggatcaaaatttacctgatagagtacctatctgttagaaatcactttcctgaaataccttctctgattttagaaaactgaaaaaacagaaaatacactacctttgacaatgcttgcgattcagggttgtgcttgtgtatgggggtgggagaacctctgctaggataggagaaagctgccagacacaagttcagatttaatagaaatagctttcaaatcaggagtctagccatcaaccagttttagatggacagtcccagtttcaagtaaataaaatatttgcatattagagcctcgtagccctacttagctgcaagtaaattttctgagatttactctgccttgcttcatttcatccaggcactgattattttttcattctttattcaccaaacatttactaagcacttctttatacaataaattctgagcaaggtactaagacatgaagaataaaacaggtctggctggagactgcacgaaattgccagtctgtctgagcctgtttgaattcataaagtccccgagaaagaagaaataggtgaggattagcaaccctgtaagagcatttacaaagaagggagtgcaaaagaagaaaatagcaccacagctcaggagggcaatggtattacttaccaagggtgcagtttgtttgatgacaaatctcaaaactgaatgcagtgattgtgttagatgcaaacacttggatgaaatagatgactgttcttgtgaccttgccaggaaagaggaggagtgaaagagagggctagagttctagtctcctttctgagttttgcattcattggcaaccatgtacctctagacatgggagtgcaggcatctatctctatcaaggtacatgacatgtaatgaaaggaagggatagagaccaggcaagagaaagcaaagagagagaaatagacagggagatggaatgaggtagacaaatcttagaggaatgcagtgcttctccaagtttggtgcaggaatgttcccattagaatcacctgagggggttatttaaaatgcagattcctgggctctgacccaggtctggtgagcctgaatgtctgtggctgggactctaagatttgcattttatatacgttttggggggtggttctgcatattaaaatttaagatcagaccactccctaaatccaagggtgctattttactgtttacttgaccaacagtataaatgggtgtcttcaaagccttgtcaccacaaccccatgcagcctgatccacttacttctctgtatcacactccctcctctcccaccaaggaaaacagagtgatcctgaagttccttaaaactcaactcaatctactgctcctcattagtaataaggttctgttcaaggaactattggctaatcattcatatcctgattgagataccagcatatcctacccaattattaactatggatggactccaaccaggaaatccaaaactatatgctgcttactgaatgacaataataaatgtaggctcttatttaattatgctgcggtttattaactatccgataataaggaaaacccctagtttattatagatctgtggggtgtgtgaatatgtgtgtgtgttttgagagatatatacaggaccctaatcagagagagtgccaggaataacagccatgcatgccaggcatcttttcctgtttctttttcagttacttgaatccacctgtgataaacttgccaaaagaaagaggaagtacaataaccacaaacgttaagtgatttttttttttgttctacaaactcgatgagttcactgcattgtctacttatctgtttttgtaatttcaacttttatttttgatttcggggtgcacatgtgggtttgttccataggtatattgcatgatgctcatgtttggggtatgattaataccatcacccaggtagtgagcatagtacccaatagctctttttcaatccttgaccccctccttccctcccactagtccccagtgtttatggctgccattttcatgtccatgtgtaccatgtttgtctgtttaactctcacttataagagagaacatgtagtatttggttttctgttcctgtgttaatttgcttaggataatgacctgcagctgcattcatggtgctgcaacagacatgatttcattctttttttatggccatgtagtattccactgtgtatgtgtaccgtatttcctttatctaatccaccattgatgggcacctaagttgatttcatgtctttgctattgtaaatagtgctacaataaacatacaggtagatgtatcagtttggtggaacagtttcttttcttttgaatatatatccagtaatggaattactgggttgaacagtagctctgttttaagttcactgaaaaacctcccaactgctttccacagaggctaaactaatttacattcccaccaacagtgtataagcatccccctttctccacggtttcaccagcatctgtgtctttttggctttttattaataactattctgaatggtgtgaaatggtctctcaccgtggtttggatttgtatttctctgatgattagtgaggttgagcattttttcatgtttgtttgctgcttgtatgtgttgttttgagaagtgtctgttcatgtattttgtccactttgtaatagggctgttttttgcttgttgaattgttgaagttccatatagattctgggtattagacctttgtcagatgcatagtttgcaaatattttctcccatcctgtaggttgtctgtttctctgttggtagtttcttttgctgtgctcaagctcttcgattaggccctacttgttaaattgtgtttatgttacattgcttttgaagactttgtcataaattatttcccaaggctgatgtccagaaagacatttcctaacttttcttctaggatttttatagtttaaggtcttacatttaaatatttagtcaattttgaggtaatttttgtatatggtgaaaggtaggggtccagtttctttcttgtgcatatagttagccagctatcccagcaataacaatagggtgtcctttttccattgcttaatttgttgactttgtcaagatcaggcagttggaggtgtgaggttttatttctgggttttttattctgttccattggtctttgtctgttttcacgccagtaccatgctgttttggttaatgtagccttatagtacagtttgaagtcagataacatgatacctctggctgtcttctttttgcttaggattgctttggctactcgggctcctttttggttccatgtgaatagtcttttctaattccgtgaaaaatgacattggtagtttgataggaataccactgaaaacctgtatattgctttgggcaacattgccatattaatgatactgattcttccaatccatgagcatactgtgcggtctttgatattgggtcctgactaggccaagaagacagagatagactggtccctcaaaccttttctctaatgtctggagagtacatattttatgcttttcagtatgtatggcctctattgcaacaactcaactctgccattacagcattaaagcagtcatatataatatataaacaaatgggtgtggctgtgttccagtgaaactttatttacaaaaacaaatagtgggccaaatttagcctgcaggctcttgtttgccaaccccagctcaaatcatcctcagacaaaatttagggagctgctaataataacaaggccatgctctgctatagtgctattaagctattgcctcagcatcaaattcaccctttggtattctcttctgtgataactggcacgtttatgtattgacaagaaagatgaccaccacatattaagtggggaaaaaatcacactttttatagcaatatcactttttttaacaaaatatgatcctctatacgtacatacataatgttgtataaggattcataagtctcagaaaggataatactgaaaggttcagaggggtaacctctggaaaatggaatcaggagtaggaagaaaagattactctgattttttgctttacattcttttgtagtctttgaatttatttagagtaagcaaatattaccattgtaagttacaacaataaaaaggaataaatcaaggtggagtcttaacagtgctgaaacacttttgttaatccatttccccagttccaacctaagctttacagaggtgctattgtcaagcaatcactcattcgttcactctacacatataataggcatccactttgggccagaccctacgctatgtgtgaggaattcatgaagtttaggatctaggtggaaaaacataattatataagctaaaattgtaattaaaacaaataatgtacatgaaggagagatggcatcacatttctttattaatatatttattgggtattatatcccattattgctggaggataaaatctatgccagggaatataaaaagatgagacagagaaaatgatacgagtaaacacgctgaggactttagactcagcatataggtgtttggttcctaccatatcatctacataatttccttaaaactgctgtgaatataaaatcacaacagctgttttaaagagactgaaattgaaattcaatgaaacaaggcatttgtaagtcttccttggctttctacattgatagtgacttttttttttctttttcacactcttagaatcagggatgggttagatgttatgatcttgctgttacttcaggcatcttctgttatcattctccctagaggccaaaggcagagaccatgtcttcttttctatatgttggaggcactgtcttttgagttatatgccaaacaccttctctggaattggtttgccacttctagggactggctccctgtcgccatgtttgtgtaatatgacaacagacttaggcaagtgatcctagctgggccagaattccttcctcacacactcaaaacaggaacaaaagagagtggtctagattttacaatgtattaactcaagggatgaagaattccttataaactagacagagacaaagatcttcagagataaaagacgggtacagacaagcagagagaagattaccaagagcagatcattctgtccaggtgcctctgattttttgaggtctaggttcttccaaaggccctactacatcctttgcttgggtttttttccatatgacatcattctacacttacattatatcttcccttttcactgaagcatctatatataaattaaagcatcactaactgatgcatgtgtatatattccaagatgtttaatattgctttcctgacagtagggatttttatctgcagtgcttcagagccaaagcaaattctaatgttatttttttcctccggaatgttctcccagaaagtttctaccagtttgctacaagttgaatgccacttgttgtcatttcagaacctcatatacagtattctttaatagccagaaacacaattataggggaggtcagaagatacatctccaaagtcttctaagtgttctctcctgtgccctacaggccaaaatggtttatatatcaaatgaccttggacaagttgtttatcttttgagtttcagttgtctcatttgtatacaggcaattctgttggctctacagtgctgctggcaggataagtgacaaactctttggaaagtccctcacacacagtcagtgtcatttaaggtggctcctcctgtgagattttgcaattagggatatgatcagtcttagtccattttttgtttttgtgaagaaatacctgaggtggtataatttataaagaaaagaggtttatttggctcatgattctgatggctggaaagttcaagattgggtatctgcatctggtgagggcctcaggcttcttcatcatctcatggcagaaggcaaatggaagccattgtatgcacaaatcacatggtgagagaggaagcaagagagagagtaaaagggtggggggatgccaggctctttttaacaaccatctcttctggaaactaatagagtgagaacttgcttaacccaaaggacaggcatcgatctattcatgaaggatctgccctcctgacccaaacacctcccccaggccccacctcccatcattggggatcaagtttcaacatgtggttttgagaagacaaacatccaaaccatagcattccactcctggattcccaaaacccatgtacttctcacatgtgaaatacaattgtttcatctcaatagtcccaaaagtcttaactcatttcaaaatcaactcaaaagtttaaagtccgaagtctcatctgtgacccaaggtaatttctttccagctatgagcctataggatcaaaaataagatgtttgttttcaacatacaatggtttcatgggcactgggtaaacagtcccattccaaaagggagaaattggccaaaagaaagagaaaacaggccctgtgcaagtctgaaacttagccgggcagacatgatatcttaaagctacaaaataatcttctttgcctccatgccctacatcctaggtactgcaaggggtgggctcctaatgcctcaggcagctctgcccctataacttcagtgggtgcagctcaagtagctgctttccttggttggagttgaatgcctgtggcttttccaggttgaggttacacactgctgctgctgctggtggctgtataatttgggagtccctttggtagctccacttccatagctccactaggaaccctgatagagattctgtggtggctgcacctctgtggaaggtctctgtctatgctttcagagatctatgagtcatctctaaaatcctctgaaatctatgagtcatcaagcctccaccacccttgcattctgggtgcctgcagacgtaacgtcatgcaaaaactgacaaggctcatggcttgcaccctccagagaaggagcctgagctatatctggggccatttgagccatggctggagccagagcagctgggatgcagggagcaacatccagaggcagcccagggcagcaatactttaggcctgtcacctgaaccattctgtccatctacacctctgggcctatgataggaggggtggttgtgaagatctttgaaatgccttaagggcctttttcccattggcttgactactagcacctggctccattttaatcatgctaatctctttagcaatttcactggactgggcaatagcattggattcctcttctgaaaatgtttcctttcccaccaaatggccaggctgcaaattttccaaacttttacactctgcttcgcttttaattataaattacacctttagatctttcctttgctgctttaattcagcataacctgttaaaagtagccatgccactaactgaggtctttgcagcctagcattttcatccaccagataccccaccctcatcacttttaagttcgaccttccacaaagccctaggacatggacacgatgcagccaagttatttgctactatgtaacaagggtgacagttcccagtaagtttttcattttcatctgagaccttgtcagcatggattttacagtctatatttctatcagcattttggtcacaaccacttagccattctctaagaagttcaacactttcccttgtctttttttcttcttctgagacctccaaactcttccgactgctgcccattacccccaaccactgggtactaattttctgtcttagttcattttgtatcgctacaaaggtgtcactgaggctgtgtaatttataaataaaaggatttatgtggatcacaattctaatggctaaaaaattcaagattgaatatctgcatctgctgagggcccctggctgcttacactcatggtggaagatgaaagggagcttatgagcttatgtatggagagatcacatgacagagaggaagcaagatgtcaacaaggtgctagtctcttttcaacaattagttcccttgggaattaacagatggagaactcatcccccaaaggcaggcattaatctattcatgacggatctgccttcatgatccgaacacctcccaccaggccccacctccaatactggggatcaaatttcaacatgtgccttgacagggacaaacaaatcaagcatgatccttagaaacaccacatggtagagtggaaagagtatttaaatgttagtcaggagacctctattctagttccctgttctcactaactagttgcacggccatgctgcttacttctttccaagaaacctgtaccttcatgcataaagtgctattccctatgcccgagtatcatcctacatcatcatgtcatggaaaccccaactctaattcatgattcatcttgagtcctgacttcttcagcaaggtctcctcagtttccacaatcagaggagaacattcctttttttgcataaataaacactgtacttggatctctcttatgggagttattaggctcaaccctactttatagatctagcactactcaattccttcttatttactttctaaagacaattcatcttccaaagttatagaaaaacaaagtttagcatttgctgcatatgtccaacaaacataattaattggataagaaacttggcaggtaattagtactaggcataccatttgcttttttatgcccagaacctagaaaagtgcctgacacatggtaggtactcaataaatatttattaaatgaaaaaatacccagacttggttaggaaagactatgtaaggcaacaatttcaagggtatatgcttttaggccaattcagtttgccaaaatctagcccttgatgttaaaaggaagctggggcttacagaaatggaggaccccaacgctaatggcaagggcagaaatcatcatttatgagacatagtctcttgtttggtggggaatgtttgacagctagctgcataattccacacggttccacaggagatgattttggatgtggagggaacactccaagcacacttcttatgaagacctataatcagaggtcttaacaaacacaagtgattaatatttgttgacttcatgacacatttattttctttagagcacttaccacagcttactctaactttattaaactttttagtatatttttgggttttttttgttgttggtggtatcctcaataaactatgagttctgtgggggaaggaaccatgattccctgtccattgttgtacatccactacacagcacagagtagatgaagctcaacaaatgttggatgaataaatatgcatatagtatgatggatggatggttgagtggataaatggacggaaagaggccagctagtcacccatacaagcttctgggttatgaacctaaataataacacaagttcaacagcaacaaaaataatcccattccattataggctggatgaaaggcttacccactgtcttacaccattagcgctgctctaacaaaatacctgacaatgggtgatttataaagaacagaaaattatttctcacagatctgggaaatccaagatcaaggtcctagcatcttgtttctgatgagggtagtcttctgcttccaaaatggtaacttgttggcagctccttcggaggaaacaagtgatcacctcccaatggcaacatctcgtaatattgttgaattggggattaagttttaacatgcaatttggaggagacacaaatattcaaaccatagaacccacttagagatgacagaataacgaatatatatgaattaaaatgaatggaacaacaacaataacaacagccatcacttatgtagtgcttactgtgttccaggcattgatctaaatgctttacatatatgaattcttaattcctaatacaaaaaagtgagtgttccttcttgatctggagccaagactgcatctatcaaaatgggaatctgatcatctctcccatctgccccccaccccacgtacatcaatggtctacatgacaatgctacaattaattccagaagtaaacttaacctctcactaagtgcccaaccaaagagactgcatggtttcccagtatgaaaatgtgaaggatcaattcacaatttgtttcctgcaaaactgtcattcctctcttcatacccatcactggagaaattacttttcagaccattctacagcttgggaatactaaataagccctaatgagttcaaaagtcggtaatgacagtactaattcagtggcctgtttggtagaaagtcagtctcccttcttcaaaagcaaaataggattatcaagtgagctgggagcattttctttacgtgattgatgggtagaaaaagtaatcacctttgaagtgccacaacatataatatatctcctgtgttctctttcttcttctgacacccacaagtaattgaagggaagggagcctcttagaatgaccaacgaagtgaaggtgacaaccctttctctgctatctaccactagagtgacatgctggggtcttgaatagttgagaactgacatgagtgtctttgatgggctgctttgatgcttggttcagagtgtacctgccaccagtcaggccacacagactttgggtgaaacatacatctaaggagacaagtgttactacttcttagaagcaaagggcctgtgcacctgtgaaagaagatctgttgtctgagctctggggtcggggtaaggtccgcaaggtggaagtgaaggaagtcaaggagcaaagcaagttgaagcaggtaagaaacactgaatatgatttcaaaacagtttctcatcatactcatccataatgaccgattaaccacaatgttcagactgacaactaggagatcattagcctcttgacctcagctcactgatgcagaagcagacagtcgtctccttggaaaaggcactgctctacagtagcttactttgtaaggggatttttgcaactacaagtaattcaactgaaacagagttgacactcaaaaaccttaagaagcagggattatcaggcaggtgaacagttttattcttaagagctcactctttctgaactctcctaaagcccatccaggcaaggacatatgagtttgttatctgaaggaagaaaaatgctttgaagaagatttataaagaggaagggtctttggtttattgacaagaaagtaaaagactttctagagttgtaagcgaaatgtcgctgttcaggttctagaacttgctggctagagaacagatggctgccacttgttggcacctggagtgacaaggagttgaggaaggaagagagtgtcatccatgtgatctggcacagaacattcttctctggagccactcttataaagaagagactggcatgtttggtgggtttactgtatgatatggtttgaatctgtgtccctgcccaaatttcacgtgggattgtaatccttaatgttggaagtggggcacggtgagaggtgatttgatcatgggggcggtttctcacgaatggtttcgcaccatccccttggtgctgttctcatgatagtaagttaccatgagatctggctgtttaaaagtgtgcggcacctcccaccttgcctttcttctcctgctcccaccacatgagatgcctcactccccctttccctttgccatgactggaagcttgctgagacctccctagaagccgaagctgctatgcttcctgtatggcatacagaactgtgagccaattaaacctcttttctttataaattacccagtctcagatatttctttacagcaatgtgagaacagacaaatacaccatagtacctccaacctgctaattaagtcaggagtctccccctggttggctgctacccacaggctccactactggtgagtcgtagaagacaaataaaggcattttaaggaatagtacgacaataatctctagatacatctgcaatcaagtaacagtaacccctctcagaagctatgccagtatgttgcagatactgaacacacatctgttaaatgaatgaaaatgaatgaaagaataaatgattatacagtgtacttgtttcataattgtaactggtttatattgatttggttatatctgcttggtaccatgtgagttttgattacataaagatctacagtctttgtatgacatggcctcagaacacaagtcaacttcttcatctggttctcaacctaagaaataatgatctgttgcaaggacaggctggccatggtagaagtacgaagcaacattttatctacatagtactttagaggtaatgtaagagattttcaaaatcatgcttttacaatgtctacattaaggtctggcttttaactaaaaagtatgtgaaacatgatagcatttctagattgattccattcagaggtgcttttatttcacacatatatctcagaccaagggtaagtatggtaagaacaagtcactaggaggccagcaagagaggattaatgaatggaagaaatggaaaggagagtgaaacactggtaaactcatcccagctccagcaagaggggccaagatatctgagctagctggaacagcacaataataaaaataataacaataatgacattcactgtgagcaaaagaactctgtaagcaaatcaaaaatatcagtgctaagggtcttaatagctgattataatgaacttcctcatgtaatctcagggagcagaaaagagaaaatagattgtgcatctgttcaaactaaacatatttcaagctggaaccagcttggtgccaaagacatctctgtcacagagaagaaaaaattccaaatggaagaaaaattccacttcatgctcaaacaccatgaacttcgacaggaaaattaggtaaccactgcctcacttacaaggcaacgcatcagtttcctatggctgcagtaacagattaacacaaacttagtggcttcaaaccacaccactttcttatcttgctcttctggaagttgggggtctgacacaggtctccaggtgtgggcagagctgacaccttgagcctgacgcaggtctaaaatcaagttgtgcgcagaggtgacttcctttccagaggcttcttttccagtttctagagtccaactacattccttggctcgtggcctcttccttcatctttaaagtcagcaataatgggacgaaaccatctcacatcacatcactctgacctgcttttctgcctcccacctccacttctaagaatccttgagattacactgagcccacctggacagtctaggataatcttcctattttaacatcagctattgagcaacctcaattccatctgcaaccttaattccccactgcatataaggtaacacagccacagtttctggggattacgacatggaggtctttggtaggaggggggtattctatccagggatccccaaccgccgtgccacacagcaggaggtgagtggcgggtgagcaagcattactgcctgaggttagcttcctatcagatcagcagcagcattcatttctcacaggagcaagaaccctactatgaactgcacatgcgaaggatttagaatgcgggctccttatgagaatttaatgcctaatgatatagggtggaacagtttcatcccgaaaccactccctccaccaccgggtctgtgggaaaattgtcttccatgaaacaaggtccctggtgtcctaaaggttggggactgctgttctatattgcctactacaggcatcaatgtttcaaatttacttaaaaatctgttcaggtccagctaccacaaatacaagtgagtgcctctcatttgtgaaaaactgtgtatgtgtaaggtgtgagaatcctatcttattttgctaggcagagctgactatatgtgctctcagagcccccagaattccagaaaaccaaaatttaaaaaaaaatattgaagattaaaaaacagagagacagtgttacccagtgaagtttctaagagaatctacccactaacagacttttccccatctcaagttctcaatcattcattttgttacatttttttatatttgacaaatgatatctaatgcatttcattgctgttagcagtttagacacttatgagaaattaaaaccccattaagtgtgaaggcatctaaacaataccagatctgccttccactgaatatattttgggatgacaggtctgcttcatctgactcctcaacaagaacagcttatgaaactcacagttttagtgacagggcccaaccggcacctatttttgtatcacctggaaaaaaaaaatgcccacataggcaatacatctgatacagaaatgaaattaaatagaacaatactgaggcatcaaccactcagatccatttcactgtttcctattctgagacaacctaattgaaggtggcattccaaggttaaatcctagctctgacagcatctcctgtcagacacctgtcaaaatgtaataagacacctgtgaaagggaagtgatgccaaagccacatcattttcccctacaccttgattcctaacttgcaggattcatgtcacccagcaaacagagtggtagctgggtgctgctggcactgtgccaccatttgcaggtgagggagggaagggaagggaacacaaggggtgggggagagagagagagagaagaagagagagagagaaggagagagggagagaaaaaaaaagacaacactgcaaaaggaagcacccaagcgttttaagtttagcaaatgattatgagcataaaaggacaactctgaacggacttgaattttaggattcatccctagagtcttgatcatgatcagaagcagggaattattttttaatatctgttttacataattaaggggtggtagctttcatgcaaatgaacgctttgaatgctcacaacaccaaatgggcttcattagcttagctgggcaattatgaagcaggaagtaaaaagctgagataaagacttatctcaaaaaggtctgaagcagggcgtgttgatagccaagaggcacaacgatgcattttgtacatttattacctcggaggcaaaacttctaggattctagatagctttgaaagcagtgcatacattccatttaacacccaaatgaaacaggtggaatgtttaaagatctgtagaaagtcttgaaatcgttcccacacattggaaggttttaccaaaccttctctatttattctaagtgctttttctattgtttttcaattgcttctctcatttccctcccgtgtacatttcagagaaaattggagagcttaaaatgcgactaaatataacccctgcactaagcaaacagtgaataaatccttaagaaattatttttgaagcatattctttctgatttgatttaaaaactgcaatatcacatgtgagtcttgctcaggagaaaggctatttgttcacaagacgaccaagcatgtagagggaaagctgagggtgaagggactgaatccggttctcagctatttcaatacagatgtttttctagataatcggcctcattgtaagttaaagaatcaaacataaatcagatctctcacaggctgagaaaaggcaaaacaacagcctgttcgttctgtaaaaggaccattctagttggcctatctggtacaaccaccttgtttaaaagacagtaaactgaatccagcaaaagtttattgacttggtccagaatattactgagccaccaccacagccaggcttacatcccagagctcctgtttcccatcctgggctgtgtatattcttccacgtcacctccccaggtggctggctttgagaagaagggaatcataaaaagaccagaaataacatatacaccttgaaggagttgacacaggattttttcttgatcactttgcaagccagggacctctggccagtgacaccctgcccaggcctcactcggccatgctacttgctataggagatggcccgcccacttagcccgctcaggccgagtctgacttgcacactagttcccaagttcttgtcctgcgccccagcagaatgaggatacactgacaatcaaagaaaaagtcagggagttttattgagtgatgaaaacagctttcagcagagtggggatgcaggggtggtccccctatctgaaggcaggaaagtccacccaatttgtctgagtctggggcttttataggctcagaataggggaggggcaggcagtaggtagtactcgaaaaagcaacattagattggttcaacggcattattcagaaagaatcaaccaagaaaggtcaggcaaacagaaacgcaagttctcactctgggtcgcaggtttcatccaggaccagcagtctggtctttcagccttcaggctgtttctgttggttcggaggtgggatttcactggggactcacctctatctgactaggtatttggctgcctcctactgtcctcagagtcatctgttcatcagtttgttttccctgtaccttcctttctcacaaacattccattggcagatttctgttttgttctgtgtgtttcctttccttctccccagttcaagctgaggcagacgcatggacaaagaaaaacaaactgctggctaaatacagagcagagagtgtcatggaatgtttacagaggaaatggttttaggaaccagagagtaggaaaagctcaggctggggaaggggcaggaggatgcaagagggaatgactttagggtataaaaggaatggaaacggccaggcacagtggcttgtgcctataatcctagcaccttgggagactggggcaggaggattccttcaggctaggagttcaaggccaacctggccaacacagtgagaccctatctctgttattattaaaaaaaaaaaaaaaaaggaatagaagaactcgagtccttaaagaattagggtctccatgtagagtaccaggtggccaggtgaaaacatacccaaatatcaagtaaggacacccattggccagcacccccaaattttagtccagttattacacccaacttggactggcaatttatcccctacaggtaactgaacatcttatggtctgggaaatctaccagcccctccaaacagaagatgaggagcttaaatggaatagtaggaagggggagctttaccccttgaccatgatgggtctaaataaaatgagctgggaatttccctaggagcccagggtagtgctacaaagaggacacactgcccctgaggtatactgtgttcatttgggagctatctagtcccagttttccaagacagactccagggaaaacaggtctaccttgaacaacatgagtttgaactgtgtgagcccacttacacatggattttctttcaccttcacaacctctgagacagcaacaccaacccctcctcttcctcctcctttacagcctacttaatgtgaagacgataaggatgaaaagtctttacaatgatccatttccacttaatagtaattataattcctctttctgattttctttttttaatcttttcttaattctaccaattaattttttcttttttttaaaattttattattattatactttaagttttagggtacatgtgcacaatgtgcaggtttgttacatatgtatacatgtgccatgttggtgtgctgcacccattaactcatcatttagcattaggtatatctcctaatgctatccctccccccgccccccaccccacaacaggccccggtgtgtgatgttccccttcctgtgtccatgtgttctcattgttcaattcccacctatgagtgagaacatgcagtgtttggtttttttgtccttgccatagtttgctgagaatgatggtttccagtttcatccatgtccctgcaaaggacatgaactgattattttttatggctgcatagtattccatggtgtatatgtgccacgttttcttaatccagtctatccttgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgacatggtatctcattgtggttttgatttgcatttctctgatggccagtgatgatgagcattttttcatgtgttttttggctgcataaatgtcttcttttgagaaatgtctgttcatatcctttgcccactttttgatggggttgtttgtttttttcttgtaaatttgtttgagttcattgcagattctggatattagccctttgtcagatgaatagattgcaaaaattttctcccattttgtaggttgcctgttcactctgatggtagtttcttttgctgtgcagaagctctttagttcttactaatattttcttttctctagcaaactttattgtaagaaaacagtatataatacatacaacatacaaaatgtgttaactgattgtgttatcagtaaggcttctggtaaacagtagtcaaattttgggagagtcaaaagttatatgtagacttttgactgcctgggagtcagcacccctaacccctgtgatgttcaagggtcagttgtattctgttagctcaccaatgtttacctgatcttacacttgtcctaacttctaatatggaaaggataggccaatgatatagtagagtgcttagatttgactgttgaccactggctctcaaagcctctccagtataactgcctctgcctcttcaccccatctcccactgtgcctaaaacccaacactccagccaaagagtaatcatgcgctgttgcctgaacataccccatacttgtctcctactagtctttgctcatgccagtcttcctacctcaaaggctctccctttgctctgtttacctcttgataacttatccatctaccaaccaagaatttttaacatctgaaatgattcacaaatggaatgggatgggctcaaacgataaaaataataatggctaatttggtgtcaggaactgtgctaagcatgtggaatacattattctcataattacctaagagggagctataataatcctcatttcatagatgaggcccaggagggtcaaagaacatttccaaggtcactcagctgggattctgacccaatcagtaggactttagagctgggctgttaacctgtaccctctatgcctctaatggtccttctaacactgtgaccctggcattttataatgtaactgtttctccccagatccctttctgaatgcccccaatgaggtgtaagccctccttactctggaagttatctcactggcctcacccgacatatttacatacttttttcatctcaccaaatacagatggtccctaacttcaatggttcatctcaaatttttttgactttttaatggtttactgggagtattaaatgcattttaactcatgataagtttattgggacacagctccatcatatgtcatagagcatgtatactgggtaagcttcatgaaagcggaaactctggctgatttacccacaatcagactgtctgagctgcagcagatattaaagtatttttcgtgaatgaacatctttcatgcttcacacagtagaagtgctccgtaaatggttgtggtgtgtgttgaattctgttcaaacaattatcaggaacaacagtcacagtttttcacagtagcacactggaaccccctttcttcactgtgagtgctgccctgaccctgacaatcaggtcaactggacagtctgttctcaccagtctcaatataggactgaaaagctatcttctccaaccaagttgtttggatcacctgaggtcaggagttcgagaccagcctgacccccgtcaatatggtaaaaccccgtctctactaaaaataaaaaattagccaggcatggtggtggacgcctgtagtcccagctactcgggaggctgagacaagagaatcgcttgaacccgggaggtggaggttgcactgagctgagattgtgccactgtactccatcctgggcaacagagcaagactctgcctcaaaaaaaaaaattgtgattttttgaaaccattaaattcttcactggtgtcatggtacaaacaaaatcacttgctttgactcttggccaagtccagaattgtgtcattttaaaaaactggtttttaaaaatcctaagttgtttccacctgcaggcataggcagaggagccttcgtccctcactacgctgaccccgagtggttccagtcccatcattccagaaacccctctctggtcttgtatcaaaaacaccacaaatcactgggattgctctgtcatggggtagaaggggctcgaggacaaagtttagcttaaaaccagagtgaatttatttctattacatatggttaaatcatgacttcttttctaatccctaaagctaaacagtagagtcatgctggagacacaccatcatctatgtcaatcagacaaaattaaaacagagaccaacatctccttgtttcatttaattttgttctcttgttactgcatgtgtgacaccaagaaccacttgacctttggacaaaaaagtagttatatataagccatgtatggctaaggtcctgttttcacaggccaggaacatgtaacagctctaattcttgttgactctatttctgaaatagagtctgaatatgtacacttctttctgtctcaaagtctaccccctaggccagaccaccattgcttcttacctggggaacagggcagtatctgctcttaactgacctgccggcccccgctccctattctaatcctttctgtatacagccgccagaagggcttgacacaaatgtaaagcagggaaccctgaccctgtgcttcaatgacttttcaatgcatggagaataaccaagcacattacctggcctgcaaggccctgcataatgtgatgtggcactgtacagatggccatgtccacctcgggccactctccctcacacctcctgcaccctgggctcactggcttcctctcacacctgagcacttgctgctcctttgacctggagctctcttctttcagctccccaggactggctcttgctcatccgttaagtttcagctaagtgtcaccttcagaaagtcctctctacctatgctttctacaaaggtctctgccttccctcacccaccccatgctattttctattacattacgtatttttttcttcctgctcctttttacacaaactgcaatgattgtctttacgtattgacttacttatcttcaattttccctattggaatgtaattccatgagggcacagcccttgtttatcttctttggcattgtaccccctattaacctgcaacacatcacatggatgtaaacagtatctgtgcaatgaataaattaacgaatgccaagttccatcacattccaaggtctgtcattacctgggcccctgccatcctttccagccttatcaaccagcgctctcccacatggacaattacgcaaggcacactgagccacttccttcaggaataggtcactttttcttgcctctgaaattttataccagctgttgcctctcgctaggatgtctttcttcccttcctcactcaagtctaattctgctcaaggatcagtttaattgttacttcctctaggatttcaaaagaatttttgaatgcaccaaggcaaagttaaatgtggcaacaatctgtcagaaaagctgccttttggtgggtgagtcccagaagtacagaaatcatggctaaatcgtacctttatcttcaatacaatacctggcacacaataggtgttcaataagtgttaggcaaatgagtgagtttaactaaattataacttcctgagaactaacaacatctcaatcactacgctcagtatagattgaggctgagggccgccaatgttggcagcagcaaagcctgcttaaatataataactacagctgcattgcacagaagtccagttagtgcagaagcataaagttttgagggtgtgtgaaaggaacaaagacaaagttcaggtgagacatggaagcaacgagaaatgcaacatggggcgagtaagccagcactttctgctttcacttctatcactttggaaacatttagtccagaatgatctgggggttcttacttatggttctaagacagcctccacattcctcagcatgtccagtcacaatcaccatctccccaagaaggcacaaagtaagcatctgtaaatccatagttggctattttggaaaattagtgttaaataagaataaaaaaaaaaaacccttcacctttatgtgtaataaagcactgcttaacaatcaaggtcacccatgtcaataacactccccaagcaaagcttcatatctttttaattcctaggctcataaagaccattgtcacttacatcattacaggattcaagggagaataacataaagagaatgtgcaggataattttcaaaataaaagagaaaaaaatgacacatctacatatcaaaccacacaagtcccgtgtctgataaaatcacaattatagatttggtgcatttaaccagtcatacatgccatgcatttgcgaaggtgccatatgggggagttgtggaaagtcaaataattcctagactttttctttctgagcacatgtgacaatgaatattatttacccctgtagtatagaaattatgaagcttaagaccccattgcttctttttaataaaagctaacacatcacagcttactgcttgacccagctccttggtctttgcacgttctcctctctgggcagctctctctcagttttaccccctaccacaggaaaggagacagctgtgtttctagacttgacagacttgtttttacttgataaacacattgtatattgtaggggagaaaacgatcacccctattcccctccttagttcttatgtgggctctttggcccgatctaggaaccaaattgacacaacacagattaacaaagaaaggcgtacacattttattaattttacacatacatgggaatcttcacaagacagtgaagttcaaagaagtgaccaaagcaacatgcttttacacgttttagacaaaaacaaacaaacaccacgataaatttgtgaagaaatgacaggataaaaagggatctggctagggaaaataatttctatgggagtgaccaggagctatatgaatgtaaaacaagtagaaggtaaggattatttcaggaagtttatttgctcagacacattgcagcacctaatcacagtctccactgataaggaatattctcttacccttgtacggagaaggcagccctcccaaaagaatctttatggcttgctacgtgtagaaaaagactggtcagttagccctctgcaattatactttttccaacgttttcagctcgaaataatcaacataccaattcgcatattctgggatggcatgtccttcactgcttcaggaatatgttttcctttgtgctttacttggatattaagttccaaccaattttaattacatgtcgcttgtgcataatattgccacttctaaaaagcagatcactttctgagttagaaagcttatctgctttccctccttatagacacttctgaagcagaaaggaagtaattcctatgctcctatcagatatgggctcatatttctgtttcaaatttaagtctgtgacccctacatgaggccaggattttgagaagagtgaggaaggtagactctttttaaaccatgccacaggcaaaaactcagaactcattttggggaggaaaaaaagtcctatcaaaccagtatactataaattaaacaatgtagcatcaaagataacttttcctttagttgttacccctgagtggtcacgtagccataagaaaatcacctccttgtcaacacatcatcaatcaaccagtgttcattaaataccaactctgtgctagaacctgcttggtataaagaattctattttgtgttcaatgtgtgcattcagtgctttgattgtaattatctttgaaatgacccaaatcattccaaacaactataagtgactttatattcagaatagcaaaaagctgacttgaacacacaatgtaaaagtcttgaagagagagtgaattaaacttttttttttttttacaacaatcagtgggcttatagaatagaaagagaaagagggggagaggtttttatcttttagaattgcaatgcagtgaatagtgatactagaagaacaatcaccaaaagattacagatgagaacttcagatgaaaataacaatgaaacaaagcaaaattcaattaatggccttagagaaggtgagatcagaaagagaaactgaaagttttttagacttctctttaagacagataaaatttagaatttttaaaaatccataataaaaaccagaacaatgctacctcgccaaagttgagttcaaatttagtcacttcagtcaccaagaatccaggaaacttagttactatgggaacagaggtcctcctcttcagaaaggagggcagtgtttctttcaaattccaccagctaaattcaagatcaatgatggttgtttaatatcctctcttgaagctcttactgtctttagtatactttaaaataaaataaaaactcaacaataatggagctcaattaagcataatttgtgtgcttcaacctttggctgggtgactgctctgtaccgttcacacttgtactgtagagcattgcaatttttaattaagatcactcattctatttcccctgaaccaaccaatgttgaggttattgtttggatacaaaactctccaggatacggcttcacttaacaaggactttgtttctttcaagtaccaggcactcactggttctgagtataggctgcctgccctactttaaaatgcatctcaactttatttcagagacagtaagatttcattgttactctacaggacttagaaataaatgcatgcatgtactcacacacaaaatctctcgataattttgcatataatacagtttttgtgctctatgccaacaaagaacagaatgtttagtaaatcacagagaaacacttttatttcttgagactgagatatgtgtggcttctctacttttctaggaattacatttaaaatgtaagaggacaagacctcattcaaccttttatgcctactttagtgatcagggtgaaacatataagaatattgcaacaccaaagctgtgtgtcactactcagctaatggtacctataaagaaacttctcttaattagctttaccctgaactaacttcctttgctctgccatgtataattaaatatgttagcaagacagaaatgtgagatgtagcagctttcacacccaaatttccgactccaaatttataaaaagtgtggatttttttttagttgaaagcccatcatgaagtattttacttttactctaaaaactttcaaaattacattaaaagaagaaaaagaaaatgggcaggaaaattagtaatgagagatgaattttcagagaaaagaattctacagtagtccctcctgatctgcagtttcccattcagtgctttcagttacccttggttaaccatggtccaaaaatattaaatggaaaatcccagaaataaacaattcataagttttcaactgcaagcagttctgagtagtgtgatgaaatctcattgtctctcactctgtctcttctggagcgggaatctttcctttgtccagcatattctggctgtatatgccactcacctgttagatacttagtagctatctctgttaccagatcaactgttgtggtatggcagtgcttatgtttaagtaactcttctcttacttaacgatagccccacagaagagtagtgatgctgtaaatttggatatgccaaggaaaagtcccaaagtatctcttttaagtgaaaagtcaaaagttcctgatttagtaaagagaagtcatatgctaagggtggcaacacctataggaagaataaatcttctatccatgaaactgggaaaaaaagaaaaattcatgctagttttgctctcacacctcaaaccgcaaaagtttcaaccacagttcatgataagtgcttaattaagatggaaaaggcattaaatctgtgaaaggaagacatgaacagaaatgtgttcgttcctactgatggcaattaggttcggtaccatctgtgatttcaggcacccactgggggtctttgattgtatcccctgtggataagggggtactgttgtatatcaaacaaaatctgaggtgcccagccaaggacagtgctgcttcccagaagagatgagactcccctatcctttctatcttcccaaagggtgcatgtagtgtacgcccattggtctctccctttcaggagtgaatccaaaagccacaatattgatggacggcaggaaacgtccagtatctgggctctgaagaaccttgaggatagaatccagctccaatcatacagttcctctgtatggataccttaaacaaaagtgtattttatcctttttaatttggcatcccttagaaatgtgaaacttccttgtgaaaactgctctttaaggaaacgaaacttttttattgtaagccttcccattgtctgtatataattaagaaaagatcagtgatagttcacggtggttttataataggtgaattaatcagttttaaaaagctgaattttacatgcatttgacaaccaatctgggcactattttcctaggaaaaggctcatttgattaaataaattttaacctttaaaagctttaattcttttttttttttttttttttttgtacacaaaggactcttttgtgatggttggatcaacttacacatccagagcacatgtgcatagataaaactttgcagtaaactatcctgttacagatagcttttcttacacataaaaatacattctgatgagcaatctaggggaaacaaaactaaaaaaaattaaaatacagatatacaattcatattctaatcttatcagaataacctactgttaaaacacaaactgaggcaggataaaattttaaagagtttatttgatcgaacaacaattcatgcattgggcagcttctaactggaagtcattcacgagctccacagagggaacatgatgggtggacttttataggaaggtcacaaaagtaaagcaagtcagtatgtgactggttatagctctataattgccttatttgctctatcccattagaaagtcactaaatatatatacataagtttgttggctacttccaactggacaggcttaagttctgttttcctttaatataggcatttgcaaggaatagcttaagtttcacttaagctttgcaagccaagcaaggtttaggtcacttatgaggtctgatatcatctgtttctttcaggcctagtctccattttaatttactttaacactatccataagaatattaaaaacaggcagcagatatgcagatattttatcaatacaaccttttataaatacaggaaagaatagtgttgacagtctaaatttgcttccttgaggcattatctgtttgaccagatttaatcatttaatttgaaacaaagaaacaaatactactctggggttgctgtgaaaggacattcagagtggacaaaacctctttaaacttttcttcaaggtttcatcttcacatatatgttagtttggttactttgacagattggtcaacttaatccaatacagttttatgggtccggaaagtgctttgcttgactttgaccgtatgtgtcatgtcagttaagttaaaagctaattcaatgtgtccacttcggggttatttccatcataaggcattatgtttttacttgggttgtatgggggagttcctctgaattgactagacagatgggaggtttagacacagtttaatattctgtacttgcagaagcaactattgagagctttgattacaactaaattcaagctagctcaaaagttggttctcagccatttaagtcaaaaggttaggtaatgtcactccctccaggggttcattgtccagtttttctgtgtattcattttgtttttatttcatgcctatctagtacccacccctgtgtcccacctatgcctgaattcttactgtgtaaactcttttggatgggaaatgaccagctcctgctactgaccacagccctccctcttgccagagcctgaaggacaggggactcctagctcgacagatcatgctaaaattataccttgtgcttagcatttcttggcctttaatcctgtcccagttacttctctttttttttttttttgagacagagtctcgcttttgtcgtccaggcaggagtccaatggcttgacctcagctcaccacaacctccacctcctgggttcaagtgattctcctacctcagcctccccagtagctgggatcacaggtgtgcgccaccaagcccagctaattttacatttgtagtagagacggggtttctccatgttggtcaggctggtctcgtactcccgacctcaagtgatctgcccacttcaacctcccaaagtgccaggattacaggcgtgagccaccatgcccagccattccttctcttttctaagatttgagttctcattgttaatctggtaattttctttttcacaccagataagcagagctggtttctgcattgctaactgggagcttcctaactaaaagagcctcacaaacagttaattctgctctagatgctgtaaaagagggggacgggggtaggggcagggagagagagagattacagtgataaaatgaaaatgctgtttcagccaggaagttttttctcccccatctcatatattaaaatgggcctgattttctaacttcagcataaaagcccagtaagaaatattagctcttcagttaatgtcattcacacaaggaatttatcagcagagtttgtgtttgaacttttcatgtcatctcacgcatctcagagggtattaaactccataaaacacaatcccaaaagtgaaatatttcccacttttactctataagtgagtcttagggaacggaaaaaaaaattccatgtctggcttattcctaaagagagagtaaatagagatatttcttgggccaaataatgagaagaatcacaacccttagggtttatgttccaaaggcctccaaatcccaacaggtccagcaaagcagaacagagaaaggggctgaatatacatgaagagaataacagaagcaagtggttaatggtttccttaaatgcggcagaaaatggcttatgtgtacctaagtatcctatagtactgagacttaccaagaagaaaaggtgaaaatggaacttgaggcccctggaagacatgttcttagctttgcctgctggctttctgcataaatctgacctttctgcaggtgaagttcttctttacagcccagtttctcctcttagttggctactgacccacagtagcagccaaaattaaaccaatgatgtatttctcgtacttccccaaatcacttttctttaaataagttaataataatccaaacttgcatttttcagctgagtgctttgatacttgcttctcaaaaaactacttggaaggtaaaggagttttcttttcgagacctcgatcagaaatactccatgattcacgcactcagttaggcctaaattagcccaatgttatggctataaaggaaacaggaaacctgtgttccagggacaatcttcttcatcactctattcccagcgtcctctcatatgaggacacggggggttgggctacctccatagaatgataataaaagtttgcctccaaaataatttggaatttttgggttaagcatcaggacatttcatatcatgtaatatactaacattcagtataaatctctaagcagggtaagtgggctcagaataagtcacaatctctcaactcatttcaccatcttgaaaatttcttccatggagcacaaagatgaactaagtaatcaccacattcctcgcaacatttatactttctgatcaggacaaaatgattctaaggagtgattaaagcagggtaagagagtcttctcaccctaatgaatccaaagatcaccaaatagacacccagtttatggcttagtgatgtaaaacaggtgtgattcagagccaagtttacgtaagttcaaattctgtttccatctttggtagctgtgcattcttggataagttacatcacctccgagcctcagtttcttaatctgtaaaacagacatactaacatgacttcatagaggtgtttgaaatagattatctaaaataagcaccaagtgttacatataatggttatttcagttattcattgatttaattcaattaccattaaggttgagacctggtcatcattacccagttaaggaaggggtttgacataaaaaccactcaagatttcttcccactttaggactttatgattgcctttaatttttcatgtttcaattatgtaactaaaatcttctattccatatatatcagaacacaccccatctaatctctgctaagtgtttctctactctgcctgtcccatgaaacaattcccaaagcctaggagagtctcctgtgatacagataccaaaatgacgtgggtcagaagtaactcatacatccatattgtcagaggtgaactatacaaaatactgagtacactacagagtgatctgataggccaagaagaaaaaaaagtaatctgatagaccgagaagaaaaaaaaagtatatgttgtttctctactaaagaatgtcaccgcatattgatttttctagtcttttacaaagactgtgttcagaatttagatcagtgttagagaaattcacttataaattcacatatacccgtatataaggatacagtcctgtatctaaggataaagtcctagcttaaatctggaatgagtaaaaacaaagtgtaaagttaaaaatgcccctctggtaagacaaacatatgcttttcacccaaaggtgcagttaaagaataacaacaaaagttggtagtgagatccctctaaaaccactgatatataatagactcctactgacaccctagaaaaatgatgccaacccatgcagattagtttcttccagcaatgtaattacccatttctttggggctatctttccttcaatggtgatttgagaaatacctttcatttatactccattttgcacaaataaactacatttaaagctctataattagctgtcctttgctactgtaaaattcagtgtttttgtccaaaaggaacagactattgatttacaaagaagctgaaatgctgtcaaactacccactgaagaagtaagaaaaaagtggtccctatcttggctctgcctctagactagctcttgtcctacctcagctttgtatccacataccgagccttctgttaaggtttagacttgcacagccaaggcctcccaggcatctccccattgacatctaagagacacctcaaattaaacatccaactctttgcctgaaacaccgttccttaagggctttccagattagcccttttttgcctctattatttgtatctcttaaatgcttactattgcaagatgtagaaaatcccaactaaaacgggcataaaccataagagaaattattgtctcacacactaagataagtggctcagtgaagctaagtatgggattatttctctttgctcatgaaagcatcaatgtgtcagttgggttcaagtacaagaatcagaacccattctagatattttaagcaggggagatttaatacagcaaagttggtgctggagaaataacttggagggctgaaagtacaactctaggtagagccttcagtaaggactcccagaacaatatcccattgacctcatggaacttgtaaggagccactcctcctgaagctgtcttggagccatagtaaaatcaagaacttgtcaccattacaactgactctactaatgcaagaaaccatagaatgcttatctgtagctgtggtcccgagtttcagaagcctgatcatagcgctgccactgctgcttctgccatcccaaccatttcgtaaaactcagaaagctggagagtgggcagaaaaacacgactgcagggaacctggacattgccacagctacgtttaccagcagaaacagccaaaggagggctgaaatatggcctccacatggctttcaccttccacacatcacatatacacatctaattggagaagactttttttgaagctggctaaaagagaatctgagaaatgatgcttttagttttgcaacaactttaacttgaatgaggatagaatggaaactacataaattcatctagagcatacgaaaataccagcttcctgggtgagtctttacataggagcatgatggaagcaagcagcaatcaaggctgccacagcctttgatatgttctaacagtagagaagaaaaaaatctctttcctggctatggcatagaaggccttcctttactccttatggaaccactttaagccatttgctgactcacagtcgaataccactgaccatggaatgctatgggctgattggctcagatggacaatctgttgagtgtcaaccacagtgtagtctatagtgtgcctgcttacataacatctaatcattgagggctttcctgaccatccaatctcaagtagcctcttctcctgacccatgaattctgtgtctgcttaccaataggtaagtcttcatggcacttaatgcactctgaaattatcttgccaatttacttatttgcctgctccttatctcctttccctactaagacgcaagctctgtgaaggtaaggatcctgtctttttcacgtctgtatccccaacacttacagcagcatgaaacacataccaagcattcaataaattgtttaatgcataaatgaataggctataatccatgtactacagaaaccttaccaataaaatgcttatgttcttcccagttaggccagcttagcagtttatttaaaaggggatgagaaagagagagctgttcaacgtgtgtgtggccatacacagtgaatctactaactggttagtcttttgggattcagtgttacatctactatgcgccagtcactgtaccctactattagcgatgcataaatcagaaatcttggcccaaaggaggactactggtacatgaagattaagattctacgatgacagctgcattggaaaacagtatcatgaaaagtgttttggagacgggtgcacaacaatgtgaatgtacttaacacttctcaactgtacacttaaacatgatcaatgataaattttatcattgggccgggcgcggtggctcacacctgttatcccagcactttgggaggccgaggcgagcggatcacgaggtgaggagatcgagaccatcctggttaacatggtgaaaccccgtctctactaaaaatacaaaaaaattagctgggcgtggtggcgggcgcctgtagtcccagctactggggtggctgaggcaggagaatggcgtgaacccgggaggcggagcttgcagtgagccgacatcgcgccacagcactccagcctgggcaatagaacaagaccccgtctccaaaaaaaaaaaaaaaaaaaaaaaaaaaaaaaaaaatatatatatatatatatatatatatatatatatataatgttatatgtatcttaccacaattaagaaacaaaaataaaaataaaaaatacattataaaacaagcacaaccttttatgtaaattacttacttaatcctcataatcagacaaggtaaacagtatgaatattcctattttaaaaattctgacccagtaaggttaattagcttgatcaagtttatatagctacttaggagcagggctgcgactagaatttaaaaatctccaactcctaagatcatgagcacacagatacacaaataagcaatagcatcatgttttcaaacagtctggtctcttccctggctctgtctgaatgacagactctcccattgtttcttgtaaacaggcaattaattgtacacactaatacacagaaatggcccttaaaataaggaagaacaagagaaatccttttttttttttttttttttttttgagacaaggtctcagtctgtttcccaggcctgagtgaaggtgcaatctcagctcactgcactcttcacctcctggactcaagtcatcctcccgcctcagcctcctgagcagctgggactacaggttcatgccaccaagtccagctaatttttgtattttttctaaagatgaggtgtcaccgtctttgccaggctggtctcaaattcttgggctcaagcaatgcacctgtctcagcctcatgggaaatcttgcactgatgggctaaacttattcaaaaagaaaaatcttccttaaaattaaaaatgaagagtaatagcaattgttggaagtgtactgattcaagggtatccaggtcaactgacagaagagagaggccagaaaggaatcatagtatactgaaaagccgctgtctgataaaagttggcaaggcagattctaggaagaaagagctcttcaacaaacaatggctaactatttaaggaaaatatgttacattgttttctcatctcatgtcaaatattaaaattaatcacatgcttattaataaaataagagcagaaaattgagccatattatacacagaagaaacttttatctggattaaaatagattttaagtataaagatcttaaaacaaaatgacaaaggaaaaaatgaaacataacgccccagaaaattaaaactttcagctccccaaagccattatcaataaaatgaagtgaaagaatagggagaatatgtattgaaaaaagtattaaagacgaagagctaacatcttcagacagagtgctattcaaatcaatatggtacaaatcctttattagaaaactaaatttaaagcatgagtagttcacagaataagaaatatatgtggttaactaccatatgataaaatactcaacttcactatattcaattaactacgattttaaataataaaacggtaattttgttggaaaaataggcagagtattttcatttatattcaagtcttcagaggccacaggtatatgtcactataagggaaaattggcctacatatcaaaatatttattcatagcgttctggcaacttatgccaatgtaatgatcagagacccacacaaagattagttgtaaaacatttgtcacagttttatgtataaccataacaaaactgtaaaaaactaaatgagagaacaaattctgatacacaaaggtgaatacttgaaagacattaagaaatcaggttttcaatacttcataaaatgaaaaagtattgacatagtaaagtataaaaaagtagaacacaaaatgtacaaacacgaataggtattatgtgcatgtataatacatatatattataaatctacaaagacctatccatatatgcatatatgcatttagataggaattttttaaagcactggaaggaaatttactcaaatgttaatgatggttatagatgagaagttgaattaatgttaactcttctctttatttctctccatttttcaaatattctttaataaattggaagtgtattagaaaacatccaatgatgtcatgaacactcattccctagacatattaaatctgttagcgttaactatagactagtgtactatgctaaggtgttatgacaaagaaaaagaagcagtagacagatacaaagacattcctgacattaggagaacttctggagaaagagacacatgttggtacaaaggctgtaatgtaagtaaagtagaaatataaacaaaaaaagcatgagaattatattgtagttgaaagccagaaaggcttcctggaaaaggtggtgtgtaacttttatatgaaaaagctggagccccatctcatggaacagtggcacaaagtattctcgatagcgggcatcaccatttgaactcgatcctcagccttcaataaaaatcataaagcccatcttcagagcccctcttttcttgcttctccataaattatgtactttcctcttttctcacctccttgagatactgtttacctaggaatgagacaattcattttttacagcccatcatgaacaattctgaaaaagaatcccctcattcattacaagacagtatgaattaaagctcaagaatgaactcttcctggcatttctaattaaatatgtagtctacctatcctctaatggtgaaataaaaagtagccccaatattaaagcaattccaaggatcaagcaagcaggtaaggcagattggccaagaaggaagagcaaggcactgagaaatcacaccatgacgcaaatgactttctctgttgatatgaaaattttttcctgccataggtgatgttgatattctaacaattttaaaacacaaaaaaattaaggggagtaacaaaatttcccttctattttttgagttatttaccgctaacaatctcccctctagaaaaagttacggaaatattgtacaaaatgcaccatgggttaaaaaaatgatttaaatacaggaaataattgttattaaatacatcttctagggagatccactctgtcccaatccttaaattagaaagtcagcaaaaagatgaactgaatccctgatgttaattgtacaggcttactggattagaactagagataattaattgctaaattttaatatgcattggactaaatggctgataagatttccagtagttggcttgaattccagaagggaatgattatttcttccccggcctgggagccctacaagccgaagacatttaaaatgtctgtatttggaatgaaagaagttgggtaaatagtagaataggttacagaatggcaaaaacttctagaaagaaaatatggaagttcaaattgccttttcccatttgaaatttagaatataatactgtatagaaaagaggatttaaatttttttatttttattacagcttcagtgattagcattcctgtactataatgtcaatattaaatccagacagacccaaagtctattacttcctatctaaaaaaaaaaaaaaaaaaaaaaaaagacactgtttatcacctaggtaattatattttttatgttcttaagaatttaggagcttgctatggttaattgggaaaaatgtgaattatggttaagtcgtgcctttttttattaaacttgtaacaaagcaaatgatgaagaaccaacaacttgccaatgctgagggtccagatgaacagacgcgcagagaatgcagatgagctgattccattaaaaagttggctgcaagggtagatgatgaaggttaagaagatgtaggactatagaggccaccagtgaaaaggaaaaaaaaatcccctgcttcctctgtacaaccttcaggatgttcaaggaggaagaaagaccaccaactgcagggtcagtacccagatgccttaggatatccatgaggctgtcaggcaccagtgaaaatcaggtctggttgtgcatcagaatcacctgtggagtttgttaaaagatgggattctgacctccattcttgcaaaatgctgatgatccaagcggtgagtttgagaccaaggatattatttatcttttaacaaacctcacagtaatcgtgaatgtacagcaaggtgttataatgtattttgatatcttattttttagagacagggtcttgttctgttgcccaggctggagtgcagtagtgcaataatgtctcaccgtagcctccagtttctgggttcaagcgatcctcctgcttcagcctcctgagtagctaagaccagaggtgcacaccaccatatccagctcatttttaattttttttttttttttgtagagacagggtcttttccaggatggtcttgaactcctggcctcaaggaatcctcctgcctaagcctcccaaagcgctgggattatacgtgtgagccactgcacccggccctgttttaattttttaaatttaacttttaaaattcaaatataggtagcgttttggtaatctcttattttaatctgaatgatggaatatgtcaaggggtgactgacagtagggaggcataatactgtcaggagcttcctacagtgctttcttcaattactttagaatctttggtctccccagaggtaaagtgactcgcccaaggtcacacagtgaattaacaaaaataagaaacgaatgctaatattagaaagtacatacctcctataattacttgcttgggcaataaactagaagttagtaaatattaagaacttcagggtccgggcctgtaatcccagcatgttgggaggctgaggtgggggcggcgggggggggggggtggtgaatcacctgaagtcaggagtttgagaccagcctgggcaacacggcaaaactccatctctactgataatacaaaaaaaaaatagctgggcgtggtggcgggcacctgtaatcccagctactagggaggctgaggcagaagaatcacttaaacgtgggaggcggaggttgcagtgagctgagatgctgccactgcactccagcctgggcaacagaggaaggctccatctcaaaaacaaaaacaaaaaaaacntcagggtcattaccctatttcttcaatttttaatttattttttatttttgagacagagtctcactctgtcatccaggctggagtgcaatggcacaatctcagctcactgcaatctctccctcccaggttcaagtgattctcctgcctcagcctctcaagtagctgggactacaggtacctgccaccatgcccagctaattttttattttttgtagagacagggtttcaccatgttggccaggctggtctcgaactcctgacctcaagcaatctgcctgccttggcctcccaaagtgctgggattacaggcataagccatcatgcccagcctatatttctttaattttaagatgcctattttatgtttttaacataaataaatgaagatgcatcttgtaattgatatgtttaatatggaagcactcattttttccaaaatatgaaatcagtggtgtacttacaactaacagcattataaaatccaggatatatgggaggggtattgcatatttattgtttctttgaaacaaggttttctatgaattaattttgtccctgtatgggtactgtcatcgtgtcgggtaaggaaatcaagactcacctgtgctagaaacctggaaataaactgttggcatatacttgcctcctatggtcagcatctaaccactcattgagtactggtgactcaatttctacctcttcaggcttttttcccttcccagttttaaaacttcaaccgtccctccagtgtagcactaatcaaatctaccacagagctgtcacatttatcctcattaaacacatacttgattccatgacttcctttttataaaactctactggctccccagtgctttcagaatcaagcccaaataccatcaaatggcatttagggtcctgtgaaatctgtccttaccctgcctttctggtatcacagtcatcagctgcttcttccctgcttaaaaaatcagcctaatcaacattcctgaagcttacggcactgttaccacatttctaatagtttaaactttcaaggcccagcttgaacatcacaccttccaccaaccttttccagtcctctcattaaaatcaatttctcccatctcagcattcccacaatatacagcacaatgagcatgtagtcttgcctgatgtatgcctgtctgtccacccaactggacagtaaactctctggcagcagaaactgggccttaatcatttcagtttcctccacagagatcagcacagtgcctgcacgtagtagttatttgctaagcatgaaatctttaacaaagccagaattgattctgaggcagggttaaagatattataaataaaacttcactgaactgaaattcatagtcccatgcagggcacctgcatatttttattaggtttcaccatggaaggcataattttaggtattattatgctgatgaagcacaatcttcctgctccaacttggccaaacccagggaagcaatttcctatttgattaagagtacgacagcagcgaggactggagtataaaaatttactgtagggttgagaatgtaagcttaattgtggatcaaatgggaaacattctaaacagcattttttaaaggaagtatttgaacagcctattttaaaatattcaatatcatcttcagcaataggcaagttttggaaactagcaagtttcaagacaggtactcactcattctctcttctgcaggatcctaaagatggtcctggggactatcagttacttaaatgtctcaggttattaattcttactttaattatatctcagctaagtgattttttttttccaccatttgctcacatagcagcgaacaactttacactgttatcagtcttcacatagcagttcccaaattttgcctttaggtttatatcatgtgcaatgagttttaaaaggctttctccacaaaatcataagagagccttaagagtttcattctctgcctgacctcctgaaaccctcaaaagataattaaagaatcatgaaatcttcttgtgatttcatttaaaaaactttttttaaatcattgatcatgtcttcattctactaaaccatttaagaagtgggcaatttaaactacccctataatggttcactagcctcagcaatcaaggctgtaagaagacagaagcctatgtccaacattattattagtagtaattatctgttacatattaatgctactaaagtaaaatgtgatctatatataatcgataatatgactataataatgtatataacaatccaatatagtttccccctttatctgctgtttcacttttcatggtttcagttacctgcagtcaactgcagtttgaaaatacatgtgtacaggccgggcacagtggctcatccctgtaatcccaacactttgggaggcagaggtgggtggatcatttgaggtcaggaatttgagaccagcttggccaacatggtgagatcccatctctaccaaacataaaaattagccaggcgtggtggtgcgtgccagtaatcccagctgcttaggaggctgaggcaggaaaatcccttgaaccaaggaggcggaggtggcagtgagctgagatcatgccattgcactccagcctgtgagacaaagcaagactctgtctcaaaaaacaaacaaacaaacaaaacaaacacacacacacacacacacacacacacacacacacattagccctgtgcctaatgtcacagtgccatcccttggtcccactccaacaactatgtatgaaataaacctgtgatcctatcagtcatatcccttctccaagcctccctttctgaaactctatgcctctaattctatgagacatttcacaatgttgtatctacagtcaactaagaaataatatatttgggtttatttcactctttgctcaaaccaaggataatttatcaggcctgctaagtataatctgctttcctaagtattgtgagaaatatgaaacagactacacttgcaaatcttaaattgtgatagaagaaatgagagaatgcacaaaagttttcttttcttcagaagagaaattgcaactaaaaaaaaacgcctagagataataaaagagacgttagaaagcaacacacaactgtcaactcaaatgtactgctaattactctagaaagaagtgttcagcattctaataaaaacattatattagtataatgtttgtcattaacaaagagttgcttacaaccacatcaacagataagatcctatgatacgtgttgtctggggcaaagcagggaattgtgggaaatgtaaaacaaatttgtgttgaatcccggccctcagggaacatttgagttcatgaaataaaactaggaatcagaaagactgggcaagatttgttttgctaggaattcaggatacatgaatccatgaggaaacatgaacgtcttggaactcgaacaggaggtggtggtaaaaatctaggagttaggtaaacagtgtctagccacaagaacagaggaggggtttaaacctctaagagatcattttatgggaaaaagcagcccctcctgaaaacattcaattcaggacacgaaggacagatagacactcagagcctcagagaaaaaagtatctggtgaaatctcttctagaaactttggctggggagagtttggaatgttgacttaaagacccacagtgaagtctagaaaaagatagaggcagcttgttacaatttacaccaacaggaaaccatttagaagggaagaataaatgttagttaaactttaaagattaaattacaaatttactcaagtgattttaacttttactgcacaagtagcaattttaagtcataagggatctgaaatgtttccagagttttaaaatggactgttttacacaagtgaaaaaaagattttggcttctagtgctgagcacagagcaatcctatgccttgtaatgggctggtataattgtgcagtttcattaaaataattttattactgacttcctagttttctgttaattatcatttcagagtaagaaaaactattacttttaaagcctatattaaagtaggcttaagcaagcacggaaaagaaagccagtgagagaaaatataaaaagaagctattaatattaacagttacagttggacacttgttcatttcataaatctttgcagtattagcaagattgatgagaagtagtacaaatgagaagcacatgagataagcgatcatttgttatcattactgaaatataaagtatgattcagtgtttcataatggatgttaaacttgatttaacatatggttggctcatttgctgaaaactatccttaaagacataaactcattctaaagtcaaagacattgtcttaataacagtctctgaattatctttctataagagactgagtaacctcaataaatacaaacttagggagaagttgtgaaaaggctgttccttaaggagaaaaaaagcaaatgtgttatatactctgattcattaaacatattatagagaattctaaaatatcgttgaaagagtaaagaattaatgtgttttaataccaacacagagtcttttgaattgattttcaaatgatgagtagagaaacccaatcactgctgtcagtgcttcagcagctacctaagaaatcctcctttgtcaacttcatttctctaatcatgagagaacgccagtgcccactttaagtttagtggattaagcagaccactgcaagtgctgctaaaataatttataatctatcattatacttcagtagtgatagtatactactgaatgagaatacactggattctcattcaacctggaatgagacacttaaaaatatttgttacatgagtatattcctatccacgacttagttttgtctgaattctcacttccattaacagaaatgcactaaaaatatatatatatatatatatatatatatatatatatatatatagagagagagagagagagagagagagagagagagagagagagagagacagagagagagagagatacaaagtctcactctgttgcccagactggagtgcagtggcatgatcatggctcattgtagctttgaactcctgggttcaagtgatcctcctgcctcaccctcctaaagcactgggattacaggcatgaaccactgcacctggcctacattttttttaaaacaacaatttatgtacctcctagagacaccagaccagtttgaagactagccgtcttcaacagtccctgtagcaattatgctcagaaaggcttatttcttgagctagcaagtatctgccctaaaaccaggttcattaataaaatgtctatctttcaaaaaaaaatacttgaatcttctgttttccctgatgtttgtgtctttcttcatccttggatacctattcttataacacagcccatgctcatctgaaataagtgacttcaagtcagctccattatcctgcatcctgcctgcaaaaatgatctagatatggggagtagtgcttccccttgttctatacactatatcaatataagttgttagactgcatcttctttaatcaaagtgtcatctaattcacatttagccatcagaagcatgtctaccaaagagcaatgcagccaaataagctttatgcacccatccttaggttatactccttagctaatgttactcttatttggcattgatttgatttattgacaacaaaaatacccatgtttgacaccaactagccttgatgtgccactattactgactctctcgactttgctcccccaatttgtaaaatgagaagtccaagctttcagtgattcatgaaagcagagtccactgtcagcctggccacacaactagcccctgaggatcttgctaggggtcaaaacccacatattagatctgatggggccctccaaattctctattttagtaagttcccaaatgcttctcacgcatgtctcttacagaatagatatagctgaaacaatctacaatattatatactgaactcattcaaccattagctcaaaggaaatgcatgctaaaccagctgcacaatccactctgtggagaaatccagcagccactccaagaagctgacctccaaaggtcatggagcaagatggagatgaagagccagccagggtctagagttcccactttgctctcttaccagctgtacaactttggacaagtctgttaacctctcagagattaggatatcttttctgtaaaatggtggtaataaagcctaccttagagggaaattgtgcaaattaatttttaaaatacacatgtaggccaggcgtagtggcttacgcctgtaattccagcactttgggaggctgaggcggtcggatcgcctgaggtcaggagtttgagaccagcctggccaacatggtgaaaccccatctctactaaaaatacagaaataagccaggtgtggtggtgcatgcctgtaatcccagctactcagcaggctgaggcaggagcatcacttgaacccgggaggcggaggttgcagtgagccaagatcatgccattgcgacagaacaagacactgtctcaaaaaaaaaaaaaagtgtatatatacatatgtgtgtatgtgtttgtgtatatatatgtgtgtgcgtgtgtacatatatatatgtacacacacacgtatgtatatgtaatgtacttacaaaatgggaggagtagagacactcgggaggactgcatttggctttattcattgttccttctggtatagcagctaacacacagtgagtacactaaaaaaacaatgctttgaagaaacaatctaatccaactacccatgacacgtgttattcattcagaacagtttattgagaggcctctttgtgtgaaacactgtgacagtccatttgctccttcaaatctcttcctccccttctttctctgttctgtgctgcagaaggctgatctatgtggactacactgacaggccccttggtgttctggcttctcctgcaagttggccagtgagggcttcataaggataccaaatgagaggaaaaacaagaacttggtctgatctagcagaaagatcagaccaaggccccaatcacagagatctcctgtttctcccaaagtactctgttttcccaaacatctctcctactgtgttgcagtaccactccctcaccttatccctttgggcttgagtctttaaaactccactgcttaccatccccaggttcctgtactaaccttgtggttcctctaaaccccaccagtgcctctctatatcgtccctttataaagaagttctctggagcgcagcctcagttgagtgtaccctctcttccagttggaagtctgatataaacaatgtgtttgaagttagggaatacagtaacaaacaaacaagtcatgatctctcatggaattctaactactaccactgtcataacaaacagctaccgtttattggacacatatcccatacaagctctatagaagttgtatacctgaggttgctatcatcatctctgtttttcaaatcaaaaaaccaaaccttggaaatataaaacccacatgagtatcaaccaacagaatttgattcacaacagaactcagattcaagccagagtcaacccaatccacagcacacgctcataaatgctgaagtattaccacatttacctcaacaatgtccctgccaaatggatcttcaatgtgagtcataagaaattttccccaatccttctccccatgccagatctggggattttcagaaagcctagtgtgaaaattcaggagacctgaaatgtgccctcttatcatatctactcaccaactggcttgtgagtttcctcctctttgagctaatacctgcagggaggtgcgcgcttccgtaactagtggcctttgttctaaccaccatctctgccatttttcctgtgaaatttcaagataaatgcaggcaagcaagggagagagcccttggacactcttctctagtattctaggacttttcaggcctgcctggtgagatcaggtaccttatcactagcttctacttgtgcaatctcccaattacacaagcgatcccatctagatttacaagtggccatcctctctgacccacaggccagagaactcagcccacgcaatgtttttaaaatagaccccaacccaggggaggctgacaggcacacagctgcaccaactttattaatgagtacccagacctttagataattgatttccactttgatcccagcctacgcatttctatctctgatatctaaatagcaaatcatgttatcttacaattaagtgataatcttcatggcagaaaagttgacaggtctataaatggcttctgcaagtgattaaaataacttcctccccctttccacccagccctggaaatgttctacaacttcacaaggctattacttgttaataaactccccatgatatgaacctcattcatattcaacaagtttacatactaagttactctccagaaatgatatacatcttattttttatgcttaaataagaacattttatttattttttatatctatttttttggagaaagggtctcactctgtcaccctggctggagtgcagtagcatgatctaggcccactgtagcctccaccttccaggctcaaggatcctcccacctcagcctcctgagtagctagcactattggcgtgctcctccatgtcagctaatatatatatttgtatatatccatggcagccaatatgtatacatttgtagagatgaggccttactatgttgcccagtctggtctcaaactcctgggctcaagtgatcctccagctttggcctctccaagtgctgggattacagtcatgagccatctcatgcagcctgcaagtacattttattagccttagtaagttacacaaagtcagcaaaacctttgactttaatattcaagtaatattaagattgttaaattttgcatgtatatgcatggatatgaagtatatacaagtgcagagtaacttgaagatcagtgttgaaacaacattgagtatttaatatgaaatgagaataaatgactaaaagaagataagttttacttcaataagtgaattgaatattgaaccctgatatggtttggctgtgttcccactgaaatctcatcttgaattgtagttcccataatccccacatgtggtgggaaagacttagtgggaggtaactgaatcatggtggctgttccctcatgctattcttgtgatagtaagttctcacaagacctcatgttttaagggacttgacctttcacttggctctcattcttctccttcctgccatcacgtgaagaaggacatgtttgctttcccttctaccatgactataagtttcctgaggcctctccagccatgctgaactgtgagtcaattaaaactctttcctttataaattgtccagtctcggatatgtctattagcagcatgaaaatggactaatacaaacccttactatgcactgaattctggggcaagtacccaagatattacagcaaacaatacccaccaatctgcttctatggcagaactgggccacatgcccagaaggcaagtaagaattactctgcaaccaactgatcaccatagtaactgagcatcaggtagaaagagtgctgggattgattagcagagtctgtgatttggattggacatagaaatgatatagtccattccatgtatgctcaatgaacactgcacaggtgaacagataaggctgtgacctcctctgaggcaagctccctggttattccatctccatatacctcaagactcctaacacagttctttgcacataatagacattcattttgcaggacagataccaagatgaattgcttcagtttgtttttaacaacgtaattctatttccaatttagataattcattgatttcacacctttccttcctggttactctatacttaattttcccttttcttctttccttttttgtttgtttttttttttttttttgaaacagagtcttgctccattgcccagactggagtgcagtggcgcaatcttggctcactgcaacctccgcctcccgggttcaaacaattcttctgcctcagcctcccaagtagctgggactacaggtgagtgccaccacatccagctaatttttgtctttttagtagaggtggggtttcaccatgttggcagggatggtctttatctcctgaactcatgatccgacctctcaaagtgctgggattacaggcatgagccactgtgcctggcctcttctttctctttctaaaagcacatcaatttacatttctacatctgcttcctacaaagaatttcctctgaatgaattcaacaagtgtcctgtacatgtaaatatatgtatgaatcttttgtacctatccatgtcaaagggtttttgaagccaaactgaaaactttcctagactacatgttgatgttctgaatatccacatttcgaggctcttaacaaagctgtatcaaactccttttcttctgagtaatatattatgtacgtaaagtcctaggagatgccctaagtctactataagtgaatttactttttgttttctgctttgcttcattcatcctgctttgctttttttctcatcccaaatataaacatctgttttgttatcaagttaaagttaaggagatataaaaccctctcagattaatgtacagcccattattgaattctggatcttagtgatatccaatatattatcatgaattttatagaatatactgaacttttaattcttatctgatttatcttcttaatgatgcttagatttccattcaaaaatcctgtctcttctcaccctttccacactgtgtctgtttttgtgcccttttctagagttttacatttctctttaggattatctctctctttctctcgctcacctacatacacacaccacacactccatgtccaaattcacagtctaagcattttggtgatatgccattcctcttctacctttgttagaagttcctctttcccatggaatcaattctaccggaaaaaagtgaaaaggaaccttagagagcaatcattaaaggtgcaaagggaaaggtccccatgtctgggagtgtctctaaccagctgtgtgatacgtgccatgtaatatctggctttggttttctcatctctaaaactggagggtaaaacaagactatgtcttgaaacctttctaattctgaaatgttcactattatcagttaacatttattgtgcttttctgcatggcaggcctcaggctaacggctggctataactagcactatccatgctcacaacaactccataaggaaggtgccacggttatcctcattatgtcactgagaaaactgaggttctgagaggtaaagtcatttcacacctgatgggatatggatgtaagactggaactcagacggcatgactctcaggttacagattctgcatcacatgctcatatcaactgatctgtatttttatacaacttcaaaaatgaaaacactgggcatgtgacctataaataatgaaatcatatacaaaaataaagaaacaccccacattgttgaaaaattatttcctttccaaaaattacttgaaagggcatcagtaagccctggcatatttgttcaaaatacagtcttactgaataggggtgtgtgtgtgtgtgtgtgtttgtgtgtgtgtgtgtgtggtgtgtatatacacacatatatatgtgtgtatgtgtgtataggtgtgtacatacatacacatacatgtgtatacatgtatatagacacgtatacatgtatatacacacatacacatatatacacatatatgtatacatacatatatgtttatatatatacatatgtgacaataaaccagtagaaaggtatatatatacacatatatacacatatatacatatgtgtatatatacacatatatacatatgtgtatatatacacatatatacatacatacacatgtatgtatgtatacacatatatacacatatatacacacaaacccacagtcatcccttggattggtttcaagacccctgcatatacaaaaattagcagttgctcaattccctgatatgaatggtatagtatttgcatataaccttcccacctcctcccattaactttaaatcatctctagattacttataatacctaacacaatgtaatgctatatagttattctaacatattgtttttatttgcattatttttattgttgtattactttttatggtttttttcccaaatattcttgatccacagtggatgaaattcacacacgcagagcccatggatacagaggtccaactccatttttaaccaatactcatattcgcacagattcatataatctcacactttcaagtaacgtaagcactatatgatcccattatattatcagcttgtcaagaaaactgcctatgctctgtgtcctttataaaacaatgttcctacctaataagggcagctacagcctttccccccagttctccctgctataaggtggcacccacagatatgtctccttctcttttgcctaagaaggcccttttgatttctctttcaatcctgtccccaagcctgaactcatcagtatcccctactgctgccagtctaggagagactccaatcatcttcccctactgctgagacagcagccttctacctggtagcctctgccctcctcagtccattctccacactgcttgctttcctatctcttctcaaagccaatcacataggtcccttcctcacttaaaacccctttatgactcctcattgcatcagaaataaaatctgaactcccttccactgtttcagaggcccactctcaagctctccacatctataaagtgccaactagtctttgccagttgtcaaacagactgagcttagctttctctcaacccagaacctttacataccctggctccttgatttggagtgctctctctccatctgccttctacagtcggaccttcacatctttcaggctgagacagaaccctcctccagagagctttccatgtcccccttatttagtctgacccaagcccattattctctcttcactcttcatttgtttccttcataataattctgattgatcattgtgttatccatctccacgtgtgtgtgtgaactatattctctcactatcacacaagcctccggaggatggaaagcagctggccttgctgatagatacatcccatgcatttaactcagagcttggctcaggttagatggtcactagttatgtatttgttaaacgaatgaacatatgacctcagatctttttgccttaagagaaagaaaagtaaaccatttgaaaaggggggaaaaattataaggctagcaaaagttaatggtattggcaaacattactacaggcccttgatagatgttaaaagaatggagaaagccctttaacatatttaatatatcatccctagttggaagatacttttagaattgtgcctatgcccaaaagttaataaatgggtgaggatattctgtgtgactaagaggggctaatgaattgataagtatttctgtgagatttactggatggttgaaaaatctctgtacattttcccctgattgtctctacctttctgctggcttattgtcatgctgatttttatggatctacattcaacagctaaggtaaataaggtaaaatgccagagaataatccaccataatatagtagaaaacttttttaaaatcaaaattcctgttgctaaacccaccatctaacaccttttatcacatttgagtgatctttaaaagaacatcacacttaaattcgcttttgagttagattactgaagacaaatgacatactgaaatagcatctaaaagcgttaatatacaaacatctacccaatacagatttaaatatagcagtgactgtacacctaccgaaacatgaaagactaccaggagacagggatttaatgtggattgatactaaaaagctaatggaaatccggtggtctttatgattgagatggaacatctttcacggctcttaaaaccttaggctggacagtgaagacatgggctggtgctgatgaaggagggctataccccaagcctgggaatctggaaatctgatgtgttcggccagagaaactccaaagttctccgtgtttctgcctttctctacccccacaaacttcaattcttcccttgctaataaaatactggaaactgagtaataaaaggcaaatttcatttcaatcctttgggctcaaagccagctccctgccaaaacttctcctgcctggaggggtagagcagggaatgagttggggcaagcacagatgtcctgcttctactctagagggagagatctgcaaagggtatggctcagcatcttgtctaccagctaatgtgattcataaataaatcacacagggagaagtgtgggaggcccctgtggttcaattctttatctctttttctcttccccagtgtggaagattgtcctgagagtgtggggaccagggggcagagtcacctacatggtctgctgtacagcagctctggcagcttagcacaacccattcacatactgggcagagcccttccaatgttaacctctgccagagctcctcctgacttttttttttttaatcctaaaagaggaagcatttcaaatgacctaaatctaaaaatagagtacttcatgctcatgactattttaaatagcatctaaaataaagaattaaaaaaaaaaacatgtttccatttttgtgacagtttccccttcccttgaaaaaaagaaaatactgtagagcttgtcattcaatctaaaatcagacttcgtgccagctggaatcctaggtttatttattactgtgcacagttcttacattaactgtttgttaaagactgattttaccaccactgagacacaatgtaagtgaaggtctttccatgttttaccaaaaagagtgattcaagcatgacccgtccaggagaaatgatattaaagaaaagggacagaagtactactcagtcactgatccaactatatttctggagaaatcaagtttaaacataagtaattgcctaatggagttgggccaaggtggagataggaaaatatccatgacacttccagtatttgcaaaacaggttcaaaaataaaattgcaacattttatggtctgtaacatacttagtcacttagtcgcagagacatctggaaaaagataatccaatggggcaggtttttattctctactttagaaaattgttcacatttattccctatcatagtttcaagtagaatggttataattcatccaataagcttttttaaaaagcagggaatcacagtttctgggcgtggggcccacaggcctttacaaaacttcataggtttatacctacataggtcatagattgtgaatgacacacaacatgatgactatgttcatgaacacacatgctcatatacatatatacatgcagtcaagctcaacctagattcacaaatcttacaaggttttacttccacaataatgggctcctgttcagtctctcttgccagccaatcctccaagagagacaccgacaaatgtagacacgtaaacatgctcctccaaacatggaatagctatcacttatttcaagtcatcaaacgtatgagtcagctgtatcttgatacaattagttgaggttctctttcaatgtactccttagacactctgtggtgtcaagctgtggtactatggctctttcactagctcattaccacctccagcagagtctgccttggtatagcctcagaggcacagagcaagcactcaataaatatggagtagaggaaagagaaaggtggacaggaaaaaaggggggagggaggaaaggagatgaaaaaggatagaagagaaagggaagccagtgagggagtgaatatctagctgagaatggaggaggaatctcaaataaaaagggcaaagtcagaggacactcagaaaaacagaagtggatggacaacagtgccacaggaactcaaaggtgcaatgttttcaaaagatagatagattccaaagatggcacccactgatgaagcttttctattaccagggtcacatacaaacaaatcaattcggcacccagggctgaggtggtacagcgtcacgtccttaaaatgccttcagggaccaggcaaatagcataaatataagattataggcgagaaaatgcttaagtttcaagcacagcatctgtttcaagcagaaaaactgtgcagatcaaacagctcagcccagactctatccctacaccctggagctaacaaatcaatttgattcaaatatttgtggaatacctacaatggggttttaatcacaaaactttacttgaacagctgcaacctctagcctctccaggcttctttcctcatcatggggagaaaaacacaaacatttcaacatttgttgagaggagaagaggttctacatgaagtaacccgactgacttatttgtactgagaaaggaaaagcaactaaccctgacctaccagaacttctcacctcgggcagtggcagtgagcagaggtctcagcagcaggagcctgcacaaccccaaaggacatagcagagactccaataccatgtctgaagcaacttctttgaaatcaaaatgctgatcttctcacatgctgattacagacacttccattatcaaacagaagaatttggggcaaaatggattcttaatggtgtctgtttcctacattttcttatcagtagagtggctcaaaatctaaatccacctaaactgtccatcatcgccccctccccaccaacaatgctctcattttatcctgtatgtgtttttataaaacgtctcaccatctgtaacaatatatgtatttgagtaattgctggtttactgtccattgcctccactaaactgtaaactccatgaggtcaagtacagagtctagacttgctcatgactaaatcacctgcatctggcacatagtcagcatgggatatatatttatctgttggcccaacaaatatgactcttgctgctatctgattttacacaagcacacctccactggcacaacacaaggagaggagaagagggaggcatctggagagctcaatgtcaaggttacttcccagctgccattccttgtgtttcctgaatgcaagtgtaactagtaactgtactaacagagccaagggctatatattcttcttcatcccataaacagaaaaataaacagttctgtggaactgtgcaaacccaacttaaatttcagattccagacccattatctggcaccctttgctcagaaatactttactaccactagaagacaatctaacccctggtctcacataccacataatgctgaaattcttccccattctgtctcaaacctgcccacaactccgtttcatgagggctgagccactatccaatttctatccttataggggttcggttttagactatgctcacaaatcccaaattcccagtgagttcaggaatgatgcttccttaccttaccttacataggaccttgaagatttctattacccgcagatgtaacatgcagttgttaagaccgcacattgcatcagcccacgaaatgagttgggggctatccagcctggcccctctcacgaggccatgtaccttgtgggggagctgtgtctccacaaaaggagtatctttttctattttatacaaacatgccctatggattagtaacagtctgatactagaaaaaaggaagctcaaaacttcacaggacatggcaaataaaacccagtgacctgataagaggtacaatatctccttggtttaatatttcacctcttctaattagaataaaatattcactaggaaaaatttttatgatagtgtccttttggcattagcatgaatacctccaaggagccgtattattcaaacaattttctatttcaaaatacacaggtagtaagaactaacaaatcattacatttccaccaaatgcacggaaacaacaaacttaactaagaaaatactgaagcagcttttcccaacggtacctcgcctccctagagcggaatggttttcttttaaggaatccctattgatgccagaaccaccttggaagaataattaatgacattttgaaaactgaacttccttctcactgcctttcataatgcaaagtgaaggggaggcggggtgagagtcccccaggaacacacaatgcatttttacaagagcttctaaagcccctcagtgagacagaaacacactttctcatttaagcaaaactttagaaaactaacaattaaaatgtgagttaaactgaggaaacatcttacatctgtgattctccctccagaataatatgactaggtagctagctgccagacactcttgtttcagcaatcatgtgactatgtgatgagggctggcttcatgattcaggtggaactgatcagggcactgacactgatggagacaaagcttgtcaggcatgatgtccttgtaggcaacaatacctgaaactctgttaggaaatctgaggtctttggatagaaggaaggaaataagccaaaggctagagtcacacagtcagtatcacttcagacaagtcagcactggatcaacctcttcacctgtaaaatgagggtaagaatatccactcaataagtatatgataaaaagaaagtgacaacacaaagtgtaaatgaatatttaagcaacatctacacataagagaccctaaatgaatatccgttgaaataaaagcaatggttacatgcttctcatatcctgtggcccactgacctcattagtcattatcttgaccagctccacttgcacagcattatgaattacatgtgtgcagggctattcaattgtctagtttgatgttcttaaccttgtgaggcagtaaatatccattttaaagatgagaagactgaagtttacttcacaatcttagtggctccaatcgaagatcgtccactgtaaaattcagttatctgcctcatgatttcacggcttatggctctatggaagttctattcttaacatgacgcaaaggaagtcagaagttgcaaaactctgagttagataattaagccatgaaaagtgattgatgctaagcatctgtacacaacatgtgaaccaagggaatgagtgactagaacccaaagagagtttggagttatttggctgtgactgagaaatgatgggctaggaatccaggtaacaacaacaacaaaagtaaatacacattgtctctcctctttgagaagatgaaagaaaacatctttttcagttcaatgatgcttcctgtagacagaaattttctcattgaatggacaaaactagcaagtgcacaagttaataataaccttttacccaaggttccatagcaagttccacatgctatgctatcatctaggctccctgcctgcctcttctcattgcatcctcatgacaacctcataagttgtcatgctatctccaagttttggatagagactgagtctcagtagaggtaagtttgtttttcaggcagggttgagcttttcgaagtacagagagaactggggaatggggtgcttcaaagtcactgaaagagctgaagctgtgggctctagaaagacatccaggatgaccacgaggagtaccactacttctgccaccatcagaaaggcagagactcaggaagtcaccaacagaatcattattagaagtagactgtctgaattatgaacatggatcagaaagctgctgtcaccaacacagcctttgactttataggaaagccacactagcaacaaaataaacgctctatccactgcttctcagtggcccttcactgagtggccaggtactgaaagatgagtgcccaaaagcccgatgtctcctccaatgttctagccagcaaagatcacagagaatacagaaagttggcttcagtctcaattctgtcttccaaaactcaaacaagtgcatctaactggcaaacaaggaatcagatccagggccttagctgtaaagcatctggaaatgtaatgtttgaccttcccgcctttcagtacaggaaggcacgtgatgaggaggctagcaaggttcctgagagctcaatcactgtgtctacttcatcagatttgccatcccatagctgattcctaattaaagggagtgagaaccaaaaagggggcaaagccaagtatatgagtaaatgcacagaaacatgacagactaatttaaccagagaactaaaaagggtttagcacccactaagtgaagagtgcatttggaaacaaggtggaggatatagctggagaggcaagaaaaggccagatgatgaaaagtctatcaccccagcttagaagctttctcagcctaagctaggatatcccttctgaacttcttagaagccttgcacaatcctcagctactcattgatcacacagaattgtaaccattcatgttcttgcctgctttactgttccccctgactatgagggtgggaggtcaagggaaaggaggggctattccactttgtatttctagaacatagcacagtgcctggcccataaacgaaagctccagaaatacgtgttgtatggaattacgtcccgaggttccttccactatcaatcatctacttaaaaaggagaaaatgctctctttaccttaagtacctttcattattaaaaaaaaaaaatggttaactatggccacgcaatggctctcacctgtaatcttagcactttgggaggccaaggtgggtggatcatgaggtcaggagttcacgaccagcctggccaagatggtgaaaccctgtctctactaaaaatacaaaaattagccgggcatggtgacacatgcctataatcccagctactcaggaggctgaggcagagaattgcttaaacctgagagacagagtttgcagtgagcagagatcgtaccactgcacaacagcctgggcaacatagtgagattccatctcgaaaaaaaaaaaattggttaattgtagattacagattgataattgtaagaatatattcctatagacatatttttgtacatttatgtacagtagtagacaaatgttgtttctgttaactgaaccaccattctcccattctgatgatagtgcctcaattttcctgtaggaaaccacagctactcccctcacatgaagaaattcacatgaggggtatgacctcagccctggggtttcagtttggcacatgacatggctggatcaatgaaagttctccgtgggattcttgatatgagcaacttggcagtgagggggaaaaagttgctctcttatgctgagattgctactagtggcaagatagtaacattgtatggccaatgaccaccacatgagacaaggtgtccaaagaaggcaacatggaggaatcagagcccatggagggaaagacacagactctattttttttttttttttttttgagacagagtttcgctattgttgtccaggctgtagtgcaatggcgtgatctcagctcaccgcaacctccacctcccaggttcaagcaattctcctgcctcagcctcccaaatagctgggactacaggtatgcaccaccacgcccagctaattttgtatttttagtagatacagggtttctccatgttgatcaggctggtttcgaactcccaacctcagatgatccacctgcctcggccttccaaagtgctgggattacaggcgtgagccaatgcgcccagccgggagagacacagactcttaacaacactgagtactcggatctagggtgtcaaagctgtcatcggtcagtaaatttctttttctttttcttagaaggtctaggatggtttcagtctggtaacaccaaaagaaattcaaagttttaagtttaccatacataaactattagttgaagaaatggcaatgactaaatagcagaagaatgaaactcagctttgggggacatcaatctgtcagtcatctactgtgcagccatttcgaggggggataactggaagagatgaggctatcacctggacattcttaagagaattaaaacataataagccctctccctgtctaaatgcacagataattgattaacagaaaatgatcattactaaaatggcttcagagtttttcagggttgtgggaattacaattgttctgaaagaaaactgattacttacagtttcctcctaagattgtagttgtgcagtaatgatattgagacagcatgatgcccattaaaaaaaaaaaaaaaacactgaagactttacaaataactgagccaaatgagatattgaaaaatcaaagcgagaaagtcccatcactaaaagtatacaaatacatgagaatcagccagtaaaacaggaagtcactctcatctaaaatggcctttgcttgtcatcaaactcatatagaattcctaaaatctgtcagtgtagtagcttctaagtgatatgtcaacaaatatattcactgagaatacttattctgcctagagccaatgtttttagaaaaacatcctaaagagtcaactgttaaatcactaaaatgaatgttttgagcaggtgtttggaattgtgctgatttatccatattttccagtttaatttccacgtttaccaacaaacttcagcaagaaaacataaaatgtacctggaaggattatgttcatcataaatacaaggacagttgcgctaaacatatctgtactggtaacagtgattcataaaccatattcattaacctaaatccttaaagttttctgtttaaactgtagtgattggaacgccaagtgtcagagtttaaaatggtatttttaagctattagcagttgacattttaattaggcatatttatgacagacatggggggataaaaaagaaggtaagcaaggaataaaaggtgcatcaaggacacaagaaaagagaaaagaattaccatccattcctgttatccttttcttttagcatatcaataggaaagcagtataactaactggtcaagaatgtaagatctaaagccagcctttatcagctcaaatcatgactctgatatttaccagctgtgagaccctgaacaagttacataaactgcatctgtttccacagggataatgccagcacgtagctcataaggttgctgtgggaactgaattgggtactgctcaaaaaatatgttgcacagggcccaagaggaaagaagtattcaataaatgctaactactactatattatttgtaaccttacttaccgggtcaagggctaatagtggtagtaaattgttgcttaaaattttatttatatatttcttcttgaaccagaaaagatgccaggctatttattttttaattttttgttgttgttattgttttacaaagggtttctcagtctgttgtccaggctgcagtgcagcagcacgatcatggctcactatagcctcaaactcctgggttcacagagtgatcctcctgcctcagccacccaagtagctgggactataggtgcacaccactatgcccggctaacatttttgcgtttctttttttttttctttttttttttaagagatgggatttcactatgttgcccaggctggtctcaaactcctggcctcaaatgatcctcctagatcagccactcaagtcactaggatcacaggctcagccactgtgcccagcatgcaagacaatttaagaggcatacaaaagacaaaaatataactcaacttaagaacagattaagaattaacaagataagaatatttaagaataggttaagtaaacaaatgtcatagacaaaactagagtcaggaacaagacaaaggataagaatcacttagatatggctgctctaagcagctactagtttgtcttcagctttctggcatccaacacaagaaagaaaactgggtctgcggcacaattttcaatattcgtgagattaaaatatactaaatgcccagaaagagagagtacagtgattttgttagaggccgagaacataaggaactaaggccatgcagcaaatcttcagaggggcacatcatagccacggtagatagcattgccaaactcaatttcttagccctccttgtatccacacctgtatatggcctctggggccacacgtatttccccacctcttcagtcaaagcttggtcctaggacttccttaggccctgatatatggggagaagtgacagtgcatcttcactcagttctcaccctctgccttaaaaggtcttaagcatttctgcttgccttgctgcatctccactacagccatagaagtaagtgacatagttggtgtggttgctagtctaagggagatgaaaaacacaaagcagtatggagcagagccatccactgagcccagcctagatctgctaaaccccagatgattcactaagacacaagcaaaaataaatgattattgttttaaacttcagagttttgggataatttgttatgcagcaatggaaaacaaattcagtaacaaaatgatgacactttttaaagcagtatttctattgccaactataagtcaaacagtatgccttctaaatggcttaccataacctatcttcataactttgatttctaaacttattaaccttgttactgtaatttcagagaccctcaacaattaatataaattaaatttgtcactcaccctactaaatgaaagtactctggaatacagtcaccaaaattaaataaaggttgaggtcataggcctccaaatacaggccatacagcataagcaaaattaactgggaggtggggtagggaggcaagcagtaggtcataccttaaagagagaccaacggcttccaaagtaacaacactaggcatgaaagtagcccatgtgtggccctcaggagagctgccatgtgtatgaagacacactggactgagaaatcagtctcttcaaatgtgtgctttattcaaaagatatcagggcagatgtcccacaggatttgtgttgatttgagttgcttctcacatgagcaaagctatccagcatccatacggcagaagttgttatggggacttattcatttacacatggataatgaaactcatgagcaaggctggggagaccaactaacaactctaataacaacagtaatagctgaatcccattgatatggatggtgctagtcactgtgttaagcactaagcatcaattatttcattcaattcattgaacactcataataacccaaggaggtagttatttttattcatttctccaaccaactttgccttttgcttttacaggcaagtattctggagcttggagagactgagggacctggctatagttacaaaggcaccaccttgtttgacaggggctctcaggcaaaattagaacaggtaaacttgattagtatttgctttaggtaagtcttgaacattttctcagttaactgaagattttttttaatgtttatgtattttttaatgaatacattataattgtacataatatttacggggtacaatttgatgtttcaatacatatccgtgttgtgtaatgatccaatcagggtagttagtatatccatcacctcatgcacttatttggtgaaaaccttcaatagcctcttttctagttattttgtaataaacaatattttactgttaatcatagtcaccctaccatgcaataaaataccagaatgtatttctcctatctggctgttgattgtagttttaattcttttcttaaatatgaagcttctgtaacttcaactggtctgtgaaaatattatgccaaatagaaagcactttttgtaaataaagggcgtgtgatgcactatgaacacctcccaaatgatttggaggaaaaaaacatcaattccagtgatattgtttcagattatcccaatggtctaggtttattccaaagactttgacctaaatccctcagtattccccttcaactaactctcaacccatttgaaatcttattcatatgttctcactgttagattgtccacctacaatttttttttgtcctttgaattactttctactgaaaataatacacagacctcggtgttattggaaattgcattgtgaatacacaaggttttttgtctaaattttaggtagttttctctttctgttgctacctcaaagagataacagattctgcagtcacattatatgtaaattatgtacaagcttcaccacttgggcttgtacattattctactgattttctacagtggcgtggggggcacataatagccagcaacaaattattagaaattaaattcaaacccagtgtatgctggatatgagcatttccaatgcattttgcctccaatttagttcagatgactaaaaacagacctgtgggactgtttaaaggcactaaatctccacagaatcatgcagtgctatgacataggcattctgttctcaaatattcatcatttatcagcaacggaaacaaacataggattcacatgtgcaaagtaacaaaatagatggtcctagctgacataccagtttgactcaactgactattacccttacaatgagcagcttcttaaaccacacttatcctggtcccctttatctatgttagagaaacaagaccatctctactattaattctgtctcaaaacttcaggttacctagttttttccctcaaagattattcatcttcgacagtcaccactgcttcacaaaacagattttattgttttctttgccaattaagggctccccaagaacagtgaataatctgtcaggttgttataaaccatcaaaagttctagaaatgtcacattacctccttcaaatattttttaacatgcaacagggacatacagctttgtcatcaaaagctgtattggtttcctcatattttctaatctacaccataaagggaagatgtttatcataatggcaaaataaataatttagccagtccaaatctcttacaattgcatgtggcaaaccaaagtcaaactgaaggagaggagggtggaatagaggttaatttgctcacatgacaagaagccttgtgactttatttaggataggtctaggcagtgaggctggtaaacatttaacaatatactcatttaaaaaaaaaaagggcagggggtaggagggggctgacttgcagccaatttcaagctaccaacacgctgtcaaccagctcacagaattcctgaacatttaacaataggctattgtatgctgggatgagccatccccagcatgatactagatccagctatcaaacaatatcataaacaccccatcctctcttctctttttcctgctttacttcatctgatttcattctcaaacagatttactcaaagatgactgcagaggaatgttctcagagggctctaaataggttggctttggatctgccctcttaaaactaaacattaccacagaggaatgaagtattctgatcacccagtttgggagctagagagaatgggggtagctacgttcaaaccatttggatgaggcaggactcgcctgaaatggggtaagtgtagccctcctaagaaagaagcactgtgcggatgaacatcatgaacaccatccaagtttcaacatgtctgagattaaatctgcagcaaaagtttactccatttctgggtgtgtaaagcagctaaaacttcctaccatgcgtccgctatccatggaaatccggaacaaaagcttaagatccaagaaaataaaatgtgttttgaagaaaaatatgctcttgcaacataaagaagctgtcttcagttacaaatagatataaaatgtgaagatatataattgctgcataaatttattaatagaagtgctaatgccataaatcgtacatctccattttgacacgcaatcctttattttcctttcactgaggaagaaaaataaaggagcggaactggtaatattgcttgcaactaaattggattttccaccagagaaagctgtttagaaaaagctattctaaaaaagcaaaatagtactcacaaaagggtattaatgaatccaaccaggaggaaaaagcctccaacaatacaaagctttccaaaacctctttcaggactgaaagccaaaaggatgctttgaactctctgtctttgcagaaaccatctcacctacaaaccgagtatgagatagagttcaaattttagaataagaactcttaattcaaactacaagtcttaactgacgattcaagaggagagactgcagcagctctgggtttcgaaggaaaccgatacatcctgccctcaaactgtgaggcactataggagcaagatgtaaaggatgcagtgcctttgcgctcccacctccgccaccgtgggtgtcataatacagaggtgaaagttcaacatgcgacaggtagggatgcagcagactctgtggctttatactgcataggtctttcactgcttggtcacagaatttctttgaatcctatttgtttatacactgatatttatgtaataacaaaagagtaagtaaagagcaaggaaacagccaagaaaccctgagcaaatttttttccccctaagaataaaggagttgagttaggctatcttcccggagcttctctttatcgctagatgcagtcagctggaaacatatgcctgctaattgctgaatgtgtgcctcatggagcaacggtgcagttgtcgaacgacctcggggaaacaagtctaggcctatttgtgcatttctttctttcaccatgggactcaagtgcttcgccaggccactattaggacagtggaaaatcaaggtggaaggctctgatgaaatcaattatcactaagttattttcactggtgaaggggtttcctcacaggggtttaatagtaaattattctttccatgggatgtgctagattaatggaggaaacaaagcaaacaaatgttgcctggtaagactaagaggagggtcccaaaatactaatatttactgcccatgaagagatagccacattcacaagaaaataaatgtaaacctacaattccagaggcgaaaaggaaaaagaaatgctaaatggcagttatttcctcagtgttatacattacacatatcaataaaccctagagtcccatactatacatgccatatggatagataaatggcatatgtggtaatagtctttcaaactggatgatagtactttgcacaagtcagggatgcagcaattgtttgaaaatagggaaaataaccattttctagcattacctagtgaaatgtaagtgtgggtacagtttgggagaatctgtatagtatttatttttatcctagcaaactatactttacctttctggtagaattttaactttggatattttacaaatatcatatatagtcttggtaacatcttttatttaaaatcacaaatattagttggatagatgtgttaagggagatttaccagactgcatacacaaaggaggccatcagacatgggcatctgaattgatataggttacaccacaccgtagttaaagaccaaatatctgccagtgttcccaataaggaaagataactaagataaaagaatgtctcttgcagaattaagaccttgggattcttttaaagcctgggtttacatcctttgctcagaagagaaagacacattatttcaatatattttcattcattcttaggcattaactgtcttaataaaggcagtgcttctcacttaaaaaataaatttagctttaacaaagtaagtgtaaacgtgaccctaattttcactctgctgtcctttcttccctgttgtgcttattagctgctgctctttgaccttgaacagtaatcctttgagcatgcctccttccaccatcaagaggaggttccctacggtctggtagtatttctatcatagttgttgacatgccagggaaaataatttcctttggacactataacccttctcgaaaccagctccttcaaacaactcacctaattgaacgtgaaagacatgaaaccactggtgtcagaaattaaatataggtgtttctttgttttctttggcatttcttctatttactttctgtcatctatgccataggatttagaaaggaaagctatggaaataggcaccatcaactagaactcaaagagagaattttgtatgaggaacacagtccaccagcagaaatagaatagtgttggatatactcttcaacatgcttttttttttttcaggatcaatgttgatggactgtattgaaaacaaaagggtaattcttctatggagttgtcttgcaaaattctattctagggttttgtctttgtcctttgtaagcacaaagcaaatgagaaaacaagtatatggtattttgatcaaaatatatctgccattaaacctaaggttccggagctccatggtatctggaagatgctttagagggtaggtagcctgaaggtgctgcggtgccatcaaagggcaatgaacatctgttgccccatagcccctttcctcctcctccagcaacaaccctgacatcatttgggaattcaatcatctcctcctctcagtctataaggtcgcagtagaattccatccttagacatgaagaatgtgcctcaggccaagctaagaggcacatcttactcccctatgcccctacccccctacccccctacccatagagatttgctgtgggatagacacatgacctaatccattctaatcagggtgactctcaggatgtctacaggagctataatgaaagagttgtaatgtctacagcagaaataatgtcttctgctggagcttctgcagccatcctgccaccactggttaggctggataaaaggcaaacctttaagccttttttttttttttttttttttttggtgaccaagttttgctacttgttgcccaggctggagtgcagtggcgcaatctcagctcactgcaacctctgcctctggggttcaagtgattctcctgcctcagccttcctgagtagctaggattacaggcatgcgccccccacgcccggctcattttgtatttttagtagagatggggtttctccatattggtcaggctggtctcgagctcctgacctcaggtggtccacccaccttggcctcccaaagtgctgggattacaggcatgagccactgtgcccggcctgcctttaagcatttaatgggatgttaggaatacggtactgtaatttctccttgggtataaaatatattggagtcaatcactgttgcccctaccctagtggggatatggcaatgatctcaccccataaggcaaacactagaaatttatgcttcagaattccatctggctttggttactttttgatacttatgattattatttttatttgaaacagaggctcactatgttttccaggctggacttgcattctttagtctcaggtgattctcccacctcagtctcgaaagtcgctgagactataggtgtgcaccttaattattttaagaaaagaatgtaatggctgggtgcagtcgctcacacctgcaatcccagaactttaggaggctgaggcgggcagaccgcctgagctcaggagttcgagaccagcctggccaacatggtgaaaccccttctctattaaaaagataaaaacttagccaagcatggtggcgcatgcctgtagtcccagctacttgggaggctgaggtaggagaattgcttgaacccaggaggcagaggttgcagtgagccgagattgtgccactgcactacagcctgggtgacagagctagactccgcctcaaaaaaaaaaaaaggatttaatttttaaaaatcagcatgaactgaaatttacttcacaatggaattaaagacccccaacaagtcataatatgcttatatggcaatatcacattgtttgtgtgagttataaagttggatggatttgcactggcatcttttcacggttttagtgagagaatcatgcatcatccaaggaactctgatgtaaaagactggacatgagaattattacagctttgaaattctgtcaatttcctacccatttagtcagatttaagaacagtatgaacctatcttacccaaaaaaataggttctaaagtcagtacataaattatataatcatgtgatatgactttatcatatcagtttacattcctgaatataatatggtccaatatcttcaaaacatatcaagactctgatcacttcttaccattcacaccattatcatcaagttgaaaccaccatcacctgttttctgagttacttccaaagcctcctaatcagtccaaacttagtcccatgcaatgtattcttcaaagaaccagtaaattcttttaaaaaataaataaacagatgagatcacagcactacttaacacctctaacgtcctcccattgcaaaatctgtaccgtgacttacaaggtcttctcgatttgatttgccccatccctatccatctaatcccaattcctaccactctccctctctctcacaaagcttcagccccactgtctttcttgctgttccttcaacattccaagatctttctctcctcgggggctttaaaccttcctacctctgcctgcaattgttttcctcttaatacttccaaggtctcccttttgaatccattcagtttactgcaccaatctcatatcttcaaaaagtttttcctagacctcctaacaaaaataaggcccctttcctaatactcactatccccttattttcctcctagcacctgcaactatataatttccctgttgacatgctgattatccatcttatccactgaaatataatccctatgggcacaagtacttttgtttatttgctgctgaatcatagcatcaagcatagagcctggcacctataaattgctctataaatttctggtgaataaatgaatcaatcaataaatgaatcttccaacaacatgatgcaacacagaccaacgttcagatcctacaaggtctaataatgtggctaaaggggcacctgttcttggttccctttggtgaaaacctgataatcaatgaatggcaagcatatttacatatttaaaagtttgcctgcaaggtaatcttaccttgaggctgtgtaataggagtaagtatctattagctcgtaggaagcacatgcacacatgtatgtacacacataaactactctgatctctcatgtcttcaacaacttgactacatttttacctgaaaaaattattgtagctattactaatgtgatgcactaaccagagagcagaaacaaattgagttgtttgtttctccaggagggaaagcaggccgcagctacttccagaaggtcaagagatcagggtatgaatacctaagacatgtgtgtgtatatttctgccacagggagttttcacacaatacacaaatggaggatcaactaacaggctgccagtcaaggggagattcaagaagtttcaaagaaatgctctgaaccccaaaataacaaaggaaaacatgttttgaaaagtacacaaagacagttctcttaaaaatctgccaggactccttgccaaaatggcatgttacacatccccttctctataacctataccatctgggctttccgtaccccaccagcagggtgtaagaatgcctattcatttgcacccctgcccatataagttattataactttttaaaaatcattcccaaacctgtaggttaaaacatgatgtctccctgctttaatttggaggtctctaagttgcttacggtacaacctcaggatccattcatgctcattttgtagctacaaaagaaaaagctctaaaggaaggccaagtgaaatcctggacatgcagtgtgatgaagaaataagggctgctgcttaaccaagagtcaactcaagcagtctctgtgaagttctttctcactgcctctgtttattttcctcctcagccaacacacgactaacagcagcatcttgaatttgcgttacaatttaccaagcacctttattttcctcaatgatcttcataaaaattctgtactatggataagatgactctgttttccagatgcagatccagaaaatggactttccctcagtgtctccagttattaagtagtaaaacccagactagaacctgtgttttctcatggcctcttcaaagttctttctacgatggcatagttccttaagataaaccgagtgaaagaaaggtaactttcactcacaattcaccagaaaaaaaaaaaaaaaaaaaaaagaggaggtgggggagaaagaggtgctacactcagctgagcccacctgtttggtttctgttagctttgaccaaagtgccagtcattacactaaaattctattttgaggtttatcatgaatattggtttctacaaaattcttcattaattaatgctagaaaacacagctctcagtcaattgccatggggcacaatacccaggcactgcttttctttgttcttcccagtcttagggacaccaatccagatagaattacgtccaaaagtagcctaaggccacgtttatgaaataaaaacaccaaggacacaggctgattttagggcaaattttaggtctggcattttatcattctgctctagatctaggggttaaactctactgaaataactatggttgcttttggtggaaacccccttccccaggcccttccagccctggccaggattcaatcatccattcaacagctattcactacacattcacattgtgctaggtgctgggcatacaatgaagaacaagatagacactgcttttgttctttagagatgacatactagtaagagagacacactaaaaacaagtaaacaaacaaagttatgattgactataagtgtaatactctaaaggaaacaaacaggggcactaatggagaataacgaaggcaccttctttgtttagggtggccaagcaaggcctccctggaaagtaagttagtaacagaactgccattaacccacttaggcctagtgttccattactggaatgccaagcatgtgggagttatccatatcctactgctcaaagtcatcgccaaggtctgatttttcactcatgcaaaaattcaaaaaattacaacctccggcatatatgagtcaataagcattccttccttgacctacacatgcttcaatccatattattttccttagtaggtggctgatgaacaggtcaaaaaccaaacaggccatggtagggatggcatcaggcataccgaaaaattctgctttagaaatcagtcatgaaaggtcattccagtttaaattacaatcaacatatagaagctagaaactccaatcagggcaaaaatggcctctttatatcccatcaaggaatcatttatctaagatgacaagaggtatattgccaacaaatccacaattctgtttccaattaatgcaaacttataatattccaagctgttattagatttcaattaataacctgtgatgcctcattaatgcaaatatgctcttcgtggtgctaaaccttcattagtgaaatgggtccaatgacatgacggtttcatatgataatggaactatgattaaaaggcacaattaatcattttcttctactacataatctctgtgacagtttacttatgcctatatgaagcatttgtttcttgcaaacagtcaatttatatttaaactattcaatagcagaaagaaaagcagaaatatcatactaaattatctctaatagttgcaaagaatcccagcaccaagttaggttgttcaagaataaggaccaggcacgatggctcacatacacctgtaatccgagcatcttgggaggccaaggtgagaggatcacttgagcctaagagtttgagaccactctgggcaacatagtgagatcccagttttacaaaaaaaaattagccaggcatgcacctgtactctcagctactcgggagactgaggtgggaggaccacctgagcccaggaggtcgaggctgcataagccatgatcatgccactgcactacagcctgggtgacagagtcaaaaaaaaaaaaaaaaaagtcacagagctggtgccattctccattaagagcataaagtgtgaaacagaaaatctcagtcacacggctgtcagtgctttttctttctcttgtctgtgtactttccattctttgaaccctgaattgctccaccagcaggttcaagccagcaacagatcctgaaccaaacacagcaaaaacaggacactattcccacccctcattttctccccaactaccccacgcagcaaagtctgacttgaagcgaagctgcctggaacagtccattactactacctgcccagtgtccttccccaattctgacaataacactgttttgcctttgcagaactgcccatctctcatatccatgtgggcctggttgggtggtcaattgcaactcttccctcaagcagccagagagagggtcagaagcaaggctgggccatcaaataccccaatactcagcacagtgattgatccaggaatgggctcctgaatccagcagtctcctgggttttttttctgacattcatttactgctaataaagaataccacgttgactccatgcgttagctttgtttgctgtttgtgatttgtggagaatcgcagaagtgaaaagtaacaaacacatgtcaagggccatccaccccactccaacctccacctcaaccgtcacccaagtaaagtccagctcctttagactccctctctctcagtccccagtgttacttattgccaagagacataaagcgtgcaaaagccacacacttctccttctaaagtaaatatagttttaaaaatctattgagatttcattttaattgttgcttagtaaccattgcaagattggaactgtttcctagcttaaaaaataacactataaaaaagatcatttagggccgggtgtgggggctcatgcctgtaatcccagcactttgggaggcccaggctggaggatcatgacgtcaggagttggagaccagcccgaccaacatggtgaaaccccttctctactaaaaatacaaaaattagcagggcgtggtgatgctcctgtaatcccagctactcaggaggctgaggcaggagagttgcttgaacccgggaggcagaggttgcagtgagccgagattgtgccactgcactccagcctgggtgacagagtgagactctgtctcaaaaaaaaaaaaaaattagatatttaaaattaagctgtctaattgttttaaaactcagatgttatagtagctttgcatcggagatacaatcctaaaaaatttaaaacaaaacaaaatgactgggtgcagcggttcacacctggaatcccagcactttgggaggccaaggcggaagaatcactagagcccaggagttcaagaacaacctaggcaacatagtgagatcttgtctctataaaaatttttttttaaattagccggccataatggtgagcacctgtagtcccatctactcaggaggctgaggtgagaggattacttgagcctaagaagttgaggctgcagtgagccatgattgcaccactgactttcacctgggcaatggagtgagaccctgtctcaaaaataaataagtataaagcaaaatgtttgaggattttatttcaataatgccaatctattcctcttcaacgttttgatctaatgtatgaattgtgactctgtcctcttggcaacaaaagtaatgctgggtcttaatcaatgtgcattagtatgctagcaaaatgatacttcttccatatgtagttatatattaaatatatataaaatagaagtgttagatacgactcttatgattaagatatatctttatttaaataactatcccttactggaaaataaatatggatttatacatttttgattaataaatcaatactcatttataatctgatttataaatattttttatttataaacatttattgatttattaagtgcacatgatgtaataatggtttcagtgcctctgccaacaatcactggctgctaagagttgctagagtaatggattgaaaaatgcaaaagggcctgaaagcatggtacgaaagaccacagtgaatgatcggttatgtcggccaaggatgtgggactcagaaatggtagcaggcacatcaagagctttttttaaatctaccgcaacgtggaaaagtccagttgttctaccagtaggtgcttcacctttgtgaagtcacaattctctggctggctgtctactcatctttaaaatgagagttttgattagatgacctcttatgtcccttctagtttgaatattctatgatattctgaaaaaaaataataataatagctcttgtattagcatcccaagcagtctggtgtgggactagctaaatacaggcagcagtgagcttcgaggtgaaagctctgaggaaaaggcagagtagaagaagcaaactttcactgagctgtttagcctggagaatgatacctaaaaagcaaattaccctgtaagaggacttgggaggaaagtgcacagtgaataagtccatcatcttctcccatatattttcaaaaattattcctggaattatgttgcaaaggagtctcaggatgtttgcagccacaggaactggaaactatttcacaaaataggaagtgtagagatcgggcagattcagtgacctcacaatgttatgggtgaccccagatcttctgagctttttgctttagtgaccttgtgaagactttgtcttcaggctagttccctgaatggtgatgagatggctgcatgtagcaattggtgctctttgcttccttgttcggttcctgaaagagactagttgttcttccttagaagcatgagcaaagttctccttaccactatgtggtccaaattggttcctaccagctcatctttgaatctttggcaagacagatggaagtattctgataaggaacaaaagaagaaaaaagcaaacccttgacatctggaaactactcaacacatatagctgggcctcactgttagaaactaacctggcactcatagccaggccacattattatcctgctgggcataaacaatgtcacagaacataaacagctcaagaaaacccactctgagaccatgataaagtaagacaaaacaagactatttcataatttctctctcttttttttttttgagacagaatctctgcccagtctggagtgcaatggcgcaatctctgtgcactgcaacctccgcttccagggttcaaacaattctcctgcctcagcctcctgagtaactaggattacaggcacctgccaccaggcctagctaatttttgtatttttagtagagatggggtttcaccatgttggccaggctggtctcaaactcctgacctcagatgatccgcccgcctctgccttgcaaagtgctgggattacaggcgtaagccaccgcgcccggcctcatactttctctaagcgcagacaaagaaaaggtcactgcacaactcctgagataccaaacatccccgtccattagctactaagagtgactgctacttcattatgaaaaacaggtttagcctcactttagactgtcttccctttagagatgtgagatatccaatcataaaattatccccactttgtgacagcaccctatgcagaatgaatctccctcccttccttagactctcccccaaatcacccaaatgaactccaaattcgttctaacaccctcttactgagatatgctatggttctctgtggtatgtgttctccctcactgcaatgagcaaagaacccaacttcacctccaagtgtgttcctggaggtctctagctagagggcattaattctgattttatactaatgtttgctaacctttttcattattaccccccaaggagcctctttagacttttttttctaatcatcccccaccatttaattccacagatatactgtatatgtttgaggggagggggtttgaaagagggtctcactttgttgcccaggcgggagtgcagtaacccgatcatggctctctgcagcctcaacctcctgggctcagatgatcctcctgcctcagccctccaactagctgagactacaggtgcctgccaccacacccagctaatttttgtatttttagcagagacagggttttgccatgttacccaggctggtctcaaactcctaggctcaaaggatccacccaccttggtctcccaaagtgctggaattataggtgtgggccataatgcccagccgatgtgtgttttttatatagaaagggtaagattctctcccccatacatatcctcacaagccaattttcgtatggtttaaattaaattataagggggtagaaaggaagttgaagagtctaccacaatacgttaaaaagcacacaccttcttagcaatctacctttttagtacagtaatagtaacactcaatgctttttagcactttccacacaccaggcattgcttttatacatctattaattttacacagattaaataattttatccatccaaaaaatctacatggtagatgctagaattatccccagttcaaagctgaggaaactgaaggacaaatgagccaagtgtcatgccccaagtcactaggttaataaatggtggagacaccaaataactgccctctaactccagggaacatgctcataaccatgaggacacattgcctcacactcaacagcggctccagaaacactccgctcaatgcgtgcacaaatgagcaaacgagagtcataatttgcatgatactacactgccttgttccaaatacaaacaaggcagtaaaaattacggacataggataagacttaaaactaagatgtctgctatacagagaaacatattgacggaaatctttcggggcaaatttttaaagtctgtgctgcatgactcaaatgtttcagaaaactaatcccattctgtgcttatgtgtgtgtgtgtgtgtgtctgtgtgtctgtgtgtctgtgtgtgtatgtttacaaggtggaaaatgccttggttaagaaagggaggaagagagggaagaggaaaaggtagtatgttttcccctaaaaattagagattccgaagtgatgatgacatcctccaaccgctagatggaacgcagttctcccacaccatggccatgactgctcatttgaacttgctgcttcatggtcataaggccaggacttcctggcttcctcatgagccaccacattttccatatttttagagcattcttcctacagaagaaacctattttgcattgtttttacaactatcttttttgttgttgttctaatgttgccaaggaatcaagaacctcaaaacctatcttcttctgaggtcaagccatccactcacaggacttctcaagctggagcccttagttgagctgattttacacaatcgagtagagaaagaaaatggctttttgtggtgagcatctgctgttttgttaaaaatgtggttaaagacattaacaaaagtgacattaccagctgttgtaatgtcaagcagcttagctaaactgttttttatcaaatgacaacatatgacacccaaatcaattccaaaccaataacacattgttacttgtaaaacagagctgaatgagagtgagaatgagagcatgtgtgtgagtgtgacagagagagagagagagagagaggttaattaaaatacaaattcaaatttctcctgaagtaggaacaacagacaatatgatcctgataattttcattaagaaatttttaactttatcccagacaaagcaaaaaaaaaagacgattatgcaatccatattcttacacaagaaacagtgtatttcttttgtaaaattcttgtaatagcaaaaagatatgacggagtttctggccacttaaaatctgacttggcttctgtccttcagccatatacctcctaacgagtatgacaataacagaagaactgacttgtgtggctatgtttggtctctctatttttatctgcccatcatgtttaattatcaggctattaaaaggtggcaaatcggtagcattgccaactgcgttgtccctatggctgaaaagcctgtggcagttgaaacaaccaaacccttcccatgggcatcacgaagcttgtaaaagcaaaacggcacaacgtctgcctgcctgccatagtcatggccaatcctgaataaatgtttaatttccacaactgtgatgagggtagggcctgatttgtgccagtgcttaggaatctccgggtatttcatgtgcacaattattaatagtgtaattcacaaatgccaagtctacccttaaggcctgagctcagtcctgctctgctagagttggtgtgacttagtcatcaagaaagaagacactttcaagggcatgattcctcctggaagaaaaacaaaggagtgtgcttaggggataggacgcttgccaggaacagaaggtatgctgcacatggagagtgtttcgaggtaggtaactcaggagggacctgcatttgggggaaaaaaaaacccagaaccaacagaagcagcagaaataaacaagcaggtgtgtgcctctatgtctactacatgaaaggaaaacagggctgaaagtcacaatcagcatatggagacacacaaagaggggcacctgggaaaatcaatgtgcatcaggctcgatggtgcctgcttcctccaggagctcactgcattatcacaggtggataaagtcaccccttcaatgggcacaagtagatcactcttctctgctgagattggattaaaggcgacactgatgctaacagcaagaagaaggtaaaccggacgttggaaagaattttcaacagcaaagccacagtacaggacagatcaccaggagaaatgtatggggaaatgttagaaaagtatggaaagccctagaaatttcaaaagtccagctctgtgaggagacagaggaaggggcagaatgacctgaaaggccattctagtgctattactatacataggaaagcttccttgagggcattacgttttaggtttccaataaaggagagaccattttcaatattttttaaaattttgttgtgtcattttataataacttccaatgtagatcttttaattttactcttgcaataaacctgtacattttctatagtcacctgcctatttaagtcctttattacagaagaggtagaatataggccaaatgccagaagtaagggtcggttacaaattctcaagtgcttgtttatttctggattactttattgactcatttatgtaaccaatgagatcgtgcagtccagcctcagtttccctaaatatttagaaaacaggttgaccatgggatcatagtagtggggcatctggttttcttctgatagtgctatttgttaaatattctgtattatcagatgccctactgtgtgcctgtatatagacttcatcttattctaatgctaactttatgaaatgcatttcatttttaccttctttatagatgagaaactcgctagcaatcacaattaatatgaggagaagttaaaattggaacccatgactgatttcagagccaacattttttagtcactacgctatactcctacctataaacttctaaaaacactgttcacaagtacatcattcccctatggcttccctggatattgagagacctggattataattggaatttttgactaaggtaaacatttcaaccacaagacctgatagaatctttcctatgagaattggtctcaggcttacaacaaaactagcaagttcttccagagtacagagcacccctgtttgaggcaagacccagaactttaaaaaattctaacaaaggtcctagtttctcacacagagctcttggttttggataagacgactttagcctaggctggactgaagacatgaggggaagttctgcaaaagacattgtgcacacattatctctttcactgccctatggcccgtaagatgttcctaacctggaaactgagaactgcacaggtcaagtaaggtgtccaaactcacccaggtcctaagaaacagagcacagattcaagcccagttgtatctgcctccaaaatgagtgctcttttctgttacaatacatgctactatgtcacctccaaaggtaggtaggtactacctttacccacacgcgtgttcttgaactccccttacatctcacctaatgtgaaaagcctgcatgaccccctgggacatataaggccctgggtagtccacaaccaccacccctccacgtacacatcagccccctttcttcctgttaactgccacagaagcctccttctgttcctccaaggccccctgtgctttcctttgtacatgtggttcccctgtcaagaaaactgttccctacccatctctgccaccttgctgactcctgctcacccttcagacctccctggaggaagcctctccagcatccctggccaggccagatttctatggtttacagcagagtttctcaccctcaacactgttcacatttggggccgggtgattctttgttgtggggtctgcaccgagcatcatggaaagtttagcagcattcactagatgctggtagcacctacccctcagttctgacaaccagaaatgcctccagacgttgccagaagtccctagaggacaaaatcactcctagttgggaaacactgatctattgctctttagaatcactttccttatcttcagagcactggctccagagcacaggatgtgcttctgtcattctttgaccatctcctccacgtgaaaatgagtttcttaaaggcagagacagtgctggcttctgctcaccctcaaatgtccagtgttcaggggcatgcctggctcaaagcaggattccaacaaaaacattttttttggaatttctccctaaaaaaggtttggtgggagatcataaacttaagtaggtagctagtggaagactgctgaagcttttttgaataaaaaataatgccagcagagttcaggtcaggggaaatgaatccctggcaggatggacattaaccaaacacctaacacatcagcagaactttctgccaaaggtgttgagaggttatcagcagcccccacagcacaaacaggtgtcagaatgacatcccaccaaaatggcagcagggccctaattaaaagaagaggctgttctttcaagtattgccatgcagccatggcactgctgggatgtgtcaaatcacacccatctaaaaacacacaccacgacctgacatctttgcccagctgcaccatcccacgtttccgtgatggatattagaaaataatgtaacctcaactgacaagtttattaagacacagaagacattacagaggcccttttgacattccaatctctaacgcagtcagggggagatgctgacttgccatcattattgaaagtaattggtcaaaaaaaaaaaataaaagaggtgagagagaaggagagcaatcctataaagctgtcaggttaattatttggcctacaggtgtgctcagtgctcttgatctgcctaccactgggcttgccagtgctttgccagtgttttctccaccctcactcctagtttgggatagttcaatctaaagctaagagagtacatttaaagcagaattttaccttggccaagttatttccttgcctaattatacctacgtaccagtccaaatctccattcttccctatggctctgtcctgttggcataccaaactccaattttccaggacagataacccagttagaaacaaccgacttgtgtgaaatgccacagagagtcacaacgcaaaaacaagttttattcagattgaatttaatttcctaggcagtttagatcacagatccgaaacccagacattttcacaagccaggcaaataacctgaatgagtccagtgagtcagatgggagccaaaaggaagtgatgaggatgatgacaaacaggaacagcaggctgtgagctcagtgttagcagagaaaacccaccgtgccagggaagctgctgatgctactccctggctctaggtccaccacacgcagagtagatgctcaattaatattcagtgaatgaatgaatgcctgcccaagcattcaccctgttgtttccatgtctgttatttccaccagaagaatgttttgtaggcttaaatctccagtgccttcagcgcaactgtcatttggaaagtggtgaactttaggaattaaagaatggaaacaaagagtacatgggagtcactaatgcatgtgggagatactattcatgccacttccaagaatggggaatccgtacagctcattgtcataagtgatgttatttccaacttgttatgggtgagcattatttagaatagcttggaagaccacaatattttgcaatagacatggtagcctgtcagggatacaaaatgaagactaagactaagaatgtcaaatgagattataaagatacctatctttgctcaaataagcaaagggaaaaagtacaccctctgcctcttctcctctccttaaattccttttccccttactctctcaaggagtaaatatatatgctcatatataccaacataaaaaggacattggtagaagcaaacaatacagaagagtataacgggaaaaatacaggtcccactactgagaggtgtcctcggtgaacaatttcagggctgtgtgtgtatatttacgtgtgaaacataaataggatcgtgataccttacagcaacttctgtttttttcaccggacatctatggcatttttttatacttacaaaaatgcctcctttgctctttttatctactgttccataaaaactcactttataaacacaaaaggccaatttttctcacattcatcaaggaaaggctcctgtaatattgtgctcttttttctacctccaatattatgtttaagcaaatcatgagaatcaattaaaaagtggctaacattggcttgtttctactgtaaggactgtttttccataatttgggcttgaaaaaaaatagggttgtcaaagcatgaggtaagtagaagagaagcattaaccaggggtgttaggaacaggaaatgtatttttgaggaaggttttggaagaggagttatgcatccaaagggttcagaattatgggccaactattcctatgtacaaattgaagacattatataaacactacaagaactgaatgcatactcatctttggctgctatttcaaacttccagggacaaatatttgtccttattataaacatacatccaatatgtgttaagtgctcagaacatgtcaagcagtgtgctaagcagtacccatgtactatctcacttaattctcagattcaccctgaaagtaaggtactattattatctccagtggaaagatgaaggaattcaggcttaaggctacacaaagattagtgagacagcaaagatgaatcccagcaatctatctccagaacttggaccctatgaccttcacattatacgtttaaaaatgtcacagacagatggacacataaaactgtgttgctttcatgtcctgggtttctcttctaaaagcaaagcatatttttgttttctctttccctaactagatttccattttctttggtgagcttaagggagtgccctgccaccttaataccaaatattatatctagggtgagaaggagagaataggaagagcaagcagcaagggccttcagaaactatttgtacttgcctcccaagatagggcagcttgaccttatccatgtggctgacagtccagttgctctagtcatgcacctgtgagactactttctgctccctaaatatgccaaacacacaccatgctttgcatgggaactctcccacccctcgacactacccagttattcacatgaaggagtcttcactttcatcagatttctgctcaaagactgtctttcccccctttctaagagttctgcctcattaacctcttatcctataatctgttttgtgttatttttggtacttgtggaaataaagtgccatacacagtcaagtgttttgtgaatgtcaccatcactttaagcctcatagatatcccacttctggaacaatagaagtatgatgcttgataactatttgttgactaaaataatacattgcatactacttgaaacacacctcttattctagtaggaattatctaatcaaagtttgtgcatgtatgtaaatatatccatatatacacatgcatatgtgtacacacacacacatatttgcattttgcagtttagactcttaattaccaatagaggaaactcagtaagtagcatgatagaaatgcaactagtataaaccaactgaattacaaacacaggacttagaggataactgggcattgcaataattgtgaaggaagatgcttagtgaatgattagagggcaactatgttctgatatctgtgaatgaactgcacagtcttcattaatttcacagaaaattcatttttgtcctgttgcctatcctgccatgaaagtggagaattgctcagaatctagctttagataataacatttgtaaaaaattaaaatttgtggcagggcgtagtggctcatgcctgtaatcccagcactttgggaggctaaggcagatcagttgagctcaggaatttgaaaccagcctgggcatcacagtgagacctcacctctacagacaaaaagcaaaattagccaggtgtagtggtatgcgcctgtagtcccagctttttggagggggaagatgggctgagcctgagaggttgagaactcagtgagccgtgatcacaccagtgcactccagcctgggtaagagagtgagaccctgtctcaataagtaagtaaataataaacaaatttgttatcaacttgtcctgagttgatcaagttgctatagttaactatgaatttatttctgattttgatgttcatagttgcagaaactccaaaaactcctagtcagtacacagacggaggcctggcaataaacacttgaaagaattgcctgttggatgaatgaatgaaacaagagaccgacagacttcatccctccagagagatatcttctactgcttctctatgattgttaggccgatgtaattaatctaacacatggagcagattttacccttcattttcaagtacattgtctattaacagcgtccatgagccctctgattatgcaaggttcctgttaatggatctctgccaataccaaccatcaagctaatgatctgagcttgccagctccaaggtgaaggaccactcttgggcatatctctccaggactcaaagaagaatcccctctccaaatgatcttggagaagcaggtgtccactctgcctgccagaggctctgccagcacagggtgggggcatcaagggaggagaaaataaaacccagtaattcatatgggttgagattattgacttcactttcaaagaagataaagtgaaaaaggaagaaccgtgtttttgaaaggtaagacaggggacattatcctgcgtttcatcaagtcagctttttcatgtcaggcgatggtatatctcctgtaacttgtcaatggcaccacacagtgaagctaaaaggttgaagattatttttgtaacgattgatactctttctgccacagcagtcaagcatctgaagattcttcctttctctcctctgctctggtgaatccttttaaagttcttgggtgaaagagctgcaaaccccagcagatatcaaacctgaaacactaacttgacatatcgggatgtgtgctgctatattcactgcttggcttcaggccccttccagagcacttgaaatacagttggaggattctttgaatatggggtaaaagtacgtggatgacctagattgtcaaaggattctcttcaaccaaataagaaagtaagtttgggtcagcacatgctatcagctagaaagactgctcaaaattgtgtgtgccaaaataatgaaagaacgtgccaatacgtcaatccacgtttgtttcctgcccccgttcctgccacttcacagctctaaatagaaacacacgaagagaaattccaatgaaacaaaaggaatatctgaaggatctcacagctttcaggggtactgtaataccctgaaaacagtgtggttattccgggctccacaaactaggtagaaataaacatccatcattgcatagggcaggaagaacagcaaaagcatgttggctaatttataaatgtcacatacagtgttctttgtttcattgcatagggaggcaacgtaatgaaaacattaaaaaccatcttttggtgataattgttgttttaaactgacaaattatataagtcaaagtgaaataatctttgcaactccatagagaaacagaaaactattaaggcccttagaaacatcacaacccatgttcccctttcaaaggttagaataatcctgagtatattttgggaaagtaatatcctaagtcagtaaaaggtcagtgacagggaagattcttccacatcttcaggagacaaaaagtcccctggagaagagaaaccaggttccctggtgacattccgcagaaatctccagctgttagaagaacttggatctccgaggccacccaaacttcaacttaagaatgcaacaaagtggggatgaaacagttcccgggagggaggaggtagaataaaaatggaagcaaagctaccctacagcactaatctgtaaacctgcttcaattggcaagaaaaagaggaagtactacacatgcctgaaatgacaatgtagcacatggaatggacctctgctgttttcgatgatccagcattcctcctgattttcctttgggagaatcatttttcacctactcacagttcacatgattggagaaggcgccttctgggtacaggcatataactaaactgaataatccattccctgacttcatctttcctgtgcgagttggtccaaggacttttgttgaaaccactggaagagagtggctttcttgacagcaggttaataagatggatggaggtaatcaggttggcaagtggctgggcaactgtccttatcaccatacaaaggaaatcttccagagaacaaaggaatcacagaaggaagtggatgtgaaagacagccagagattcccaacaatatatgattctgtaaatccaaccatgaatgaagcttggtatccccactatttgagccaataactcctcctgttggctgaagttactttgacatgcattcttatcacttgcaactgataatccatcccacgtgagtataaatgtgaagaaatcattctaagtacatccaccttaccaaatggaccatgttttgctcaccagtgtgaccccagcacttaggacaagagatgatgtgagaagacttcaaattattgttcaataatttttttaatgattatttgttaactcatgaattatcttccatattcatatcttttaaaaatgaaagaaaatcaaagcaggtttctcctttctgtctaaatcctagcaagatcaaacactggggaaaaaaataacattctcccatatctatctgaccccagaaaaattattacttccaaatagtatttagtttttggcagttatttatgaacaggtaatctatataatttaatagataaacctatttaattatctattttttctcccacaaacaggaagaccagtgtcaaaatattgagcaactctcctaagaacaaggcatgcaatctcaaattcctggttttcagaaaaggttaattggacaagcaaaaacaaggagccaacttattggggagaactggaggcctaggaaaaagaaaaggcccaactttctatccccaacagacactttgggaactgataaaattaaacatttttcaaagaccctccatttcctattaccacaagaaagtcaaaatatttctatcttttaatttaactttatcttgcttttctttttgaaattttaatttagggcaatatttctgagggatgctatttttttttaaataccttctttccttcagctaatgtaaaacaaatagttactcctggaaattactttttactattggttccaaagctacaatttgcagcaaataaaaggactcttcccttctacagaaacattcagacaactacatattgagaggaaggtttatgtgtacttggagcctttgggtgatgttctctttggccatatgatgtggtactcccatcagcctgccatttagtgactcctatcaaagcaaacctctctaaaaacagacacttcaaagaagatgactaattgtgggtgccaactggatgctgaattgctgaatttctgaatggtttccatctcattttccaaagaaaatgtaaaatttcagagtaaaattgccacttttcttttttcacgatgtagtatttggtggcttttaaattcacagccttctattcttggaattttttaaattttaaattaactttccttccttcattccacattcatgcattcatttagtcattcattcattcgtttttttggagacaggatcctgtcctgtatacagcccaggctggaatgcagaggcatcattacagttcactgtagcctcgaacttctgggctcaagcaatcctcttgcctcagcctcccaaatagttaggattataaccatgtgccaccctgcccagctattttttttttataaatgggatctcactatgttgcccagatttgtatcatactactggcctcagtgatccctcttgacccctcagatcattaaacatttattaaatgcctttcacgtatcaggtagtgaaccaatgctgagaacataatcatgaacaaaaatccaaacagccccagtttttacagaatatccagattagtaggggagacaggtattattcaaacaagcacataagtttcttaatacaacaaaaggcgcatggctcttcaaatacaagtaacagaggaatgaaactgagctcaggaagtcaggagagctagttaagggagtgaaaatacgagttgagagccaggtagtaaataggcctagaagaagtatgggttttttgtttgtttgtttgtttgtttgctttgagatggactttcattcttgttgcccaggctgcagtgcaatggcacaatctcagctcactgcaacctccatctcccaggtttgagtgattctcctgcctcagcaccccgagtagctgggattacaggcatgcaccaccacgcctggctaattttgtattttttttttttttttagtagacatggagtttctccatgttagtcaggctggtctcgaactcccaacctcaggtgatccgcctgccttggcctcccaaagtgctgggattaaaggcgtgagccactgcaccaggactgaagtgtgttttgttagaataagagaaagaaagacgtgggataggggcagaaaaaatgttgggaaaacggaaagaacagcaggaacagagaccctgtagtggaaaaaacttagtatatgtgaggaactaaaaggcagccagggtggctggatactgagacaaggttggtgtgagatgggcagaggctcctccaagcaggactgtccaggctgttgcaggaaagaggtcttctgtctactagtaatagaaatgatccaatttactccattaaagaaacaaaactggatatattcaacacattttctctgtatctaacatttcagtagaagtgatataaagattgctaccacatattctgcttgcttcacctacatcttactgtatgatatgggtaacgaataaaacacattccccctatctccattctgtatgtatataccattattttatttcatcatggtatctgaaaagcaattataaatcatgattacagcagctgaaatttgctgaagacttactatgagcacggcattggaccaactactttctgtccatttccacactaaaatcagctacaaccttaaacagactgtcccatccaaagctagcctctcaggttgaaagatcatgatggattatgcagcagggacccaccattcccagactggtatcttagggtccagattccatccatcaggcacacctgggaagaaggcaacctcacttggccttctattcaccagtgaatctcaagtatctctaatgatacttgtggtagtgcagttttctgagtcagccaccctggtatgaattagactgggtaaagtgaatgttcatccatggatgcagctttccattttttagtggcttataaccaaggcatactgctcttaggagtttatttcagagaaaaaaagtatgaacagccaccatccttaaatgtacaaccttttctctgcaacagcttgtccttaaatccaggacacaggatgacaaatgggtttccctgccaggtcctgagaggtctgtgggaaggtgaggcctaggcaggagtggagatcaacgaagcatgaaatggtggatgtttccggggctgcagaattttggagaattcctcacgctgtctgctcaactggtctcagttctcagtggactctgtggggtcaggaggagccctttctctgggttttccctctttctccctcagcagagaaaatcgagaaaaggacattaaattcagtgcagtcactgtgggtgctaaaatattttcaggatcaatggtggtgctaaactatctccatgtttctaatatatatatatatatatatatatatatatatgtttttttttttttttgagatcgagtctcactctgtcgctaggctggagtgcagtggcgcgatcttggttcactgcaacctccgcctcctgggttcaagtgattctcctgcttcagcctcccgagtagctgggattgcaggcatctgccaccacgcccagctaatttttgtatttttagtagagacagtttcaccatgttggccaggatggtctccatctcttgacctcctgatccgcccgcctcagcctcccgaagtgctgggattacaggcgtgagccaccgtgcctggcctgtttctaatatttttaagactgaagtgctttttaaaaagaaaaaaaaatcttatggctacaccacaaaaatgcagtgtccttgggtaagggacccacccaagccccttggccttttactttccaggtatcatttttccctttgatagtactcttgtgtctgcaaaaaatgctctgtcttgatatgctcctggactgtaagattttgattgttttgttttatattttgtttatgtttatatgcatcttatatttccctgaaaactaattaacactgttggcctttctaactggaaaaaaagtctattatttttatactagtgttacaaaacagaagttcagagagaaaatataatttggccaaaatcacatggctaatgagaagtcaagttggaacctgattataaatctatttgctttcaaggtccatgcttttttttttcaagctcagataaatttcacataatataaaattaaccatttaaaataaaccactcagtggcatttattaatatcaattcataatattgcacaattatgtctatctagttccaaagcattttcatcatcctaaaataaaacgccatgcccactcagcagttatttcttattttctttttccccagcccctagaaatgaccaacgtgctttctgtctctatggatttacttattctggatatctcatataaatgcaatcatacatttgagtcactacagcagttaacacagtgcctggcacgtagtgaattttaaaaaatataggttgactgtgtgaacgaaaggataggggtggataatgattaaaccaccataaaatcctgagatattgttctaatatccactgcatgctctccacaaatgctccttcgaattttatcttctgtgacgatgacactatgtcaacctatccacagagcccagcagtgttaatgccgcatgttaataaaacacccctctttccccacagagctggatttttataaaatgaagctttagaatctagataaccaggacacagtacactgaatgtctactcctaatatgtttgcacaaagctaaactacacatattgctacctaaaatataaaactaatgtgagtgcctacagaggaaaatgtggaatgctgaatagggtgaaccccctgctattagcctggaaatgatgactctgttgtgaatctgtcctacagggtatctcagggtctgagataatagcataattatatatgctaactcttcctagttataatatcttggaagacaaaagatatagggtaggagggaagaaaagttaagccaaacaaaaagaaaagactaaattatttttactcaacataatgactctttgggaagtctaaatggcaatacgagcaaagttacaatgcatacttcagaaaggagaggtaagatagaagataaaagctgtgcacatttatacacatattctacaatggacaataaaatgagaaatgcacagtttttcagaagggcaacaagaacacctctacctcctctaaaaattaggatatcaccaacaaatcgttcaccaagttagaagctgaagcattttaaaactcaatgctattaacagcatacttgatataagcagaagacagtgggtttcattactgttaactaccctagtacaacccatagaaaccatgactcagtctgaagtagcacactctaatagaacttcctgtgataatagaactgttccagatctgttctgtccaatatggtggccactaaccacatatatttactgagcatttgaaacggggctaatgtagctgaaagacgagttttaaatatcattgagttaattaaactcaaagttaaatttaaatagccacatgtggccaggtgtggtggctcacgcctgtaatgtcagcactttgggaggccaaggaaggtggatcacctgagtcaggagttagagaccagcctggccaacatggcgaaaccccgtctctactaaaaatacaaaaattagccgggcatgttggtatgtgcctgtaatcccagctactcaggaggctgaggcaggagaattgcttgaacccaggaggcaaaggttgcagagagctgagctcgtaccactgcactccagcctgggtgacagagtgagactccatctcaaaacaacaacaacaacaacaaaagccacatactagtagctactatattagagcaactctatcagatattaattagtaaagaatatagaaatactctctagcatagtttacctgcatttcataagggcaatcaaaatagctttaagcatgtgtagtacaggcatacttctcaaactttaaggctgtgtgatatataaacaaacacctggcaactgccatatggaaacggacaaacacctaggtaggtggggtagagatggaacaaagtggaaaaacacaagtcaggtaagtaaaaaagctcatcgagggctgaaatgtcccaaagacttggagagtcaggccttcctaggagctttccatcttacaaagctgagtattggcaaatgttaccagagagatttagcacgaggaggaagctggtttaatgaaaagagctgcgtcaatcatgagccgatggaagtcctgctctagcctttggctatcgagccataaaatccgttgcttggaaatatgaaacccttttggctacttaatgttttctccaattcctctaactcagggaaaaggatcatggaaagaaaccaaggagggcaaagcaaggagaaaggccagaaatccaaagaggaagaccagaaacaggaagaaaaaatacaacataaaattgtgggagaaaaaaaaatgctcatagggagactggatgctcccagggtgaaaatgatgaaaaatctgtgcgaaagagcatgcccaagcagttagcaaagacctttgtgaatttatgtacaaaaccacaaattacacacatgcttcccaggaacaacaaatgctgcccataaaaataaatacctgccattaaaataaataataaggaggggaaggagagagagggtcagggaaataatacaataagccaaggttaaaaaaaaaaaaaagctagaagaagttgaacttgacctagaatttgatagtcagttacttaatccagaaaaaatgaaactgccaggcaaaagtactagcacaactggctatgaaaaaaactaaaggcattcacaaaggtattggtaactcgtcttatgatcagtttctccctaacactaaagtttccaattaaaaataaaaaacaagtgaggtaaaaggaatgattctaactatagtcccttcgcatagaagtaggtcaaaacagaagaggcttactgggatggggaaacagacaaattccattttgtaatacaccatggagaaaggtgtttattgaaagtggcagctttagcaccattgttttgcactctgagattagtgatttttgaatcacctcctatggtattacttttactgtgcatttagcaatgtcagctgagatataattatgccaaacctagtgatatgatcatctacctttcaggttcagctaaagagttctcactccatcaagacttctttttctctgaaaaggattcccactaaaatactgtcatttcctttgctttgtcacaatcacattttggtataggctggactgggtcagtgctgtgaatctgagaggagataatgtacttcaagtcccaaagtattttgagttgctggtatgccacataggattacaatcacaaaagaaagttaatagtgtgactcaatgctgagagtcctagctacgggaaagtgagacaagattggtttcatacctggcagcactagaatttaacgttaatatgaagtgtcctgattagctattatataaaacactgaaagaagaaatttctgttcaggaggtattcagaagaactgaggaggatagctggctatttagtgccagagagccaagtcaacttccaatccccatgggcttcttcagtgcacatgacctatggccaagccccatctttttatttcacaaatgttaacttcccaaatgggttagcaagggaaaactatcattattataaagaagcgcagataaggcagacacaatggctcacacctgtaatcccagcactttgggaggctgaggcgggcggatcacctcaggtcgggagttcgagaccagcctggccaacatggtgaaccctttctgtaataaaaatacaaaaattacctgggtgttgtggcgcacacctgtagtcccagctactcaggagactgaggcagcagaatcacttgaaccctggaggcagaggttgcagtgagccaagatcataccactgcactccagcctggacgacacagcaagactctgttggtggcggtggggggagggagaaagaaaaagcacagatatgtcaagtcagattcacttcatcaactctaagatttaaataatactaacactttactcactatttaaactacgttgtttttcgtccattagctcttcctcagcaatctgatcccatgtgatatatattgaagaaagactttcacagatcaaataaggtagggaaattctgaaaactaaactgtattcctagaaatataccatggtatgagcatattaaagaccctgagaagttctgcagtaaagaaatctgatattgccctctgtattctcctaaagcgttttagcttggggacgattttccctttgttctttatataaaatacgtattaccatctcatattcagagccctataaaatatacttcaagaaatactgaggggccccttaattacactataagactcttaacatacagtaggtttgtaaaaagatagtaaaaaggattaaagattcctcagaattagcttttcatgggcagcaaaagaagtgagaaaagaatggtatttattgctacctaccacgtggccgcattccattaggcgcatttcagtctcagtaaatcaccgcaacaattctctagtaggtatcattattctcttttatgcagaagagaaaaccaaagttcatagatgccacacagcccactcacggtcccagagttaagagacggcagggcagggatttgaaaggcctgtgccctttcccctatatcacagtggtgtaatcttttcacactatgcatacttctataaagcaaaaccattttgaaatatctgtcctgtgtgacatcacaatattgttaatggtttccttctgtttccagttgtctgcttagtataatgaaattaaaccattaaaatggaaatggaacttgttccgtgaccttccctttgtgagaatatgccaaattaaatcaacatgggatttttggaggatgtgccatttttttttaagaacagggtctttctgccaagacaggaaaacttataagaaattcaactacctagctacaggacctcaaatattaggttataatacatgtttctgtaggttgtaagtgtgtaaaaaaaaaaataggttccttcaggtttaagaaatccaaggtcatgaaaacaggcatctggccccagctagaaccctggtctagaacactaaggaaaagctaggccatctttcatttcttcctgacatcttggtctctctaaacgggttctcttcgttctgcatgctacatgaaaggaaacagctaccattaattccccagtattgctctctcctcatatgtgaggtcaaatagattcaagatggaatctgaatgacaattctaaattctctgaggaattagagcccaaccttggaggcaatcctccacggggactatatgtaatatatttatgtaatgtaaatatggccaatggaaattacacagctgtaaccacacaaactgggacaagcagcctctggagagcatggagagcagtggtgtttaggccaccaaaacagcttatacaaagacttgacaaaaagcacacaagctcgtcaatggaaaatttatgagataatgctgaagtgatttttaactaggaagatcacgggcagcaaagtgagtcaagttttaaatgaaaagtagaaaaaatataccgtgctgttgcaacaaaaataacccaacttgtgcttatgctgaagttataaaaaggagaaagagaaaaacttcacacctgcaacagcatcattaaaacataacaggatggtttgggtttgtcagaattaagggccacctgctgttccacacttcaccctcatcccaatcccagtccctgaaagaaatgaaaagaaagctgaaggaattttcatggagacaaaatcgagcagagactggatctgccaaagactatttttctagtcttcaagaaatatcctgaagtactgtttctaacagcttcattttaaaaaatattttagctctttgtttgtcttaggcattcagaatataaaatgtacattttatattttaattctctgttagaaaaacagggcatatgttgtaaaaacgtatggaggtcttcctttataatttgacgttgatgctttttcacagataagcatttatctttcagaatctaaataaaatgccatatttaaattttggaattttaatctgtatctggaagaaccaaacagaattttcaccatctctaaattactggattgcaagattaaagaatcaagtactttgatcttatttaacttgtacagtactcacaaaatttaaaacactgcacatattttaaacaaactaagtaagcatttacttatatttgataatctggatatttttaaattttctattttaaaatgaaggtgagtaggaaaaattacagtctctttaaagtaccatgagttaaactgccacattgatggtaccatttaccaaccagctatgagaagtaacaaaataaagttgcaccaggaatattactattactctctacaatcattacacagattacaaatttttttaatttttttttttttttttttgagactgagtctcactctgtcaccaggctggagtgcagtggtacaatcttggctcactacaacctctgcctcctgggttcaagcgattctcccacctcagcctcccaagtagctgggattacaggtgcccaccaccacatctggctagtttttatgtttttagtagatacggtgttccaccatgttggccaggctggtctcgaactcctgacctcaagtgatctgcccacctcggcctcccaaagtgctgggattacaggtgtgagccacagtgcctgaccccagattacagattatcctcattttacagatgggaacatctaggttcaaaaaggtaaaggaatttcccaaggatatatagctataggctaggattcatggcctggtctaatgtcagaagcaccccctattaccactggcatcaacagaagaccagagtagagtttaggttgttagtaaagacatgtttaataagcacaaagcctcttggtaataattaaaattgaaaatcttcatacagatttgtgatctggtctcacaaagtgaaaagctcaatgcatttcttttgcatttattgactttaattttcatttccatagctctttatagccttcaagatattgtcacattatctcattctgacagttatatccttcatattttagcatttattaagttgttacatgtctgactccaaaagaaatggaggtacaccctcctatatatatctctacctgtgatacatcatagcaatcaccttatgcatgatgctctgaaaaacaaatccgaaatatgcaacagcctagataaatgggatcacaaaatccctggtggggacttttaattatatgctaagtaagaggcaggttatgcagaactttctgaaaaaggggcagagggttttcagaacgatatgagataacttctaggctgttgccatggcacttgtaaactgtcctggcgccaatgggagtgtctttatgctaatgagcaatgaaggcaactagaggttgctttcctccccacctggtagttttggctggcttcttcactgcatctgaaaacgggattgactaaatcctgcttctattagtgggaccatgacctgaaaacaaatcctacaggcctcctacctcaacaaggcagcatcaactgttctcacaataaaccaaatatcaatgattccatgatttggtgagagcactgcctattagcatctttaagtagcacaaaacatggcagcagacgctctccttcatattaggttgcatctagtcactaggcaaaatcttggttagtttcctttcattttaaattttgctcagaggcccagtgggcacagtggctgacacctgtaatcctagcactttgggaggctgaggcaggcagacagcttgagccccagagttttgagaccagcctgggcaacatggcaagttcctgtctctacaaaaaaatataacaacaaaaaagtcaggcacagcagcacaaacctgtagtcccagctacttgggaggctgaggtaggaggatcacttgagcctgggagcttgacactgcagtgagctatgatggcaccactgcactgcagcctgggtgacagagtgagaccctgtcttgatcaatcaatcaatcaatcaatacttgtccaaatgagttgttagttcctccttttattctctataaatgctgccagtcgggggcagtgtgtaaaaagcagaaaaacaaagtcaaaaaataatggagggttaaaaaaaaaaaaagaaaaaaaagaaaaaacaatggagggttccactcctttaaaagatattctgtccatgacaactccccctctgcccatttcctgaaagaataaaaaggatatgtagttctttctctctgacatcttctgaataaagtatcaccttcaattcaaacaggtaaaatatcttgaaaaagtggtcagaggagctggccaggcacggtggctcacacctgcaatcccagcactttgggaggccgaggcgtgcacatcacttgaggtcaggagtttgagaacatcctagccgacatggtgaaaatccatctctactaaaaatacaaaaattagctaggtgtggtggtgcatgcctgtaatcccagctacttgggaggcttaggcaggagaatcacttgaacccaggaggcagaggttgcagtgagctgaaatcacaccagtgcactcaaatctgggcaacagagtgagactctgtctcaaacaaagaaacaaataaacaaacaaacaaaaaaataaaagtggtatgatggaggattgttttgaaagtgttttgttcaatttgaagtcaacaccgtgactaacaagtttgactgacagtgtccctcaatcagacacacttagaagctccacagacttgaccagaggttccacagacattctgggtacttcaaaaaatcacaccacaggctcaagtgtgccatgtcacactcttttcaaaacttgacaatgccaagtcaatcaaggaaactgattaagtgatgccgacaccctcttgcctccccagaatccctttaaaaccaagaccaactgtgtccaatctctattagggccagtaacttttactaagaaaaaatatttcctactgtggcccagatcctgatgacagtcaacagcgttaacgtttttactttttaattttagactagttttaaatctacagaaaaattataaagagttcagagttcccatatatgccacacctagtttccactattattagcaacttccatatatgatagagttgttacaatcactgaactagcattcataaattattatttatattaatttatttttcgtttttttttttgagtcagggtctttgccactcaagctggagtacagtgacgtgatcagagctcactgcagcctcaaactcctgggctcaagtgattctcctgcctcagcctcctgagtaactcggattaccgggcattatcacacctaatttgttttttattttttggtagagaccaactcttactatgcttcccagactggtctcagactcttggtgtgagctaccatgcctggcctctgagacattactattaacaaaagcctctattttattgggatttccttagttttcaatctaatatgctttttctactccaggaccccatccaagataccatattaacataacttatgttgcttaagacttttcttagttgtgacagtttatgagacctttactgtttcttatgaccttaatagtactgaggcaagtatgttgctgaagtccctcagttaaggtttgtctgatgtctttctcatgattgcactatgtctatggttttttgggaggaacaccacaaagataaagtgccatactcatcacatcatagcaacgtccatattatcaacatgacttatcaccgatgatgttaaccttgatcactggttgaagtattgtttattcaatttttgcattctgaagttactcttttttcctcctttttaagctgtacactttggacaagaaaccacgtgtggccgacatttaagatgtgagagctaggctccagctccttgcagtatttatgagaactatccggaattctgctaaacagatttttcaattctacctcatttatttgtttattcaatcatttatttccatccctatttattcaaatctttttttatattttgggttataattcaatagtgtttattctgctgttcgaagcgacccatctttggcgcttgggaactccttgagttggctcctatgtccctttaacacactcccattattgtgatttattttgttgtgttttctgagcactgtcttacttcttggcactataacgtgctccaggctcatcatgtatatttcttgctgaagtcccagaatttgccatttctccaaagaaccttggtttcttttattgggaaatggaattagaaacaaagatctgggtgttaggtgtatttgttgctcccacggtttattcgtgaagcagaaatgtaccctggttttagtaaatgcagaatgtcaggtatccaccatttacagcgtcaaattgaatagtttcatggtgtggggaaaaaaaaaaatcgcatgtttcacctattaaacctcaccccagaaccttcagtaacaatgatttgtttaccatctccatggttttgtctttaccagaaagttaataaagttgcatcatgcagtagatagccttttcagactagcttctttccttagcaatatacatttactattcatccatgtttctatgtatagttcattcctttttattgctgagtaatgttccattctacagatgtaacagagcttgtttattcattcacttattgaaggacattttggttgtttccagtttggggaattatgaataaagctgagacaaacattccagtgcagggttttctaatttcataagttttcatatcagttgggtaaatacctaggtatatgactgctggattgtatggtaaaactatgtttaactttgtaggaaactgcaaaactgtctttcaaagcgcctgtgctattttacattctcataagcaatgtatgagagtccttgttgctctacatcctccctattaatggtattgtcagtttttggtatttggtatttgctctacatcctccctattaatggtattgtcacacaccagtggctgtgtgatagtatcatcttgtactaatttgcaactctctaccaacatgtgacgttgaacatcttttcatatgtacgttttccatctgcacatctttagtgagctatgtattcagatcttttgatcatttttaaaattagcttgttttgttttcttactgttgagttgtaagggttctttctatattatggatacaagtcctttatcagatttgtattttgtgttctcccagactctggcttggcttttttcttcatagtgtcttttgcatagcttaagttttcattttaattaagtgtaacttacgatttttttcatgcattatgtttttggtggtgtatatacctactaacacattaccaaatacaagatcccagatttttttctagattttatacttttgcatttcacatttaggtctattattcatttgagtttttttgtgacatatgcaaggtctttgcttaagttcatatttttacagtggatgttcaactgttctaccaccatttgttgaaaagttatcctttctccatgtagtcacttttgtgcccttgtcaaaggttgactgaatttgtgtgagttagtcaactgtttttcaaaaaggctcagcattttcgaaaatccaagaaaacaggaaggtttaacttgaagccaagagcaacttgacagtggcagggcaatgtcatcactactgtgtatgtaggtcaaaccaagaatgttacacagtcataacggaggtgggctgcgtacagaacaccctgcatctcctaaatggtttataatcactgattaatcctctgtgagtatagacgggcctcattagctctagtaacaaggaaagacagtgttagattgataaagctaaggttgggaaagagaaattagagcagaagagctgtaaaaaggatggaaagtgccatgcccgcaaactttgtagatggatgtttttattgtatttgtttttttttttaacaaataccaccatcttttcattttcttcctatgttctacactccctcaaattaggaggcataagatatttaaattcaaatgggagctttctactctagctcccactgatgtgtatttcttattaaagctttgtgattattttgtattttaccagttcatgcccgtagagtgttgaggcctattttatcaaaactgaaatagctcgtgattagagcttacttaaaatatgcaaaccaagacaaggtcaaagcaacctttctttcagagggtcctgtgggggatcaaatggtatacattgtgattcattttcattcttcttctgtgtgtttacccatgatggccagggaacacaaaatacaagcctctcactggagtcagcgtgcaaaatgtgaaaccccctaatgtcaaactgcaatcaacacatcacaagcctgtcattaaattggcttcacaaaataaaagtgagaaaaaagacaaatgaagttaccacacgtaatacagaattgaagtggatgaggctgaagtttagaagagaagttgtcctctgaggaccgaagtataaatgcagtttttaaattaggccatggagggaaactcttggattgttccattgctggtgccctcggaagccttcacgggtttcctgtgaaacacgcaatgtaaagcagtgaatgcagaatatttgatcctatctttgtgttaatgagtcttcaatctagagagtgggtgatcacttacaaaaatggccttctgctgactcaccagccctgcctattacattcaccctgctcctgcacaaagccagaaaaactgaacaacaagcagcaaataaatttcaataaacagatttattgtcctatttcaatacaaatcacagtctattaagaataatgcactctagtccaggttctgacagtcaaagatgctgatttaagaagagaattgtgctcctaatttaattcattcatttgcatctctctcttctaagtatgatataattcagccttactgatcatagctggtaatcactcctctgttttatggttaaaattgtgcttttaaaaaattacaattctacctatttatgtggggatttttatatattatggttctaggatgaatggttattagatgacaataatgaaaaaggcaaggtttatcaaagtgacctctgaaattaccccatacattttcaaaatgatgcacctgtattacacagagcatcatagattccaagcacattttccataactaatgatatgacttggaccatctacaccttttgtcagcactgttttctgatttcaacatagtacaatccattgaatgtcagactctaacaggtgtctatgaactcagggatcttgacagtttctttcttttttttttttttttttttaccattattacattaaaggcaaacagaattcagttccttcaaaattagacattttcaacttatgtcccagctttctgttattccacctcacttttgtacttggtaaaataaatagatcacaccgtagatgctgacatgcttctatcacatattatgatattttggctttattttttagttgaaaaagtgactgtattttgtaaaattatacacaaccaagagtttaaattggattcaatgtgtgtatgctttccgctgaatgattcctttttctctgggtcttgcctcaaacaagaaaccattaatgagtagtgaaagctttggacacagattttgtgaagtttcatatgagttaaggagtgccttcatttcatccttcaaattttgacagtaactatttttataaagaaattaattcagcttttccaaacttctttacattgcatcataatatatatcacaccatgatgacaaacattgaatctatttctattaaagacaaacatgcacaatttccatctcaagtgaaatcttgagcaaggatggaaacttctcaaagaaagaaaaaatagtaagccaccttgtattcttaagaatgcagaatttcaaaatgagacatttctgagctgcctctcacaaagcaattttttttttagccgcagggcaccccagtagaagttaaaaatagattacacttctattcatctaaaagaaggacactaatatgagcactgtagctttctgcacttcagtaaaaatcagaaatgatctgcagcccggtgaataaagttgattcacttagagaacaccagcatttctctcctcacctagcttttgaaagcaagcatgagacagcccctgcctacaaaattgcagaggaattactctcaattacaggcttctgtctgttaaaaagtagagctggtgatcagtctgaccttttttctctgacaagtcaaataaatgaaagggaaaaaaaaatctgacaggtgttcaatttagaagctgggggtgggggggaaagaggagaaagaaaagaaaagcttgtattctctaactagatctccggatttttttgtattattcatcctattttaaaagttccttttcagtgaataaattgcatgtggcaatgtaattttcttaaagtcactcacctaatgttttaatttgagtatcatttactgaaatcttcccacaatcaatcattcaggcttttagtttcatactttagatactttagggcaattctgctgaatgctacaactccgccctacccccattcttccttccttcttataagtagattacaaatgaccacagaagaatgacttttctggttccctgcatttgctatatttattgcaagacatggcttgtaaacaccagcctccacattttacctgataatgcgatcattacagaattcactagaatttggtcggcattggtattatttgaatgtgaatgttttagtaatgacatgaatcgtttttcagctctctgacatttacccacgttttttcatttcaaaagagttaactactttgctaaggactgaaaaagttgttctgatgaaagttaaattctaaaacattctgtattcttcggagttggttggttaggttcttgataatccagcacttgttcagcaaaactactaattagaggtggaagccatgtatgcattgaacagttacctcttcaagtttcaaagagagaagaaggaccaaaggatgctctttcccttaggaacccatctgacctgcatttaggccagttaatgatgacttccattcagctttgaaacatgtttcttttaagtcagctacttttcagtagggaaaaactattttgagaattaatcattctcaaacatcatacagaagccaaccagttaaaataccacaatcttaaacagacctgcaaacaacatttggaaagttgaattgtgattgactgatgacatcacagaaccaaaataacgtcccacattcacttcttgctctgttatttttgtttgcttcataacagtcagaactgcttttctgagatggctgagacagttttctcagaaatgacgcagtgaaatggctaatggccagagagtgggagtgagatgagaccagaaaaaaaaaaaagaaaaactaaaagaaaaaaggtggaaaagaacaaaggtgatgtacacatacccctaaaagctggccaaaagatagttatagtaaaaattctaagggagggctgggcacggtggctcacacctgtaatcccagcactttaggagtccaaagcaggcagatcacctgaggtcaggagtttgagaccagcctggccaacatggtgaaaccgtgtctctactaaaaatacaacatcactggggactgttgtggggtgggggagcagggagggatagcattaggagatatacctaatgctaaatgacgagttaatgggtgcagcacaccagcatggcacatgtatacatatgtaactaacctgcacattgtgcacatgtaccctaaaacttaaagtataataataataaaatttaaaaaaaatacaaaaattagctgggcatggtagtgcacacgtgtagtcccagctacttggggaactgaggcatgagaatcccttgaatccgggaggtggaggttgcagtgagccgagattgcacccttgcactccagcctgagcaacagagtgagactccatctcaaaaaaaaactaagggagattttgaagttgtgtctttttcctgtgactgggaggccctgggaagctaagaaaattttattgaacatctgctttgcttccaggagataaagtcttcctgatacttccttctaatttaagtgaggcagtatcccacaattaaaaaaataaaataaaataaaaaaacaatggttcctttctccaaagagtcagccagcaatgatcaagaaaacagcacagtggtgtatactatacagctttggtaccaatgccaacaacccaaagtgataaaaaattaagaacagaatttatacaaaaataatgcttaaacacatgttttattaaaagctatagaaaaagggatacatttgaaataaaaatagcagtattttctgctttaataaccaactgttgactagtctcgtacttagaaaacggcaggttgtcacctagtgaactactcaaaaatctctctaactagcaagataaaaagcagtatttcaagtccactgaactgaaatgaacataccatacgaacataatggcagtgtacattgctcacatacaaaaccacatcataaagccgtagtgattagaagggcatagtgaccaaagcatgatcctctcctccagaaacagactcaaacacacagaaaagtagtatttttttatatgacattgcaaattcatgaggccagatgaattaatcaacaaatgttattttgggaaagtgaggacattgaaaagaatgtgaaccctacctcacaccttatcccaaataaattggagacagattaaagattaaaaattttaaaaataaaaatgtttcatttaaaacataaagcattgaaaacagcaaaatgatttaaaatacttttaaaaagtcatttttaaacatttttacagtgggagaaacccaaaagaaaagactaacaaagccaattacagaaaatgaaaagttcagataatacaaaccaaacagaaaacaaaccaaaacacctacaatcaaaaaaataaaggtaaaaggctgggtgtggtggctcacacctgtaatcccagcactgaggattggagactgaggcgggtggattacttgagaccaggagttcgagaccagcctagcaaacatggcgaaaccctgtctctaccaaaaatataaaaattaccaaagcatggtggtgggtgcctgtaatcccagctactcaggaggcggaggcaagagaatcgctcgagcccgggaggcggaggttgcagtgagctgagttcacgtcactgcactccagcctgggcaacagagcaacactatgtctcaaaaaaaaaaaaaaaaaagttaaaggatagacaggcaaaagttcaatggcctttgaaaaaggtaaactgagggctgctgaaagccctaaagcaaggagacaaatgcagatgtaggtttaggactcagcatgaatgctgtggctggagacatggggtatggcagatgcctttcatgaaagccaacagagactcatctccctacctcccaaatggctgtggaggagtttccgttctgtgactctacctctcctgtatgggtggacacgtaaccagaggtaagcatctgatctatgaacaatcaacacagagattgagttgagccatgctctctacagggcattcagaagtaaatgggatttccaagttcaattagcagagttgcctgcatctcatatttgacacctttaccctacatgctgcttacctgcccaggatctgaacttctggatatgtatctttatttcaccccacactctgagtcctaactttctaccctctaaaatgattccaccaccatccgtgaaagcagaactgataactacaggctgcgtgactcatgtttggttttgacttttcgtaaccacgatccacattaagagctttttcaaataattgtttataggttatatgaacttcataattttgaatgacacaagtttctactgaagtgattggtctgccacttccactgccagtgaaagaatattctctctgtgttcttaaaatcattcattctaaatgacactggggtaagatgaccgaaaactaaagggatgacattttgcttaaaaggtagaattgtaaacaccagactgcactcagaaaaatggagatttctcaaaatttaaaatcctcaaccatgagaaggataattaacaaaatacacttcagaaatatgaacacttagaatgcacttagtcactttacgagaactactgtaatcgtgcccaagcctaaatgcggatgtgagtataatcactgaccagttgcagcaacactgctgctgagaatggacctgcatcagaagacatgccgagggacagagctggtctcagcacccttaggtttcaatgcatgtaagagccagtgttcaggctgcaaaggtctgggcatttgtctttccaggctaacagaggaggagacaatgagactctacatcaatttcccagtatattctgcaaagtgataatgaatttctaaaagaaaactaaataaaaatatcatttagttggctaaagagcttccagaagaaaggcctcagaccatttcaaaaagaaaatggacaactctcaaacacagggacatagatgaggcagaaaagaagaaatatgcatacctataaccatggccttgacaagtcattttatagaaaggtaagatccaagtcttgaggcacttgctcaagcattcaaatatttctggggccaatcaagtgctggctgtggagatgccacatcctgaccctgcaaacagtttagtgggggacacaggctttcacatatatgactgtagcacagtgtgatatgtccaatgtcaggggccagtaatgagaacatgggggcaggaaaggaaggagagagtcctcacacctcagccaaagtggttcaggaaaacatcccaggaaaagaggtgtttgatatgggtgttaaaaaatgggctcgctttccaatctaaagaacttgaaagtatcatagacgacacaaatgtgaagacatccaatgatcatggattggaagaatatcatgaaaatgatcataatctgattatccaaagcaatctacagagtcaatgcaattcctatcaaaaaaccatttttttcacagaaatagaaaactcaatcctaaagttcgcatatggaaccaaaaagagcccaaatagccaaagaaatcctaaacggaacaaatctagaggcaacacattgcctgacttcaaattatactacaaagcaatagtaaccaagacagcatggtactagtataaaagtagatttataggccaatggaacagaatagggaacctagaaataaagctaaatacttaggaccaagtgatctgaaacaaagcattaaaaaacataaactggggaaaggacactctatttaataaatggtactgggaaacctggatagccccatgtagaagaattaaacgggatccttatctctcatcatatacaaaaatcaactcaagagggattaaagacctaaatctaagacatgaaaccataaaaatcttagaagaaaacctaggaaaaactcttctggatattggcctaggcaaacaatctatgactaagactccaaagcaaatgaaacaaaaacaaaaatgaataaatgatacctaattaaactaaaaagcttctgcacagcaaaagaaacaatcatcacagtaaaaagcccacagaatgggtgaaaatatttgcaaactatgcatctgacaaaggactaatatccagaatctgctaggaactcaaacaaatcagcaaggataaaaaacaaataatcccattaaaaaatgggcaaaggacatgaacagacatttctcaaaagaagatatacaagtggccaccaaacatgaaaaaaatgctcaacatcactcatcatcagggaaatgcaaattaaaaccacagtgagggctgggtgcggtggctcacacctgtaatcccagcaccttaggaggccgaggagggtggatcacctgaagtcaggagttctagaccagcctggccaacatggagaaacgctgtaacaactaaaaatacaaacattagccaggcatagcggcagggagctgtaatcccagctactcagggggctgaggcaggagaatcacttgaacccagaaggcggacgttgcagttagccaagatcgcgccattccactccagcctgggggacaagaatgagactttgtctcaaaaaaacaaaaacaaacaaccaaaaaaaaccacagtaagacaccattttaccccctccagaatggtcattattaaaaagtccagaaacaatagatgttgacatggatgtggtaaaaaagggaacatttatacacttctggtggaaatgaaattagtacaacctttatggaaaataatatcgtgatttctcaaagatctaaaagttgacctaccattctatcttgcgatcccaatactgggtttctaccgaaaggaaagtaagtcatgagatcaaaaaagacacctgcacacatatatttattgcaacacagttcacaattgaaaagacgtggaaccaacctaagtgaccataaaccaataagcggataaggaaaatgtgatatatatatatatttatatttatataattatatttatatttatatataattatatatatgtatatataattatatatattaatatacatataaacatgatatatatacacacatatatatatgtataccatggaatactactcaaccataaacaagaaaaaaataatgtcttttgcagcaactttcatggaactggaggccattattctaagtgacgtaactcaggaaagaaaaaccaaataccacgtgttctcacatacacagaggagctaagctatggatatgcaaaggcatacagaatgttataatggacactggagactcagaagggagggtgggaggggcgtgggggattttaaaaaactacatattgggtaccatgtgcacaactcaggtgatgcatgccctaaaatttcaggcttgactgctatacaattcatcacataaccaaaacctacttgtacccctaaagctattgaaatttgtttaaacgaaaaaaacttgaaagtgatacagttttaatcaaccagttactgaggatggacatattagtttattattgccgctgtcacaaattaccacatacttagggcttgaaacaacacatatttatcctatcgttttggaagtcagaagtctgaaatggctgtcactggggtaaaaccaaaaagtaagcagggctgtgttccttctgggggctctagttcagaatccattcccttactttgtccagcttctagaggaagcccacattcctcacctcatggtgccttcccacatcttcaaagccagcaacatcaggtcaagtcctgctcacaccacaacactcagacctctgcatccctcatcacaccttctctcactctgactcgcttgcctccctctttcatttataaggacccttgtgaatacattggacctacctgaataataccagataatccccctatcccaaaatttttaacctaatcacatctgcaaagcccatttggtcatgtaaggtaacattcacaggtgttggggattagaattaatacctctttgggggatcattattccacctaccaaagtgggttagggaccacacacccgccctaagtgcagacggaagcagcaatggcctaggatgtgtaacatacatacatacatataaacatatatacagacatacatatataacatatattacacatatatacatgcacacacatatccattacatagatgatatcatacatatatacaatatatacatactatgatagtaaatgttttatttgtaaaaaaaaaaatcaagcaggattatattagtctcatttcttatactttgctatgcttttgtgtgggcaaaaagccgtatggatcatgtactggggaccacaggtaagtacatacagccatgcagacaccccatgcatataaactccatccaacatgtagattactgcaccccaaatagatagatacatatatacgtagacagataaaagaactgcttttcaagtcggtgttccccatagtgtggtacatattccatttactaattcaaactttaaaattcgaaaagcagcatacttaacatgcatttaaaaatatataaccatcatgtcagtcatgatttcataaatgccacagcttggaactattctgcccatagtagtccctagccacatgtggctcttgtcaatgtaaactgtgactagtccaaactgagatgtgctataagtgtaaaatacacacaagatttcatagcattaaaaaaaaagaaatctcatttaaaatttcttattgatttgcatgttgaaataataggatacagtgggttaaataaaatgtaaaattaatttctcctgcttctgtaatatggcaactcaaaaatctcatgtgccttgcattatatttattttaacagtactggattaaaacaatgccaaagcagttgtgaagtgaaaacaaaatgagttgagctaaagtaaatattagtaaagttagcataaaggtattacaaatatcttgaaatttcaaagctaataacctatgtttggtaacactatacaacatccctggaaaatggaatccagcttttgaatattttctggaaagggtatcttagtacttccgaggttgttcaatgtagtggtagagggggtcaaatgaaaaacatttcttctttgtattgactggaaatctgaaaaacctttgtacatttctctccaatgcccttagttctggcttataaagcacagcacaaacctacccactactatccataactagctggttctggccttttgaacctttagtttcaaggctcccatgaaaccaacacagcagctttgtaacttcacaaacttgaaagaccacattgttggaggaagattcttactgcaggccctggcattccccattgatgagctgaaatcagttattatgaggttctgtatacaccttctgatgatggataaaacaaatgcatatgcctcacaggcacagcaggaattaaaaatacattagttcatcgcaacttcagatctgggattgaggaacgtttggatgacttttttttcttttcaaataaagtttagatgaggcaggaatttcactacagagtagagttctgagactctccaggtccagttcagcacttggagagaaatcaaatacatcttatcttaggtatggcactaactttcatcaaaaaattatcatatgctcagtcacaaatggttattgtaaaatctttactaacctaagtgcatataaaaattgtgaattcctaatacaaagcagtatttgacttttaaatttcattttaagcttggcccgttcacttggaatgtgattacagagtaaattaaaaagtaatcacatgtgaattacatttcctcatgaatgtaatgacttcaggaggctgattaatgttaagcagtgcctgtcctactgcatgcataccttcccaggtgagatatgcaagatagctgtcgtgagttgtttaattttcttttactggtattccagggagactgcctgaacacataataggctcagcacattcattaggactgaggatgttcttccctttggtatgctcaagtcccacgtgcaaaataccatcaccgtcaacttatggttatgagaaaagcccaagggaggcggtgcagctctggtaccattttctacctagccaagtttcaatttctcaatctctctttctatctttttggcaaattcttcatatttgaatggaataattccagagaatcactgaaaaatgcatttgcaccagtgtaaaggtaacgaattgtctcacaaggaatgaaggcttattaataatctacaacagtattactgcagagaacaaaatttaaactaagtggagcacaggatcattaacatatttcctctcaggtaatggggaatgtagcagtctaaaatatttactcctttctgtagtcaggttaaggcattgttttctaaaggagttgtcagaggaatcacgctattgttagaagtggaaaaggcttggtgcttcattatttctgtgcaaaagaagagcaaatacagtggatttagtagccagccaaggaaagccaggtactaaaaattaccttgggacaaaagttggtcttttattcctgtgattccccattccactgggaggaacaatgaactagtagagcagcctgagaacatgttacatcataatctagaacatatagacagctgatgtcatgaaactgtcatactatatgtgatgctctctgacatcatctattatataaaattttgtttttcttttttaagtttggtgagacaggctaaattgaattcaaaatccatcagtgactcatgaccatcagttagaaacattctggattgggagcctttggaatcacaggagttgagagactgccagctcacttcattgtcatttaactgtgggtcctcaaaggggaatgttccaaatgtcatgtcttcccagctttgtgtgggtggtgggaaaatgaagaggggtaatagcgagagaattaatgtcaggagaataagacagaaaaggcctacaattctgtagtttctcctaagactggcttcaggattcctttgagtttaatatttctgttatgtttttatcctgagatatttaaatttccagaacattcaaggtcaatgataagactattagaaagatttttatttaaacataaactcaaaagcactcaaggataaagaagaaacctatgagaactctgagtaggtaacctacaattcttctgtgttaaggagagagtagagagaattactcttgtgtttcaaactgggggtgtcaaacataggggactaaaaatgtgaaatataccagtatacaatataactccattgccttaactgagatgacagacactaatattcttttgttgtactagggtttttattctgcatttgttgtaccttataacatttttaaggcctttactaacccactgtgtgattcagaagagggtgatcaagaaagtgagtgacctagagaacacaccacgggataaccaatcaacatagacaaggtaagacttggacactagggatgggattaggaacagggtgtctccatccagaggacagtactgggtccaggctataaaggcagagacactggattgtgggtgctccctgacgtgctaatgagagttctgttaccaacaggactgggataatcaatttcccttctctgcatcccctttccacattttagggcctgatgtttgacagccatctaatgagctaaatgaattctacgaattctgctctaccatgttggatttgctcttgtggataatactcagcagaccactacaatttctagtgggtcacaatctacttttgacctcccccttctctaggacatatccctggcattttcctatacatgaccaaaattacttttagagaatgtaattttgtataaaatgggaaaaattaattaaatcattaaaatatgaaaaggatcctcttctaacaaggtctttcctctacagggcatccatgctttgaactctagggacagcattaaactgaagcaccagtgtctttcttctggaatcagaatccctttgttgcttttgggggaaaaaaaaaaaaggctgtcattgaacttttaattaggttccaaaaatgtgacctgaggcaataatagaatgatttattttaatgctacactgctcttgatgatattcggttaaaaatgggccagcctttgaaacaccctgacaccacacactggcatctacaatgttgaggctactgattcagttttatttcccaagatgtctttctttactcctttgttcaaccacccatccttctgtccattcatccattcaacaaacatcaacatttattgccaggcattaaggacagacaagcaacaaaaataaaatggtccctgtctccaacagaacttactaaagttcagctgggaagacaaccacttacccaacttaaaatagaacaacgtgggtggaaagtactcagtccaatttaaagagaccataatatctaagttttggtctttactgctccctctagcctgggttttatgtttggtttagccatttaaccaccactatgtataacaacacgtatgttccactgctgattttaccaacagaggccagtctcacggtgggaaacgtggctcccaatggtatcttatataccaaatgatcgtctatggtagatttcaatcatcattctaaattctacattgtgggtttgtatttctgagtgccaatacaaaccacaatactatctattttttaagagatggggtctcactatactgcccaggctggccttgaactcctaggctcaagtgatcctcccacttcagcctcccaagtagaatatcttaaagtccagggccattcagaggaagagagatgctacactgggtagataatcagaagaaaagaatcatttaacaaccaccctaccccccaaaaaaccctttctctctgcaaaatggaagggccatctagaaagaaacagaatcattcatacatatttattttaaaaccaataattaaccacctattgcagtactgaagttcatggcctacatgggatttattatactgattagtccacttctgtgtatatttaacctatctcataactttttttaaacagtcaatactaataaatagctgagttcatctaaaatatattggatctaagactacccaaattttcctcaaacatcctaactagaccccagttaaacttcttttggagtctcagggagaaaaaaaaaaaaatagaatgctttagaaattcttgattgaattttgttacattagctcagcataagcattacagccaccaaaaccactcttaccagtaagttctccatagcaagagatggctgcctgtcccaggattgcccacatatgtcttcttaggatactccaggaacaaagaggagaaaaataatcttggaaattctgtagactgttttgactttttaacccattcattcaatccataaaaatgaacaaagtgctataatgttacagtggaaagagcatcttttcagaggaagatagctggaattttagtcaagacttcgtcactaattatcattgtgcctttaaagcatatcacttcacttttctggaccacatttacttacaagaaaaatgaggaagttggaccaatgacctagtagcactcgtttctgattctcagtctgaagtcaatggatgctattaacatggaagtattttgaagctgcatttcctgcaggggcaaagcaatgcttcctccacattttcctgactcctttcaagttctcctagagagctcctaagacaattcataaagagaaagggggtactgctgcccaagcacacatcctttgtcacggtgtgtggtcaggcactagttggcattaatttacttgttcacagttgtacatgagacattattggtagagtagttatggttgcctgattgtggatgtgtaactaattctggaaaaggatgctataaagttacaatccaaacaatctcagcaggtgtcactgtagtcaggagaacatatcttcacaaatactcattatttatttatccttaagtaagagaaggtccctaccagccagcctaaaagtactgagctctgtttcccatcataaggccaagaatcatcaactttgtaagatcaaaagggggttttatgtatgctctgtcttcgtgcaggtctaagtggagccatgacaacctgaggcacatttgtagatattttttcaaggttataggcagaatggcactccatagcatcagtcagaaagctactcccatgccctactttgtctatgacctcagctttatctacttttatttatgagtgtggagcttaggatttcagtgacagaataatttgtttgacacattacagttaaaaaaaaaaccccaatagaagtacatagacatacacacacacgtgtctgtaaaattggtaaaatctgactaaactctgtggattgtaccaatgttaattttctagttcttacatgagactatagttactacagttaagcaagatgctaactatagagagtttgcatgaagtgtgtgtgagtctttgcatttttgcaactcctgtgaatgttgaattatttcaaaacacaaagttaaaaaaaaatgacaaccaccaaataattaagaaacctataccttcaaaagcaagatttaaaaagtaattgtaaaagttcaggaatagtgtaatgacacggttcatcatcagtgaacacctctccttcaaaaaatatttgtatgataataaatatccctcaacaaaggcatgtaagtcaccagtattcattcccaggaaataaggactgtctctttcaaaaatatttagaggacctgagatgacccttttcccctaggtcacaccaagagtttttatcactgaaagctcctttttgcaattcatagttttgacaaaaaagattttagtgatgtgtctgtgtctccagatgcactgctctgtgcaactatataataactattacctggtcaacctatgtcagcccattggaactgatctttaagaacacaaaaacatatatgtacacactggtatgaacagcaaatcattcttaaaatatttgatttagaaaaaaatgcaagagagatgatagttaatatccacaaaaggcaacacaatttcacaaatagacaagaaggggacaaagaaaaactaaaagaaaaaaatgggggcaaagacaggaacaggaagacaaacttcgcatgttctcacttattagtgggagctaaaaatcagaacaattgaacttgtgaagacagagtagaaggatggttaacagaggctgggaagggtcatggggaggggggtgaatagttagtgagtataaaaaatagaaagaatgaagaataagagctagtgtttgatagcacaacaaggtgattatagtaaataatttaattgtacattttaaaataaaagagtataattggattgcttctaacacaaaggaaaaatgcttagggagatggatactgcatttacattggtgggattattactcattgcatgcctgtatcaaaatagctcatgtactccattaatatatatacctactatgtacccgtgaaaatgagaaattaaaaaatgggcaaatatatggagaggtattttatttattttattattttatttgagacaaggtctcagtctgtcacccaggctggagtacagtagcgtgatntcagctcacctcagcctccaccccctgggctcaagcgatcctcccacctcagccttctgagtagctgggattacaagcacgcatcaccatgcccagctaatattctggtttttttttttttgttttgtttttttagtagagatggagtttcaccatgttgcccggactggtcttgaactcccgggctcaagcaatcttcctgcctcggcctcccaaagtgctgggattacaggggtgagccacccttcccagcctgaaaaggtatttttaaggtgggacaatataaaaagccaataaaaatgaaaagatgctcaaatttaatagaagtcagaaaatgttagagaaaacaatgagatgtcatttagacctaatgcactaatacaaatgaaaataaggggaaatacctgctctggatttagataaatggatattctgatacatggtagattaaaatatcacttttaaggctttatgaaatgtaatgtaacaatacctatcaatatttaaaaagtacattttcttaaatctagtactttcatggctgacaatctatcccattaaaagtaggttattagtgagaccccatttctaccaaaaaaaacaaaaaaatctggccaggcatggtggcatgcaccagtagtgtcagctactcaggaggctgaggtgggaagatagcttgagcctgggaggcagaggttacagcgagccaatatcgcgccactgctctccagcttgggtgacaatgagaccctgcctcaaaaaaaaaaaaaaaattatatgagctttttgtacagtgataagacaaaacaaaaccacacaaaggctggatcccaccagcagaaaatgttttaaaattatgttaccgccactggacataatgaattagatttatacagtagccttgaagggatttcctcaaagaattattgaaagataaaagaatgagtaatattccatttttgtaaaacaatgactgaaaaatctctccagatatgtatatataaatacacgtatgtattaacatattagcaggttgacaaatacacaagtataatcataggtcagaacgtcccaaattctgcatcttggcacaagtataagataataacttttatctaacactggggtggaaagataaaggttgttcatcaccagaaatgatgagccaaaggatagagccacctaaaaagcagtatttgagcaaaggagttggggagttcaaaaggaagttgttgcctgaggaggattctgggagcactccaggaagagggaggatagagcatggtggatgaggtgggtcatgtgtacgggaatgggatagtaccgagtgaaaacatgggaacaaaatgacgcaaagttcagaaatacacatacatacatttacatatatgaatacgtatgtgtattcttgaatttcatggtcatatttatgcattttcggtgaaattgtgtttttaaaacttactttatgtcttaaaaataacacttaaggctgggcgcggtggctcacgcctgtaatcccagcattttgggaggccgaggggggcagatcatgaggtcaggtgattgagaccatcctggctaacacggtgaaaccccgtctctactaaaaatacaaaaataaaaaaaaataaaaaaataaaaaaattagccgggcgtggttgcaggcacctatagtcccagctactgggaaggctgaggcaggagaatggcgtgaacccgggaggcggagcttgcagtgagccgagattgagccactgcactccagcctgggcgacacagcgagactccgtctcaaaaaaaaaaaaaaataaataataataataataataataattataacacttaaaaatgagcccaggtagatgatcttccagtaatttctcccttgattttcttgttcttgctgctattaaaatcaagagggcaccatatttctccctttgctcttctaagatccagtacttatgataagaaaaccatagtccaacacaccctatgtaagttattctgtgtatctgagcttcagatgtaaaggagctctttcagacttcagggttatgagagtttctgaatagccacctggcaaatctgggtagatgttgactttcccagcaggccacgatttattgccaaaagcacaatttttttcttttgttttgacttaacatgccagaaaaaaaacacaagactataagaattaaacctaatgcatcacagctaagctctctaaggcatgaaagaggcaagggctgcaccaaaacgaatttatcaatcacggaatgcaggaccccttgtatgattagcttaattatttaaagaatgcaaaagaggtggacggttctaccattaaattatcctgtttaaagaaaatgccaactcggtaagcatttctaagtggacaggctatttcaatagagtacattgctgaatgtgtgtgtgtgtaataataaaagaggctgccctttaaaaatccccacaccacgtacttttattaatttaatttggtgtccactgtactttttagttcgctccagttgcaattactattctagtttaatttcacatatatttgcattgtttcatggaaacccttacctcggtaaagagtaaaaatagatacctcccactagacccacctcaaaaggatatatgtgtgtgaaaacatacatacacaactaagtgggatgaaagtgatctttagagatatgggataaaggaaaaaccatttgaaaaaagtctcagaacactcctaggaagaccatatgtacttcctcatccagcaaagtgctatttcaaatgtgttaaataagtagggagtgtgtcagtgtgcgtgtgtgtgtgtgtgtctctgtaccaataaacatccagaaaaaaagaggggaaaaagtcaatataaaaatttagaaattagaatatttacttttagttaagaaaatttctagaaagttttattttgatatacaaaatataagacagccatctcaacaatcgtgtccagtcattcagcaatcagccaccactgacaacctacacctttccttcctttcaataatggccttccaacagacctcgaaaggcttctatatgggtcacttttcttactatatctgtattttttttccaaacctaatcctgtttgttctgaattatactgagtttctgataaactttaaaatgtttttcttagatccagctgcactaagagtataaagcgaatttagaatcaccaccccacagtccccccgccgacaaatcatactatttaatatggcggtgatgagaacaacgtatgtgactaccgtgacactcaataaaaatgctatgatttgctttttaaaaagtcagaaacctatagaattcgtatgtgagttccactcattgtttctataaaaaggtcattctgatatgttttagggcattgtcatgagaatgtgtgaaaaatctataggcttacaaaacatgaaaactcaagatactggttggtaaggacatggtaggggtaatgtattcttagaagagaggctgcatcatttctgcagataaatttgaaattttcttcatgcaatttggaatgtaatctcttactagattaaattttacagctcaggaaggtgaggagctggtaagagcaaactgcatgagacaagagtatagatatccaacaaacaatgaggcaaccaacctgattcacttagtacttgacagcaatgcttttattagaaacactttacttatgacctattaccagtggttcctctactattgggatacatttaaatctgtcattttaaatgtgtttacactttttctgtgtacaagaactgctgacaaaggcaagcgtgatatgtcatactgatgacgtgttaagctgaggaaatttccactgccacaggcaacactttaaccttatgaaacattttaatcacatttttattgaagaagcttattaaaagatgcaggctttcagaactcgacaaattttcttgatcctttgccaaatcagaggtaggcaaagtgtactctgaaatcacctccccccaaattgtaaattcattttctgaaattagatattgacatttaagcatcatataaaagtcaaacttttctaggatggctgagaagttgaaaatcctaaatgcccacattatgagaaaagaagttaaggcaaaggccaatatggtgagtaattttaaatttacacttagcatttagccccttttctgcattagtcccatgttaggaaccaactcattctttcatatccaacatatgtattttcagtatttgctaagaaataatcctcatttcaaagcattggttattattttctacaaaagcttggtttctcaatagtataattctgtgtttgcagactataaaagtatagctctgagaatatgaaagaaaataatcaccaggacaggcaatcgatttctgtgtgggcaaaaattttagaccttttttgtaggtgaatgacatcagagagccatttagctctaagtttccatgactacctgtaaaatggagatatcattcattcactcattcatttgataaatatcaagagaacatccacaatatttcaggtacagaactaggtggcattggggtgacagagaacacactggttttgcctttaaggacatttatagtctacttgctttctgtccacttcgactcagacataaagaatatttatcaaatataccggaagtcccagaataagggtactctaaatacatcattcaaatttcaaaatagaacctaaaaaacaaatgccaaaacatttacccaatgtattcaggccttatgaacctagtgattaacatatttttaatatgttatttcagctatactgtaactatatggtgaaacacaacaaaccaaactacttggtttatttagtttagtataaagccacatttagtagtattccaactcagtgctcttcggcaagtatgtgcacagctatattacgtctaggcactgtaacagtggctagggagatgatgacatgatgacatgatgatctgttagaaccctgtgaccttaagaagcttatggtccagaaagacatacaaatgtgtcattcactatgtgatactcctctcaatctcttcctctcaccatctcaccatctttcttacattcctactcctgatttggtccagacaatccacccatcttccagagccaagaactctgttgagccaatagtaaaaatctcattccctctgcaaaggatttgtttgtttaggaaagttgtgtgacccagtttcagccaacaaggaaagtgagtgaaaaaccattcaatagggcttttgaaaaagacatggaaccaatctaaatgcccatcaatgatgaactggatcaagaaaatgtggtacatatacaccatggaatagtacacagccataaaaaggaatgagatcatgtcatttgcagggacatggatgaagctggaagccatcatcctcagcaaactaacacaggaacagaacaccaaataccgcatgttctcactcataagggggagttgaacaatgagaacacaaggacacagggaggggaacaacacacaacagggcctgttgggggtggagggtgtgtggggagggaacctagaggatgggtcaataggtgcagcaaaccaccatggcacacgtatacctatgtaacaaacctgcacgttctgcgcatgtatcccagaacttaaaataaaaaattaagtatcaatccaaaaaacacaaaaacaaaaaccaaaaaaaagtttcttcactctttccaaaaagaggtaaaagataaacccaagtgaatggagaatttggtatatgataaatatgctatccttaaatcactggggagaagatggagttttgatatgaactgttgggataagtggatagtcacatgaagaaaggtaaaatcagatccattccttagactttaaaccaggataaattccaaatggatcaactatttaactatgaaaactaaaattaaggactagaaaaaaacatggtaatatgtcatctcaataacctaggaatggggaaaacttttctaacaattatttaaaatcccaaagtaataaggaaaaacatggataccagtgattacataaaagattccagaaacaaattgggagaacacattggtaagcttcactagagataaaaatccccaatatacaccagggctgcaaaatcaggaaaaaaacagcccaaaatcacactgaaaaatgagtgagaaatatgaactgattagctcataaataaatgcaaatgggccttaaacataagaaaatacactggactgtgctgttaatatgacaaatgcaatcgaaaacaatactaatataacattcctcacctatctgacaggaaagtcttaaagttcaacaatatagtatgttggccagacttagggaactaggaattcttatatagttgtggtataaatacaaagagacatatgcaaaccctatggataagtgttcatcaatacctagcaaaattacatatgtatttatcctttgacacagaattgcacttctgggagtctatccaaaagacacactagcaaagataaaatatatgtttgcacaaagcaattcactgcagcattatttaaaataacaagagattgaaaataaaaatgtttataaataggggatggagtgagaaaaaaacatggtacatcccccatgatggagtactataaaaccgtaaaaaaaaaaaaaaaaaaagaagaggaggaagaggaaaaagaagaaaagaaatcattctagaaagtgcaactaaatgctctccaggctatttttctaaagaacgaaagaaagttgaagaaaaatgtatagagtatatataacttttcaaagaaaggatggaacacaaatataaatgtatttatatacatacatgtatgtatatccacatacaaacacatatatgcaaccttatgtatatattgtatttgtatttaataaacagagtaagtattaaaaatttgggggaggaagaaacagagtataagggagatatagaagttatactactttgaacatactggttttatagattgattctgaaatcataaatattctacataattataatgcaaaattaaatctaaaaaagcaatctctataaattgaaagtaaaataaacctaatttcatatccagttgctatcataagcactcacagaggtgctatttctagcgattttatttaagatacataacaatttaaaggaaaactctaaactgctcatggtaattaaattatttgtagtaggactggtatcgatattctgagactcttgtgcatgtactgtgaataaatcaaagaattatgatggtatcattaagtgctgaggttttgttggggaaggagagtatggttgaaatgaaataaggatgtgagatcaatggggtaaggcattctgactggggaaaaccactctcccaaagatgagcctacaagttgccttagctggttctccaggcttctgtttctaaagttattgtcatgacatctttttaatgttcgcttttcatatgatgaggccaatatatacatattaaagtacatttacatgcatatacacacgtaaacttatttggatagcatgttctcatgcatcgatcacatttctgatttgagataatagtacactaggttaaattcttcctaattgactgtggccaagtctgctcacgcccagcatcggacctcacattctttcctacctacttgttttaagctgctggctccttgcagtcacttggcagaaaacacttctcctcaaacttgcattgtatttctagctttcactcatcaatatgaattttaaggctcccagtgaaaaccaatttaaggtatggagcctgtttaaaacaaggactggctccagtcacacccttattttcagaaaataagcctctgaggcactcccaacatagggacatgcagccaggacgccaagtggtatgctttggtagaaagaattaaaaacaacttagtataaaaacgttagggtatttgttggatttaaaaagtttagctaatgtacatgacagcagacctcaaagcaccagaagactcccttgtctgtaatagagcttcagatagaacacacctcttgaaataatactaatatctattttgggataatataaggtattttctccaaaacacatatctctttcacataacgggagacatataagtaaacagaaatatctctgaagacaactaagtgttgtttaagcactaaaataacaatctaatgaattagtaagataagaaaaaatctatggggagaggaatattatttagtttgggaaaataaatatggtttgcaaggcatatgaaatatcactgggacagaggacaggaaataatactgggcctgggacaggatatgagaaaaacaagatgaaatggaagatgtgagaattcagaatagacaaagaaaaaggacatggcggagcaatcctgggcgctaatgattttctaagaaaccagcaaatccgggtttgttcctgaggatgttccaagtggagcagctgtctatctcagggattttgctaactccagaagccatcagcctagtgcccagtgaatgtttaatactgagatgctttcatgccacctgaaagaaaagcaagagagggatctgtgtccctctcaaagtacctagtactttatggtagcttcattggtttattgcgttgattattcaagattccttggctgacgatgacaagaacacaaatcaaactagcctcaactagaaagagaattaattggcttatataactaggtattccaatgatagagagaacatgagacaaatctggatcaaggcacataccctttcttgctctctctccccccatctgcttctttccgtctcccaattctgtttgtctctgatcagcttttggcctcatattcttcttccatgagcagactctgaaatcccaaacccacagcttttttgtgtcaagtcgtctctctacatagatcagatttcaccgaagcaatcttactgacagctacatgggagatgcttcagcttcctggaacaatcgctggggcatattcctgtgattcagacattggacagacccaagtcaagctcccacaggccactacactggccatttccaccacaaccatacaggatggggaaggagcagttttccaatgaatcccaacaacagatttttcccactatccttccaataagactatttttcctccaagggcatggcctctcaaatatttttggccttctccacactttaccataacatctcctaaatatatgccccataattaaacagatggaaaccagaatttttattgtagacatcatcagtgaattattttcacagattgcaaatacattccttcaatattccattacctgattgtgatcacctaattagcagatgaaaactattcagagtatcaggagcataagaggaacaaggacatgtcaatttgaaaatgatatccttagaaagcatgcctatctacatctcctatctctaagtcataaatggaaagcatttaacatacttactgaagatttttatatgtgaaaaatgggatggttcaggtagcctacagatcctgcaaccgtggtgtgtggaacataggtgtcatgcagaataatctcatgtaataagaggttcagagggtggtcgtgactagcgcaatgggaagctaagtagatacgattccaggccctaccctcactacaaacagaaggtccaagatttcatcctctttcttatttgagagtttcatatttttcatttttttgaaaaagcaattgtactgccaaactaaaaaacttacaaacaagcaacaaattgtattagtctaatcacctcattatactaaagatgaaatagtttctaaatacagatcctaaacttgctgtcatttaaatttcaacacagctatccttttacttcaccaggctgcctttcttaatttgattttacaaaggaaagctttttaaaaaaaactaaaactaaaaaagcatagtattctatgcttgagttcttagactacacataaatatttaggccgtgcttatcagaattttagaattctgaagagcctccctgaactgtcaaaacctctaaaagccacaccatgctggtgaggcgacagagtaaagggaacacttacatactgctggtaggaatgtaaattagttcactcactgtggaaagcagtgtggaaatttctcaaagatcttaataacagaattaccatttaaaccagcaatcccactactgggtatataaccaaaggaaaataaatctttctgccaaaaagacatgtacactcctatgttcattgcagtactattcacaatagcaaagacacggaatcaaccaagatgcccatcaacagtgaactggataaagaaaatgtggtacatatataccacagaatactatgcagctgtaaaaaaaagaatgaaattatgtcctttgcagcaacgtggatgcagctggaggccattatcctaagcaaactaacacaggaacaggaaaccaaatacaacaccctctcacttataagtgggagctaaacattgaatacatatagacacaaagatgggaacaagagacactgaggactgcttgaggagggagatgaggaggggcacatggattcaaagcctgccaatcatgtacgatactcactacctgggtgacaggatcattcatccaccaagcttcagcgacactcagtttacccgtgtaacaagcctggatgcacacccctggaatctaaaataaaataagataaaagtaattcattcaattaaaaaaaataggctgggcctggtggctcacagctgtaatcccagcacgttgggaggccaaggcaagtggatcatgaggtcaggacttcgagaccagcctggccaatatggtgaaactaaaaatacaaaaactagctaggcatggtggtgcacacctgtaatcccagctactagggaggctgaggcaggagaatcacttgaacctgagaggcagaggtcacagtgagcagagatcacgcctgtaatcccagctactagggaggctaaggcaggagaatcacttgaacctgggaggcggagtttgcagtgagccaagatcgcgccactgcagtccagcctgggtgacagagtggtactccatctcaaaaaataaaataaaataaaataaaatggcacagaagcatcaaatgtggatagaagaaatatctacctatgcctctgttgaaatatcaatgagtctgtctaataaatgcctgcaataggctacttaattaaaatgaatagctttagcaatcaccttggttgacaacattcagaatgaagagcaaataatagttaacacttattctacataattactcttcccttccgtacacaaaacatgtacagagcctgggcttggtaacacgaaatttccaataatctatgagagaacacttaaagactttacacttaagaagaataatttttggattaattttgaatctattttccaaaagtaaatgactttttaaaggcctagtcagttaccatgataaataaagacatacactccaagtatttggcacatgtaattacagtaaaatgaacacaccccatatcaagcacatctttgtaggtcaagatggcaataagaaagtatttttcactctggtccacagtgatcaaagggggatcaacactgaaactgtatttcagaatgccagccaaaagctttgaccatgaaagagaagcagtgctggccagttgcccacaagactgcatactacattaggttttaatacatttcaaaaacagagaatttatatagaaactgtgacaatttgaagaagtttgctgggataatcttagaagactgatctaaagacagtctaggacagctgcatgcaattctaagagtcagatctgtttgtttgtttccgagataagcgtcaaatactaatacagataagagctaaaactaaaataccaattcagtgaaaaagctaaaacccagaagacgttttatttcattacctgtctgaagttatttttaacagtgacaggtcatgttctatttcttcactggggtaagagagaatatttgaatgtcccaaatatattaaagttataggcaaaaatgctcacaaaccatttagaaaatgattcattttactgtctacctaatactgagctgaaatactctactctaagctgactgcttagagtatgtttactatctgctaatcctatagctcgcacttaaacaaggctggttggatagataatccagacaaatgcagggttccataacagagcatttttaaatgtcttaggctatcacctaagccacaaacaaaattgatttttccagacatgttccagtgtctgcttaccctttcctgctaccaactgtcatctcactcccctgataaaactcttgacatgttttgcagtatcctctactcccttcccattccaaacagctgtcttcccttcctggcagaaactccctgacatctggatactcaggatggctactgttatgatggacagattccattttatccaactacccagctccgagaatataaaaatgagcaaaaggaggagaagtgtgatagtttcaccagctacacaaatactagttcaagtaatggctatattaaagcattagcatgttgaataattttcttttaaaagtccaattttgtgacatctgtaaaatgatacagaatgttaaaatgcgatgattctgaaagaatacacaattacaagcttcctaaatttctactcaggtaatgacaacaaatccaagcccatagctcaaacataggatttctgcttcatggcctaatttgatgtttttttactagatttaagaacaaaaacatgtgtgttagatgaagacagatgagtcgaagaaaagacaaaacatgagtcactttccttgagctcatcgcccatatcccatcaatcaccagttccactttgtgctgcttcctaaatatgtatcatctcttgcatattctgctacactggtttcttaaactgttttcctatatccattctcccactacttcagtctattctccataagcagccagtgatattttattgaagtgcaaattgggtcatatcaccctaacaccccctttctaaatccaatcagtggtcccccttccttgtagaataaaacctacgctagtccacatggaccctaaagctttgcataactctggtcccagcttctctctggcttcatcaggagcctgtcttcccctcactcaacatattcaaaccacactggccttccctccattatccaaatgcatcaaatttctcccattcctaaggtctgctttagcacttttctctttgcctggctccctcctgcccatggttcagatctcaatttatatgtcacttcctcaaggaattactctgcaatcaactgcaatatgttatgtatccttttatatctctcatgggatcatggaatttttcttagcagcacttttaacaactgtatttaattaacatattaagtcagacattaaagagatttgcaaaactataaagcaatgccattctcaatttttggttttgaaaaattgttaattcttgtttaaaaatgttatcttaatgtgcaaaatgtttattattgttttaaagtattattttaaaaaaattttaatttctaatatggcaaatatcaatagatttaacaacataaacaaaacttctttcggtcgtcaatcttttttaggagtataaagggattctgagatcgaaaagtttaagaaccactgaataagaaattaaactatggcttgtgaaagaatgagatactacattttaaatcctttaggaatacttaaaattgtagttaaatatattttatgtaggaaacaaagctttcaagtaatgttgctaccttagaaagaaaatgcttaattcttatatactgctaagagaattataacaggattgtacagctaggtcataagcaatgtgtcaattataaaacagttgataagaaagttcaacttgccatgacaaacatagtttacagctttaaatgaacaattttttctttgaaagcattctaacaaatgttatctttaataacaaacacatatggcctttaaactttcaaggcaaagattcttgaaaatcataattaaaacaaacctttcgatcttacagaaaagttcttaacagaagactaacaattttgcaatgacaagatggtgaatatgtgctcaatactaattacagtcatgatgactgtgatatcaacaaacccatatatggtacttttctaagagcttagaaatcagccttagttactattattattagcccaaggatatgtaacttaccctgcatctgacagctaagtaagtgacataaatgaggtttgaatccagggtctgagctcttaactctatactgcctacatacatacatacatacatacatatatacatacatatataaattaacctttcttatcctgcttctaaacaaaggtaagggccacccagtcaatgctttgtattcttccaatattctttcctagaacttcttcaaaggctctcatgaagcactggtgaaactggaaatcactgaattttactaccattttaaccaaggctgaatcaaataatttagaagttaatattgtttatttacccagggtctatctacccacattactctcattttgttcacaaattatctaatttcctactgcatctggctttgcttattttgggttttcattgctcctgaagatttttctggcaaattctgggtttctgcccctcgtaatccttctgtggacattcaacatgaaatactaacgttcctaggccactggactcttggaaagctaatgctgtgaaatctttgctttgtaatagccctatactttgttcaatatctatttcatctgtgtaacaagtattataaataataaaagttgggagtctccagtaactgagaaaattctacccaaagtcaacatatttatgttaaacaaaaggtagtttgtattctcaaaatgaattgagttattgggtctgacatcctcctgattaaaatgtaaacttattattgagtaacgaactttgaacatagtcagaattttagagaaacatcaatttaaaatatataattaaacagacagagggctgtaagttcatctgacagaatatgtttacttttgttgaaatgttaatgatgtcagtgatacttccctgtcccccttcattaatcttgggaaaataaactatctgtttctcctcaaagctttgttctcctcactccatttcttcttgtcctcacccagaagctaatgaagtaaaagctttagggcttcttaggctaacaccccttctaagatcttgtatctaaatgtgtggttataattgtgtaggctttatcctaaagaggataaaaattgcataagattcagacgctactcaacctggatctgccttacgtgagttgtaaatatttcagtcaacttgcaattactgctcatatttttgtttctctgtacttgcagccgaggaaaatcctttggagtggctcatggacatcagtccccctgatacaaaagcttattttggcaagaaagtggcaaagaattacaagtcaggatagaggctaaacatgaattttagatctaaatttctatcaataggtaattagatgaaaaacaataataaggtagatccatatcagagacaaagtggaggcctctagtcctaaatgggcctgaataatttagaaatgtaacttaaaaatgtttggttttgggaacattttatgtaaaaattcaggtgtcaaaaatcagacctgataaaactgggtataaatgctctggcctgaatatatttcctatctacctcccttcactcattttcaaggcctgcctgtccccacctaagttaaatttaggcaagcccaaagggttattattaaagttatattcctcaaattatggaaataatgcccaagagatattaattattaaaaaaaataaatcaactgacataatagcattcataatagcattcatactatgtttcaacttttattttaaatgatttatataatttctaagatgaattcaaattatttattatggtatacagtattttttaatattcagcagaaaaaattaagcacaaattttattttaaataacatttcctaccacctttaaatataacttcagtagcagacactgtgttgatggtttggctaaaggaggacaagaaaataggacctgctcaaattcatgcatggtggcaacaaaaattcagggatcatggcaccaaaaatcttgttttccaggatggatcacagactgaggaagcacagattatacatttagagccgacattcatttcttcacagcagtattagaaaagaaaagccacagtcgatgccatttccatctagctgcatccaagcctttctgcatacagagaaatatctaattacccaatacactagagcaacgtgtggggattgttttaatatatattcacagcatgtgtcattatggctcctggcggctattaaaagggtgggctagcaacatgaattaacaataacacatttggtatatgatggctttataatgcctaaagcatttagctagtctcattattcttaatgtgccctacagctcacaagaatcatgtaactgtgtattcagctggtcccaaatgctaaatggaaagcaaaatatctcctaaaagtagttctgagtaactgctatgtctagttttcttcctttttcatcaactaacatggcatatgttataatcaacagatagttctgttttcagaacgtttttttccttttgttttagacaagcagaacaactcataatagtagacaacttcaccaggagaacagcagttcagtacaacaggaaggccagtgtctccccagtaccacctgcttaagctactacaagggttcccttaacagagatgcctgcctctatccatcctcctacagcccattctccagtcagcaactatagacatctgtgaaaatatcagatcgtatcacattactcttcagctaaaagtactccagtggcttcaatatgtactaagaataaaatgcaaacttctggtcatttcccacaaggctccttcatgcggtggctgcctacttatctctgcaacttctgtttgtaccattctcattactaaacctgaaacacggcgcacacctgtaatcccagctcatagtcattccagtcattccacacttttagcatttcatggaccctcagcctggaatacccttcccatagatcttttaatgactggctccttctccttcttcagaattctgcctaaaattgatctcctcagagactatcctatctgtagcaaccattttttcccaattctctatcgctgtcctatttaattttttttttaattaggcctagtagagtgaaattagttgttttttcagcatgatttcttatcaactatccctatataaatgtgggtatgcacacacacagaaattcgcattccattaggagcacggccttatctatctttcctattatcacctccccagtacgtggaacagatactggtaggcagtaagtgctcaaaaattattgggcatggacaaacgaacctgctagttaagcatttccatccaggagacaatcaagggagctcaacttgggaatgtattcaaatcaactctttgaaattccatctaacaacacaggaaatcattctctcttatttatttattcatgcattcattcattcattcattcattcattctgagccaggattcaagtcctagtccctcttactagggcagaaaaagtataagctctcgagaagaaattatattcttctaccctcccctccctgttcttcaacttcagtcattcacctgctctctggtatggtttctgccacttctgtgtattacaggtaccaactttcactcaatgctcttttcacctttttacaatagcctcacactaagcattaggttggtgcaaaattaattgtggttcttgccattaaaagtaatggcaaaggccaggcagggtggctcacgcctgtaatcccagcactttcggaggttgaggcgggtggatcacgaggtcaggagttcgagaccagcctggccaacatgatgaaaccccgtctctactaaaaatacaaaaattagctgggttaaaatattattttaaataacatttcctaccacctttaaatataacttcagtagcagacactatgctgatggtttgactaaaggaggacaagaaaataggacctgctatggtgtggtggcacacgcctgtaatcccagctactcaggaggctgaggcaggagaactgcttgaactcgggaggcagaggttgcagtgagacaagatcgtaccactgcactccagcctgggtgaaagagcgagactccatctcaaaaacaaaaagtaatggcaaaaacctcaattacttttgcaccagcctaacagtaataactttaggataaagagtttgctaggactagtttttcctgaattacattacaattactccttgactattaaaacacatacccatacgtatgcatttacacgtatttttccatctacaatagtctcctccaacatttgggaaaactggatcagagatgaaggaagactttcttccagggatagaggctcccctcaggcagaatgacattgcagagtccctggagggctcctaacttttactaggcactcagtggtgtcatgctctgtgctttatttattacaatacccctttgaggaggtattcatataatgtattttgcaggggaggacccaggtacagggagcttaagtcaataggacaaggtcacatagctagcaaaaggcagaagtcgtgttcaaattcaggtccatctgggcaccagatccattcttggaaccgctgaatcatacatcatctttgcaacacgtaagcgatccatgctttgttttacaatatacttctttcctaaggtggtaatccgagagcttttatttacttattttatttactaatctaaaaactgcacacacccaccttcccttcaatattcccaagtaacaagcttgttgagaaaccctactgaaaacaagctgagccttcttttcattactcagtgatttttaagtgttgctagtttttataccattagacttttattttcataattataggctgccatgggcttcttccaaagccccctgccaagtcttcattcctacatacaggtgctaattgctttcttagcaccactggttattctctgaacctttggatttcaccacctacaataggaccctgggtttttctccccttcagtaacccttagcacaatggtcacagtcactccatggctgacttggttctggcccacaagtctcatctcctcattctcaaagcggagtcaagttaattctgtgcccgtgctgcgtcctgttctctctcaattcttggtcgtggtgcttgatcctcaggttaaagcaactgaactctagtagctttgaaacaaacttgtatgtttcctcctcccctccatatagtgtgaactatatataacttaaacattaacaataatagcaaacttttattgagttcctatcagtctccacaccaaagcctctcaacaaatttatttcgtaaaaaacaaacaaaaacgagcaaacctccctgtggaggagtaccgattttatcccccttccgctatcttccagaagacagcactgaggttcacagaggagaatccattcttcctggttccagagtccgtactctaaagacccactacccactatccctcttgtgaaaactgtcccaacctgatcctgatgcaaaatgatggcaaataaaaggcagtagatagatttttacagtaaaagagaaacagaagataattaacttgagttgtgaaaagaattcaagaagggagatgcttcctttcaagacatataatctgctcctgtatgtctttcacttgttcttcaaggaatcttcgaaatgttcccctcacaaagtttctccttatgctcatatccctcctaagccatccatgagggtacccatgaaggcccagttcaccggagctgcctgacgtactgattatccctctctaaagcatcctcttttggacaacaaattatatgtccacccaaaccataatctccatgagggcagggatgtgccttattctcctttttatctctcaccaggatttttattttattttattttattttattttattttattttatttgacagggtcttgctctgtcacccaagctggagtgcagtgtgtggtcttggctgaaaactccggctcccaggttcaagcaattctcttgcctcagcctcttgaatagctgggattacaggcatgcaccaccatgcctggctaatttttgtatttttagtagagacggggtttcaccattttggccagactggtctcgaactcctgacctcaagggatctgtttgcctaggcctcccaaagtgctgggattacaggaatgagccaccacgcccagccaggattttccgattttaaatcagtactggagtaatgcttgctaagaagtcttccccccaagctaggtagaatttcgtcattactaagtccttcatagcattttgtgttcgtctctcttacagaaattatcacatgccaactttaatagttcacagaccatatatgccatgcctctgtggcaggcctgagtctccactcatctttgtatccctagatacctgattagatactttatccagtgacgtggttaactacatgctgaccaactgaactcaatattcttttgatatcctcattttgcaggcaaactcttactgtcctgccaatggaacagaaaatttgagagttgtgagatcaatgatacaccaagtgctggaggaaagaagacagagtatctgtacctggagaacaggagaaagtttagaaacagggctaaaggactaggaggtattatctaggtataaatgtctgggtattagggatgggagagagttgagagaacctcccaggaagagggaaaagacagggcagatacaagacagtctgcacgcagaatggtgtgagtaggttgtgtggctcctgatggctgaagtttaaaatcagaagggagatttgagtagacgcttacttctcaacaggctgttctgttaaataccagagcaacagtaaataagcatttaatgcaaaacttgccctcttaaaacagcgactttgggatcatcaaaactgcattgtaactgaagataacagacggacaggggagcaaatagatgacctcaggacagcttatttggggctgagacagaatacagcattctctctccacttttgcacttccctcagcagatctacagaactgcagaggaccaagtcctgaccaggaatgtgaccataccaaagggaaaacagtcatttcaacatttctgtgggtgcctgtgctgaagggacccagtgaggctgggcgctctgtttataaaacataatacgaatcatgggactaagctatttagcagagcagcaatgggacagccccacagggagagaaagggtgaggagatgttaacaaatggtctcaggggaatccatttggggaagaaggtcccagtggtgaagaaggaccagaggacttgtacaacagagctgtcttctgttcaattaaaaagcactgttggctgggcgcagtggctcacacctataatcccagcactttgggaggctgaggcaggcagcccacctgaggtagagagttcaagaccagcctgaccagcagggagaaaccctgtctctactaaaaatacaaaattagccaggcatagtggcgcatgcctgtaatcccagctattcgggaggctgaggcaggagaaccgcttgaacccgggaggcggaggttgcggtgagctgagatcgcaccattgcactccagcctgggcaacaagagtgaaactccgtctcaaaaaaaaaaaaaaaaaaaaaacactgcctgcctgcactatactaacatgttctgtaatccctctcctttaccctaagcctttactgttgctgcacacaatgattgcaggattaaagcactttggaaaaatgaaaaactgggaacgtgtccaggctgaaaggaagcatggagggaaaacaacagttggttgtctctcgagactagatatagaggaaggagggagaatcaggaaggggacttatggggtcacatggatgtgtctagggataagaatgagaagcaaataatcatacagccctatggccttgagaagtgctggttttggagcacgcatctatctgtggacactgatatcccatcttgtctctattgtcacgccacttctctatgtgaatgtgagccattatcttctcctctggctagaacatctatctacctaacgtagtaaatgaatcaaatttaatttaaaggaaaatcaaaagtcatttccatgcactgacataagaaagcacttaatctcaataaactagcagttaggatgatgggaaaatctacaagggctcagaggtatgcagcaaatcaaaattctccccatttgtataatggaacaaagccaaagtaagctttcttcctggcctaaaccacataacctaacacctgttagaaaaatgggctggggcaatgagctgtgaccaccggtgattcaaaggaatcactaaactctccccaccagtttcacagaactgcattggaaaatgacttttaccaagattcttaataaaatcaacatctttgcctgtttcatacattattagattttatggcatgcatttcagaactctaataccttaactctgtctacaagtgaggtgggattcccgaaggaccaccatcccacctctgaaaatattttcattacccaagtcagaggaagtgaagaaatgaaagcttcctgaatctggccagctaaatagcttgattcaagtgtgttatgttttcattatttacatttcccttggaatttgagggctgtcttcaaattttgtgacacctgtatttttttcacctacttctgttcagtgatttcctggaagaaggaagaacacggctgaaatgaacaatcaacgaacactgatttaatctataccacatttacctccaattaggtaaatcatggatcactgtttaaaaatatttttacaaggccattggataaaaacaagtattaggtatcagtcagtgctctgatttgggaagagccatttacggtctctaagcttatgtcatctcatctgtagaatgaaagtgactgattccccacatggcttccaactccaagaacttctggaatgctgtactgacactcatacagagctgatttggggttaattattgtttttcatttctgcttccttttcttgatggattttatcaaaaagtgaaccattttaaaaagcaattactggacattttttaagaactgcaggggagctggagatagttgcaagagggagacctattaggtttcctttttcttttactaccacttaactttttcctccaagcctcttgcctcacaataaacataaaaacagatgaccctatcactccagactgtccttcataatggcaacaacaacaataatacaagcttttaatttttgaactcccactgtacggcagacctttatctcattattggaaggagtataaagtaaggcatgaaaccactggctctgacatactgtatgatcccatttatgtaaaatgtccagaatagacaaatccacagacacagagcaaagaaaattagtggttgccagggacattaagcataggagaatgagggtgacttcttaaccagcacagggctttcttttgggaagacgaaaatgttctggaactattaatagacaggagtagttatgattgtatgaccttgggaatacactaaaaaagccactgaattgcatactgttaaaaggtgaatttttttggtatgtgaattatatctactaaaaagataaaatttaaaaaaataaaacacacatccatggctctggatggagattgtccaggttcaaatcccagccctaccgcttctcagcttttctaagcctaagtttctacatgtataaaatgggagaaatgacaaatacctcacaaggaaattagaggactaaataatgctacgacttttaggtacaaaggccaatttatagcgtgttttaaaaatattcttacgagacccttgaataaaacaatattagataccaaccagttctttgatttgagaagagccactcctggtctctaagcttaagtcattttgtctgcagaatgaaggggactggttccctacatgagcatcccataaattttcctattcttatgtaatccccacaatagttctataaaatacgtagaacattactgattttagagatgaagaaacatcagtaaagggcaaggaagttgctgagccactaagtggcagaggtgagattcgagaaatgtcagaatggaacctcacactcttgagtgacacaccactgcctcctgacccacatattaataacccagcatatgtacgaactgcttactgacttcttactatgttgcagaaactcagggacagtgccctcaagaaagtcattacctggccacttgcagtggctcatgcctgtaatcgcagtactttgggaggctaaggtgggcagattacttgaggcaaggagtttgagaccagcctgggcaacatggtgaaaccctgcctctaccaaaagtacaaaaattagccaggtgtggtggtgagcatctgcaatcccagctacttgggaggctgaggcaggagaatcacttgaaccagggaggcggaggttgcagtgagctgagctcctgccactgtactccagcctgagcaacaaagtgagtgagacatcatcaaaaagaaaaaaaaaaaaagaaaaagaaaagaaaagaaagaaagaaaagaaagcaagccattacccaagatgggagaagaacaacagtgcccagggattaaggaaattaaggaacaggtgtacacagtaaaagtataaaagtagatatttttaccatataattcagaaccttctgtctttagaaggggactttcctatcagggaaaatccagagtaactgggctgagaaaaaacattatgtagatgaacttttgagagtttctaagaaaataattaagagactgagtgctgtggctcacacttacgtataatcccagcactttggtaggccaaggtgagaggatcatggccaggcattgaagactggcctgggaaataaagcaagtccatatctctaaaaggacttttttaaagttagccaggcatggtgatgcacgcctataatcccagcttctcaagaggctgtggcaggaggacagcttgagcccaagactttgaggctgcagtgagctatgattgtgccactgcactccagcctggccaacagcacaagaccctatctctaaaaaagataacaagaattaagtgtaatcggccactcacctctatgccaaataccatattttacttaagatttcaaatctcgttgttcaataccgtggccactagccacatgtagctaaatttaaatatattaaaattgaataacgttaaaattttggttcctcagttcacaccaccacatttctagttcacaagagccacacgcggccactggctgccataatgaacagaccagataaaagagcatgtctttcaatgcagaaagttttaagggacagcactaatctaaatataaaatcacatcattcacagtcaaataataagagaaaatgcaacattttatttcatatcctaaaaagagatttggtatccaagtgaatacctggaactactataaatgctcacctaagttgtaagatgacattataatttcttatctacactttaaaaataacattatctgatcatattgctctggtgtaaagattttccagaaaaaaaatcactttccgagactccttatttttaaaaatcgcagatagcataggcaaacagataatgaacatgtaagctcactgcatctcagttttgaaatggattcaattcactggtcttgaaaagaaaagttcaggacattggggaaaactcagttgctctggtctctgagttaatagccttatgagtagaatgcctttttgtccaaagaattctcaaaatagtattatttttgtttatttgtgtttttgagattgaatctcactctgtctgctcaggatggattgcagtggcatgatcttggctgactatgacctccccatcctgggttcaagcaattctcctgcctgagcctcctaagtagctgggattacagccataaaccaccacgtctggctaatttttgtatttttagtagatacgaagtttcgccatgttggccaggctggtcttgaacttttggcctcaagtgatctgccctccttgacctcccaaagtgattacaggcgtgagccaccactcctggccttaaaatatttcaataaccattctaatgtgagcagacatggtagtggcaacaactcggaaataaaataatcttatgaggtttggtcaaatacgccaataaagctcctctgccatcttgcctctgagccatgctcatatttgtgaaatgggaggaaaaatttttctccttctttgcagatatattattctccttctttgcagatatatatgtgtgtatatatgtgtgtatatgtacacatacacatacacagaagcgcacacatatccaatagaagttggtatctatcatccagtacttcagtttttaagtataactgacacacatatacatataaattcaattaattattttacagtctgaacactttcatgtaaccaacgcccagatccagaaatacagtattaccaacacctcagagtctacctgccgcagccttccaggtaccctcaagggtaaccaacaacctgacttctagcaccactggtgaactttgacagtttccacatcttacatatgtggcactcttttgtgtctagcttttatcactgaacaagacaccatctagttttgacagatcttcgccacaaggcagccatttaatgctttcctgccttatagaataactaatccttattgagcacatattatgtgtcaagtgctttacgtgccttgactcctttaattcccccaaacaagcttatcagtaaagtattattattatccctattaaatagatgagcacattgatgtgtaaaattggctaggctatagttcccacttattcagttacatactaatctaggtattcctgtgaaaggattttacagatgtaattcaagtctctaatcatttgactttaagttagggagattatcctgggtggacctgatttaatcaactgaaggccttaaccatagggctgaggcttccaggagacagggagcataaaataaggagggaagggggcatttttctggagcagataaccatgagcaacaatcatccattaacttatacatgccaataacagatgtcacaccaactcaaagacaaggctcttcagttcattcttgaataggaacttgtagtagaaatggtatgtgccacattatttttcaagccagccctgatgtcatttgttcatgcacactgtccctgtaagaacactctcatttttcaagtcctgcatcatatttcaagttgggaaaaataaggtcactctacacatggtagggtgatggaggtgtttttggacagccagacttttcagatttactcatctttaaaagcaatctcagtgaaaggcttctcttgagtggatctaaatagatctcaagtaaacctaggagattttttaagaacaggagcaatttcttccattatcttatcccccttaacatatatcattgagcaggactgaagggaagtcttggtaagtacagatgcatgttatcatttgtctcctctttttctattgaaggctgattttaaggattttccattttcagaggtgaaattaaatggaatccttagttttcccttccaaccctcaagacttcctcctcaagtcttctccatctcaattattagcgtcccacattcgctgggtttcctgggccagactcagtagtgatcagcaagtcagttctgcctccaggcatatcccaaagctaaaatcttatctccatctccatctccagtataagcacccttgttctgaccattctgtttgctaaacacagacaaggagacctgagtgatctcctggcttccactcctgcccctctaaagccatgtcatatacaacagagagctcattttaaagctgcaaatgtagtaatatcactctcctgcgtacaactccaaatgagactggatatgtgatgacactaaggaaatactgtcaacttttagaagtgataatgatactatggctatagtttttaaaagagttctgatgttctagagatctatggtgacaaatgacagcatgcctccttcaaataacactgtgcagtggtggtgactgggaaggggtgcagctggagagaagggataggtaaaataagatagaccatgagctgataattattgaaactcggcaatgggtacattgggagtcactatacttttctattttcatatcttataacatttttataataaaaaactattaaatccccaatgactcctgactgcacttagagagtaaaatcttaagaacttgtatggctcaaaaggtatttaatgatctgactgatgcctggcaatccatgattttatccagtacccagctttgtccattaactgccaaacagctgtaacagccatcccgtgccttccagccctttgccaccataggaccttcagacaggctcttttcagccttagagggctcctccccaagatgtgccagatgtgcccagtgttgggctccttctccttcaggtgtccactccaacaaactcctcagagagggcctcctccaccatgctacctaaagcaccttccctccccgctctcctcctgcccacccctctgcacccttaccactctacctattttctttcattatttcttcataatccttatcactttttgaaatcatcttttctcttaagtccttttgaaaaataagctgatatagtttggctgtgtccccactcaaaactcatcttgaattgtagctcccataattcccatgtgtcatgggagggacccggtggcaggtaattgaatcatgggggcaggtctttcccatgctgttcttgtgatagtgagtaagtcccacaggatctgatggttttatgaaggggagtccccctgtacatgccccctgtacttacatcttgcctgccgccatgtaagatgtgcctttgctcctttatcttctgccatgagtgtgaggcctccccaaccacgtggaactgtgaatccattaaacctccttcctttacaaattacgtctcaggtacatctttattagcagcatgagaacagattaacagacaagtcacttattatcaatatactccccatactagaatacatgctctgagatcattgggaccttgtctgtccagttcacttgcatgcttccagtgcctatgatagtgcctagcataaaagtaggattccaatgatgacacattacacaaatcctttaaatcagaccagacaattaaagctgtgtacatagcacagggacaacaaaaaataataataattaatgccttggaaagtgaaattatccttacatgtatatatctgtagtattaatgaatagttaacactaacggatttcatttgaattaaacatatgtcaacataatgaataactacttacacatattaacacaattaatgaataattaatacctgtgagttttctctgaattgcattcaatatatccatacacaatacatgcacatacacatatagtctttatttcattattctgataccgaatatataacaccattgttggcttatatgtaaggaatatgacagtttatgattgctatatctcgagcaggagattttgctaaatgtattgttgccagagcttagattttaaaattcatttctaagtcttagctggtgttaaaccatgtcagcataataagcaagttttgatttcctttcagatgttcctggctgctgaaagaattgattttgaagattttcccattgacctatagggctgtgaagaagagatagctcttcttaatctcaaagatccaaactgagtttacattccccagcctttgtttggatgtcaccttcagagcttgcttcattatgtgtctcaggagaaacacagaagtattagtgataggacactgactggtagactttaatccttctttgagatgttgtttaataatgatggtttagtatcacattcgaggataactgtagttagttaatatttttacttttaatatacctactttcccaagtacaaatttatcctggggctacgtaggtgacccaagtgcatcaggagcagtttcgaacaaggtgtaacttctcaacgttacatggaataagagagagattcaaaaatcacatccaaactcaaacatcatttcaaaggtcctttcccatcttcctctccccaaaaacaactaaaacatggcatattgcatctttcaaccatggtcaaaatccttctctgttaagtagattctatgtatttttaaatatctatgcttttgtttgttgttttttttttttttgagacagagtctcactctctcacccaggctcgagtgcaatggcgtggtctcggctcactgcaacctccgcctcctgggttcaaatgattcttctgcctcaacctcctgagtagctgggattacaggcacccataaccaagcccagctaatttctgtattttttagtagaggcagggtttcaccgtgatggccaggctggtctcgaactcctgacctcgtgatctgctggcctcagcccccaaagtgctaggattacaggcgtgagccaccgtgcccggccatatctatgcttttaagtattgttttccttctcagacgtttgagaaactcaagaaggaaacattgtatacagactcagacttaacctcaatgtgaacatacacagcaacatcattgacagtctacagttacatgatctcaatggcaagtgtggtccactgtgatgtcaattttataaagggaagcttgaaaaacatcacaacagaaagaaagctgtcatgcttgctttgattaaagaggatgtagtatgtttcataaacaggttagttctcacaggaaggttcaataaatggaagcaaaaagcaaaaactcacaatggagatcctcccagtgtttgaattttaaaaaataaaggtcagtttatcactagagcgttcaattggctccagggttcatagggtattgttagactagagctccttttgctaaaaaacccagaggacttcttgtattttgcttctagctatctgggtctgcttttaattcctcagacatactcttctgctgcacgtagttctcacacctcaagacccatgagtttgctgtctgcccaaatgcatcttctctatctttcaacatccaagttgaatgcaacttctttcagaaagccttccatttccatgactagtacctcattttcaaatcaattccattgttctaagtggtttgaccttgctgggttcatgctttaattcctctgattgtaacaataaaaagtaatttactttctatgtgtttgccacacatactagatgaggcccttgaggacaaagatagcatctcatttgggtctgtgtccccagagacttcctcctcagaaaatgttgaatgaaagaatcaaataaataaaggaatgatgaatgaagcaagccaacagcacccttcaactctcagtttgcttcaaatccccactactacccttccattctatccccagtagaatttttctattctcttttcagtcttaaacactgttaaaatttcaaggtaagcatcactgaaaactgaagtgctgtggcacaatgggtttttctaatgaattatttatctgtaagcagtagttcatattcacatattttttagagaccagttgcctttctttgtgaatggatatgttcatgtatccatctattagatgctattgtcttgttttgcaaggcaattgagtgttttatttccttttttttacttatacagtaatatttgaaaatattctcactgtaaaaaattcaaaccatatagaaaaatataaaaactcccttatcactccttttaatccactttcctccccaaaagcaatctttattatcagtttcagatctttttctatgcatttagctacatatgcacatatacaagctttgtgtttgggtaggagtctcatgcatatgtagaatcataaggttttataaacttctcccttcaattaaccatgtatctcagagatagatagtcccagataaggaacatacctcatccactttaagtactagcattccacactttggatataccaacatttattcatcattcccatggtgactaaaatatattgatactccattttcactcttacaaatcctagatcatatttctttatgaaaaagcaccaagagttttcaaaaatagaattactaggttgaagggtatgcacagactggcttcccagagtatggaactgtttatttctccatatccttaaaaattgtgaatattaacaggttttgtttttccatttttttttttttttttttggttaatctgatgatagcacctatttcctacatgacctaaaccagttgagaaatgcccatatttacacctaccatggtgtgttgcgactggaacaggttcaagtgaaatataccaagtgactgctaacagcctcctacctaactcctttcagcttacatcccagtaacataaacagggatccacactgaattcacgtttaattatcagaagacagggaccttgatgagtgtcttcacataaactatcttgtttaatcctcttagaatcctgtgaaatagaaacttttattcctgttttatgtttgaccacagtgaggcaggccacccaagatcacaagattgtacttgattccacaaagcgctccactgaccccaaattaagaaactgccccatacttgcattcggtttgcagttttccactgttattgcttcttggtgcctaatgtaactacccacataaaaactgaagatgtctctacctattattttaggaaaagctctggctttgaaaatactgaatttttctgggagaagcagctggttagaggcaggtagaaattaagaatttgtgggccgggcatggtggcttatgcctataatcccagtactttgggaggccgaggcgggtggatcacctgaggtcaggagtatgagagtagcctggccaacatggtgaaactccatctctactaaaaataataataataaaaaaaatcagccaggaatggtggtacatgcctgtaacctcagatacttgggaggctgaggcaggaaaatcgcttgagccttggaggcggaggtggcagtgagccgagattgtaccactgcactccagcctggcaccaagcgagactccgtctcaaaaaaaaaaaaaaaaaagaatttgtgtatcagcaacaaatacaaactttattggacactccctccctttcttaatgagttcctcaggttttttccagaactaaaccaagtcatgaaatgtcagataataaagcccttaagtattaatgtacagtataggtgaatggctactgtacttactctatcttagcgatatttaataatattaaatgttttaaaactatcctatctaagaatgaaataaaagaaagccatggttttattatcttaagaaatttataccactcaactagctgtactaagcaaaaaaaaaaaaaaaaagtcacagcaccatggaaaatgaacacaaaagatgctttctaaaatgctgaaaagcataaaataaaagattaaaacatttcactatgcatatgttatgctggaaccttgaagctatcgcctacatgagaatggtactttaaagattactgaatatgttttctgaaagtatagaatgatcgattcatttttcaaacccttagtgtagttgcactcttcctttccctgacagatgacaaggctcagggaaagcaaagatcagagctgaggaacaacaaaaaaagttggcacctgattcacttccccttcatgccaaccctgtttttctcccttatcatacaacaaagcaaaaagaaaagtattgaatatgaaaaccaaaaagattccccatgactgagctttggcaagtacaaatgcattaggaatggagctgattcctgtgaccttttcaattatgataatcctgcaaagaaaattaaaatcattttctaaaacatggtccaaggagttccatagataattgaagaaaatatttaggaacatccctggcatttttctaagaatgtatatacttagcccaggtctgttgcacactgcagccatttcagccatgagtatttgtgagcaaaaggtcaaattaacttgagagatatttttgcaaagcctacttccagagtttttgcccttcattttttcttttgtatatatttacattttgaaatgggaagactgaaaaagagggaagctatatacttgtttctgctttggtctgaaaatttggtagttgaatgtacttctttttgaaagcatctttttggctgggaggagaggctcatgtctgtagtcccactaacttgatttggaaggctaaggtgggaggattgggtgagcccaggaatttgagagcaccctgggcaacatagggggaccccagtcttttaaaaaataaaaaacttggctgggcatggtggcacatacctgtagtcccagctactcagggggctaaggcaggagtgtggcttatgcccaggagctcaaggctgcagtgaaccatggtcatagcactgcattacagcctaggcaacagaccacaactcaaaaagcaaacaaaaaacagaatctttttgttttgggcatgaaaaataagtgaagaggctttagagttcctaggatctccactggatttctaacaagcaaaagtttccctaaagcatggaaaaacacacagatttaactatatttaaagtaaaatgatccacaaagctcatccttgcccaattctcatttaatgaataagaagactaaatacttcagaaaatcaaagactaccttactaatagacttagataaatggatttcagtttagacccaagaagggaagtcaaatctatagatacagcatctaagaagttgagaccttggttctctattctactctccctattattggccttatgaccacaagttggtcagttcgcctccctaagcctcagtttctcacagggaaaataggaatattagcaaatgacagagcaaattcacaggactgctatcataggattaaataaaacaacacaaaaaactgtaaaaattatataatacaatgtaaacaagcaaatggcataataattatttgtccttgttcaccaagttaggttttcaatatcaatatgcatctccctaccacagcaggacagagacagctacagttactggaaactataaaatgggttccagtcaacaaaagccattggactgctttctgattcttctaatagaaaatcagagcattagtaggagagaatggggaaaaaaaggctttgcttcaaatttatatttctgttcctgatacctattaagagccagttatgtagctattaagctacagcttgcaatttaaaataaataaactgataacaaaacccttaaatttccatcatcagagcagatcaaactacaacatatgctaccgaggatgcaaagcagctaatgaagacttcaatatcaggattatgacccttaatttcaataggaatgtgttctgttgtttgagctcacacataacgagaaaaaacatcacggaagcacaaataaactgtctcattaaaaagcactttgccttggtccaaatataatttcgtttttatacaattcaaatgctatagaacaaagaaagagaaggaagagggatgataaatgcagaggacttgggagggaagcctgttctgcaataattgagatggaaaggagggttcaacctgcactcctttgtttgtggagacaaagtcctcaacagctggcagatagcaggaagtagaatgctgatggctttgcagttagcttcaaaacctattagcaaccctcagatccaagagctgtacctgctttgaaataaaccaggaaatagggaataaatcatttcttctggagggaaaaaaattgtttaaagtgattaaaacatgccacaggtttctcacacaggaggaattaaggaaactatttcagaacttaatgggacctgttaaaaaaaacagatttgtaagaatttaaaagtaaatatttctttatgcaaacttatcatagtgagtatcttttaaatactaaagctagggatgcacttgcaacagtttttaggaaacgggggtggaatggggaatcacttcactgaagaagtttaaagacatatttattcctctgtggattccatttcttaaaagactgccctgaaacttcttcctaaattctgtcataattccctaagacagtaccaagggaattatcattctttattagatgccaaagaaacataacaaggatcacaaatgaaacaccagaaaatttatcaaataagattggatgtacagacccattctaaagagcattccttctcccccatgttttaagtcaaatttatattaaaaatcttgaattttctaggaattttaagtactgtcccctaattttccattaataagcacgctcatgagtatgaaaaaaatatttatttacatgcatttattataatgggccaagaaaatatttctatgtaaaggtactatcttcctattaatctgtagtttttttgctttttttgtaagggttgaaagaaagagaaaagcaacagattgcaggtggggatagaggcaaagagagataaacggtagagaaaccagttctgaaatgtcagggaattgcctggagagagttaaatatactgtttctgcggacccattcccagataggtaccgcctattcctacatatgaagagagaagagatgagttatattcatgactagtaggagttagtttatcttgcttctgttttttaattttactctaagacaaagggactgctataaaagaggaagaagtggagcttactctaattactctttattattctcttgatcatcatcacctctagtaattttgtaattcattacagtaatttatctaagtttccaaggattttaatatgttctttagctcctaggtagagaaaaattgtggtaacaatcaaatgactaatcacaattattggttaggaaaatgaaaatcacaatgcaatcattataaaaacagggtgtgtatgtaattacactaaaacttcattgatttaggccattattaatatttggtaacaactaaaaatatgtattatctttcacgttttatttcttcccagcttctccagtatgaataagaatgtatacaagaggatgttaatgaaaacaatcttacagcatcacatggtattaaatagatttttatctgtagctgtatatttcaaataaaattgatattttgcttattttcagaggaaatttgtttaaaatcctataatatttcatgttggcttcaaactctatatatttcaccccaaaccgtttctcagtacatacttacatccttttttcattaacatgttcacaaaacccatttgggtccttatttttctgcaaagtacatattatttccaggcatgttctatattcgtgtgtatgtatgtttgcttctccccaatccacataatcttcatgagataaattatattgccttcttcactactatctgtagcttcaacacttagaacaatgccttgcagagagcaggtacttgaggcaaagttgactgcttagataactccaatacctcttcacctcttcccatcagtaactatattatttatttttagctgagcacagggatccccgaaataaagaccacatcttctaatttcaagttgactgcttttgccccttcttctctctttcattctttctattggttagaagatggtcataatggctgaaaactctattagacagcactgctttcagtccttcttcctcatacaaacacatatgttcatatatatatatttatataaacacatacacatatgtgaacatctccccaagcttctccatctccttgctttttgtcagcatattaacacaccaggagaagtagatgttagtctaatctccaagccactaggtctttacttgaattgataggcacattttcaagtgaaccacaatggccttgaatcagcgttctcattttatcagtgtgatgtcaatattcagtccaaaactaaaaaaaaaaaaaaaattagatttgggccactcatatttaacactgaatatgaagcaaatggattgttcgcctttgggagggtggtctatgattaaacagaaatacagggttacctctaagcagcttcattttgctcacttggataactatctggttaagtggtattcacagatgggaaaagagttaacactcaatgaatgctatgttgtcattaattcaacaactgaacaaaagggacaagatccccacactcataaagctaacattctagtggggcaaacaaagaaacaaataacatcaacaaaccacactcaattggtttcttcagagaatgtaacactactgacaaattagtattgtcaagaactactggccatggagaggcgatggggagagcttgacctgtgcctgcatacactctagggactgagcttaaaatcttgactttaagctcaacaaatggctacatcttttgaccaaattccatcatgctttaagctccacggtttaagcccctgaagtcctttagaagatagaggcaacggctcttatttaatctatagacaccagttcaacagcagaaactattatcttgaacagggtaacacctacaaccgtgaggaatgataaccaccttcttaaacgttgaagatataatctgtacgacagtggcaggtgatgctttacattgttttataatattatcccaccacccagttctaaaataaactttaacttttttgttttttaaagccaggaaaggagataaagaatcaatgaaaggtcaacacagaacagacagaaagtaccagatgtgctctctaaattatgttctgtaagagtcagcagggagaacagaaataatttatttcaggaatcctgacgttaccatcatgtacactcggttaaatggtttgtatagctgaaaaactcagacaggtcttacaccattctcctttacttctaccacttagagaaattcaatcaaaggctgaggttaaagataccagttcccatcaagccagtatatatattaaaagtggcttttctgatcacagcaattctcaggcagtttaggtgtagtgataaacctaaaaatataatctgacaaattttcaactgttcattctaatgttcaatacttcagttattatacttcatattttccctataaatgtcaaggaaagggaattgtctataggatacacacatacctatatacacataaatgtatggggggagggatggaatttccattaaataaagagagaaggataaaaggtcacacaattgtcactttctaaaaataatttcccaggatctataatttctcagagctgtagtaaattagtcacttaaacttattaaaaccaaaaatttaaggaatacctctgaatataactcagaataatgtaacaagataatcatgagcctttacaagatttcatgttgattaacagtaaatagcttttttactgactgatttctgcttccaaatgacaccgcctaaacaaactttgttgccacagaagccacaaaattgtaaggcaatgaatttctgaattggggcctcaatgagaagtttgatttttaggatcttgagtgttctgaattgtgctcaacagtatttaccacacgtgttgcttgtttatgagacagagactacaaacatcttgaatgggacttttatttaaaattctagatgtttcacatttatattttaaagcaaaagatcttacatttgatcagcgtggcttttaattttagttatgattatttaaaaatatgctaagatattcctgacatctcaaaagaacaaattattactgtctgtcaatgcatttttagaaaaactgtatcataaaaaatgtatagcttcatataattaaaacattcaggtagtgtgcattgactaaagtaatatggactattaagtaattcaaaattgtgtttagcggcagcagctgtttaattaaaaggtaaaaactgcaactaatccactatggttgacagaaatacagcctatatcagcagtcagatcccctaggatagagaatatggatatgaattcaagaagtcatgagcttcatttaatgaatataatgaaaataaccacaataaatcagtactgaaacatactttatatctaaaattatctgtatgttggcccacttttaatttccttgtagctaataattttgcatttcgatgtagcaaaaaatcctttaacatacatattgtcaaccatcaatgcacacagcttttatcagagggcccatagcataagctcaacttataaggaggctagaaatgttcttagaatcagatgatcccttcaaagttctaaacttcagggttcaatattcaaagtactcactcataattaccttctatcatggagaaatacaaaatggccaataagctcataaagttaatcaaccttaccaacaagtgactaactgaacattacaatttcattacaaaattattttcacctacgatattaggggaaaaacctttttgttaattgaaaaaagaaactagtgatgttgaggatgatatagtcatttgtaaagataatcaagcaatatatatgatattcccagcccttgatccagaacttccaattctagtggaattacacaagtgggcaaaactttatgtacaaaaatatttattgcagaaatgtttttaatatcaggaaaatgtttaaaaatataaatcaatattggcaactgatccagaaactatggtaagcatacagtgaacaattatctgggcattaacaagaactggaaaaaaactatctgtatgtacattttatgtgacaaaaccaaaacaagccattggacaataaatgcagaataaattcatttttatacaatgaataattgtaaaatcaaaagatataaaaaaaattttcttaaatttgcctatgcttatgttaaagtaaactgtttaattcccttcataattttctgcttaaaaaatgcttatttttatattgtttaccctggctgtgctttaggaaatagatcagaagtatggaatgaggcagaccagtaaagaggcattgcagtaatacaggcaaatgaggtagaaatggaaatgtagagaaaaacaaaattataaatggcaaataaatgaattctttttagaacagttatactaaaataaaaagtctacctccagcaaatatatatagagagttatctttgaaggaggaaaaccaaatcatttcaacagtgttcttttatttccaggaggggaaaaatgtcctattaaaatggcagaagagaaaaggggaaggaaggggaagggtctctcttttactttacaaactagaaacaaacagttcacaggtttcttaacattcgtatcaaatgtcccgtggattttatttgcaaattatgaggccagcaaagcagaaaatgggagtctttaattaggaagaacaggtggctgagaggcacaaggtgagtattagccacatctctgcctggtgccaaaaaacacagatccgacctgcagaacaaattttaagggtgagagcgtaactgtctccagttggagtggagcttgagtggagctcaagctctgtattcagcttttctgaattatatttactcctatttaaagtgaaatggtttgctcttcagctttggttggaatttaccaattacaaattattgaccttcttcatattgacattctccacacagtctacaatcctctctgctgcagttgaagcaaattcttgacctgccaaatgttcctgtttctcttactgggttttcaaaatgattctcctaaacagctgattacgtattttaagttagaatgacaatatagggcttataaaagtggaacacagaggattttcagtgcattgaaactattctgtatgatactctaatggtagattacatgcaagtaactatttgtccaaactcatcgaacatacatcactaagagtgaaccctaatagaaactatggactttgggtgtcaatgatgtgtcagctcatcaactgtaacaaatgtgacactctgatagggaatattgataagtatatgtggaaggggagggagtattcgggatgactctgtaccttctgctaaattttgctataaacctaaaactgttctaccaagtaaggctattaagaagtgctcagagctgggtatggtggtgtgcacctgtaatcctagctacttgggaatctgaggcaggaggatcacttgtgccctgaagtttaaggccagcctgggcaaatatcacaagaccttgcatcagaaagaagaagaaagaagaaagaagatagaagacagaagaagaaagaaagaagaaggaagaagatgatgaagatgaagatgaagatgaagaagaagaagaaaagaaacttaaaaaccacttatacatagatacatattttttaaagcttttctgtcattaaatgttttgggtttacaaaattaaacatttggcattcttgctcaaaaacagcagtaatcttatcttaaagttcataataatcatatacgcccagcctctggctctcaacttatgagtctcacatttaggcaaatttttatgaattgaaccaatggcatttcatagtaacgtaagttcatgtccaagtgccacagcttgccacttgcttgattttaggcaattttcataacatcttatgcctcagtttcctcatctctaaaatgagagaaattcacatatctacttcactgagttgtgacaattaaatgaaagaatgcagttaggagctcagtgaagggcttagcacacagtaaagacttaagaaatgttaactctttttgttatgactaactacaacttaatgtaaaagggaactacaagtaattttttaaatcgataagcacatggagccttcgaggagaaaacatgacaccttcaaaaatgaatatgcaaggtttggaattcgttacttcagagtagaattttaccaggttagaggaatgacttataaccatatctaaaaattgtcattcttcagtgcattgctcttcatctgcatttgaagctgcctcgttataaaaaagctgtaaaacgtcctcaaagtaactttagttcttccccctaagagttcaaaatccactccctaggtttattctttggtacaaaaaccttcaaaagctgatttgctgatgataacaaatttgttttcagaaataatattcctgatctgaggtgataaacaattcagaactttcatatcattggggaattacatttaagagatcaactggggatctgtgaaataagaagcatttaccttgctagaggaatgctagcctgcatttaattgtataatatttccccttcagggtgtatgagacagcgtgttggaaaatggaatgattcttggctttattcagaaagagaacaaaggagagaaggcaggtaaaggacacagcaccatggaaatgacatttcgtttccatttgaattctaaagtactgaacttttaaaatcttcatttgaagaaactctgagaaatttgtcaggagggagtaagaaaaatgatatagcctaccacttaagatagggtgccaaaaaacattaacaattgttcaacctaaatggttagtattcaggttgaagggtggcagaatatgccacccctacatatgccactttagcataaggattattttgagctaaaggcacttaaaaaacagcaggtgctagaagggcgctgtgactcacccctttttcttcccgaatgcagggataaaaccccaatacagaagatgtcctctttataccagaaggaaagtcacatttttatcatcaaggatgaaaaggtgagacctggagaatgctgcacaaagataccatgtgaaaataattcttatcttcctttagcctgcctacagagttcacttacttttccacaattgcatcttttcagtcaatcgaatataaaagcatctaggttttgccatttctttatgtcttcatttcctaatgagggctccataaaacttctattaagtatatttgcatgcttttcttctgttaaactgttttacatcagtttaattctcaggcccagccaaaaaactctaacaaggcaggggtagaatttttgccttcctcacaaggtgttcgtttttctattcttgaaactttccgtatgtttcacaatttttataaacaaaagttgggggaatgaactattactaaaaaatctggaagacaaaattctgttctcatttgacacaccgagtatctatttacacttttctcggaaacagcgtcttctcctcctccacaaaacccatgtgctctgagggaggctgactccatcacttgggctataaggataagccacagctctggtgaggacaactggcaaaatcccatcaccctgttcatttgattggctcaggggatgagtgagagatgaaagttggaccaataaggatgaaggatttttttttcaacagttatcagaagagcctttccattttcctacaagacatgaatggacaaattagaaaggcccagtgccaggagtgacattagaaccatgatctgagagtctcctggagactgggcacaatatcaaggaaatacagccaagacacacacacacacacacacacacacacacacgggagaagggggaaggaaaaagagggagagtgtattaatctgttctcacactgctaataaagacatacctaagactgggcaatttataaaggaaagagatttagtggactcacagttccacatggctgaggaggcctcacacgcatgccaggtgaatcaagagcaaagtcacaccttacatggcagcaggaaggagagcctgtacagagaaactcctgtttataaaaccatcagatcttgtgagacttattcactaccacaagaacagtatggggaaactgcccccacgatttaattatctccacctgtccctgctcttgacacatggagattattgctattcaaggtgagatctgggtagggacataaccaaaccatatcagagaaaaacgtagagagaaaaaaggggaaagagaaaaaaaagagaaggaaaggtagaggaagagaggccatacatgcactagataaagtcgcacctacagctgagcaagatagtttccaattatcctagccaataaattctattgtctgcttaagctagaatgggtcacatttttagttgcttactagtgaaattatcctaacatgctaacaggcaagataaaaatagtctgagcaatgactaaaggagcacattttttacctcatatactgacaattcaagagcattattgcatcatttgctgccaaatggagaggaaagttggttcctaaggaccccctcggccagaaaagtacaaaacatctgttgaagtcatgggtgacttgttagcaaagttcagcagcagtaaagcttcctaagaaacaggtcttttctcaccagcgggtattgatataattagggtcaattacaatttagaatttccagggcatggggctgaattacagtggcatttaagagctctgctaaattttcccattcatcttgaagatttctggaggaacctgttgtaattaagtaatcttcttcttttcatttttatgacaattttcttcttcaggctttgcaattacccactactccaaagtaccttcctttagaagaagaattaaaaaaaagaccacctgattttcaatcgacaatgagacttggttttgctgcctgctaagtgatggattgtgatgtgtacagcaatctctaaataagctgcttcaacaagattttttaaactcccactgccctcaccaaacacagataatcccaaaaactcattgtctgagtgggtgatcaaaaacgaaagaggtgacattatgattgctgggcatcctttacccacgtggtttgtaagtagccctgggagatgtgcaaacaaactctattacttccttgtgggttttcacatatgcttcccccatacagattttatgaagacataccttttgagctttatgcaatcgaggggaaagagctttcactggattaagctattccaattgcatttaccttgggcaacaaagtaaaccatatccataaaaaacagccagaggcttttaagtattaggtcaatagcacttgagtatcatatagtcccaaaagaagctgtaacagatcatgttgattttatggaatgccttggctctctctggggagggagtagtacatagggagtgaggaacattatgacacctattactatcaaccactgttcagtgatggctttctatgcaagcacccaaccaccctgagaaaaaagtactaacatcttcaattgcacaaaagaagagggaaaaataattacagttagttgtctggtctgtgatcatccagctcaagtgaaaaaactaaaatttgaaaacctcatctttccaattccaaagtttatatttaaaaattgtacttccagtgttgaaaagtatctttgggaatagttatgccagtttctgactcacaataagatacactccatgcatgttgtgtgtgtgtatctaaaaccatccttgacccagtacaggcacttctagttaatctttcaactgatcttatccttgtccagcgtgtgggccactgctcatgccatttcttctacacagcatacctttcttttccctcccatttccacctatggaaatcttgcttgtaagtcaaagccctgctgtgaactaactatgtgcaagacatgacaaacacagcagtcagacagatgtagcctctttgttatctattccataataacacgaggcatgtaatagtgtttcacagtttatgaagaccttccaatgcacttccagaatggccaaaattccagctaactctggaaaacgcattccaaagagaaccaactagaataaatggggaaaaattttatgtcatgagtaccgaatgtgtgccaagtatttccatatatgcctaacttaatcattggctgtatgacaaaatatgattgcaagcatattaatgtattaattcaaaaatatttttgcaacagctctgttgttaaaggttctgtgttagacacttgatgcaagcaacacaaagatgaatcagacgagaggaaataaagtctacacaagtagacaaagaaaaacagtgctttatattggacattaacaaacaaaaggaacctgtaatcccagaactttgggaaaccaaagcgggaaaattgcttgagcccaggagtttaagaccagcctgggcaacatagcgaaaccccgtctctataaaaaaattttaaaaatttaaaaaatttaaaaaattagcagatcataatggcaactgcctgtagtcccagctactagaaaggctaggtgggaggatcacttgagcataggggggtcaaggctgcactgcggcatgatcatgctactgcactctagcctgggcgacagtgaaactctgcctcgaaaagaaaaaaataaataaatagaaggaaataaacgtgtgctcaaagggtattatggtagtagacacctttattccagcagctagtactgtacatgggaaagagcaaataatgattatttaataaacagataataaaaaaagactgggctgggcgcggtggctcatgcctgtaatcccagcactttgggaggccgaggccggtggatcactaggtcagaagatcgagaccatcctggctaacaaggcgaaaccccttctcaacttaaaaaaaaatacaaaaaaaaattagccgggcgtggtggcgggtgcctgtagttccagctactcgggaggctgaggcaggagaatgccgtgaacccaggaggcagagcttgcagtgagccgagatagcgccactgcactccagcctgggtgacagagcgagactccatctcaaaataaataaatgaataaataataaaaaataaaaacaaataataaaataaaaaacactgtggcctcatcgagtttctactgtagtacaccattgaaagagcacagaacactgaagtattcattgctacttatatttttaagtttttatttccattctacactccagtgagcaaatcaaaatgcctactgccaaaaaaggctcataattaatacatttttacttacaatgaaggctatcattagtatatcaccaattaatgtcagaaaaggaagatctgtcatgatattctgaatcgacattgtaaaaaggagaaaatatatggatggaaagtattctggcatgtttctagttattaagaacaactctgctgaacagcaatttgggatgatgtgaaatgaaacaaatgatatcactcattgtattcagtgtgatgatcagttggcaacaattacaaaaatgtaccagtaaggatataatatcaaatgtctatagatagtcaaaattgcaaatggcatggaaaaaacataagagaaaaccatcacacctttctctctgttttgcagtcaatgattttctcatttgtattctcctatactgtagacttcccaggacagagattacctgaggttcttctctggatctctagacaaagcccactgtccaatacttaatatatgactgttaactatggaaacaaggaaggaaggaagtcacaatttcattctgaaaactaatccaccttcttatcagccaatatgtcctccttcaaggagcagcactggaaaaactaatgaaataaaacaccaggacaaaacgtggtatccttctccagaatgcacaggaaatttctgaatattaccaagaattaaatatatttgattgttatatagcctcaaatgggccagcacttacttgtgagttactaatctaatctcaactatttcttttctttacaacattgtatttcaaaataactcaaacctacaattggttgcaagttagtacgatgaatacctgcaataccctacttcaactgttaaggttttatcatatctgctttctctcttttacacacacagacacacatataggcacacactcagcaatatcatcatcattttcccaattgcttcttagggcacaatggtttgggtattcaagaaaacaagaataaaagtcatggcatcctgcagaccaaagcaagacctaacccttgtgtgaggtataatcagtatcttgagtgaaatcatttccctggagtgaagagttcccagtgcaatgaacagtgagaactacaaccggaaaaacaggtagcaaagaccctaataactccatattttatctaataagaaatgaagtgctgaagatttgtgagtgggcttgtaaccaaataaaatgatttttcccaatataaattagagatactatatcaaacgcacagcagagacaagaaggtggtggcaggaaaatcaggcaagtttaaaacacctagagtattagcaaaaaaatacataatataactggatttgttctattcctctaacaaaatataactaaaagggtttgaaaagtcatcggccaacaatatttaatataacatactcaaatcacatatatttcaattaattaggtttctacaggagtaatgtggtatttggacttggacattaaatcaatactggccttacagttacttcccatgttcttcagccctccattacaatccactcccctacccaaaaatcaataccaaagccttatatgagacagaaaggacagtaatctttaagtggaaataggaatctaaattacaattgtaaatgtctaaagcttgtagtctggggattttcctaatgggaatatttgatgtgactttttgttattcttatggttgtgctcataagcacatcacaaggatggtttaaaggcccgagcaccataaattagatattctttaagaaatcatgttcttgacatattttttcattatctgagaagaatgaaacagattttttttgttaattagtgctaaggcatgtattttgcattagcattaagtttaccaaaatggctttaaaaacttgaacagatggcagaattataataacttttccttatgatttaggttaagaataaagtgtcatgagaattctcctcctacctaacttttctataaagttaatgcatttaatagatatggcatgtttgtttttctcactgaggtgtaaacaactctatcacacctcagatgagtataatgagatgcgggaatacatttcaatactctctacctagggtaaagggattttccagggtttaaacatcaaaccacgcagaaacaactccaaaccttcgacaataactgcacaggatggcacaggggttgcaaagacagatgtctttaggggcctggcaggtactgaaaacgagtaaagtagacttgctctgaggataatagggagtagtgggaactgcagccagccggacagagcaagcaccacccggggcgacaaacccaacttctcaccaactgctttcaggaatggaatgaaggccctgagtagctggaatcacttattttccaaaagccgccccaaatctaactttcctatgtgaaatgtcccaataaaaatttcggtggctagtttatatttttttaaagaaaagataaaataaaaagaaatgaggactaaagaaaacagtcagtggcctccaggaggaaccatgagacattagtctgcagccttagatggatatctataactggtgttcatggacctgggaggtggaggttgcagtgagccgagattgtgccactgcactccagcctgggcaacagagcgagactccatctcaaaaaacaaaaacaaaaaaaaacaaacaacaaactggtgttcatggttagtgctatggcttatttcatgccctgtccttgagggggatctcagcccctaagtgaaacacttgaaattagtaaactgggtcggcttgcaagcctgatttttgaaaaggtattatggtgaaacctggaaacctgcatgaattctaatgtggcccacctttatacctatgtgagatgatcttgagctctgtaacctccattgatcttaccagtggctcagctagctctcattttatttgtcttcttgactctcccttaaattccccatcgtgcctattcccaatttatgcctcttaaaagtcattagtaactgaaatgagcaaagtttaagaactggtgcctcttcctggcctccatatgctttaatttcattgcagcattggatatctcatcttcccatgtctcttatcatcaacctcaagctccccaaatttccttgctctcactaaatttacccatttttctcaagccttttaagatttcttagaatccagaactgtaagcaataaatatttgttgtttctaaatcacccaggctaaggtattttgttatagaagcaggaactgactgaggcaaaatgttatcttgcttaattcagaagacagaccctatggttacgccattttgtagatgagctaactaaggctaagagaggacaggtaacttgcctgaggttacacaactaggcagaagccaaatccaaataccagtcaagcactagccaccaggctctcctttctcatctcccacttctaatcaattgataactttggtagatcccaccttggtttagtaccttgcatccacacctctgtgccatcccagcaccatcataattctaatcatacatttcagtatgattggtcaggtgcaatagtctcctaatctccttaatatctctagtttctttctcttcaacacaaatttccacactctatgatcttactaatattcagctcccatcatgttcttcagaaaaagaaaaatgtgtggaacctacgcaatgtctaggtctgttcagtgtcttcaaggtattttacaactctgttacattacaggtaactaatagtaatgcaaaatattaagacatgcaaattatttcctgtttgatacaggtttactttgacctccttccttcctgccacctggaggaagaaaacagctttgcctccattttcacacacatttcaatattcctgttttataaacatgcctgttgtttggattatcttttaaaccagttatatcatctgcagcttcccttgtgaattaaataaaatctttaacacaggttcatttctgtatctgtctgagagttatgacttaacctattgctgaaaatgttcttctaacatgtttagctcctaacagatccttgctctaaaaccttcaatggacaccagttgccaaatgaattaaatccagaaacgttaccctggaattcaaaactaagagtatcatctactctgtcagtcatatattacactgcttgtccattcacatcctgcatggacaataaaagaaactccgtgggtgccacacatttcactctcccagttttcttcctctgctgatgctactctttcaccctggattgtggcttttcatagagtgttcaacataatagctgctgtggatgccctaacccatgcttctcaaacatttcacagtagtaacatggcatagggattaacatttgcttcactgaagtaggggagcaggaggaggacaaggaaggtggaggtaaagtagactgctacaagcagaaatttctttgatgtctcatgctttagctcaaaaatatatgcagattaaaaaggaatgagatcatgtcctttgcagtgacatggatgaaactagaggtcactatccttagcaaactaactcaggaacagaaaactgaataccaaatgttctcacctgtaagtgggagctgaattatgagaacaaatagacacatggcgggaacaaaacaaactaaggcctgtcggagggtcaacggggaggagagagaatatccggaagaagagctaatggatgctgggcttaatacctgggtgatgggttgatctgtgcagaaaaccaccatggcacatgtttacctatgtaacaaacctgcaatcctgcacatgtaaccctgaacttaaaagttggaaattaaatacacacacacacacacacacacacacacacacacacctctgcagattttgtacacactccatcatatatcagcaggggcttttgtgaaaaataatattgccacctccaaatattacaataaaatttcccttcctggcaggtgactagtctgtggtgttgtacatcccatgaaacactctgtgacaacgttcaactttacctgagccctgtgctcccagaaaaccagaattaagaaatcttcaatcctttctgtaagatcccatctccatcgttcctcaggattcccttgtttagcggcctctctaaaactccaggcccacttcctcttcttcaaaatgttctaccataattaatgctctccctgtagcagtatcctaaataaaatcacctccttaactgtccagtgcattatatctttgacatatggcatcccttctttgaaaagtccatgattttagatggtgcttcctaagattattactttaaaatattaaattgtgatagtagtataggggaaaaatatattttcctcactcaccactaagttcatggctgaggcacctataacaaaaggtagatcaacaaggaaaaagcatataaatctattgaatgaattttacgtgacatgggagccttcataggaaaatgaaaccctcaaaatagggaagcctgtgtctttttctatgttggtttgatggaaaagtggatagtaatgaaaaagtattattggatgaaaaaatatgatctaatggtaataagctgggagggactttggaaggcctgtttgctaaatcttctttgtgtccctgtatcttcagagataaggatgttccctttctccagatctgtggagggtacctcttgaatgagggtcttatgagaaggggaaggggaaggggaaggtaaaagagatcttcctgcttctgctatgttctcaaatatcaagatgccatattttgaagtcatgtgtcctgaaccctattcagttaaaaaaaaaaaaaagacctaccttgatgtggttccgaaagatttttttcacctgtccccatttaaaatgactaccaaagttatagccgtcaaaactacataggaatctctgcagcaggccaggaattgctgaggtagagaaatagaagaagtgggcagagacctttcctatcacccttaaaatatctgaaaactaaaactactggaaatagacactagttttcattcaatctttctttcaacaaatgttgctcagacatagcagatgagcggctgggtactggctatacaatctgttcaggggaaagctatggaatcttgattaaaactttgaaatccaaaccacagataagatgaaaaggaagaagatgagtagtgggtgtggagagaccttcaaagccggaaggctacaaaacatcaaaacattctgaggacaggatgggaagaccttaagttatggcaactgcaaataataatggcttacatttgttttaagggagtatcttaaaatattcaggaactaagcttagtaatttacattcatcaccttgctaaatccttagagtaactccaggagctaagtactattattatccccacttaacataaaaagcaacacagcctcagagaggttaattaacttgcccagggacttgcagacagtaagtagctaggctgcccaactcaaaatcatgtttcaataatgcaccccaagtgctgttaccatgggttttctagaaagggtatccaatataaattggaatccagagtgaggtggagaaagagtaaagagtgggtcagatttcctatgccaactcagggagtgtgaacttcaccctggcaatgggatgacaaggaaataattcaagggagggaaagcaagaggctgggacctagcaatggatacccctgtaccactgggccccttccagagcatgaaaatgaatgagaatagggtagaatacaaccacaggctcaagtgtctcaataaccacaaggtcagaaaggatttgctttaaggcaatatttaaacgccagtgaacactcaggtctgaattctgtgcatctaaccactacaagttagaagagaaaaaaatattagtgttcttaaggaagatctagcaaaaccatccttccagttctaagggccgtagagggtgtaggaggttggttcacacttcagggtgtaccaattaagtatgatgactgcagcaaaatagtgagtaacacagctagatatttaaaagcctcagttactggattcctgccactgcaggaaacttctgtcttgactaaatttaaaaaaaaaaaaaagaaaaaaatagtgtcaggagaaacaaagtgtaaaatacagaacttatttttcttcctgccaggtgtaagcgttaaaacttggcgtattcactattgtttagaagtttgaaaacttttaacaaaacaatagaacacagaagtgaaaaagtgattgttggggctttagacttaacacaaagcttttgcaaataaatgcctctataaccttaatgaattctaataaaatatattatgctatttttttcttgtatctgtcagaggtgtttgaaccagagcaactctatcttgaatagcggctgggtaaaataaggctgagacctactgggctgtatttccaggaggttaggcattctaagtcacagacgagataggaggttgacacaaggtgcaaatcacctgataaaacaagatgcagatgcgtaaagaagctggccaaaacccatcgaaaccaagatggtgataaaagtgacctctggttgtcctcaatgctcattatatgataattacaatgcatcagtgtgctaaaacacactcccaccagcgccatgacagtttacaaatgccatggcaaagtctggaagttacactatatggtctaaaaagaggaggaacccaaccctcagctccgggaattgccaaccccattcccgggaaagtcatgaataatccaccccttgttcagcatctaatcaagaaataattataagtattttcagttgagcagcccaaactgctttccaaataaacttgctttcactttactttttggaatacaaaagtattttggaataaaaaaagtacttatccctttactttcctaataaagttgatttcactttactctttggactcactctgaattcttccttgcatgaggtccaagaaccctttcttaggctctggattggtacccttcccagtaacatatccacgacaggtgagaaaagaaaaacaaaagacatatatatcatattacatcctacctaagatggtaccaatcgcaaggaacgtattaatttcagagacggtgagtattagaatcatcaaaatacactataattatcacattcatgagtcctgttgatacatttattttactgtctaaaattcaggagtttatggtaagggagtctatttgtaagagaccctgttgattttcacaagtcaagaaacaataaacttcaagacatactaaaaagaaaccagcctgatgtcagatcctcttcaacatagaaactatcctcatagtaaattaaattgaggaaatatttaatggataagcttgactttgtaaacgtgccttcctgaccaataggtacgttactgatgacgttcaggacaccccactttggcactggaggaaacagcagaagcaagaaggtctcttggaccttcttcctgcccttctcctctgaagcagactatacagtaattctctgacctctgcagtacatcattaagactcccatttcagaggttctctcactgtacctggagaaaaggaacatctctgtctctctgaagacaaagggacacagaagaatctgaacaaacaggccttcccaagtcagcccagtttattaccattagaccataaccttttatcctcctataatatttctcccctaccatctactttatcaaactgaacattaaaacatgtacatttccctatgtctttgggtcttcattttggaatgatcctgtgtcacataaaacttatgttaaataaagttgtatgtttttctccggttaatctgtcttttgtcatagtgtctcagtcatgagtctagtgacagatgaaaaatcttttgtcccctacagcatctatgaagatccaaagaatgtcaaagtataatttttaaaaagttacaaacattgcttttagataaatataaagcaaacatatcaaaatgaatttcttaatgagggaaccagtagcatggtgtattcatacaaaaagaattaaagaatctaagtacaaataggccctgacaatgtcaaactttacctgagccctgtgcttgcagaaaagtgatggttaacaaccacccctacaaaccttttgaaaattaaaggcaaaacatccccaccctttttggttctgggaaatggctgctgaagagaactacccttccccaaatgacttagatatgactattcttactctatcataattttcacaaaatgtgcagaccaccccttttgtttacctgtaacaaggccagaaagagacccaaccctttttacctctagccaatttcccactctgtggctcaggattgattagctaagattagaactctttttacccctaaaactgctagacgctgaaataaacatttcctgttcagctaactgactgaaattccctgacggcaaaacaatcccagctgtgaatctcttacctaaagagttaaccaaataaactctttatgtggttaggtactttatatgacttagtacatataaagtacaaagaaaaaaagataaaaaaaaaagacttggatttgaagaacaaagaactttagttctttgaaaggcacagtttaggaaataaaaagccaagtcacagactagaagaacatatttttaatgcaaatacttaataaacgacttatatctagaataaaaaataactaatatctcagtaagatagtcaacccaattaaaaatgagcaaagtacccaaaatgacatcgtacaaaagaaaacataattacaggaaaaaaatgcttatcattagtcattagggaaatgcaaattaaaacccaaatgagatactgctacacagctaaatagaatggctgaaataaaaagactgacaatatcaagtgttgacaaggattggcagcaattaagaacttccaaatgttgatggtagagtgaaaactgatataaccattttagaataccactggcaattccttgtaaatttgactttaaatatagcatgtgactcagtaattccacttgtaggtatgcatccaagaaaaatgcaaacatattctccaatagactcatctatgaaaaattatagctttcttcataatagccataaagtagacacaacctaaatgtccactatcagatgacttaacaaactgtagtataatcatgcaacaatactactcagcaatgaaaaggaatgaactgttgacacatgcagtaacaagaaggagaaaaggccccaggaacaaaaagatacatgctacatgattccatttatacaaaatacttaaaaagccaaacctaatctatagcatcacaaagcagatcagtggatgcctgaggccaggggtggtagagaggaggtggaatgcaaaactgtggaagaaacttattgatttgatgacagtattctacagtaatccacagtgtatgtaaattttatgtgtgttgctgtatataaatgatatcaaaaaattaaaactaaagaaataaagtctttagcttaaatgcatctttcaacaagttcttcatttgcaatctagcttatcacattagaataattggcagtctcctaggaaactggtctggagaaagtgagtgtttttttttttaaatgaaaagattttagatttacgttgagaattttaccaatcatcttaaatatttttcctttgaatctatttgatctgttcaaattaaacttgttatgtcctgaggtggttagctaagggtaccatcaacaaagtatgtggcatcagcttccagtgaattccccaaagtgggggagaaaaatattagagatggatccaaagagaaagcctttcaccaaaatctccattcagccttgcttttcatcacttaaatcctagaagaaaatgttctctgaggaccactctgtatgtaggagtagcctgatgagcaaacataatacttctcaagtatagacatgataaagcagcaaagtcaaaaccatggacagattcaagtcataaaaggattttgaatacatttagccatgcactcactgataaagccttcctaccaatagttcagctcatattacatataacaaggaccagtagctagaaaagctaaagcttaaaaagaaaaaattatcacagtggaaaattatcattagaaatactcaacttaagaaaagacttgaaaacctcttctgtacacacagcactttatcactataagttactggttctattatcttatttaatcctaataacactaacaataatacattaagagagttaatagagagttaatataaaagcacaatagagcaaacactgcatatagagcatttagaagtccttcgaaagcctctgctaggaatggcttcaaaacccagggagttgaatgtggactctccttttctcctttcttttatttcagtggttcttgaatgttcaagtacatatcaatatatcaaaaccatgtactcattaatgagccacttaaggaaggaatttttaaggcaattgtgatgaaatgcgactttcacctcactgtttctcaatctttttttcatcatcatccctgcaaggagcgttttctaattgcccccctgaaattttaataccacagattttctttatatccttatacgtattgtctctatgtctgcgctttacacataaaaagaatgactttttattgctcccaagaattaattttcaccggcttgggggtgatatcactcccactgagaatgcacgacctaacctggacctctagcttaatatgaacctctcctgtttatcttcaatggctcctttcaatgaaaagtctacatcccagagccttcttggttgaagcatatctattaaagtttgttttctttataccaagtttttcccaacatttctgctgaagtacacaatgatagtggagaaggaacatacatgctgaaaatgaaaaacatatatagacatatttagcaagcaggaaatgtatttgagctctgatatcttaaaacattaagcaaacagagaaagagtagtctttttaagagatggtccttggacaagtggatatctacacacaaaagagtggaaggctcctacttcatagaatatataaaaattaactcgaaatagatcaaagacctaagagtttaaagtataaaacttagaagaaaacatacatgtaaaccttcatgagtacggattacacaggggtctcttagctatgtcagcaaaagcacaagcaacgacagccacaacaaagaaaaaatatatataaattagacttcatcaaaatgtaaaagtttgtattttgaaggacatcattaataaagtgagaagacaatcaaagaggaatgggagaaaatatatgcaaatcacatatctgagaagggacttgtatctagaatatataaagaactttttcaactcaataataaatagatgattcaaattttttaaatgggtaaaggttttaaatagacatttctccaaacaagatactcagatggccaatacgcaaatgaaaagatactcagcattaaaagccatcagagaaatggtgatctaaacaccatgagtcaccatttggcacccacaaggtcacctataactaaaaaaaaattaataatgatggggaaaaatcagaacccttacatcttgcaggtgatcatgtaaaatgatgcatctaatttattatatacataaagatagtatatataaaggtatatatattacccagcaattccactcctagttatacacccaagagaaatgaaaacatatgttcacacaaaagttctatatgaatgtttataacagcatcatccataaaagcctaaaagtggaaacaccccaaatttccattgatggatgaaaagataaataatgtggtacacgcatacaatggaatattattagcaataaaaaaataaagtactgagacacattacagcatgatgaaccatgaaaacattattctagctgaaagaagccagtcacaaaagaccacaactgtgtgatttcatttataggaaatgtccagaacaggccaagatataaaaacataaaatggaatcataatgcccagggccgcggagggggcttcatgagaaacagaaatgactgctaatgcatctggggtttcttttggtggtgatgaaaatggtctaaaaatgactatggtgatagttgcacaattctgataatgttccgaaaaccacagaatatacactttaaatgggtgaatggtatgctacatatattatatctctctaaagatgtttgagcaggggaagggaaaggattaaggaggagttagatcctcagatcccatctcccactcctgatagccaggagattgcgacaccccctcatcctggccagtgacttaagctttgttcctgtagagagtaaaatagagggtctctgacatagagtaccccagcaaaatgagagagcagggctgcaggagagatgtctctaggaagatgaaagtgccagaataccagaagtgcatgaacatcttgagaaggtatttagacaaccagtgaagactttgggggctaagacagtgataagtatttacaaaaccaagcaaattaaaaaacaagaaaattattacatccagagaaatcaaaagtcaggcaggatagaaagtgtgatggtagtttactccacacttcagctttagatgacatttcaatactgtactaatatgaatattaatttcatcaaatttgcagtaaaattacattgagataagggacagaagaagagcgtgtgcaatagaagtgaagggaagactagtgatattagttatgttctctgcttccatagtgcaaaatcaatagaaagagcttgaaatgtaaaaaataaaaaagtatacatattacttagagatacagagataaatactaaaataatcagtttaaaagaaatgagggagaggaaggagggacaatgtaggggttttgaattattttttagtaacaagccttatagggctacatgaggtcacatatacacacacacacaataaatgggaaatgcttgcaaattgcataatgtaatgaaaattttcaaatactttataaaaataccatggaaaaattatgctattataagaaatgttatgtgaattgtgttctcaataatatgatttttgtcataatacaaaaatattttaaattactcagtaggtaaagtatttaactttgttctcaaataagcaaaattcctcaaaagatgcagcatgtttatcctaggtctccacgggcctctgaacacaatagcaattaccactataaaatcccagtctgagattttgtgcttaacatatgaccgttcttccacacttagcattttctactgtatacatcattaattcgtttagtaaatatttaagcatttactaatgatcaattcaagtaaaataaaaatatctgatctaggactgatcctaacaaattagttttctggaattatattttttctagattgctgatcaccacgtacatgaatacaaaactatttattgaagatgtgtgatattcagcctaaatcttgtaaaacttggacttgatagtctaagaagctattatgtgcacacatatttgaaggacatttttaaaagtgctaaactataaatattctgattcactgctctcttacatgcactaaaaatgacttcgtgcaatcactaaccaggaggtaggttttgtatcttactgaaaatgtcacttaataaataaccttcaaatttaaatgcaaactgtggatatcattcatagaacctcaaacttgcccttgaagtctaaatgggcaaacaaggtaactacaaaaagcttttcaggcgttaacaccctactgcttcaactccttgaaaagcagtctgaacttttgagtttttagcataatattcttatgctgaataatctctatctcctatagcatttaggctgaggacgttaagtatgatgtactgttgggataatttgcaattttcacttctcattctcagattagattactaacagtgttggaggaaatcactttactgcatagttcattcatagcagttcatttgtctattcaaaacctgatgtcttgtttatggctgtatatcctaatgtgttgcattaaggtgttaacagaactagttgcaaccctaaaattggactaggcaacatgacttgggactggcacagtcagagaccaggaagctggacatttattgagtaagaagaaagggaaattttgagacagagaatttgcaattatgtattatttacattatgtgaagttgactttttcattagccagtatacatccttgattgtgactgctatatatagtttacttttatatcctccatagtatctgtgttcacagtaggtgtaggtgtggtcgacagaatcctggccacctatagatgtccatgtcctaatactcagaacctctgaatatgcttacatgggaaaggggcattaaggttgcagatgatgaaggttgctaatctgctggccttaaggcagggagatgatcctggattatctaggtgggcccaacataatcacaagggtccttaaaagatggaagagacaggctgaagagaaggtcacagtgatgaaaagtgagaagtcaacctgccctttctggctttaaagatagaggaaggggccatgagaagctggaaaagtcaaagaaacaggttctctactagagcttccagaggaaacacagccctgctgacatcttgattttagcccagtgagagccatttaagacttctggcctccagagttgttaaatgattttatttttgttgttttatgttactaagttttcagtaatctgttatggaagccatcaaaaactagtaaatgattaatttaaaactttcaaagtaaaaaataagaactaagaagaacacctaaaggaataagtatgagccatcaagatattttcagttttctacgtctttaaccttattgggaacctttggttgatgtagttaatcactggagttttcctgtccattcatttgaaatctagaatttctttccatttgaaatagttttcttttactgaccagaagctaaactgtcctggatcacctgctggctgttcttttgagaaatcttggtattttccagtgagttatgactgcactatgggatactacttcctgagaacacaaaagttgctttagcttatcgctttaggcagatatttttgcctcagttatcttttagctgtgtatgacttaaacacaaaaattttaaaaatgtgggagtgcaaagaaatatcttttgaggtaggcagtcttttatctatttctccattcaaccagcatttgctaagcatttaaaatatcctagcattgagccaggcattgagtatgtgaagactgaacaacacagggtcattttcttcaagaagctcacagtctagtgaagcagatagaaatgttggaacaaataagagtttaagaaaggaatctgtaagtgttacaggaactttgagggagaaatgtctaacttcattttaaaaaactgccatttcggttcataaaaaatggggagttacacccctatgggtgaacatttgctgaccttgtaattagttataaactcatgggttggttagaagattcttttaagtatctattcaggcccatagctttctctgaaaatgaccaggcctcatacgacgccagaactaacatgaccaagggggtgtatctgactctacactgggccagccaatcagattctcagtccagagaatttggaattagaattcatgggatgaggttgtatctgttgtgacagcgaagtcaggtgacagagactcagtggtctaagagaccaggccacgcaggcgcatggagccccagcacagaaggcagcaaacagagaaaaagaaggccaaagcacagactccgaccacaactgcagttcttgcttgcctcccccagtgaggctttgttgccctctctctttcctgctgcagtgagagacacatttgtgtccttcacatacaatccctattttggttaaagttactttgagtttctattacttgcacagtgacatggttctacctttttaaaacagattccacattttcaccagtccatttgcctcaataaccttacctgcaatatgggaagaggaaagcagtttcctttcagggaaaaggcagtagaactcataaaagatgttcaagtataaaagcacttggactataaattatcatacacatgcagaagattgaaatctgtaactggttatgaaatattgttcacaaatgacccctattaaaagccaaatggaaggattttccagcaaaaatgaggtaggaaaaaagctcaaataaaaatgggccaagattctaggcagagctctaatattcagtttcagagattagttcggctttggccatttccaagtgtgaaagagggatggggcgaagaaggtaatggcaaaaagagaaagaatctacaaagaaccatggggaggaacaccggcaaggattttatccttccagagaaagccatatctgctgttaaaacacagtgcacagcagactgacaatgatcttcttgcaataggtcatagaaagggcattaaaagacaactttcaaaggtctcaaactagataaaccgaaatcagtaatagaggacttatgctggacctataggagattttcttccaggtgactattaccagaggaatctacataacagtggactgctgctatttgggggctaacttctgctgcccacctttgaagtcactaatagcttgttagcacagaagccacgctccgtggctcacacctataatcccagaactttgggaaacaaaggtgggcagatctcttgagctcaggagttcaagaccagcctggtcaacatggtgaaaccctgtctctccaaaaaaaactacaaaaattagccaggcatggtggctcacatctacactcccagctactcaggaggctgaggcaggtgaatcgcttgaacccaggaggcagaggttgcagtgagctgagatcccgccactgcactccagcctggggaaagggagtgaaacctggtctccaaaaaataataaaataaaataaacgcccattagcatagacaaagagaaagacaagaaagtaaaaccttagcttatgttattccctattagcatctctgataatggatttgttcattaacaagttaggaactaattgaactggagattcaaaataatctaaaaatttcagttcttgatgttagtactgctgtctctatgcactatcaagtgcacggaaagtatagaggtcaatgtatggcacatctgctttccattaccatgaaattcacttcaacacatcactgtcataaaaaagtcctatactaagcattctgttgttggtattgatccttcccttccatgttatgaagatagttattcatttttgcagactcaacatggcataatgcctggcacagagctaatactcaacatctgtgaatgtataaaagagcagatagtagaggctccatgcacttctgaattgctgaccataattgttaacattttctgaaaacttaccaaactccaggtgtagtaccaagtgctttatgtacattgtttcattaaaccctcacaacaacccaatgaggaaactgaggcacagagacctgtccaagatcatagactactaactggaggaagtgagatgcagacagaggcagcctggttccagagctcaagctctacaccacgctgcagtactgcctcccgtattctagtcctctcatgaaggcttgctgatggtctagcacatccttcatgctctgcgggacacaaaaccagacacaattttaaccttgctctttggagttaagagtgagagttaagtggtatttatacaattaactccaatatgaagcagaatttaacaagtatgtctagaaatgaggctgaaggtacagaagacaggaacacaactcttagctaggatgggagagaaatggaaggttgcatagaccagggacacataggctgggccttaaattatatagaagatctgcaaaggcagagatagagaccagattatagtcagcaaaatcatcacatgtcagaaaagtcagtgtgtgtctggggctatctggggcacagggtatcttcaggaagcagtaatgatgaatcctttaatgatactctaccaattcccccggtgtgaaaacatatcaaatcttgaggtacagaaagggggacaaaccgaggactcccaaaactaatcaaagaatactccttgaagttctgaacattaatgaggatgaggacctcactgaatggccacttctgtacaaactgagtttgaagtcacagaaatgttagaactgtaatcctaaaactcagttaagagggaagtgcatctacaaatcaagacagacctccagctgaaaatgcctcaacagacacttgcataggccttccttccacctttccgtgtgcaaacggatactgtgattttgagaatgaaacatgatagctcctgcatccactactaacaaaagcaagtgactggcaatgagggtaaatcaggcctcccttgagttggtccttgaaggtgctatcaaattaacgtatgtctaacaattctgtctccattcaaatcaattcgcctaggtagctaacctgctcactgtttctctaacaaggtaaacaatggattagtaaaaactacacatatcagacctggtttcttacaacattaggctcaaaatgcaagatttacataaagagaacatctatggtgagaaataatttgcttagacaggaaattttatcactgccattcagttagttggaaaatgaagatttagagatttggggaattctctaatgttctacataagcatagggtaaaataaaaacttcgtatttctttgaattaatatccaattctcttctagaggaaattttattgaattggaagtgtaattcttctgtttaaaagaaagcctcagccaggcatggtggctcacacctgtaatcccagcactttgggaggccgaggcgggtggatcacaaggtcaggagttcaagaccagcctggccaacatagtgaaatcctgtctctactaaaaatacaaaaaaaattagccaggggtggtggcgggtgcctgtcctcccagctactcaggaggctgagggggagaattgcttgaacttgggaggcagaggctgcagtgagctgagatcacaccactgcattccagccagagcaacagtgcaagactccgtcgtctcaaaaaaaagaaaaaagcctcattattttttataatgatcatgctgatcatactgctattctagtcactgtcaataaacaaaatgacaataaataaccattacaaggcagcaattaacatgatggtacctcctaacttctaagcttgtttctttaacgtgaaaacactatttctattggcaagtatgtagatgagagctgagtcttcctgaaggacagattgaaagagttttcacaaatatttaaaatcacagaaaaagtaatgttctgaaacatttacagaaattaataaaagtatctcatctttgtgtagattaaatattaaaatgcacttatataacttttattaaaataattaatatttaacgaagacaattgaaagaacacaactatgacaaattacattttggcagtaatgataagcctttgagttctagttctttctccttagggatgttacatatctgttttctctacttaaatcactctgcctcattatcatctctgccttctactctcagttcagcttgaaagttcatcttatacagggttacacgattttataatatcagataactctctttcacaccacttaccagagctctaatactaacttatgtgtctcattcttggttgaacatttctctacctcactagattataaactccttgagggcaggcactggttccactctcttccactaaatccccaactccaaaaccctaacaccttaacacctaatatatatatcaccatttacatatcagtcactcaataaatatttgaagaacgaaatgacaaaataccctttacctgaatgcttacctaaaaatgtatcttatatatggaatgaatgatccacacttactacatggatgtataaactcaaacattatacttttctttgcacatttgagaatatgtgtcataagctatgtttacaatgatatggaaacaaaaacttgtctataacaaaaacatgcccatagcaataacagcaacaacaagaagtggttccaaattcaaggtggtagcacagcttttttcaaaaatttgagaaaaaacaaatctattaaaacagaagatatagtctcttggactccactaaaatgagtctgttcaggtctactacaaaacacatctttaagagagattcatggccttagtagccagacagtaggtatggcccagaccttcccagcacagcctatgtattgaagactttagtgaaaacactcatgtcagcaaatttagcatggataattgcaataggaagttctataactttgctttagggaaaaaaattctattttaattttcattcccaaacagaattatgttagaataacaaaataaacttccccacatttatctgttttttaaaaatgatagtctcaaggaagagaaactttcttttcattcatttaataaagatttttgcattttatttaaagactccttatggctatattttaaggattcaagttcatttatttgtgataactagaaaaattttttgtccctttgtgaaaattttggaactaggcatattttcattactgttttcattattactgacaacttggctccctgctctgggaaatatttctggaagaaaagaaaaaaaaaaaaaaactatgaatcaactaacttacttagcaaggtcatcagcttactcaccagggcttatttcaagaccctctctgtgccacaaacacaagactactttgtctaaactcttgtccaattccaatcatttctctgacttgcagtacctgccttaaagtaatgcagaacaagcccagaactccataaatgtgctctcctaatttatccattttgagcaactaatcagattctctcaatcttgtatattcttttcctatagatctaaaatcatagctttgcttgatcaacaggtttttccggtagtcttgtggaaacttgacagtaggcattcatcttatatccactacacagaaacctgagttcacagatgttgtcttagtcaatgccatacacacacacacacacacacctgtgaccagcacagtggttggcacataatatgtgatcaataaatgcatacttaggaaagaagattttgttctatagtattacagagggtcaaagttcttataaaggagagtcagttactaaaactaaactgatattctatcttctcatgtggtctttcggcatcagtcctatcctacacaataatgccttgcaatctgtagttgtgaaattagacttctttttatgtgtgcacaaattaagccagtttctacaaattaaagaacatccagcaattattgctctccttcaagctgaccaataggataagtttaagcagtagttttgagaatttgtttttgcaattttttttttttttgagatggagtctcgctcagtcgcccaggctggagtgcagtggcatgatctcggctcactgcaagctctgcctcctgggttcacgccattctcctgcctcagcctcctgagtagccgggactatagatacccgccaccaggctggctaattttttgtgtatttagtagagaccgggtttcactgtgttagccaggatggcctcgatctcctgacctcgtgatccgcctgcctcggccacctaaagtactgggattacaggcatgagccactgcacccggcctgtttttgtaatttcttatactacaatgtttccttctggagacagaggaagtccagcagatgaagtctaaaatactctgcttattttgtgaaaagaccaggcattcacacaagcgtttttctcaaagctgagaaaaaggaggctgaaggtgcaaaagatatcagagtactcattcagaacccaagagtctataaaatataaacctggtgagagaactggcctcagccaatggagatgcctcaatagtgtttgtgtcacgagcgaacaaggtgaatcataaaaatattttttaaacttctgtttcaaaggtgcaaaaggcatatatattagtctctttgcattactctaaaggaatacctgagactgggtaatttttaaagaaaagaggtttatttggctatggatctgtaggctgtataggaagcataacactagcatctgtttggcctctggtgagggccttggggagcttacaatcatggcagaaaacaaaggcgagccagcatgtcacagggcaagagagggagaaagagagagagtagaggaagtcccagcctcttttaaacagccagatctcatgtgaactcacagactgagaacaaactcactcattactgcaaggatgacaccaagccattcatgaggaatccaccctcatgtcccaaacacctcccaccaggccactcaaccaacaatggggattacatttcaacatgagatttggagcggacaagcatccaaagtatataagtacagcagctagaactttcagttacttaaaaaaaatcttgctgacatcttaattacctgctgaagtcctggtggtcagcaagaaagcagtgaaaacatttaaaatttcaattttcatattaatggtcctaatttctggatctggttttctcttttaaccatttgcataaaaatgttttgtgagggacatataaagaagttggaagctgcagatataggcgttaaaaaggaattatttagcagacagtgagggtatggagtcctccgtaaggttttcctttgaatgaaaagcagccgccaaatcattttcttttctaacaaagagcagcctgtaaaatcaagctgcagacccagacaagcaagctggaagcttgcaatggatgaatgccagcagttgtgccaataagaaaaagctacctggtactaagcatgctcaaaatggcagctccatcttcccttttctttgccagccacatgtagagtaacgagcaggcaacatggcgccagctgggagaagtcgccatttgcttaagatcagggtagggcatccagcttcctcgcatgttatgtaaacatcacacctcgtccaaccaatctttgggccctatgtaaatcagacaccgcctcctcaagcctgcctataaactccaatgcactctgccacaggctggaagtctcattcaggcacccttttctctctcaagagagaaagctgttctcctttctctttcttttgcctattaatcctcagctcccaaactcactccttgtgtgtgtgtgtccctgtccttaattttcccggcatgagatgacaaatctcggatattatcccagccaatgacactgcttcactgcaatttgcaacaagaaaaatatttacgacaaggaaaaaagatgaaccaactggaaattaatgacttttttagattcagcagagaactgaggtccaaagcaaactagtatccccaaatttggagaaacatgtaaacacaaagaatcataagatcagattacctaaagcaaaaacagaaggacctaggaactgatacgaacacgtgtatgataattttgacaaattgctggaggctcagtgcagactagcttgagagttaaaaactcttgcagcctagtcttaggggagactatacttttctgagttttatgtccaagaaccctatcatgttctcatggggaagtctggagaaaaatctcagggaagagaaaaagtaaccattttggaagtttcccagattgttctctgtaagaaagacacgtcctttcagggaagctattttaccagagttctatctgacttgggagaagggcaattagtcccctccagactcttttagccttcctgtctaatgtcaggggacgaaaaaagggctcagaacatttcagaagatcgcagcctagaaactcaggctcactaagaaaactgagatgtaatcataatatacaacaattatccttcctgagacctcatcaccacgtgaagaggtctttggtgattacaactgagaggtgaaacacacagactctattgaataaggagctcttaggaaagcccaaagacaacagggaagacaaaaaatacgagcacacagaagcatctggaacttaaagctacagcaagcattaaacacagtccagctctaagctagattaacataaaacctcataacaaaaaaaaaaattcttagttcccatcactcgaggtattatttccagctttcaacaacaaaaataaggcatgcaaaaagaaatttcttaaagataaactttaaactattttaaactaaataaaaatgaaaatagagcttagcaaaatttgtggaatgcaaggaaaacaatgctttgcaggaaatttaaagaactgaacacatatatcaaaaaagaagaaagatctaaaatcaataatctaaacttctgttagaaacccacagaaagaaaaacaatttaaacctaaagcaatcagaagaaaaacagaatagaaattagagcagaaatcaattacattgaaaataggaaatcaatcagagaaaaattaacaaaaccaaaagctaattattttcaaaagatcaataaaattgctaaacctctagtcaggctaaccaggaaaaaaagagcaacaatacagattactaacattagaaatgaaagaggggtcatcactactgatctcacggatattaaaaagatgataaagaaatatgatgaacaactctgtgatctcaaatttgataacttagataaacagaggcaattccttaaaagaaacaaactaccaaaactcacaaaaagagaaatagataatctgaataggtctattcaggttatatctatatctgtatctttttaaaacattgaatcaataattaactttctaaaaataaataataaattgggtccagacaatttaactgatgaattctatcaaatatttaagcacaaaatgatagcaattctctacaaccttctttagataggtaaagcagagggaacacttcctaagtcattatgttataccagcattactctatagcaaaatcagaatacacgtgcaaaccccattaaaagaaagaaaaactagaaattaatatcgctcgtgaacatgatataaaaagcgtcaacaaaatcttagcaaatcaaatctaataatgtataaaagttattatatactacaactaggatttatttcaggtacacagctggtggaacgttcaaaaactcaacaaacattcctagcactttgggaggccgagacgggcagatcaggaggtcaggagatcaagaccatcctgactaacacagtgaaaccccgtctctactaaaaatacaaaaaaattagccaggtatggtggcaggcacttctagtctcagctacttgggaggctgaggcaggagaatggcgtgaacctgggaggcggagcttgcagtgagcggagatcgtgccaccgcactccagcgtgggtgacagaacgagactctgtctcaaaaaaaaaaaaaaaaacaatagaagaaaaccaaacaacaaaaaaaactcaacaaacgtaacttagcgtatcaactggccagagaagaaaaatcatataatagcaacagatacagaaaagcactgacaaaatcccacactcatttatgagtagaaactctcagcaaactaggaatagatgaaacttcgtcaactcgataccaaaaaatctacaaaaaaacctacagctaacatgacatcatactcaatggagagaaactggatgctttaagatcagtgtagtatagtaggctgactaatgatctcccaaagatatcaggtcttaacttttaaaacatgaaaatgttaccttctttgaaagaaaggactttgtagctgtaactaaattaagaattttaaggtgagaagattaccctaagttatctgagtgggccttaatgctatcaatcataaatatccttataaggtagaggcaaaggtgaaataacacagactcatcaagaagccagtgtgaccaggaacacagagatcactgtcacacccacacccacaacccaaagaatatatggagctaccagaagctgtcaaggaatggatttccctccacagcttctgtgggagtacggccctgctgacacctagattttagacttctggctttcagaactgtcagggaagaaatttctattgtttgaagctaccagtctgtaataatttgatatagcaagctactgagaacaaggcaagattttcccctgttaatactcctattcaacagcataatggaagacctaggtaaaagtaagacaagaaaaggaaagaatattaagaaaaagatataacgattgggaagaagaaaataaaactgtttttgctctcatgatatggctgactatgtagaaaaatcctaaaaaattgacaaaacattctctagaacaaataagcaactgcagcaatgtttcaggataaaatttttcttttatcctgaaaaaaacaggataaaatatttctttccaatatgccagaaaataacaaatggaaattgaaattagaagcacaatatcacttatattagcgtaaaaaataaaacacatagatgtaaaaatctaacaatatatgtacaggatctgtaaggaaatataaaaaattctgatgaaagaaataaaatctaaataaacgaatagatattctgtgttcatggataggaagacttgatactgttatcggttcttcccaacttgattatacattcaacgcagtttcagtcaaaatcccagaaagttattctgtgaatatcaaaaagctgattgtaaagttcatagagaagggctcaagatccagaatagccaataaaatattgaagaacaaagttgaaggagtgatactactcaactttaagacttgctacaaagctacagcgatcaagacagcatggtactggtgacagaataggtaagtgaatcaaaagaacagaagaggaaatccagaaatagaccaatacaaacataaacaacttgccctggacagaggagcaaaggcaattcaatagacaacaaatagtgctagaataactggacatccatatgccaaaaaaaaaaaaaggggggatctacacacagaccttacaccttttacaaaaataaactcaaaacgcatcacagaactaaatgtaaaatgaaaaatgcaaaatgtaaatcctctgaaagataacacagggaaaaatactagatttgagtttggcaatttgtttatagatataacaacaaaaaattatctacaaaaaaaattttaaattgaattgtattaaaatttaaaacttttgctctacaaaaaatactgttaagagaatgaaaggacaaggcacagaatggtagaaaatattaacatcatatgtcattaggggattacaaattaaaacaatgacataccagtatatacctattaggatagctaaatccataagactgataataccaaatattggcaagaaagtggagtgatgggaacgttcatgcattgttggtggaaataatggtaaaatggtatagccactttggactacagttttacagtttcttataaatctaaacatagtttcaccacagaatgcagtaaccaagttcctaagcatttactcaactgagttgaaaactaatgttcacacaaaagtctgcttagggaagcttatagaaactttattcataataatctgtctttcacaacacgagaatgtataaacaaactgtggcaaatccatacgacagaatactagtctacaattttttctttaaaagaactcttatgccataaaaaggtgtggaggcaccttacagacatactgccatatgacattatggaaaagggaaaactatagaggcaataaagggattactagttaccagggatccaatatagtttcttagggcaatgtagactattctatacgaaactgtaatggtggatacacgacaatatgcatctgtaaaactccatagaaccacagaaggccaagagtgaactttaaagtaaagtatgaacttcagttaatataaatgtgtcaatattggttcattaacttcagtaataaatgtgccacactaatgcaaggtattaatagtaggagacacttggtggtggggcggggatgggggaatagtggcgacacggaaggaaaatgttatggtaagtctctcaactatctgcacaatttttctgaaaatctaaagctgttctaaaaaataaagtattttaattttattttaaaaagtacatcttagaaaacatacctaggatgatctctaggctctggatccagaaacccctatttcaaacaagtaggaagattcttatggctgctaagatatcagcagtccatggtttcaggaatacagagccccaaggtgaatacaacaaccagactgaaataagtgcagttccaagaatggagcttaaactggaaagactagagagcagctggctagctgtttagaggtaacagatggcagaaccctcaggatcaagtcatcctgaatgaagaaagacctttggagagtgcacacttgagtaaatagcggcctctgttcatgttctccagtaacaaagaaataaactaattagatggcattcataagcaagctaaaattcctttcactggaaatctggaaagaactgatttaggagagcgaaaaacagggatatatacacacacacacatacacacacacatacatgtttgtagtatcaggaaatgctcaactttgctccctcaagtcatccagttccaatgttttatatatgctattatatgtgacaaaatcatataatatatattaatacatatcattaaaaatatgtaactgttaatgtagcataggtatatatttttcacataccataacatttatccttctaaaatatgtaattcaatgcttttcagtatattcagaaaaacatgtatccatcaccattatctaattccaggacccaattttgtttttaacacatctcaaatgtagattacaaaaaaagaattgatccactagggatacggtctgtaagaagcagcctagattttttaaaaatgtttttcttctactctacatgtaaataagtctgcatcctgtcagtatttaaggttttctttctttctaacaatcatgtaaggctggtattttttaaagtttccactcagaagactgtcttcctgacctgtaaagaaattaagtgtaaaaatgtatgcaattggactaaataatgaaaaagaggttgagaagagtgcaccgaaagaggtaaaaaaaggagactatgggccaaaggtatacaatagggaaaataaaagaagtttctagggcactgcagaaagacaatgtattctagtgattacctttattagactctattggatcaggagccagttcattaaacattaatggcaggggaatgccatccatatattataaatagccattaagttgagatagacagctctgcccagggtcagtatgaattaataaaaaaaactgaagctggcatttcagaatcataaaaagataggtttagtagaaaatattcaataagaaggaagaagaacagtatatattacactatttgtctgaagagcaaactgaaaatgagaacaaacttaacataaacctaaaaagacccttcatgaatgaaacacttatttctcgaaaatggatgtcacttacatttaagaatcgtaacagtacaatgtgtgacattggcaaatggtaaatgtaaagacaaatgaggtgtagacgttcagctagaaattagacaaaatgtgaatgcaaacaaaatatcctcactgaacacagttccaaacatagtatgtggcagcaggagaactgaagttattaacagataaggtctaatttccaatttatctattgagttaatcctgaaacctatcccacttgcctgtatttacaaggtaggtcatcttagttttaccatgagttttcactattttaagagagaaatcatgttatgaaacatggtactgataagatacttacataaagagctacacttttttaatttatttttctcactttctttgctaatttacacccattgtttctgagtaatctgaagaatgagacattcccatttttttatgtatcataatgtttctaagataacgcatggactttttaaagaatttcatggtagcaaatattatgactcaaagtcaatatgaccctggttaacaaaaatgatcaaaaactaggaaataaagctaacagtagtggtagcaatggtgtatgtggcgtgtctgttcaatactgtactagaattttgttccccaagcccactcaaggattatttaattctctaaaagaacatatctgtgtttggctttgctatatacattttgattattgtaccaccactgtcaagttataggttaacttgtagtttttgtctagtacgaaagaaccactgaagtttatggtttaattgtcctgtgggatactaatcagtcttgtataaaacctagtaattttattcaaatattctccctctccaactcctttttaacaaaatgtctagaagtacccaggtcctcaaaatgcccctggattgcactggtttcttcattaaagacatattaaatgttggtatatatttattctgtatttttattatagtcatattaacccttagaaagtagtatttttcactccaccaagcacctgtgtaagattttttaaaaaaataaacatttgccaatgttttgagaggtgaattaactcaagtaaggcataaccagtaatgccaaaaataggtttatgccccatgaattatctctccagtggtctgccagccacccataaaagtacatttttaagttatactatagaatgagtgagataaataaaatgaataatgaacggcagacttaaaaattatgacattttcttaatcttcataaagcctgtgatggatttttcacttgtctacttggctaaggtgaactacagtccctccccacttgttcaaacacagatctagatgctgctgtaaagagatttttcaggcataattacagtccctaatcagttgagtttaattttaggaaatcatcttgggtgggcctaacttaaccagtttgaacactttaaaagaagactgagaaagtcttgtacttggtgttggctgccagctgagatcttggctgagactgtcagctagaactctattttttaaattttattgtttaaattgacacacagtcgatgtacatagttttgaggtacatgtgataatgtaatacattcatattacttagcattgggatatccatcaccttaaatatttgtcttttctttatgctagatacatttcaattattttcttccatcaactagaactcttataactcacggctagccactccacgtgatttggcttctctcacagcatggctgttggattccaaagaaaagcatcccaggagagggtaagtgggtgtagagggggaggaagcaggggtggggagcacacaccaacatgcatgaggtgaatgctattcactccacctgcactgagtgcatcctactctattctctatcctagtttcaacagaaggaagagaaaacagactccacctcctgatagtgtatgacaagaatctggaacaccacaatgaactagaaatgcaggtgtggccacttttggaaaatgtaattatgccacaacaatctttgactatttttctattgtatcattttcataatggtttttagaaacttggaataaattagagtcattagccctatgtacataatatgagttgcaaatatttttccctcaaacaaatgtatttttgttattcttacgtatcttttatctcagaattctaagtcccttggaagtatgcaaattttattgaagggaattgaatttttaaaagaagcacttgtagaggacattttcaatattagtgctatcagttaagtaatttacagtaactcttatggtacccaatctttctctcacagtgatatttacaagtttaaacattttttatctcaaacagagtggcctctgaattttcctcctaacaaggagcttaatctactatagcaaccataatgaaaatgttatttaaaaatcagacaagagcaacagggaaagtcggtgtttgctatttaaattgtttttgtatcaatgggcttagaacactgtggagctatatcattttattcagttttctttcattttaatgtcactgaaaggtcaagcaataatccagagatcaatttaccatcccatgcacattgcttccctccaatttgggaatataaattcaaatgtaagatggtcttcacccaagctcttccctgcaaaaaaaagttaaggcctcagatatttttatatctacagagcagagaaggctttacttcaaataaatgctgttgcaattagcctgatgacccttcttttgccttttaatattttgatattagcaggttctacttttcctcctgatgccgaaaaaaccatgtcatgttaacaaattccttaaatgttgaactcagtcagatcatctataaaatgcaacaatatcatctccctacctatctgttaagtttattatgaagacaaagtaaaatttccatttttttttcagacagagtcttgctctgtcacccaggctggagtgcagtggcaagatcttgcctcactgcagcctctgcctcccaggttcaagcaattctcctgcctcagcctccccagtagctgggattacaggtgtgcgccaccacacccggctaatttttgtatttttagtagagacgggctttcaccatgttagccaggctggtctcaaactcctggcctcaggtgacctgctggcctcagcctcccaaagtgctgggattacaggcatgagccaccacacccagccaaaatttctgtctacttctgacattagactgctgagagtactacatatatgacagtttattagtattgcttttaatacttagaacactgtttgagacacatattaagtgcttaataaattttacctggtgtttttgtgatatgctttattttatttaagaatttaaggggatcaagtgtggaaagagaagacctaccatctcatcatcaagtattatgtgcatatagcatgagaggaagagagaagaaaaatggggagacaaagaaggaaaaggaaaagaaaggattcagggttctctgattatctctgtgcaggtaagctgagggaaactgcacacacttcatcagcaccagtgggttcccatccagcctctttcatttactactgatatgaccttgggaaagatacataacccctctgtatcagttatctattgctacttgacaaattaacccctaaaattcagggcttcaaaccaccataaatatttagtatcttatacaggttctgcaggtcatgaagtttgaagctgattagctgagtggttctgactcaaggtctctgggaaactggagtcacaacacccaccaggttgggaataatctgcagacttggctgaagctgaagcatccacctcaggttcacttacaaggctggaagttggcgctggctgttggaaagaaactttattccttgctagaggaagctctccataaagctgtttaagtgttctcacaaaatggtgactagcttttcccaaaatgagtaagattttatgacctagactctgaagacgcacactgttgctttcactgtattctactggtcaaagagataacataatacaaggtgggaggagatgtcactaggaggagaattttaaaaggtaaggatcactggaagccacctggaaggctggctaccgtgccctcaaagtctctgatccagcatctataaaatgagaataataatgacttctacctcacaatgttggtggaaagattaaatgacaccatgtattcaaagtgactgtggtccagcacttgctccacgaattgcaaacctccttaatcattctgttttctaggttctggcacagtgtgtgtgtgtgtgtgtgtgtgtgtgtgtgtgtgtgtggaggggggtgtgggtgtgtgcacgcacacatgcctgggtccatttggccacctgatgaagtctgtgtacaacttccaaaaatcatacttttaaaaaaaagtacataggattatgagaatacagattatactagaacatagccatgaaaatattttaaaatatatgtaatacactaatatttgtttctttattaagacattatacaatgaaacccaatggaagctttaacaactatatcttcaaaggaatgataagcacaaatgttttgggatacatataataactgaaatatgattagacagtatctgtgatttctattggtgagaaagtcacaagtactgccaatgccaccgtggtcttttgcctatattcacacttgaaagaaaggctaaaatctactcagaggttagtgtaagtgaagatatcatttttttaatccaagtttaaagttttcataaacactctccacaaacccaatggggttcaccggaccctggactaaacttaatttactttaaaagaaagaggaggaaagaagaataagaagaccattctagtatttaatattctctacaaataattttcttcctattaaatttcctactgtacacaggaacatctgttctccatggttctctcatttcaaaatgatcactcatttcattggacatatacctacataatactttcatttaaacatattttaatgaatctttagacctagataaatggatttacagaagtgctacattaaaaggccattttaagtttgggatcgaaaggacctttaatttatagctccagaaaatatccattccatggctcaaagatccttgtggattataaaagaggaaacgactaacagaaaaggaattattcaccacattattaaacatgacaaaaagcttctgaattggagcttaaaacgggctatttaagattccagcaatccctaggactttggcaacaaaaatgttcaaaagccttttatagttgctgtcagatttctgtaaagcatttgagattcctgtgaacttatttatataacaagctaaaacctgaagctgacttgaaagtctttctattctaattatgtagaaatggaaatgcctagaaatgatgttccgtgttctcccaagaatatcctcttgaaatggtggtttcagaaccgggtatttagaagaaggaatgagagtgtagctgctatggtttattacacggaaccattcagcagatatacaaactatagtttagcaaagtggcttcaaagaactgccatttagttattctctctgcagcagcacattctaaatgactgttcatattgttccctcctggcccactacagtggtttatttctgaagctctatagttcatgtgtaatcatgtagcaaagtaattcacgatataatgacccaccaggatctcagctgattgtggttcttatcacaatactgtttctgatgctatgcgtggctttccaaagccaactttttaacctcttatgcttcagcattccaatttgacaccaggcccctctgtgttccgagaagtcagcacataccctaagctagaaatgctaggagatattccaacagaaaaaataagatgggttttgggaaagagtactgtgcttgacagcttctaaaatggctcctaataagcccaccacctcctgctattcacacccttatgtaatcttctctcactttgaatgtgggctggacctagttatttccttttaacaaatagaaatgtgatttgtttataaatgactgtgacttcatccttttcaccctttctctgccctcttcctgcttgatgagacaaggcaagctgacctatggagagcctcatgtggcagagaactgagaccaacagtcaacaaccctagaagaactgagtcctgccaacaaccgtgtgagtgaatctggaagtggaatgtctctaatcctgacaataagatattgacaccaacagcagagatgttaaaacatgtagggtctcagaccttatcaaggaaaggtctagaaaaggaatatgaaaccatttttttctagttccaaagcctgtgcttcattcactgcattacactgtgtctccaaatgagtcctgttccaaatactgaattgggttttgcctgtttggaagttggaactcatttccctagagataaaatggcataactgaaattaacagagatctgacacaatagcagagaggggaagacagaggacttggggtgggagggctcacaaaggtggctgtgccaagaactcctgagtcttagcagtctgatccaggcagctcatgggggctggaggagtgaagtccaaaggctggactgagaaaatcacttcctgatttgagttagcttttacttgatactaggatctttgtggattaattaattaaaaatctccagatgagactaaagcggcctcattgtctgggatgataatcaggttcattgtctcacagctgaggaaatcaaggctgcagacacacaaggagtgaggttaaatggggaagtttaataggccaaagaaagagaatagctctctgctggggagaggggttctggaaaaatgggttgccggtccacagggaaatacagggggttttatagatacctggtgaggaggcagagtctgatttacatagggtgaaagactagttggaccaggtgtgccatttgtatagggcatgaaaaaccggttaggactaggtttgccatttgcataggatgcaaatttctggtcgcctccaccctaatcttttattatgctgtcacgtcctctatctgagctgtgccatgttgcccgtttctttactgtacatatggtaacaacaaaaaaagggaagatggagcctccatgtcggacatgcctgggccccaggtagcccttttctgttagcacagctgccagcattcccctgtgcaagcttccagcttgcttatttatgttttcagctcgatttttcaggctgctctttggtaggaaaaaaataatttcttgggatgcttttcattagaaagaaaattctgctgagaactcttttacccttactatctgcttaaataatttctttccacttcctgtgtcaaaattatccatatttagagtgagccttaaatccaatgactggtatctttatgagagaaaggactgggagatttgggcacagtgacccagaggaaaagatcacatggaaagagaggaaagattggagccagagtgccacagcctaggaatatcaggagccactagaagctcgaagaggcaaggaagtatgctcccctgaagacttcccatggagtctggccctgtccatatcttgatttcagatttttggcctccagaactgtgagatgatagattccggtgatttttaagccaccaagtttgtgataatttggcacagcagcccttagaaatgactaccaacaccagtgatactaatattcaactagacgtgagagccaccacttgaagctgtggcgccaaccttgccaggtgaactgttattgagctcaaggtagggcccaggtggaaatcactagcaatgagaacaccagctgcaataatcaccagaaaaccaccttcatcttcaaaacaaaatattaaaaacccactgtgttaaaaagtctttttttaagcaaggctgttgtgagacgcttcgaaatagttgaatataaaccaagacctatattatactgtagtcggatatcatctcaggattagcatactgtgagcaaatcctcaacacgttgggagttccccttccccttccagataaaagttgaaaagcctgagaaaatcaggggtgtcctcctaacttggatgttagctgccgtccatttctcttgaggttttcctttctttctttaacttttacaaccaaatatttatagttagtcctgctctaagaaagccttagaagccaggataagagcatataatactcagaacaaaactgtgtgaaacagccatattattctatctgtgacttgataattagatgtaactaaattgccggccaagatatcccatacccaagcaattatagacaccaactaacgaagacaggaaatcaaagaatgaaagctgaatgccatcagtggacatatcagaaaacatcaagaaaagctttctatgaagaaaaaaagtgtgcaactcttttaaagaaagcctagtcataaaatgaaattgaaatgtgtatttttttgttttattggctttatttcaaatggctattattaaatccctgatagtcaattaaaaaacattcaccaaactagaaatctgctgaagtatacatgtataagcatgcctaaatatattacaaactattgaattgaaacattaaaacattctccatagcaacactaaatcaaactgatatttcattttggttcccctgatgccaatacatatagtacattaaacccacagctttcagagcataaaaatgtctttgaaaacatacgtaatctagagatgatgttcaaatatagtataatatacaccttggtttatagttattatttctttcccaagattacatttctatgagaaagaagaggagcctaaatatgatatagggtcattaattttaatgatgaaaacagaaattttgactttgccagttctgaccattggggaatctgtgcccatagtaatagattactcatgtcttacttgcacttttcccaaaaatctcaagtcaaagaccacagaatttatacgctagaaaatataagaaaaaagggcacagaagctaaacaagaaaagaagaggaaaaatattccagttatggcttcaaagtcactaatttccatggaaggagattaagcgtatactttatcgaccttctctgccagcaaacaacgttttattcatgtcacttaatggggaaggaggtcaggtacagatctgaaggtcacctaactatatgctttcttccacagtattatagggcatagggaaagagcctaaaatatgcctgctggttggaattgaaaatgaaacggtcccttgtttaatgccataaaaagtatcctgagaaagtgtagctcttaggcttttcctctccgaggatttagggaaaatcaacagtgcccactggacaaaaccactttagataaagaggaatggcaaatttaagggctcacaaaatgtacttaaaagtttagaaattgggctttcaaattataccagtcaagttttacatgaattaagtcctattttgagctaggatgcatcattatgggaggtaaaccaaaatcttaaaaaatatattagtttagaatgagaactgtgcctcaggaggtgccatggaattcactaggaggtaaacctactgcaaattacattttaaaaagcaatctcagcaatatattcttctctaaaaccacaaattcattttgaatcaatatttgttatgagtccttttcaacatttttccaggagcaacacagcactgtgtcttcaggggtcgaagagggaatctacaggacttaaaaaagcatagggagtgaatatggggtcatagcttctgtcattgttgaaaagagatgccagtaagttctatgcattaaaacagaccacgcaaagcacatctgatggaataagataaataacataacagattcactcttgcatgtccaagcgtacttctgagatggtgaaatgcatttgatgcactgaaacatgaaaccatcaaaatctacagctggaagggacctcagagatgaatcatttgaaagccctccagaggaacccaggttccaggaaatatgaagaacgtgaccaaggtcacaagttagctggcagcagaacttgcaccagaatactgatctaattttattatatacacttttagtttctaaacaccaagaggcatgaatttacaaacaatgagtacagccacatgctgtgcctaaaataacaattacaaaagtaaacctacagcctcagttaaattacttacctgtgtttttcccccaccatacagaacattaccattcgcacaaaggtccctcatgttgcccctttctggccacattaatttgctcccgccctcactcctctaaccatccttaatcactgccaaccactcatctgttctccatttctatacttttgtcattttaaggatgttatataaatggaatcatacaacatataaccttttgaaattggctttttacgctcagtgaagttctctggagattaagctgtatgtatcaatagttcatctgaatgcagaatagcctccgtggtatggatgtaccacagttcatttaactattcacctgcagaaggacatctggattgcttctagtttttggccattatgaataaagctgctaggaacatttgtgtaacggtttttgtgtggatccaagtttttgtgtttcttggataaatgaccatgatcacaaatgctgggttgtctcagtccgcttgtgtcgctataaaggaatacatgagtagccaggtcagtggcacaggcctgtagtcccagctactcagaaggctgaggtgaaaagatctgttgagcccaggagtttgaggctacagtgggctatgattacacctgtgaatagccactgcactccaccctgggcaacacagaaaaagaaatctcttaaaaaatagatataaaggaagacctgaaactgggtaacttacaaagaaaaaaggtttatttggctcacggttctgcagggtttacaagcagcatgatgctaacatctgcttctgatgagaacctcaggaagctcccactcatagctgaaggagaaggggagccagcatgtagagatcacatacatggcgagacaggaagcaagagagagggtaaaggtgccaggtagtttttgagcaaccagctctcagggaaatgctccaggaactaagagtgagaagttgctcattgctacccggacagcactaagccattcatgagggatctgccaccatgacccaaacacctcccattaggccccatctctaacagtggggatcaaattttgacgtgaggattggaggctattcaaactgtagtaggttgtaaggcagttatatgtttagtttttaagaaactactaaactgtctatcaagcgtgactgtatcattttacattcttaccagcaaagatgcaaaagcagtttaatagagaaaggatagcttttccaacaaatggtgctaacgcagctgggcatacataggaaggagggtgatatggtttggctgtgtccccacccaaatctcatcttgaattgtagctcccatgattcccacgtgttgtgggagggaccaggtgggagataattaaatcacgggggtagtttccctcatactgttcttgtgatagtgaagaagtctcacaagatctgatggttttataaggagtttcccctttcgcttggctcattctttctcacctcctttcatgtaagatgtgcctttcaccttctgccatgattgtgtggcctccccagccacgtggaactgtgagtccattaaacctctttttctttataaattaccaatcttcggtatgttcttatcagcagtgtgaaatggactaatatagaggggaaggggggaaggaggaggggaaagaagaggaggaacagggaagcaagaagaactttcacataaacctcacaacttgaataaaaatcaacacgaaaggaatcattttccccgcatcttcaccagcatttagtgttgtcaccacttgtcactctcatagatgtgcagcgatatctcaacgtggttttatttagcattttccttagagttaatgatgtagaacatctttttgtgtgtttatcagttaaatggctgtccatgtcttttgcccattttccaaatggtttgtcttttttgttgttgttgagttttgcgagttcattataaatgttagataatagccctgttttggatatgtggttttcaaatatttactcccagtctgcagcttgtctttttagcctcttagcagagtctttcagagagaaattttttaaattttgaagttaaactaatcaatttttccttttatggctcatgcatttgatgccaagtccaagaaccctttgcctagacatagatcccaatgactttttcctctgctagtttctaaaagttttattttctaaaagtgttacattaatgttcatgagacattttgaatgaattttgtgcaaggtgtgaggtataggttaattttttttcctaactgtacaatttgttgaaaagtctattctttctctaactgaattgcttttttatttttgcaaaaaaaaaaaaaaaaagaccagtgggcatatttgtgtaggtctgtttctgggttctctattctgttgcatttatctatgtgtctatacttctgtcaatgacacatggtcatataaatattacaagtatgtaagtcttgaaactggatgatagactaattcctaccaccttattctttttcaaatctgttttagctattctagttcctgtgcctttacatatgaatttcaggataatcttgtctatatctactaaaaattgttgctgatattttcataagaattatattaaaactctgtatcaacttgggagaactgacatatttactatgatgaatcttctaacctgtgagaatatgtctctccatttattgagatcatctttgctttctctcatcagcattctgtagttttcaccatacaaattctatacattttttgatagattttcatgtatttatttttgtgtgtgtgtaaaaggtgctgtattttttatttggtatctatctgttgattgctaatataaataaacatagttggtttctatatgctggtctaatatcctggggcctttctgaactcatctattatttctaggattttttaaaaagattccttagacttttctaggtatgacttacaaggaagtcacctgcaaaaaaaaggctagttttactgcttcctttctaatctgtatgtcttttatttcctttccttggctcactgtgctggcaagatcaataatgaaagtattaaaagtatcagaacttgcgtagggggcataaaatactaaagtgttttcctactctcacacactactcaacacttctcacaccagattctccaacagacgctaactgggtatcctagaattcaattcagttcacacattatctacccagagatattgtcagatccaacaggttaggggttcagtcccacaagacagctcccactttggatgtcagttgtgtaccccaggctgtgaagtgtggttctgactggccagctataaatcaggattcctacaacctcctcttcatgttcaagaaatttggtagagtggctcacaggactcagggaaatgctttacttatgcagatatacaaccagatggaagagatggagaggacaaggtatgtgggaaggagtgtagaccttccctctctgggaaggtgccctctctacgagcaccaccctccaggcatcatcacacgttctgtaagctggaaggtctccaaatcctgtccttttcaggtgtttatgaagcttcatttcttatgcatgattgattacagcattggctactgatgatcatccagaccttcagaccctctcccctccctagagtcaggagataaggctcaaagttctgatgcttataccacatagttggttctcctagcaaccagtccccattctgaggctatctaggggccccagccaccagttatcatattagcattaaaaaacactcttatctccagagatttcacaagttttaggaattgtgcacccggaaccaggggcagaggccaaatatgtttattatatcaaaatatcacaaaagtattcgatcttccaacactgtgttgaatagtagcggtgagagtcaccatctttgactttttcccaaccgtaaagaaaagcattcagtctttcaatgttaagtatgttacttttttgcagatattctttatcaatttgaaaacattctcttccttttatagtgttctgtttttatcacaaagtggtattaaatttcaccacatgctttttctgtgggaattgatatgatcatgtcatttttctttcttagcctgctaatgtgtatgaaattagataatttaaacttaaaataagtcaacttaaagctgttagagctttaaatcattctgaaccttgagaggtggctctgcagcctgagtcaagtggcatgcagctgcaacttctggcttttttcttgtaaataattaagaagaccaagcagtgccagggacaggaccccctcagatcattaccctttctcacagagtaataaagtaatcttcctttgaatgtagcaatccataaccaatcaaattactgtggcatgtgcactggtcttgcatggaaaatgttgtaatcctgctggaacttctctgtccctgcctatgtaaatgaaacctcaacagcaccaaattgggctgctgatccatttgtgtagagtcagccgtgacgatcctcaagctctgcactaggataaactccacatttaatcgtattctttgaacctcattatttacggttgacatgcggtagattccattgctgattttcaaataaaccctacttgatcatgatgtatacttctctttatacattgctgaattcaatttgctaacattttgttaagaaattttgacatctctgtctatgaaggatgttggtctgcagggtttttcctactattttcatttggggcaatacaacttcaaaaattaaaaaataaatgaatattcttccttcatctgagagtgtcttgatttccctttcatatttgaaagacattttcactagacatagaattctaagttgacagttattttctttcagtatggaaaaaatatgatgccacttttgcctgcctgggaaacattggctttattactactgggcaggggagaaagtcctaattgtctataatgcctcttctggtatcacccctgagtggaggaaaaggtacttctctactgttggtagaggtgaaaatccaggctccccatgtggactcgttaccacccactggatatgagaattctggctctctacttggctttctgtaataccaacctgacaaggaggctggagtggctcattacatcccagtgacgatagtagttttggctcccacttggcctttgctgttggaggtaggagtaggtaggccacacgtttttcaatgtgtgtatgtgtggtgtttagctggagtagtacagatattatctaaaaattttctctatattgctagactgcccctttcccagtccttcacctacagtgagcaggctttcgctgtaacctttccttttgtctgtgccctctgtcagctaagggttactagcttctttagttccagggctgggatagctaaggcaaaaacaacgtctagggaattcactaccatattgtttcttgtgtctccaggtctctagctgatctgacttctctccacctctcagaatatttttagttttgtcttatatacaatattcaggattttttacttgtcctaaatgagaggaagaggaaaaagtacacctttttcctagaagtgaaagtccccttgttttactttttcaaaaaaactaaaatctttctcttgactgttatcacaacagatcctatcaaagaagagaaattaagaccaaaaaaagtgtaactgagggatagtaagagaatattcacagctttacttgagaagaaaaaaggaagggttacaaagtggggaggattagagtcaaaagactcaagttctaatggaaagatggtcagctactagccttgcatctctaaatatcacttaaatattcaggcagccccatattttgttttgttttgttttttcctgtaagatggggatgatatcaccgaggtgcccttccacagttgtggtcgtataagatgagataggaaatgggatggtgctttgtcaattttcagtcaagatataaataaagggcatgttattgcactccgatgataaactccctgcctacttcccacttgctccaacaaaacccagttgtttccagtttgtcctgtgtttcagcattgatccagcaactattgatccatgtgcacaaactagaaatatgggaggcattttggatacctctgactccccctattccccaccagtcaaaataagaatatcacagtcctgatgttctccttccagatagctctcagatccatctgcttcactccatcagccctagatccagcccccattctcttttacctgtactgtaatagtcatctcccaagtttccctgcttccaaactcatctctaaaaagcagctagatcatctttcaagcacccaaagcatctctcccgagtccattctagattcccccggatccctagagttcccatttgggcttcccgtttctcaggagacttatctgttcatttatttaaaaaactgaaacggttttctcttatttatcctaaaataaaattttgacctgaaagtatgattttaaaacactttaatacctttatagtcaacaagtaaataatatttcataataggaaaataattatgtgacatgtcatattggcattgcttcataaggtcaagggaaaagctggacatataaactagagatagtgtgtttcaccatagccttatgtacgtattactaaagaatgaaaacatcagccataacttgcaaatctgcattatgactcatgaaacaagtacactgtatctcgccaagctataattactgactaaacctaaacttctttatcacaaactcattcagcctcatgtgctcaacccatacacataaactctgttctagaaactgcctagttgatcaattctgacccagatctactaggaccatttcatggctagttctagctcccaaaaccttctcctacccttctccagttccttttgacataccccccagtttccctggtgttggttcacctttgcaacagcaagctcataacatgacttagaatctaaaaattgttctgatactctttaacgggttttagcaaaataagtgattaggataaacattgaaaattttacacctaattttaacagttactaatattacttctagttagaggagaaggactacagagtagggagcagggtgtagaagcacagattactcttatttttctgtaaggactgaagttcaaacaataaaaatgcactcatacatttcctcagaaattttaaaaacacacattaaatgctaaatatacatcctgtcaattaaaaactgtaagagtaaccttataaaaggaaaaaaaagtttgctctcgggagatgattaaatacccatattgactaaatatatttaaagtggttatgattcaatgtcagactaatatttttgcctctactttaattgctttttaaaaagaagtatcaggaggttccaattagaaatttaactgaaggccactttgaatcaatatgctgtgggaattaaatgatgctgtttttatgttttcctttttgaagatattggtcattctttttttaaatttttatctctaagagttcaaggaaagcttggtttttattggtaaggcaagaaatgcagcttctgactaaatgtttatatcttcagtgtgggatgcccttctccctttctctcctcctggcatatttaatcaacagaatattcacagatcttttacctcctacaacaggcctactccaaccctgcataatttctcctatcttagggcctctgacatttatcccgaaaaagacaactaaatacttgattctatgttttaccatatttcttttcttcctccacatctcactttttatttttagaaaatgcctctaatgcaatttagtgatcatcacagtgcctaggacattgcttggaactaaataactatttaaaagaaaaaacaaatatggttgattagtataagcaactactttgcagaactttgaaatgtgacttcccatttcaaaggttgtctttcgtattccccagtcttccaacaatcatatttcactgacgtctaacacatatacctgatttgagaatattctgaggctgagctcctttatcaaagttaattggtagaaagtgtcactcaccagaaaattccatctaattgaaaactggactgaaatggctaggctcaaatgggggctgatctaaatttctcatcaagcatcactttaaggtatcttagacaagactgccttgagctgtaaaaagctttgatgccatcagccttacaccaggatcaaaatcaattttcaacttttattgaaagctttgttaataagtttctcccctgttcgtcacagttatgaaaaacctttaatatttttgttgcatgggaataaagctaggaaggatgtaaatttcagacaaattggaggtacattttaaaaatattgtcatcgagactgacaactgccaaacctggaaaccactttctcccacatcaaacacaccctgaagtaatggtgaattcaaattgatatgcaagcctgtgacagaggctatcagaagaaactatttcttttcacctctaaaatacaattcactaagcatgacatccaaattcctattgtcataggcattttcactggtttagaagaagactgcaggacggctaatgtgttttcgttctcagataaggctaatgggtttcagctctcttgccagtttgattgccaaatgctgcctgtgacacagtaaagaattttgaagttgctcatggactttgtggaggagagtaacacagtctatcagcaacatttaccagtatggcaaagcagcattcactaatgaatctgagccctctcccgttgctggacccatggaagaccatttccagagccttcagtgcagctggacagggccacatgaccagttctgtcccacaggctgtgatcagtgttgatgtgtgccgcttcacagcccatatgtgattttctatgcttctcatccctgaagccttgagataaaggtgccataagacagcagtagacaatcgtgctgagccaccccttggaggtgagctgtcctggagcatcacctagaacctccgcaggctttgcaaggatgagaaatactcccagttggttaagccactgtgattttcatattgtttgttattgcattataacccaacccactctgacttctacacacagctctcagatgagggactggagacaggagtgcccagcacttagaggattacagattaatagtaaggaacactggttcctcttacatttaagacacccacaacatcatgatgcatttccctccaatgagatgggaattcttgtacccttgcacagcttgctttcattttgatgactactaattgtgacctgcaccttggctcttgcttgtctcctttattccttctctccttctttacgtagacacacagatgttctagagcatgcctgatatatcacactaatacatttattaagtatccctttgaaaagcaaaatgaaacattacaatttctgtggctcttttaaatgcctgtgaacacactagcacattacatttttaagtatttcagtcaaggggtcacttgggttagcctacattttggcaagtaaatcaacaattgctgccaattgcatcagaaagattcctttacttttagcagatctctaccaggagaaaaggagcaaatgtattggcttattggagcaaatgaccaccacacctcaggaacaaaagcttatactttcacattgcttactagatgccaggaaacactctatgagctttactggtatcaatgaatttaatcctcccaacaaccttagaggtcatggccacatttactcctattttacagatgagacaagtgtgtgagtttacatgcttacaaaaagcacttatcttttatcatcataaaatagagtttttagataaaacataggataagcagttaatctttagataaataataaaacagttttagtatatgtgccatatattgcatgggacatacttattctaaactgttttttacatttatctgaaattcaaattcagctgggtccctgtactcctatttgctaactctgggaactctaaattagaagctggatttaaaatttcatcaattctcagtatctaactttattaagcaaccaagctaagctgattgtacatctctatcaaacaaagttaaagacaagtttttattaaaatctctgaatctaatctactataaaaataaaatgccaagaagatttttactacaaaaatttgcttttgctttcctactacccagtctgtggcaattgagaaggatacagacattgaatgtagattctgtccgttgtcacattttatatctaaattggtgaaaatcctaccactcgtgtctgtaagccattcactttgtttggattgggggctggggtttgcaagaaaacacagaatattcctttttgttctttttttttaaacttttataacatgggacctgttaagacagaagcatgaatattctaggtcaggcagagatgaaaggacataataaataggaaacactgctctcccaatgtatcctgaagaagtccttgtcaatcatttccagtaaagtgaataaaaaatgcttaccatggcaagagcatacactgagtttgatgtagtggggacaaatcataaaataggtgtagggtgaggccaaattttaaaatctaaggtaccttggaataatatacttccagagattctcaataacagcattttaaattcttcttctctcttccaggttctgtttcatgcagggccatgagttactgccaacaagttaatatctactctcggctgttgattcaacccaaacactgtgcatctccaatctccatccatcaagggcttcaaaacaatgtgtttatctttctacttgttgtgaatattaataaattaagatctttaaactgtctaggaagaagtaagaaataactgccaagagcttgggtacagatgaggtatttacatacattagagaagtaccattaacagtaagtaatggtgcttttacattctcagaatgcagtgcaatagactgtcgatttgttttgaaggtgtctgcagtcataacacgtatctcatgctaaatggatacttagcaatttttaataattttaaactgatgtgctatttaatggtttggtgataacgcacagttttatgaagacggtttttgaatttggaatttttattgaacttgattaaatttaatgagactgcatcacttacattctaccttaattcttaatgtttataaaggtcacaacaactaattttaaaagttgtattttagaaaagcaaattctgtcagttaatgactatacaatttaaaccataattccaagattttctaaagctagcctacatgtagtactgtggtatgtcttcatgaggggtattaaagcgtaaaagtctaagacatatcactgttgtgaaggaaaacaaataggagaattttattaactccagattcttttgactttgtctgacttttgattagaactagagtacgcaaaactcagcagactatggtaaagaggatttacgtcaactcaacttcccaagaagttaaaattaaaaacatatctcccctaagtcaatacatcccgcattatttcactggtgactttagtcccaatttgtttgaggaaactaaaggtaaaagagaaaacaaatttgctttgaaggagtcaaggctatgtggaatagaaatctctgcaaaaatacttaacccagtctgtagcctttccatgaagcaaagaaaacgtaaaacagattttggggcattctgacacgaattactaagatatcacttatatgcctgtttttagactgagaggctcctcaattcctttttctttctgtctgcgtcatttccatcaggaacaactgttcaacccttacttgtagatcttcataatgattcttgacaatacacgtgcaaaattaaaatgggtctctttgcactgcttgcagtatggcaagagagtttacaaggcaataattctaaatataaaataaaaaacaaacacattacatgattttacaaatttaagggaatgtgtagaaggagtactaatcacacttggcatgtttaaaaatacacttggtgctcgtcagtgctcaaagagtacagtcatatcgtttgaattatcaataataataaaatcatggaggattgatcgtgagagtgttttccttcatcttagccacagtaataagacctctatgctgcacttcttttataattaggcaaaaatctgacagaaatcctgtgaaggcagaggtagttatttctgtgtattctttagacttccacattaagaaaaccatgcccccttttgacatgactatctctttcttccccacacaacaaaactgagaacataaaattatggacacaactgggcagctaaatgcagacacgctgactgcaataaggctctcatctcacagaggaggaggcagtacagcactctgtctccagtaaaacatctcctcaaaaacttcaaactttcttaacatctacagagaagtcttaacagaaaagtcagtaaattcgcctgccacacaccatcttgtcatttgacctttgatttctatagttcagcactccctaattccaatagacaagattcaaagaaatgtctgtaatacttcatctgcccgaaggaagacagtgagataatatccacacaagtcttgaacttttaaaatccattctcactgatacaggggaatatgaactggaagaaggattgaatgccatgcttgagtttttaccatcaaataaaatcttcagtgtgttgtttgacaatgatatttactttgagtgtgttttaaaaaatgacacctgctacaaatatcatggatctgtatatccttgatgtctcacaggtcataaaacagcaagggcaaatattttatgagctacattgcattgttgttttgttcccaggaaaagaggtattttctcaaatactaagagaccagtctattcctggggtcagctgaagccagtgttgaccctggacaaacactgggagagagctgtttccctactatgatgatccctggagctcagatgctgtctgtgcccagaccctcaaggcaaccatggccaaggtagagaaggtgaggacactgctctgagacacatgtggttcggcacacacgtgtactgtgataattgttgctaatgatgctgacagtagccaacatttaccaagggatcactatgcagtgagcactgtgcacagtgccttatgtgctgactcactgaatcctcataatgtcatttggaggtaagtactatcagcaacactacttcgcagataagaggaaaacaacggacagtaatcgtgctgcacagcagcaatcttgggagttgaacttgataaatccatgcatttattaagctcaagtcacccatataaggagtcagacttcagtcagtctcagctccacctttactataaccttggccaagttacttaacctcacaaagcctcagtttcttcatttgtcacatatggatgacagtattacttgccttacagaaaagtcatctcaaacttggaaagaggcgattgagcttactgcattccttcagtgtagagttcccactattgggcctgactttctgtttacagggttaactgacaactctcaggagagggaataattagtatgggctgttacagaccaggaggacatcatcctttctgtatctaacccaacactctaccaaattgcacgtataggtataggtataggtgtatgtgtatatatatatatatatatatatatatatatatgcctctcaaatgctctttggactgactttaacgttacattgggtccccccccaacaattagtgagctgaacaaaatcttgatgtgttcattttatatttgcatgagagcatgaatttgcctttctgccaactgtctgaacacaacattgttttaagaattgagataatgcatatgaaatgttcagcataggacctgggttaccgatgattcactaaatgtcatctatcacatcactcctataatcatctctataactgatcaccaaaagtatactatttaaaacttttaatgtgaggaatggttgtttctatttactcatattcaaatacaaacagagagtatttaatcactaactgtgagaatagctctgaaattatatactgttatccacagctggggccactttaaaatctggcctagagagtgattatctcacacatcacacacccagtacgaaaatggagtttttaagatatccactttctaggctgcttggagccttagtgccgtcacctctggtaaacaggattcattagagtgataattgacagttgtttccctttctaagtgattgctctgtagttccattatgttctgtcagggaagtgctagcaattaattaccaataaactaaacaccagctctgcttgcagcggaaggtttggaaccatttatcttgggggttgagggaggtgtttgggagaggggaaaatccacctcaccaaatacataaagtgctgtgtaaaaaccttattacaagggtgggtggggatggttagaggctctgggaggacaagagacccccatttccacttctgacactttggtatattaaaagaaaaaaacctcaaaccagtggtccaaaaagtatggtccattttaacataggctactttgaacactaaaaaaaatacactgcagaatgattatgacagtcccaagatgacgacaaaactttttgtttaagccaaaagcatagcaaggaaatactcaagtggtgtgacagaggactttttaccttctattaaagattttctgtgcattccttctactggaaataatatataaactccaaattgaggctttttgtgaaaccctgagatccaagggtttgagcttcctctcctcagtaagccaacagactctgaggtcagattcttctgcaaaccatctgagatcctataccatagttgcttgcttcctttcctgtttaactttttttttcaatatagaaccatgtggtggctttttatatagatcctggggatacatcctcgcagctctccaacttcctctatcagctcaagtcgctcccacagccacaatggtctctgggttccctagattctcactacatattacttactataatttttaaaatatacttaatcacacgtgctttcagtccacttcacattcgagtgtctcatttcataagactgtagctccttgaggacaaggacacgtcttcacagggtaattaacaattactgagcacctgcctgctgtctggaatcaggtcatgcaggcagagcaggcaggcaagaaagcaagtaaacaaaggcaacctttatttacttctcccacatttctctgccgtgggaaaggcaagtcaaagctgaaagaaaaaccaaaatggatttcatggatttcaggtctccacagagcccatgacctgttatttgaaggcttttgacccaccagtatgtccaaacatctgttgacatctgcctctctgttctgtggtgtttttcaagggatgctaggtgttcttcaaggtcaaaagggaatggtgctctcttaaagaaactggtgctgaaaagaataagggtttagttacctggggcaagaagtagaacaagaattgggtggaggtcaagaaaagcctaaggccaagtgagaaagaccaacagaagcaaaggagacagacaatcaatgataaatttcccccaccctaggcctaggggtcagtactgataaaagaggaacagaccaaaaaggcacaggtgcaggaggtgaccagtccaagcctctccagttggcttctgagagagctaacagctactggggaaaactggagcctccagtccaacctaacctggccttaaaaggcacaacccccaagacaaaagcactctacgtattcctgaaacacacaaggacacagattagaggaaagaaagaaaacaaagggctcatttacaaatgaaatttgtaattgaaattattttgaaatttatttcaaacttatctacatggtccaagaattagatgagtacaggggacaactgtgtatgccccagattcactggttattatatttttccccatctgcctatcatttgtgcactttcttgcttgctttctctctgtatacacactattttttcctgcttcctttgaaaataaattgcatttagcgcatacttcttaaaactaaaactaaagatattcttttccaccccagtacagttactaatttcagtaaatggagcattggtacaatattatatccagtccactgtcttctgtttctcaattttgtcaattaacccaacgtcatcccttttggcatcttcccctctttaatataaaatccagtataggatcttatttagtgttcctaactcttaagtctcctttaacctcaaacattactttgtctttctgttttcttttttaacagtacacctccatgccccaaacccctctaccccaacgtgtgtgtgtgtgtgtgtgtttcattttgtttaaatagaactattcctcatttgggggttctctgctgtgtccttgagtttagattcaggttgtatattctggacccaagtaccatattggttatgcttctcagggtactgcatcaggagacacacacatatctctttgctcatgaatggtgatgtgaattctgatcacaggtcaagatgttgtctggtttcttcactatatggctactgtgtttttccaaacacaagactgcttaatattctgagtgtatattaggcaggcaaagaatctagctcattatattttagttatacactaacaaagtacgcacatttataaaagcttacagttgtattttgtttgtctaaaataatgacacattaggaccaatgcataattgctcactctgtgttgtctaccattctgagctataagcttttattatgcaaaggctgtggtttgtgagctatcatttgtatgggctccttcaggccctctcaataaaatgacacatacaacaaccaataaacatgcccttttcttaaacatggtcggggtggactttcacatttcatagagcatctcagggctgttcaagctaacagatatttgaaatcaattagtccaacccacacatttttacagttgagaaaatcaagacctaaggaagaaaaaaacgacttgcctaaggtaatacagtataatagttctttataaactgaattataaaatcaatttagtgggccgtgaccagcatgttttaaactgaaatacaatttttaaaaaaatctgagtacttagcatacagcaagggtaaacactgtttggtgaaacctttaattatatatgtgtaggagtatagatgctctcctgtactaatgggataaaaaaatcttttttttaagatgggggtagcccaggctggagtgcagtggcatggtcatagctcactataacctcaaacacctgggctcaagcaatcctcctgccttagcctcctgagtaactagaattataggcatacaccatcatgcctggctgattttttttaaaaatttttttgtacagacaaggtctcactatgttgcctaggctggtctcgaactcctgagcacaagtgatcctccttgccttggccccccaaagtgccaggaccttagccatgagccacctcacccagccacaaaatgtatttcttactgaattctgtggttaaaatcctttaaagaactccattagaactaacccaaaaccagtggtcattctaccaggaaagtgtttttgcaaagtttagtgtgaaaacaaataaaggttgaaatgcagcttctgatttaacagttctggtatggacctgagattctgcatttccaataggttcctaggggagatctaagctgctcctgccagcctatcaactacctttgagaagtatgattaaaaaacactgcatctgagggaggacctactttatttttaacaacgcctccctgaagtaggtactatgtatatacatacgtatatacacacacacaatttttttgctaacaatttgaataggaacaactaattcttgaaaatgtttaaaaataacaaaacaaaaccttccacaaagaatcacctcaattcactacagagaaaatgtgctaattgtgatggtaataagagcgctggtatttactggtgttcacaatgacacgcatgagaccgagtgcatccataacccagttgattcaggttgatatgatttcccccagattacagatgaagaaacagacccaaattagtttattttctccaaggtcatcttgcttgagagtggagggacacagattagcatccagccaattaattcctaaggccatactcctatcatactcactgactcacagatgtatgttatccacacacctatgcacatgctctaaacattacatatgatataaatacatatttagatacgtgcattagcaccttggcatacacttttataaacactctacaatattcaggagtcagggatcacaagaggaaactaatatgtaaaaacccagttctctaaaattaggtgccttctcaagtaggtcaagcaaccgcatttatattgtctacattaaagggatctcttgaaaacagtcacattagcagaatacaggggctgagtgagcaggctggcaggggaggagtgtgagcaggctaacgactagagctacaaacaagattccatcacctataacttagatttcatgtggtatatttagttcaaaccctgtcactttatacaaataggttgtcacgtaaagtgcaaacaactctcttttgacaaagtgatactgctgtggtgctgggttgatggctttatattccacaaagctttttaagtgacaaatgatagctgagtcttgaaaatatggtgatatgaaatgactgcataaatcctttcaggcttcccggggggagcaaaagcatagcattttgcacattaattaaaaaagaaaatctgagaggatgaggttagatctttctaatcttgactctgtgcaaacggactttgaagttactggcacaaaattgagagatggccccagaaaagtcttcaaatgagatgtacaatgttgtttaaagatcaggctcaagtgctgctcttggcccaaatgaggccaggcaagggtgcaataattatctctgctagagactgttggtgcactggcgttgaaatcttttgatatgttggataatgcagattttgtgtgcacacattgctttcccaagctgtctacatcagtgtcatgttcaaatgaagccgaatagtttaaaaggctcgctttcacactggctttatttagcttgcataaacattttcccttcaatctcatataaagtcttgctgcgtaaatgcagctgtcctgctcttgtgtcttaatacagatctttacaaagaggcctgttgggcaacatatttctggtagatgattaataagagatataggatttcttttaaaaaaaatcatgctctgactacagagggcaaattcattacccataaatcaaaaggagtaagggatttcagtagtatcagaagccttatctggcttcaatctgacagttaactgtaggccgtgaatgattaaataaaagtctaagttcacccgagcctggataaaataaaactcaaagcccagaaacttcaaataaaataagaaaaaatcataatttttcacctcaaaaggaaactgagaagagaagtatgatgtgacagaaactatgatttcaaatggagggtttcttttgttgtttgtttttcagaactagactcacattttacaaaaggctccctacccataaggaagaaagttttgagagtaatgaggttgatctgaactgttaaaaactttctaactgagatatagcaacatatggtgtggcagaataaaaatggccacaaaatctttaacattccttccatccagaagtgaggggtctatgttccttctccctgagtaaggtggggccactgagtattttcactaagagaattcagcagaggctgggtgcggtggctcatgcctgtaatcccagcactttaggaggccaatgcagcaggatcactcgagtcccaagttcaagaatagcctgggcaacacagtgagagcctgtctctattttaaaatttaaaataataataataaaagaattcagcagaacttactatgcccaggcctcaagaaactggcatttctcttcaaacactagctttcaaatcctgaattgctctaagataagaagtctgccaccctgaggctaccatattatgaggaagcccaagacagcatgtggcgagagaaagggaaagatgcccacccaacctccagctatctgagtcatcccagctgaggctccagacattaatgaactgcagtaagctattcatcctaatgccctgtgggaatctctcacccacaaccttgggagacataataataataaattgtcttcagctattgtgttatggagtagtttgttacacagcaacagatagccagaacatacaataaaatgggctaatcttaagtgtatagctctgctcttttgcatatgtatacacacgagtaaccaccacctaggtcataagacatgtttccagaagcctctctctgaccctacccagacatttccctcaataaacatccccatcctacccccacacaaataagaaaccagtatcctagcttctattatgatagacaagttttgtcagttcttgaatttcatgtgtaggaaatcacatagaaggtacgctctagcatccagcttcttccgttcaacatactatctgtgaaattcatcactgctgctgcacagggcagtagatggtatgttttcattgctctgaagtgttgcattttgtaagtatactacaattatccattctgctgctgctgatggatatttggttgcttccagtttggggcttttatgaataaagctgttatgaacattctcatacatcttcctggtggacaaatgcactcatttctcttgggtatatacctagaagtaaagttgctggatcgcagggcagtgcactcatttggtaaagtattagttcatattccaactactcaaagaattgctcatctgggccacgttatcattgttttctcccctataactagcaaatattgaggcaaaatcatgctgcattaaattaagcaatttatgatttgtccttccatattgacctttcctgactaactacacaatagtattgttctcaatgatgtctactgtcatgaacatgacattgttcttggaaaaatcctatcaggcaaagtcaacctctaaaatagcattgtaataaatatgcagaaatgtcactttttgcattagcccaaaggttttgtatagcttaaggatacatgcagtaagctaactataaaaatagaaacttgacagtggggatgtatgtgtgtgtcaaaataatattactctttctgggtgtatggcagaaaaaatgacactacatccaccagcatgatttttatagatctgcctctttgccagatgtcaccttttataaactgctttataaaaacatgacagtataagtgcaatagtgtgtttattgcttgataaactttagtaataaacttaggataggttgaaaattaaagccttagagcctattcattaagcatttaggacaagtgagtaagcaaaaaatgcaaactattaaatcctaaatgtatgcagatcaagccactagcagcaagcactatttctcaatcagtatgtcttatggaaatatctgccagtttccttgtcattgagctaaatgcattacagccacatctaaagcatgccatttgcattgctacaaatttgaatgaaatccagaatgttacaactgccacaggctcactcaaaacagattaagtctttttcaaaactgttctgtaacttagcacagcatattttacatatggcaaaccatggttccaacaactacttttctgaaaagacttgaaaagactttaaggaatttcttaaaataatttcatagcacacactcaatattttgattactgatggattatacacagcaatgtagtgtggtctgaggactttggattacctgcagagcttgttaaatagagcgatcctgtagtcctttcctaatcgattgaaataaaatctctggaacaagggacccaagaactaggattttattaagtaattccaaatgatccttattcacaataaaatgtgttaaccatagctatacagtaatctaataaaaagaaactttacaggaaagtatattggcccagaagggtgtcattttaagtgaataatgtattcttacattcttaggttcaaactgttactcaacattatatttttaaaaattcaaatggcttatattagttcatattccttttttttcttgtagttatgtatgaacacccacaaaataaaatctacttaagaacttttgaaaatcaatccctataacaagtgcatatataactaaattttcctgatgattctattcatcctggactgacaattgttatctttgtaattgataaatgaaaaaagcagtaaaataaaacaatccctttaccaaatggtctattagaattcctctgatgctcatcacatttttccactgcttactattcacccccagatctcataaaatatttcagtagttaactacagcaaagctactaacatgcagtttgtgttgggtggatcctcacaaaagtgatgctaatatattggaaatatatatacatatatcattatatataattatatatatcattatataatcatataatatgtaattatatatgtgtgtgtgtgtgtgtgtatatatatatatatataatattttccccattaacaaatcagtgtgccaacatgacaacaagtaggagagactgtcaaagcttcacagttgctacagaactctagtactgggaagtactagttcaaaattccattctgggcaagtttttcttctttttttttttttttattttgagacagggtctcactctgttgctgaggctgtagtacagtggtgcagtctttgctcactgcaacctccacctcctaggttcaagtaattctcctgccttagcctccctagtagctgggactacaggtgcatgtcaccacacccagacaatttttatattttttggtagaaacggggttttgccatgttggccaggctggtctcaaacccctcacctcaagtgatccacctgcctcggcctcccaaagtgctgggattacaggcatgagccaccatgccccgccccattctgggcatcttaaacaaaagcaaaaacaaaaaaccctgaacacatcatggtataatgcagtgataaagcaatgtagggcttttctggacattaaaatgtttgaaaataagcaccaagaaaaaaatcacattaaggagcaaaaattacagtaactgcttgcctttttctttggacatcaaaagaaagaactaacaaaaggaaagtcttgctcgatttctgatcattttatttatcttattgtgaaagaaacaacactgaatcaagagtgaaatagaaatcaaccaaatgaaatgacagcaaaagttgcaaagaaaggcatctggggggtgaaaaaataaatgttccttcacagaaagaaaccagttgtttaaaaacaaaacagaacaaaacaaaaacttacaaaaacacagaaataggtcaagcaaattctacccaaatccctcttcctttgggccttgtcacaacaagtaaacctcatcagaggggtcaagaccacaatgactgacatcctgatcatgtgatgtgatggacagagaacttgactccgagtcagcagaatcgtatagtccagtttgacttcaatactcattaattcaccttttaaaagtttctgactctctgcattcatttttgattgctgctgtaacaagttatcacaaactgagtggttaaaaataatacaaatatattatcttacagttctggaagccagaagtacaaaatcagtttcactgagctaaagtcaagttgttggcaggctgattctttctagagattcggaaggaagaatggatttccatcttttccagcttctagtggctgcctatactccttggtttgtagttctttccctcatctccaaagtgcatcctccagtttccgcctctgttgtcacatggcctgctctctgattctgaccttcctcctgccttcctcttcttacaaagacactatgactaccctgcacccacccactttatccaggataacttccccatcttaagattcttaacctgatcacatctgcaaagtcccttttgccacataaggtaacattcacaggtaccaggaattaggacatggacatacttgggggccatcactcagcctaccataatctctttggattttcttcttaatactagttcattctttgttcatttactcatccacccacccactcacccatcaccctcactctacaggagttggccacagcttcccgactagtatggcagaacaaaacggtgtgttgtaaaccttcaaaggatctgctgacaagttctgatcaatatgtataattgatttttgctgcaacagagtacacattctgacagggtgatgtttttaagggaaaaaaaaaaaacaacgaacagagtagatgatggaacggtatatagattgggataactgactgccagtaaaagggcagagacattgattcacattaaggtgggaccaaagaaatgtatcaggttttctggaatgtgcagaactgtgtttacaggaagatacagaaatttgtctcatgagcacatagaagtccgtgaccagaacagcaaacagcccaactcaaacagcagcacagccacaatgaaaccgcacaaataaagtgatcaccgtggaagcttccagagacactgaggggggctgtttctccccagcagtggttgcactgtaattaccatagttcgtttggggttgccgacttttggtcttttcatgccaggatggactcctggttctgagggtagaatcatctttctttaatttcatgggaaggggtagggtaggtgcctacacaaaacagggttttatcaggaagaaaaacaggaaaacgacctaagaggatgcacaatagcagctctcacaaaaccgcagtcactgggggctctttcagtacctcaatttaaagcgctccgtaggatgacaacttatatcttaatttctcccacacaaaatccctctaaggtgagtttctttaggcaccatccagaccacattttaagttacaccatttaaaataaactttttaaattcagagaaaactatccaagtacgttgacactcttacgttgtttatgtataaaaacaattacaacgttaagcttcctcttcatttcaaatttgtttattcttacataagcttctagacaaaagcatactctctgaaggaaaactggggcagatgggggtggcgcaggatagcggcagcgttattgtgactaggtggtggttaagaaaatattttcaagacaacaacctgaaaatcaggcttaagtgccagaagtaaaccaaaaagaagcaatagcaagtgacaaaaatggctaactggagaggaaaaaaaataggatttcaattaaatcataaacgatggctaataaagtgcgttttaacagctgtaacgctaaacataatgcatcttactctgttttaattcaaatattaatccttgtccaatcactgtaatgggagaaaaatggtatgctctgaatgtcacattcgaattgggtagcaattatcttcctggtatcaatgtcagacattcacataaatctttaaaaaatgataaacttacccaaaaacatccaatcaaataaaatgaaaagatttctataaaacttgtgctataatttatttaaaattacaagtaacataagaaagatggataattacaattagggagatataaatttgaaatggaggaacatattaatattttaatctttctgataattctttaaaattacctaatatttttatatcagcaaatattgcctcaaggactcaattgaaacccaaatcgtaatgatcactatttaactaatttattaaataaaacatgttcaattgtacactaaatcaaatgacatggccatcataatggcagagctacaaattttaatgagactgaagaaaacagtaaaaggtctttgaacctgttatccatgtgatcacagataccgaaaacatgcttgtttctctcctttgtggaggctcagggactccccaactctaagcaacagttataataatatttactacgtgcttcccaccctgcgaagaatggacaggcagtatctcattacattctgacagcaggccaggtacagtggctcatgcctgcaattccagtactctgggaggctggggcaggcagatcacttgagctcaggagttcaagatcagcctgggcaacatggtgaatccccatctctaaaatacaaaaaatagccaggcgtggtggcatacacctgtagtctcagctactcagtaggctgagacaggagtattgtttgaactccggaggtcaagtctgcagagagccacaactgcaccactgtactccagcctggtgacagatcaagactaggtctcaaaaaaccaaaaaaaattcttatagccacctaaaaggttatcttcacttaagagatgcataatcaggcattgaggggttacaaaacttgcacaagatcccagaactaaggggcagaggaactccaaagcctgtaggagaactgctgaaatctgaggatctcctctctctgtatatatttaaaatatgatttctgtctcagtctattgaagctgctctatcaaaatgccttaaattgggtgatgtataaataatagaaatttatttttcacagttctggaggctgagaagcccaagatgaaggtgctggcagcttcagagcctggtgagggcttgctctctgctttaagatggcgccttcttgaagcatcttcagtggtagaaggggcaaggaagctccctccaacctcctttaagagggtgctaatcccattcatgagggcagagccctcgtgacttaatcacttcccagaaggtcctacctcttaatagaatcatgttgggtattaggttccaacatataacttttggaagaacacaaacattcagaccttagcaatattcatccatgcttctcaactctcattttacagcagaatttcccatggaattttcaagaaacacatttgtccaggtacagcccatagaaataccgtgggcccaacagcttattttcattatgcttttctgggcaattatgatgcctgctcaatgtgtggaactcctgctctgtgtatttcaggagatcctggagtatattagcactaaaatgtctctttttctaatagtagtacatcacattggttttataaatacttataatacatgacatactacaatgtgaaggtggttttgcatgtgtcatcacatgtgacatcccattaacttaccaagagtcacagggaaagacttgttattatacccaattacagtttgagtcaataggcacaaatgaattatcaactttttgaccttggaggccatctccaactttatattacataatccttttgctttattaacaagaagtctaaggtccagagagattcactgacttttacaggttcacccagttggtaaataagggcaccggacaagaaaaacaagaattcagctcccacaactgatatgatgtgttatttgtaacacctcacccagaatgtctccagccacctttctttgaaacctgcacttgcactgttaaactgggaaaagattaataagtacaatcgtatgatcacatgggtagtcacaacactgtaatctgagaaataatcattatagatgataaagaaagaggtagaggaggaagtactatttttgtgcccttgattatcacattacaaagacagaaactgcgacgactataaaagatgatcagaggaaatgatatcccaaatttgaaccgtctgaattatgaaaaaaatacaatgtttaactagaatgttccctaaacatgtcacactttgaataaaaggagcagaaggactgtatagaagactggcaacaaagacatacaggaaatgtaagattcactatttaggtatgagtttagatttttttgtatggaagtagagcattctccccaccctttctcctacttccaacttcctgcaaaaatcctacacagaggcaaaatatataaaatgtcttaaaaccaaattgttaaggccctgtctcctcctactggggcccaaagtacctcctccctcaaggggacgcagggctcccaggacaccaccgggaatcactgtttcacattcatgaaatacgtagtcagtgatgatatctacataacgtcaagcgtctaagtgcttgactaaattttcccattattttcactttgccaactacatggataataaagaaaaaaatgagaattttaaagctaaaagactcctactggccaattttgagtacttcctgaggatgagacactttccacataagccggttagagagatctcagtgagccagtgtcccaacagaacatggaaaatgaagcccagggaggtcatacaacctggtatatggtacaacatcgccctgcaggctggaaacaaggccaggtcacactgaggtttccagactccacagggagaggaggaaatcctagggagcagatccccatctgtgttgatcttcatgattttgctcacatccctgtgcctcctgtactatcattccggtctgtcttctttacatctgctcagttcctccttaaattactttgacttaaatggaaacattctatctgtaccataaatggaaaaccagtatcacttgccacagatagacagctaaccctgttaaccttgaaacaaaaggatattaaactgtagccggaagggatccctgcctgaggctctgagcctggggcctgcccacgctttgttataaggaagattagcaaatactagaaaggtgagaaagcttccccctggctaatgagaagggttgaaagaaatgaaagggaataacttcccaagcttgccagaaacaccaaggtagggcagttttttttaaccctgctttgaggtctagaatcctttgttgaaatgaaatcttattaacaatagaagcaataatgatgatgctgataagaaacagctggttgtattaggatacaccaggcattcaaatacaagtaaactcagtacttagaagtattaactcatttactcctcattaacaaacttgtgagacacagaaaggtcaagtaatgggccccaaatctctctgctagtaacagccaaaaccctggtcctataaccccagagtccctgtttttaatgaccacccagactgcccctcaagattccagttactaaggccgggcgcgatggctcacgcctgtaatcccagaactttggaggctgaggctggtgaatcatgaggtcaggagatggagaccatcctggctaacatggtgaaaccctgtctctactaaaaatacaaaaaaattagccgggcgtggtggcgggtgcctatagtcccagctgctcgggatgctgaggcagaagaatggcctgaacccaggaggcggagcttgcagtgagccaagatcgccaagcctgggtgacagagcgagactccatcagaaaaaaaaaaaaaagaattccagttactagcaactgacaatagagttgtggttgaaaagggattaaggagctaaagtgttatgctaagcatggttatgaacaaaaggcagaaaaagaacaaatgcgtccactatatggcttgatttgattacttgaaaattattcatttgttttactctttagctctttgcttcctttaaggtaatcacttttaaccctcttctcatattacttggctgatgatataccttggtgtactgttttctttatttgaacaaatatggttactgtgccagtaccttcaacagattcaaatctttttaagggtaaaaaggcttttctatttttcttagactacaaataatgactaaagtaattcaatgataatgagcattctagatatttctgaaggtttctgaaggtcacacaaaggtgactgtttctactgtgctaatatatccctggaattttcattcttaatattttccaaagagcaggtcaacacttcacagcaaaaaaacagagtgaaagagaaaacaatttttttcatattattcatatatgtttttaatagatgattaaagaagaaaaacataccctggaaatgtagaaatatgaagccatgctacatatttttataattatgttttattgcgttctgttaactggccagagggtttttaaaatgccaaaagattccaaattaaattaccattattaagccccttaagcctcatattgagtttagactgtcactaaaaacttttgataaattaaataatatgcagtatgagtattagagtttgaaatgtttaaaagtttctttacacatctgtcagcataacctaagacataaaatggcttacatacatttttttcaatgatagtgttttgttttcaatttgttttttagaaatgtaattaatgaaagctacagagcaataatctagcatctagaaatgccttcagagttgggtttttaaactcttctctaaatttattctgttgctaaaaatacattcattacatttttaatctaacaggttttagtgaataaaacaatgatgtagatataaagctaaatttctacagtacaagacatttcaaacatcataaaccaaggcaaaagaggatttacaatacagagtcaaactacaatggacacttcagaataaaattcagtcagtgtcctctgccctgccagcagggcatttactgtagtggagaggaccaggaaggagattcgctttataggataatcatgttatgttatgcttttattgaatgcacttacattttggactacacaattgttcttgaaatgtttccaaatgtgtgtaatcatgaccgacgtgatggcagggatctacttaatttccgcattcaaaggggaacatgatgcaaatactatcaagcgagggcacttcctgtcatataacacagaagagataagaacttgaccatgagctggcaataaattcatcaacatcctaaaccagcagtcagtccccaacctttctggtaccagaaactggtttcatggaagacaatttttccacagatgggggtggagtggggctggcaggggggtggtgatggtttcaggatgattcaagtgcattacatttattgtgcattttatttatattattattacattgtaatatataatgaaataattctacaactcaccataatgtagaatcaatgggagtcctgagcttgtattcttgtgactagctggtcccatctgggggtgatgggagacagtgacagatcatcaggcattaggttctcataaggagcgggcaacctagatccctcccatgtgcaattcacaatagggttcacattcctatgagaatctaatcctgccgctaatctcacaggaggcagagctcaggcagtaatgggagtgatgggggagcggctgtaaagacagatgaagctttgctcaattgcccactgctcacttgttgctgtgtggccaggttcctaacaggccatggactggtccatgacgcaggggctggggacccctgtcctaaaccatgtttgcttctgccccctcaccctttcccagagtgaatggtaattactgtgtacgatatttaaaaaatggacgatgtccccttaacagtattttctgcctgagtccagagctactagtagtagtgactgctgactaaaggatgaagctggagtaaaacctttcctgtgctgtgacccacatctccccattgctgaagaagagaaatgtaaaaatgctttctggaagaagaatttcacaaggttatgttttccctcagctttccatgatcacagtaatcgaaaaataacactcttagtttacagatttcaatttggcagtatctggcaatgttaattatataaatgagaagagagagataagaggtgggaaacaggaagtgaatgccaggaaaatgaggatccaggtctcctcctcatggaggtcgtccccaggcttcctgcaccagtgacagcacctgccaaccacaacatttcctaggcttcttccctgatttattttctccctagagcttacccctctataacacagtctatgtttcatattccatcttcttcatcagcttctttatcccccacaacaaaatgtgctccaccagggaaggggtttgaagttgttttgttcactgctgtgtccccaggactggatgacagaggatgcccaccttatttaccaatatattcccagcatctagtccaagggtctgtcacccttttcagtaaagtgtcagagattagctattttaggctttgcaagccatacaatctctgctgtgcagctacttagctctgacaccgtagagcaaaaacagccatagccaataaatatataaataaacgggcatggctatgttctaacaaaacattatttacaaaaacagccagaggaccagatgtggcccagagctatagttgccaactccattgtagaccatgtcttgcatatggtgtgtgctaaatatttaatattatgaatgaatgtgataactccaaaccagccaaccctcctatttatcattccagaacaaagaagactctcataaaagacaaccactaccagatgttttaaggtaacaggtattaaaagcagaatgggtaagtaaaacatagagtttgtcctcagtgactggagatggtctctgctgtcctgactaaatgacctatattagggtcccagtgggaacctaattcaattcagatggttcaaatgaagagactctaataaaaggcttattaatggaggggctggcaggcgaaggaaacaagaagggaggtggaggcactcagacaagagcaagagcaggaggtcatggcatccctcaaagggcaaggggaggccacagtgatcccagagccctgtgagagctaaaacatggaggaaggactatcaatgtcaaatgtaatgctcactcaatcagggaagaagcaagaaagagaaccccaacttccttctgctccagtcctctgattttcagcctagccaccatgcttgtcaatcccagatccaatccaactgtaagggagcacaggcaatgtagtctattggaaaagttggaaagggcaggcactgaacacagagtaaggcaggaatgagcagagacagggatctagatgagagtggcagactgagcaactaacacatggatcaattaagatcaaaacaaaatcattgtattagttcattttcatactgctatgaagaaacacctgagaatgggtactttataagaaaaagaggtttaatggactcacacttccacatggctggagaggccttacaatcatggaggaaggcgaaggaagagtaaaggcatgtctgacatgacagcaagcaagagagcgtgtgctcgggaactgccctttataaaaccattggatcttgtgagacttactaactaacaggagaacagcataggaaaaacctgcccccatgattcaattacctcccaccaggtccctctcactacacctggggattatgggaattacaggatagatttgggggggacacagccaaaccatatcaatcatcctactgagtacagaaatgaaaacttcagattccatacacttgacatagattacataaaagaccaccaataataagattgtgccccacctgtatacaatgagctgttccaagccaaaaatgtgtcttgattaatgctgtggtctttaccaggagcagttttcccacccaggtcacagtcttcacaaattggaagcagcattacctctagagtaagcaataaatgaaaatggtgcctttaatttcaaattataaggtaacacactgatggataaccatagcatgattagtcgattcaggacctcaatacacaatagaagaatccatccattatctgctcaaagtaattctttcatcccagcaactttaacaacaacccaggaaaattactgtcccttagcaaagccttttgaatttcatatggatttaattagttaactgccatctcaaggatgagaaccatgacaaatagttgttcttttcaaattagaagaatagactgttcaatgagcaatattgatgtttcccctcacctatttatacaagagattttctacttttttttttctaatttagctaaccattttaacatttatcgaagcttttgtgatcactgttctctagctgagtgttctagccattagccattagctttaaaaaacagctgaaagcagcctccctgtgtacagaaaataccgtgttcctcactagagacccctggcaatctgaaccactactagaggattctaacaagacattctttaccagtggacagaaaagcaaatagagaatattgttcaatgaacaatgcaactactaatcataacagtgctgtatcttaacctgtagtcatgaacctaacccagctgcttgaggcaagcagacccctctttctttttaactgtggaacaatctatagcatgggaaatgggttaagatttggaaaagaagttaggtgagtaactagcagcagaaagccaagcaccgtaagactctacctattccatctgcattcctgccttttctcaaaaagatctcaaagcagaaagaagcaatcagaacaaagccagtcagctctggtagcttgctcttacctctattctagctacatgtcacctcctgtgagaccctctgcccctccagacagtttaagaaacttctcagaagactagacacacactttgtggctactagtgaacaatttatatgtgtgtttatatttctacagaactttgaaaaagacttgcatctatatggtaagtaaatgctcctgatgtagaaaaaagacaaacaggaaagacaaaaccattttatttggtatcatcaaattaaaaattaattgccccatatgttcaaataataacttatagccgattgtggtaatccaacatattggatgttggctttcatgatctcaccaatacatttagcaaatggctgtggaatctggcaataaaatatttccagtctctaagtcttcttgataattcactctgtgttttacaaacaactgggctcccgggattctaagcacatcactcagactgacagagcaagtattccagacaattggttcctggagggtcaagacagcaatgctcgatcaggattcaaacgggtcataaacccttcatggatctctctcaagtgggtggtgatgtctccctagggctgctcatcatttgctgctacagtcaagcacttgtcattatagacaaacaccccatcagtcttaggtcctcatccagcagagtcttactgccaccggtggagacaaccaccggtataaagaaatccaaacaaaaattcggcatgtgtgcccatccaggcatgactgttcactgtgcatttcacttctacgtctgcactttcagcatggccacgaaactcagcacctgtttatctgccatgatttcaggcatccagattgttctggaaccatatatatcaaaagctctaaaacaccaaacccgtttctagaaatttatcctaaggaaataattggacaaatgcctaaaagatgtatgtacaaggtggttccctgctgtgttctttacagaagtgaaagactggaaatgcatcaatctcagtttggttgtctacagaacgggattgcaaaatctgatttacacgtgttacaattacatcttgtcacctaatgccaggagcagactatatatggctttaagctaaaggaacatcaaagtcatgagtgccttggaaaacagagacaggagtgtgcatattttaaagcagaagctcccaaccacagtcttgttcacatccctcagttctttgaaaggcagccagacctccatttctaagggacaaatgtgaccacaacctctcccttttcaagattcttccaaggcttcctcctgtcaccagaatcccctgcatatcttagcgtggagttgaaggtcttgtgcaatcttaagtccaactcacctactgccacttttctcctcacctacactatgctctagacactctggatttcatgaagtacccttacctccaggcctgtgtacatgatgttcatccattctgcctggaatgcctttctttactcatccatcagcttagctagcctcctagtttcttgcacctctcagtgccctttcctgatttttttttccattctttccatgggtggatataggttcccctctccccacatgtccctaagtgccaagtttcatgtttcctctatacattataactgcccttttcatatctctttcccatcagaccttagtcaccttggggtcaggaactttggcttattcatgttttagatgacaaagaacacaattttaggcaatctctaactctgccctcatgcctgccctaggttgggaagacttggtagcttctttgtcactccaattctttaacatagaaatatactcggtccgggtatggtggcttgcgcctgtaatcccagcactttgggaggctgaggtgggtggatcacctgaggtcaggaattcaagaccagcctgaccaacatggagaaacctcgtatctgctaaaaatacaaaattagctgggcgtggtggcgcatgcctgtaatcccagctacttgggaggctgaggtaggagaatcacttgaacccaggaggtggaagttgtggtgagccgagattgcgccgttgcactccagcctgggcaacaagagcaaaactctgtctcggaaaaaaaaaaaaagagagaaaagaaaagaaatatactctactgacactccaggaagcatgccctaagatctgtacctcatgattctcccacattattaaggtacaattgtcctgaatgcacttgtccttcctcaccatttctgtgtaccatgtacacaaaaatgaggggtgtatccaacaagggagctgcaaactagaacaagtgccactagattctttcattaatgctaattaaatatctattctatactaggtactgtccttagctctttacatatattaatttatttggtattcacagctaccccagaagcaatgtcctactattaacctcatttgagatatcagaaaatggtatgagagaggttaagaaaattttctactatctcaaaactcctaaatgataaagccagaagttgaacccaggtagcctggctgcagcatctgtggcactgctgcctttccaacctacccaagatgactgagcctcctggcctgatcaaggaggtatgcttggctatagagtatctgctcagacactagagtatctacgatggaggaaaattcgagcagacagtatcatcacagaaagaaactgattatgaatgaagaacgagctaggtgtcaaatggacatgcagcaacagaaatagacaaactagctggatcattcttttccccagagggctgtgggatctaggaatgggtgttaaccatcacactacttctgaatctcatatacacaggtggaacctgtgggaacctccaaaagactgattttccctcttaatgctattattctgtccctagatgtgaaaaggcaactattttggggagaatcgttttcaacaatatgaggctttatataaccagcttctactcttctgagccatcccttccttgatttcccccaccactccatccctatcacaaccaagaatttgttctccagaaacaaagatgacagaaatcaagttagggacatagagatgctatcacagccaactcagaggaagatttttgccctcccttatctcaaaacctgcattggccgacattgtgtctgctcctagacaccacttaacgaaagactttaaaaactttaggaacaatttatttaaagaaaactccatttccagtatactatgactgtattccaaggtaataaagtataaatgagaacaaggaacaagctaataaactgaaatgaaggctgcatttcaataacaaggtttgggagccatttaccagccacgtgtatctcactctcatgacttataacattggctgaattacttaacagaaatgaaagcgcatattgcttctgttatccaatgctgaacaatgtgacatttgcttcagagcacttgtatctaatcgatacataatgctaaatgtgatttaaaatcaatttaattgtgctcttgctctcccatgagtcaagggggaaacaaaggtatcatttgagatatgaaaccattaggctatttcccaaagaaatcatagatcccttgcttctaatggagcccaagaagtagatacagttagtttacactaaaaactccacatgtgaaaaacagtattgctgaaacagttaagatactgtgccctaaaaggcatatttgaactgtttttttttttgaattacaaaccaattgaacttttaaaaacttctttatttgttgtgacctttctacaaattatagcaaatttaaaaagaaaaaatataattaagaaaaaaacataatattgcatgtcatatatatacttactttcctagattacatacttttaaaatatctgtattcctacatattgaaaccaaccaaattgtcccatagagctaatgtgtatgatttattttaataaacatagaaattgattctcccagtcttaaaacatgagaaagttatgtttgtcttttctgagttcctttctcaagaaaccaaccgtcaggcctcccagataggatcaaggagctgaaactcaccagattactgtatttggacaatgagatgtcagatccctcacccatcatgattgcctaacagaccacctgcttcctgttgatcaacttctctcccttacccctccctaattcctgttttcctacacatggttacatttcttctctgcctacataaacccctcattttagtcagtgagagagatgggtttgacactgacttcccatctcctcagttacagcatgtgattaaagccttcttccttggcaatacttgttgtctcagtgactggctttctatgaaacaaatggaaggacctagactgaacccctggtgtttcagtaaccatgtaatattttctattatattgtttctctgaaaataattgtatagttatatgctgagccaatcctgagtgtgtacaaagatttggacttggagtcacttctagcatccatctgcctgaccaacagttactgagtccccagttggcacaaggttgtattacttatactcaaggaaatgaggctcagaccaattttaaaggagcaaattcaggactcaactaataatacaagagtctctagactttactttatatgaggatgtttaaacaatccaaaacagtcagtaagttccacctgaattgcagtacttgggttgagtgtctcacttttaaaaactgatgtattggccagcacagtgactcacacctgtaatccctgcactttgggaggccaaggcaggtggatcatcgaggtcaggagctcgagaccagcatggccaacacagtgaaatgccatctctaacaaaaatacaaaatattagccaggtggggttgtgtgtgcctgtaatcccagctacatgggaggctgagaaaggaaaattgcttaaacccaggaagcagaggttgcagtgagctgagaccacgccactgccctccagactgggcgacgcctgggcgacagagagagactccatctcaagaacaaaaccaacaaacaaaaaaactatatattgattaaacgaactatctgtgattaatgtacagcctgtgtgtattttttttctacctgcattcaagaaattgtatggctatagtatataagaaacagaatctttttaaattattttcctaacaacaactgaaaatagtcccatacaatgtacccaacaaaacttcctttttcaaaatttgctttaaatggacaaaattatgtaatagtgaagtaaacttttattaaaaagaccaaattactagttgaagttaattgggatagggttgttttataacactataacaaggacattcacacaagataatctctgatttgtaaaggaaaaaataaagtagttcacaggaaaatagtcaattttatggctcttgtgtttaaatagagggaagaatgtcaaaattcctataaacttaaaatttaaaatatcttcagaagttgccacaacttaaaaaaaacttgaattgcaccaaaaatatctagaaaaattttaagcagtaagtatattcttataaacatccccatattattgtaccttgtcttcccccttgaccaaggttttagactaaattcagttgacaacaggtaacatagctgataaactgaagatctctgcttggcatttgatagttcatcatttacatgggcaaacaacccacataaattcaaacactatgattcaaacatacagattcaaacactatgccaggaatgagcatctacagtgtatgcggttcaggagggtaaccaatcaccacacatcatcattgggtacttgatacagggttagcccaaatcgggtgctgtgttagatatgtcctggatttcaaagactcagcacacacacacacaaaaaagtaacacaaaaacctcttgtttttatattgaccacattttaaaatttattagatatattgggttggataaactatattaaattaattatgcctgtttctctttacttaaatgtaagaattactttggtgacctactttctattagacagtgctggtaaagaacttaaaaaaaatggtatgctccaagttaccactaagaaaaatttttaaaaatacattaaattaccaattacatttttttctcagatgaaacatgcatatgttaacacagaacatattctgacagatctgacagaaaacatgaaaaagtgtgctttctatcataatgattatttttcagataacaacagctgttggcctgtacaagcaagaagctgtttttccacatactaccaagtattagcattcaatcatgaaagaaaactaattctccatgggctctctccacatgctttacatcagcagcaagctgtgcactcctatgtaatctgaaaagccgaaccaagttggggctgcttcttggctcactgctttgccacttctctctaatatggcaaatacaaagcactcacattttgctgattcagaagtaaatgaaacattcaagacctgcacaaaaaccctgaccaaaaggaagtctcagacaggtgagcgccattttggctcttctttagttacaaaggagattaaaagtaatcagtctcttgaatgcctatgaaaagagtggttaaaagtcagctgttaaagaatggctttattctagaacacttgaacatagcccaaattttggaacttgaaaatagtttaaagttcccttataaatttcaagatctcatttatcacattttgtgctcaagaatcacctcagctgccaaaatctaaatagatctgtgctatccaatatggtagccaccagccacacatggctatttaaattaacaaaactttagttaataaaaattggaaattcaggtcctcattgtccatgaccacatgtggctactggcatagtagacagaacagtggagaacatttccagcactgcagaaagttccgttagacagcattgaattagataataacatacagtaagttagcaattcagaaaacttaaagagagaagcaaatagggcagaggaaggcatgtgactagaatgcagactaagactatttaaaaaaactcactgcagttgcattatgtcaaagtaagcaaaaaaaaaaaaaaaagttctttgtcagtttgatgagtgtatctgttatgcttgaagatgtagacagagagaaaataaaatcagtggacagaaatttcatttatatatactggttacgtacttgccacgaccacacacaaactacaacacagaccaaaattcattactgatgaattatggttttgcttttctacaagacggaggtaagcttggcaacatttattcttgggctaagttcacaattgagacaacaattctttccttaatgtgataaattatgctgctctacattagggaatgcatacttttttatcgaaaggtaggaaaaatcgcaaggtgtgccttctctattttttttttccgcccactaggaagacatgaagttctatcagggagttaaaacagttaaataatggttaaaagcctgcttctggaatctgaaaaactcggtttcgtggctttactactttctagctatgtaagcatgtgttctgactgtctcctcatctctaaaatttaaatgaagtaatgcctgaataattcttggtacacaccatttctaattaaagggatgcttaatgatgcaatcattcttcctttgctgctaattactaattttgaaatacatgttatgttttgtcatgacacatacaaataagcataacttaagtgacaaaaccataaacctatggcaaaaataccacagaccactcatatccctcagaggctttcatggtggacaagttagccgtgctgtctcgtacaccccactgcactgagttgctttgataaactgagttatgatcctgggagagagtactgaaataagacagacacactaaaggcttctgggaaaccacatgacatacaggtgtacctggggtttccataaagcccagagatggcagagaaagactcttgggggactggaatgtctgaaaatcccataaagaaaacagtttgcattcctggtcactgggtacaatcaaactcaggaagtactttgtatgggcaccgaagtgtatcctggaatacacagtcacacattactatcaagcctgggcatttttaccagttcgaaaaatcgaacacccaagtttccatttgtaaggtaatttttcaaataatgtttcttttcgaattttttttcccatttatgtagagaccttgagagaagtgtcatacctgagatgcagcaggggacaggatggaatgcgttttctagagaatcttccataaagggaagcatacatatattctgcatcactaagattaatcagaagaaattgctcaaattccaccacattccactttaagactatagctttcccattaatcgctactagcccgaagacctgtccaatgctataacagtgtatgataaagcatatatacctgatttttcacaatcatctataccacaaaaactctattcctgtaaatcatctaattatttagagatcctatttatttatttacttatttatttgagacagggtctcactgtggcgcccagactcgagtgcagcggcatgatctccaccaggccttggcttctcaaagttctgtgattataggcatgcgccaccatgtctatgtctggtcccagtattttatttacatccatagtatatatgtcagattgtttcttatacctagaattgatagaaatcctttatcacatgctgccttccaaaaaagagttcaaaaagcatggttaccacataaagacttgcagttactagaccacttagatgttgcctgagaaagatagagcacatgtggttttctgcatggtatgacatatctgaacagcaccagtgaatacagaagaccatggcacataatggtggtactgtgatggggaataaactgcctatttatttattagagcacataaattaccaactgatacgcaaaacaccaactgcaaattaagccttccctcagaattaaagagaaaagaggctggggaatggaaagaatcagatgggcctgcctcaaacctcagcgcactacttaatagctgcatgacctcagtttccttaaccctgaaatagacataacaaggcctcctttacagacttagtgtaaaggaggggacccacagaagataccatctggcatatagtttgtaaaactttacatttgctatttctgttatgtatttatgaatatacacatataattttatgatatctattgctataatatatgcaatatgtaagtatgtatgcacatatgcatatgtgtgtttatatataaaatgagtgatttttgctctttgatcttcaaatattttctttggatgtcaatttttctttccttttttttctttcttgatttggatctcaggatccaaaagtaaactaactttcctaaacctcttcagtattaaagagagattcattttgagccagcacactatatttctagtccatatctgaatccatatctgaaacaaagaccacgtctaaaagtaatactcttatttctaattctcacctaacacacccatggaagataagaaaattaacttaccaggcagcagtaacttcttggaattctatgctcacactttgctcagcacacataggcgttctgttgacagttggctctcaacacctcaagtacgtgtcagagggacgcgagccgatcagtttacccaagctccttacttattctcatttaccctctagaattttatttcctgcctcagaaagaagaatcccatctgccagaaggaaatatttgtagccaacatgacaaaagtggaatccctattttgtaacagctgtgaatcaaaacactagtgactgaaattaactacatcgtgcttcggaacagatgtgtgcacagaaaccaactcaagctctggtgttcctgggcaccatgtgtaaatcatccacagacaacacggtgggccatgttctcaccttgttgctatgcacgctcatttttaatgttctcctgaaccattgcagactttgagatttttttttaaaggcttagaatctttatttccaaaagaggagattctgaaagttgccaatcactcactggaagacctaactaaacagatgggttttgacacctctggtttgattttaaatgcaaacatgtcaaattatgctctggcacaggttcttctgcctcaaaattttatggaggggtgtttaattttttttaagttttcttctctgaactcagttgttccaccattagcaattaaggcaataaaggacttattacagaaacagtgatatgattgctgtattttaatgcagcagccttaagtaattgaaaatcattactaaaaactttaggaaataaatttcaagaacagacatctgcaaatgaagttgaaggtaaggtcacatttttatataaataggaagcgagaagaaaaacatatggctttctttggtgactcttcccataatcaacatacatgtattatctcctacaaccgaattagaagtaagtggtacattgcctctgatcactgttcttgggagcccatggcagacaatggtaatccactgcagcccttccaccatccatgcccttcagatgcaaaagacttgactagctgctctgaacagatacaaatcaagggaggacttgaacttcagacaagtaactatatggttagaaagattaaatatacacaaatgtaatcacttgagaacattttaagcaacatgtcagaatatgcaagacgatgggctgcaggataattaattattgagaatatacagttgacccttgaacaacacaggttttaactgtgagtgtccacttatatgaggaggacttttttctttttttgagacagagtctcactctgttgcccaggctgcagtgcagtggcgtcatcttggctcaccacaacctttgcctcccaggttcaagtgattctcttgcctcagcctaccaaatatctgggaccatgcctggctaatttttgtatttttagtagagatggggtttcactatgtaggccaggctggtctctaactcctgaccttgtgatgcgcccatctcagcctcccaaagtgctggattacaggtgtgagccactgcacccggcctatatgagaattttttttaaatgaaacatggattaatagtatagcattggggaatatgatacctccatatttggatggctgacttttggtatctgcagatccacagagccaaatgcgggacttgagtattcacggattttgttatacgatgagtatatccttgagtacacagaaggatgactgcgttctcattccaccgtgggggtgtgttgttttgagctggatatatccacacagcactttagtttgtaaggtatacctatattaagcctcatcgttgcatgtattattttgtaataatatgttgaatttataattttaaagggttaaataaccagtacagtttaaaaattgagtaaataaaaactgagaaattaaaatctgttcaaataagcactgcatttaaaacccatagatacacaaactctacagaagcctggagaaccaggcccacgtggagacaaaggcaggattgaatgagaaaaatgtgtttctatcacaaatcataattacttgtagaaaatctttttactgcgttctaagctctgttgggatccatgccttgaaggtaacacaccattggttgctttttcctgctctccctcttgattttttttttaatagactgaaggtaggaaatgctatatgcttatctctgagaagatgcctctatgtagtctctctgctttataattagcaacagtctttcccaaattctacacttagattgacttccaacttaacagatgttacagtgaatttcttttttctttttgtgtcttcatgggtattttagtgcgaggtaaccaaaggctgtgtgtaaggctaccagggaaatattcgcaccgcctgggtcagaaccctgtacgtggcatgggtcttagtaatcttgcagaattttgttccttagttcagccaaaacgaggttcttgtcacatgaccagcgaggattagaaacgtggacacattgaagggtaagggaattggaatttattgggtgaaaaagaaaaaagaaaaaaaactctcagcaaagcaagaggggatcctgctaacaggccatcacctcacacattgaattccaagccatacacaggacctgaagatgccaggctcctccccactgcacaggaggtgaacttcccctggcttcaccctgttctcccaataatgtgagggtgggtcagagattctccaggaccctccttttatctgcatcctgcatctatcagtaagtagttattgaatacacaattgcatgagcaatgtttaaggagcagagagagctctttgcatagcatatcaggcagctgatcactcaataggatttaaaagtcactgaatagactgctaggttccatagtgtggcagatataacacagggtctgagattctcatcctaggtttatgaatgttttgtgtttggacaccaaattctgattttaaaaagattactgtgataaaacctatttaacataaaatttaccattttaatgtttaaatatacagtttgtgtctttaaatacattcacattattgtgaagcttttaatagattgaatattcttctcttctgatcaacagcaagatgatttacataattctgtaaaactatgagttggcccattccctcaagtaaagcatgaagacttaaaagcaacatggaacacagaaagagaaaaaactttgagcccaacaagattttggctttgaaagagaagtaagatgtttaactaagactcaatggaaggaaaaatattgtctggagatactgaaagttgagaattataaagagtgattacaaatgcagaaggtaaaagtattggagcaaaaattggaaatctgctcacatttactggctttttaagcaagttctatcatagaggatctctcatccaaccttcccaaggaatttgtcatcactctaatccacagctaattttggcacagaaattatattagtaaactcagccatattgtcttctcacatgaagacaggactgatgtcctctaaataaaaaattagagtctatagcgatttgtttacaataacaactgatagttacaccccagggatcttctttttgcatatcctggtttttaataatgaattataccttctatacattctttcaaaatgtaaatcaatatactaaaaaaactacagaataagtcaacataaattgccctgtgtgagggtgcctagtagaccaatactaatattttggaggagatttctactttgtagaatctactgagattctgaaagctgcctgcaattctgcaagtgtagggaatgggggaagagacagggcagaggaatgaagcaatggacttatctaatcaaaagcctgattaaaacactccctagcagtctctaagatagaactatagggaggcagcaggcaatcaaaaggaagaggtccagctatttaagtatagctcatatctattcactccgttgtttgattagatttttacctgtaccaagtctatgtaggtatgatgaagaaaggtggtgtattaaagatgaggaaaggtggtgtattaaatattcctaacaccactttccccagatatgctactaataccaccccaaattttccactacgctttgccatcatgccctttgaaacctaattaataatgtttcatttttaagatgatagtctaggctgcaattttaaattggtaagactaatatcactatctatagtagaatacctctttcctccacccacattctgatgcactgtggatacatctgtccacaacaagagattaaaccatccctttctgtctttacttctcctttaaaagccctggactgtcttaatttttgacagaaactaacttctttcccaacagtggtggactactagaattccatgaagcatgcttttggtggctcatgttgtaaaaatcatgtatcactttctcttgtgacctgtcatcaaatgtgacataatttaatgcaacagctccaattttaaggatggcattttgcactttgctttcaaactctatgactacagttatccaacagaagctggccgacctcagtggaacagacggggatctgttaacaggttgccaactttaaattactgctgagtagcttagcatatctctagaataattcctttaaaaagtaattaatcattatttcaaaaaggtcttcagtgaagtgtattttctatattttactgatgggtagcatttgattggaaacagctaatacttctccattctctgtcttgcatttacatttttactgttttcaatattgctgtttttgtttgatgacaactagggacaactcagggagcagactgagatgcgtccaacaaagagaatatgaatagcaatctagaagagtgaacattaggcagctaatgcatagaaatacttgtattttgtatctattttctccatatttcaactgaagattcttgcctcatgttggaaacagattgagaaaagtcactcgtgtcagtactacagagaacacattccatgagcccatatcttcagcaatgtgtttgcatcctagaaattatttcagattatgctctctcttgaggccataaaaggcaaacactggaggaggaacagtgaggagaaactacataaatagctacaggctgtattttagagacgcctccaaacttgttagaagataacgtgttgacttttagggtttgtcaggaaagttaataaagctagatttataagtatctttcaagatttttttttctaattgaaaaataagccacacgaaaactgtattctaacactctttggaaactggtatcaaatcagtccatcacccacttcaaagaattttattagccaagatatcataaaagtctacattttaagattttttctttttatcataaaaaatttcaaagacatagaatgatataatgaatcatttatacctccactatcactcacaaaactatttaaaaacaaatcccagatgttacttaaggcaatgtcattagcaaatttccctttgtataaacactataaattgctttaaagtaaactttatgaaaatcatatgctttatttaagattaggaacatcctaatcccttttccccatacttcacaaattttaaatcatttgtgtcatactggtaatgaacaaattactaagtgtgtacaacagagatgatatatgttgtcctcctattagggacatccagtacgtgtccatgacaagtattcccctggatcttactacaggtccctgttgaagctgggcagggcctcacagtgagttccaacacagcacaccaggtaacactaactcatcaattagagacagcatgagaactactgaccttcctggtctacagcttactgtcaaggaatctcatagccaggaataagcttctttaccaattcctgctattgttaaatacctacaatcacactgttcaactaggaggagaactaagtattcatgatggcttggacctatgtggatactctccttgcttttcaagctcacagagaatggataaattattagatttcagaaaaccaattgtagactagaacgagaacctagaatgatctaccaaatccagtttgtgactaaaagatggcattgtttccattgtcaaaatcatgaaagtagactatcgtctcaagatagaaacaccatctttaccttccattatggaccttttaataggaacacagtgctaaattcctaaattacaacagtttattgaatcttgaatgacatcagtagtaagacctaccattattttatgcactttaagaaagaaaatgtctttttgaaaactatgacatgctatcaattataagaaacacctggtttcacagttactaacatatttgtatatacacacagatgcattctattaatttgtatttaagctaacatttcttacttgaagatgcattggtaatttattgataggaaaatcacttccacaactaaggatagtttttcacctttgttgctctgcaaagcttggtcttatctattcttccttttaagatttcatttccaccatcaatcccaagggcaactggtttaacgtaatagagaaagtcctggctagggaagcagagtgtgttccctgccaacatttgcccatgtctgcgcccaaatacacagtgactccttagagagtcctcacgcaatgtccatcaattaatatttttattattagagaggctagtgctctttacagcattggaaacctagaaattctaccagcttagccagcttttgctacctataagagtagtggaaaaataacaacatggtaaggatatctttctgttttcactgatctgaagtcacaagcctataaaaccattcaattataaatgtgaaaataaataatgctaataatgacagctcttgtcaactggacatgcccaaagcagactggagccagatatgtgcactgagggaagtgggtggagccacagggaatttgcaccttacccaggggaggagcctgtgctcttcagctcatctgtgtggcctggaatcgatctatgagatgaggacctgttagcaggaatcccccacgctttgctgagagtttgttttcttttttccttttcgccaaataaattccattcccctcatccttcaaactgtctccatgcctaacttttcctggtggtgtgacaagaacccagttttagctgaactaaggaacaaagctctgcaacagttgcaactaaattgcattaaaacaagatgtgcaagatgagttttgagacctacatccttttattaaggcagaaaaattcaagtccataatgaagtcaatatgaaaaggacctgaatttaggtttctgtagcaatccattttatggatgttgctttcttagaaattttatgttttaaaatagatttttaaaatttattaccttaaagattttttcctgtagatcatatggacacttaatttcttctatcaggcgtatcatctagaaatataatgcttacatgggaaatatattatcttatgatttgataaaaaatagatggagttgcaaatatacttttatgatattcttgaattttttttttccaatgcaaagattcccaatctgcctaccaactgaactgttttggtcgtgaaacattaccttctcggtatgtggtatgcctatcagcagaaaagtagtaaagaagaatagactaactttagttattacatttgcattgtctacaaagccatttacttaatggatgagtctcattagcagtccaaccacaatataaagaatacaatgatgtgtttcataggttcattaaaataatatttcaaaggagtcattagaataaaagaagctgaagtttcaacagacagtaagttgtctgcaaataaatgagatggaaccaacatgttttcaagtaagttaagagacatgtttacaaatacattacagccattaaaaaaggaagcatcaacttagcaagtgctggggggacgattactcatgcaatttactaaaacaaaactgtaacactctcacatcaatagttattgtagatgcaaacgcctgtaggtacaggaaaatgtgtcttaagaaggaaaattcattctacagccccgagatgattctccacttggaagcaaaattgaaaacattcaatcctgtcttcagatcaccactggtttggggggggggggggtttgttttttgttttgttttgttttgtacacacttttgtgttatttgccccaaaccccaagcatgcctatcttttcatttttttttgagacaaagtctcgctcttgttgcccaggctggagtgcaatagcacgatcttggctcactgcaacctccccctcctgggttcaagcgattctcctgcctcagcctcccaagtagctgggattacaggcgcccaccaccatgcccggctaatttttgcatttttactaaagacgaggtttcaccatgttggccaggctggtctcaaactcctcacctcagttgatccaccctccttagcctcccaaagttctgggattacaggtgtgagccaccacacctggcctaccctttcattttaaaaagaaattcatggtaaattagtaacatgaataatcctgtaagggcaaaaagtatactgaaaaaaaaattgtgtctatttgtaattatctaaccacacctaagaattgacaaatgtttgtttaacaaatcaatggatgaataaatgaatgaaaaaagcaattacttagcaaaggagagtttttagattaggttgttaattattgctgctttatcaatttttaaacccagtatttccacctgtaagcaaaataataaacagcttgtatatatgttcaataatgttgaaatcttttcacaaatagcagtgtcaaattttttttaaccaagatcatagagtttatattaaaactaaggattttatttttgggtttttttttcacaaagaaaattaacatgtagaacaaaataaaaaccactaaaggaatagagattgccatttatttattaactttccttttttgaaagagcttagatttataattctaagaaatacaaggtaagacacacacatgtgtaagtatacctgggacttggcaataagtcacaggcacctagaccacagctcttgtggcagagagcaaaaatggccccatgtaatttgcaatgtcttcccactctgcatcctgactcacctttggatgcttggcttagccatgtaacttgacttggccaatgtgatatcagcaaatggacttggaaagagacttgaaaaggctttgtgtatttctctttgtgctcttcctatttgccatcagcattagaacatgccagggatagcctgctggcggatacaaaatatttagagcggagctaagtcattcagccaagaacagcctagatcattgcccagccagctaaccctgacatgtgattgaacttagccaacctcagcacatttgcctaggtgaccccagctgattgtaggtataagagaaataaacatgtgtagtatggcactacttgacatccaacagattcacatataagctttgtactttgcagtaagattattctccaaatagaacatcaggttgcataaaatcaaagtagtactgggttttattaaagtaactaataaaaaattattcattttctattttttaaaagagaaaagacaaaattaaatttgtatgcacagtctgaattttgaagtgctggaagcttactcaacaatacatctactgctgaattcagctcacaagccaccaagtgtcaacctctgttctaggtactgagaagattccatgatttcaagctgtttacggattttgtgagaaggacagacacatagtgcattacataaaagaaattaaaactattatgtcttaatgcttaccacgtggacgaatataaacaatttggatttccagatgttttctggaatgcttgctattttgcctaaaaggtaataatcagaccaatccctacaattaaggagtttactctctattttttaaatatataattgataagcaaacatattccaaaagattcattgtaagtctaagtttttcagaaggtactaaactccaaaaatatacaagcctccaaagataaactgtttattaataaacgtatatataaggacttcagcaaacatagcttcctgagaaaaagcaattcaaagatcaatatttccttttaaattttacacaacttggacaaaattttctaaagaaatcacaattttaaaaatgttggaaagccagttccattgctgaattcataaggtaacttaccgtaaatcatatatgattatcatatttataactaacatcacatagccccttccagactgtcaactccatgagggtaaaacctagttatgttgacatctgttttctcaagcagttagaatttcctgattcattctcttgtctatctggctggaacagctaaaattaaggcagtggagatcattagtttgataaaacaatagaagacaattggtattggtgtaggagccactcaccagaaatgctgtaagtaatgactaggttctgcagaaataaaattaacagattattacagtacacactcccatacctacatcaggagtgaaaggatcaagcaccacagttaaaataataatgtcagttgcaactggggaactgagggtcctggagactcccaactcagatgcctgaagaagccagggcaggtatagtaagcaagcagggaaaacttggtaatagtgtacatgtgtacttggcttctgagtagtgggagatggcactgaactggcaagcccatatcccaactaaaagtgggtttcagctactaatctctaaccaatatttgccatgtagaagggtagagctccaaactcccatgattttatatatacatattaaatggaaccacaaatagcaatttctacatattatctccaaaattgtacgtaacgtcacaatttttaaaaccattatgtagaacaaataagacacatgtttaagcatttgtgctttcccaaagatgatgtcacctttgttcctggtccaggaagctaaaaacaagtaagaggtgacttcctcccatttcttctccctccttcctccctgtattccaccaacagtgctacttaaagtatggctatggaatattgccactccaaaacctatttttttcttttttggtctaagataagcgtgatgaacaggtaaactccatgatccagccccctgtattcatgctcttgtgtgtaatctcctctcttgagtgtgaacagtgtcagtgatttgcttccaaccaaaagaaatgcaaagatgatagaatgttactgctatgattatgttatgtaaaactccatcttgctagcaaactcactcgagagtctctctcccttgttggctttgaagaagcaaactgtcatgaatcctacagccacaaagaaacgaagtctgtcaacaacctgagggagcttggaagtagatcccttcccagtcaagcagctgatgagaccacagccccagccaaaagctatattgcagcctggtaggacactgaagcaaaaaaaagccattaacccatgtctgaacttctgactcacatgaactatgagataataaaggtgtgttatcttagcaccactaaatttggagtaatttgttatatagcgacagcaaactaatacaaggggcctaccccttaatgttaattaactgtatcactaggcacattgtttagtttgactgatatttattttttgtaatagtactttctcaatgaaggaagcaatacattgaattacactcagacgcaagccacctcatctcacagcagcccaataccttgagttctacagttgatgggcatagtggaaagagaggtctggtgtaactttatatgcagaaaatgagaaaggcacattttcttcctttgacttataattttgtctaatgatatatgcaacagaggtagtcaagagcagggtcagggaaatggagactatggtgaaggagttattacctgtaatacttctaagttgcatcataaaaatttgctatcactacagataaaagcaaaggatgagctaactgataatacctgtaaaatgctgcaaacaccaccatgatgtggtgaggaaagcaagataaacattcctatagaatcctcctattactacttgccctggggccttgtgaaaatctagagaatctaatagtctagtactcagctcgcaaggaaaccagtcagtcatctttgtcattctctgctcatatcttatttcctaacacaacaaaatcacttatagacccatgcagaaaccatgcccttccttctcagtcctagacctggctaacccctgtgccctctaaagatttaattagctagctcttaccctgaagaagccttctttgataagtttgttcctccttatagcttgctaacatcctgtgcaatctccatcatttcacttcttgccctgtatcgtaattagctcttccggtgactgtcttatccactggagtaattaattgctacttaagataagaaaccatggctctcatttttgtatttccagcactgaggagcatgccttgctcatagaaggccctcaataaatactaagtgcagagaaaataagtgagttattttactagaggctgcataagagccaagagaagcaacttaattatgaggcaacaataagcttggatgatgcagacaaaaatatgctaggagattttaagcactcagtctgtcagtggtgagcctaaaacaggttcctttaaaggtaaaagattcatacaaaacaatacgaaactaagaattgtacaactcaacacatgttaaaattgaaagaaatatcacaggtactcactatacccagatgtcaaattctttcatatcttgcttcaagcagcatgtgtatattaactcatatttaatacaaaaagctatgctttttctaaaagcatttcttttttaaaatttttttttaagagatggagtcttactctgtcattcaggctaaagtacagtggtgcaatgacagcttaccgcagccttcaactcctaggttcatgtgatcctccggcctcaggctactgagtagctgagattgcagttgtccaccaccacagtcaggtaattttttaaaatttttattcatacttttagaggaagggtcttgctatgttgcctaggctgatctcaaactcctagcttcaagtgatcctcccaacctcagcctcacaggtcactgggtttacaggctcaatgcaccatacctgacctaaaagcatttcttatcagagtcctacttacccagttttgtcaggtgccaggaaataggggagctcttacctaggagctccctctggtcagagtggcctcgcattctcagtgtgggggattcagtcctacatttatacctcccttggagatcaattccttaaagcaaaacaggtggctcactggatggcattcactttcagttgatcaattgatttgtttggagatcagttcttaacatttatttcaacagtttaacaagataaatttgaaatcatttttcctaaaaaaatttcaaggtgatcttaatattattttaccaacttcaactatgaccccttcttcagacttaacctaattccttctgaaagccaaaaattcagacccatttaccatgaagctgaatcctccactgcttctctaactacctcttccatcggccctaaaacattaaaaaaagtggggtgctgcttctctttttctgtaagatgcccaggcctggttggtaaaagtttaactgcttaggtgattattatgcactatacaaagtatactacatatcaagtgctctgcccagtagagggtctactaaaaaggcttaagagtgaaaactgccaaagggaatttcttaccttccctcagggcacacagaacctgaacctcagtaccaggtgttccctacatctccttctgctggtgagtctaaacctgaattactcttctttgtctaatcaatttagacaacaaattaagcatgaatactgcttggcatagtagccttaatcaaacaaaaaagtgagattttttatttttttaaacatctatgcaaacatagagcttttgttagaaaaagttacaaattaataacattaaataaagccaactctttagaaatgatacagaatagccaattcccagaagtatttgagtggctgaaaaacaaatctgtaaaaaagtcaatctcaagcaaaaatcaagttaaaatgagacagacacactttcaaaattgcagtaatttttaaaaatttataagaagtgtgtaaagaagttgacattcatacagtcctgttcagctgatagcttttttagagagaaatttggtaatatgaccccaaaaccttaacaaattttatatatttatcctatctattctacttcttagaactctaaggaaacaagaagagatggccagagacttatgtagtaggatttttctatcacgatgatgggctggagaatccaaatgtctcacgataaaaaagtggcaatataaaaaatggtatgtgatacaatagactcctatgctataattaatttttatgacatatgacatgcttgtaacatattaaatgaaaaatggcaccaaaattgtttaaaatacaattattttatttttaaagcatacataaactcatagtaaaaaagtatgcacattaatagtattagtcattacctgtgaaaggcagactgattagtgacttactttattattcctatccttattttaaacttttccaacccatatatgtggcccatcagatttgtaaaaatgaaaatccaaggcataggatttgaaggcatacattcctataccctgctaaaaacagactcagtttagtatctccttaggttctgatataagatgattctcgaaaaagccccaagccaacccagtctgaagaaacagatacagagtagttatcagaacaagaattcaatgccagttaagtcacctttcccaaatttaattctaataataagtccgtgttaaaaagcaaaggttcaaatattttagtgttattgagaggattagctcactgctgagagtgaatataaaaaacaattctatatcaaagccaactaattcaatcttatttttaaatgtcaccaaatatggcttctctcaaagtacgccggtccaattggtaatatctgatggctgattctgcttaactctactaaatataaaccattatcttagggaatcagtagtatactttattcttgttattctttagtattttgttagggatcataaaattggacttgactttgaggacaggactggctaagccagggcagttagtcctatggaccttttcactccgggagtctgtgactacttatccttaaacatttccagtaaatttatgttttagttatcaatcagttatctgtaaactagaactttaaagaatcctaaaacataaatctttttaatcctcaatgatttagactctctacatttttaaataattcagtcaaacaaaagaagggtaaattagtcattttgtgtgtcagataaaacacacatgcatacacagaataaatgttttttgttctcaaaggattttgttgtaacctccactcgtcatgtaacactggaacaaaatagttaggctaattacccaaaattaagttccacttctcgatttacaagctttccattttattctagcaattcttagctgtcatggactcagaaaattattactgccatcaattggaagattgttttagtggtacagatggctgtccttttataggccaacttaatgacttcttcttatctaatctgtcatctgttatttagttgtcattatgaactttttgggttgcatatcaatccattttccatgtttactaaacagatggctttatttgagaaaaaaaaaagcaaagcaagaaaatgacattgcatgattaaaaaatttcaaaaggctgcatacaatttttaatgttcctaaatgaaatgaaaaattgctattaaaaaaactaaatttgaagtcaaagtgaaatagattttaaaactcaatggacatgcaaagaaacaatcagcagcagctatctacaaatagaacaaattacttccaaaacagcaataggttattcttccagtttttgtcacaaatttttttttaaatttatcttgacaaatagatgacaaatgtcaacgaagtaactcttcaattcagaagctctttatgttgtaattcacaggtgtacctcctttgtctagtatttgtaaccttatttagagagtaggtaatgacataaatacttccatttagtgaaaattgttccttatctttgtctccttatgatgattttgtttaatcactgggtcattatcaaatcaacacccaaactcaagaagcgtaagggaaattgtaaagggcttgtatcaatgagttcagagatccaaaaataataactggcactgtgccatgaaagaacactgtagttcacactgtaccagagaaagaacttgacaattattagaaactaaaatacataatcatgaaataattttatgttacatttatgagtggtatttaaaattgtgtttgttcaggaaggatatttaccaagtcttgggatttgctgtatcagcctataacaacgctgcaaaagtaaccgagcagagccttctgaaacagtttcccatgccatactaagcacatcctccattgtagaacagattgagttcaactgtggtttttttacttgcccaagttcaaggctcctgagcacaacaaaaccaacaatgaggaagagcatgatcgcataattttttatgttcttcagacaatgtaggagaacttaaaatggacagccaatttttcaaaaaggacaaattatttgaaggatttcttttcttatatgataaccacagtaaaatgtaagactagtgtaggtaattgtcctgccactccattctaagctgtgagtgaaagtactccatcagcttaatgagaacaccgtgaaatataaaacatctatttcaatacaagttattgagaagctttaacaggctttcgggagaagctaccaaaagaaaaccgaataccagatacttgatttgagactgacaaaaatcttctattctttcctacggaaaattaaacaaaatgggctattatatagcaggaagacagagacaaaaaaaaaaaaaaaaaaaaaaaaaaacggaagaaagagtaaattgtatgaatcagaaacttggaataataattctacctcaaatacttctcttaggtcttctgctcacatctttcaggcagagaacatctatttgatgccaaatgtgtggctagaactgggccaggtgctttacatgtcatagatcaataccaaacaactagtgaaatcagcacaaattcaaccaatgaagctcttaaaacaataaggtgaaaaaccacattgttgaggagagccatacaatacagtcaggttctagttcaaattacgtttctttccttgagatcttctggtccatgatatgttttgatctgtctaaaatattatgtaggcattctcaagtgattaagaaactccggattgtttcaaataatcaggtcttccccaggcaaacactggagatcacttgttttttgtttgtttgtttgtttctgagatggagtttttctgtgtcgcgcaggctggtatgcagtggcataatcttggctcactgcaacctctgccttccaggttcaagctcaagcgattctcctgcctcggcctcttgagtagctgggattacaggcacccattcttgagtagctgggattacaggcacccatcaccacacctggctaattttttgtatttttagtagagacagggtttcgctatgttggtcagactggtctcaaactcccaacttcaggtgatccacctgcctcagcctcccaaagtgctggaattacaggcatgagccaccacgcccggcccaatatcactttcaatgggtcccaacacattaaatgatgatttcttgacaaagttttacacactacttaaggatcaattgacatcaaccctaactcaaagccaggaagcttaatccaacatgaaaatattctgtggatgttgtacttaggcatattattctctgtagtatatactttcatattgatacacatatttaacatattgcaaagcatattttaaaagcattgatctatgttctactggtaattttcacaacgcttaatcacatggccatcatagtctttgcataagactaccttgttgttcaagaatggttttagcattccatccttctccatcatactggctcagaggtgagaactgaccttctcccagtagataaaagactctcataattgtattatgtacagcagcatcagcatcacctgggaacatgttagaagttcgaactatagacctccaacccaaacctctggaatcaaaactcaggagataggccttagcaatttgtgttttattatatcctccagctgtctggagaaccacataagttttgagaaagaaggcaatgcaccttatcattcttcaaggcaaagttcacttcacttagcttggtattcttcactgcacctagcaccctcaacataacaagcacttaatacatatttgtgacataaaatagattaaaatattctaaagacagaactcattttagagaacaatcctttccagccactatttggagattttgatactagagatgtatttggctgagaagtttcctttccttaacctattgctaggttctgtgaacttgccatgaattgaaaccaaggatggactacagtcagaatgaaggaagatgaggaagaaaaaagcaaagaagaaaacaaaaccactctattccttctgaatttggcacaaagatctcaggtgttccttatattcttaagacgtaaatcacaatgaattatgatcattgagcaaatattactgtgagcctaggtcaaaaagctaaggtcatagtgttctgacataaacaaaatcagctttatttcagaaagagcatagtgaaaggctaataaacattgctaagtaaagaaggggctgataacacagatacaacatggtaggtctatactttctagtgcttatccatttctctgccagcccctgcatttatggcacatcaatcaaaagtcttggttttggagccaggtgaactgggttataatctggctcaggtcttcactagttgtaggtctttggggaaattattcttctcctttctgactgtcttcatctataaaatggagtaataatggtaactaactcatagaattgatggaagatttatattaaataatgtgtgttgtaaatgctcaataaatggtagattgtttttctttgtctataggaggtgttgagggcttgtagtctacttgttcaagcaacaggacataaaacaaaagctcattaagtcagatgtggtatcccatcagcacttgcccagcactgagaatacagcaggtattccagaagtgtgagccaaatcacatgcattataccacagtacaaagaaaccttccccaagagtcatggttgagaattacacagcagagattttccacatcacagaacagagtagactggcttgacttcatgatatttggatacaaaactgagaaaattagatttccaaaatatattattacttgaatatgaaaatatcttttttttttttttttttttttgagatggagcctcgctctatcgccaagctggagtacagtggtgtgatcttggctcaatgcaacctccgcctcctgggttcaagcgattctcctgcctcagcctcccaagtagctgagattacaggtgtgtgccaccatgtccagctaatttttgtattttcagtagagacagggtttcaccatgttggccaggatggtctcaatctcttgacctcgtgatccacccgccttggccgcccaaagtgctgggattacaggcgtgagccactgtgcccggcctgaatatcaaaatatctttttcgaattctgtgacagcccatgaccccttcaccagagcaagccaaacaccacttgttttcgccaaagagacaggagcaaaaggttctggtatttatcatctgggctttatctttttctggatagattatgaaattccagtgtattccagacaggtccattttcatggaaccaaccactgtcttccctaaaagcataacagcatcacaggcaaaggtcccaagataatagaattttatatatcaggctggctttctaagagaagtcaataaaatccaacaatgatgggaaatgcaggatgtagcagagatccttaaaagcaattagcagagagcagggatgaaaagcaattatgcaaacactagaacactaggacattcaagactttttttttttttttctttttttttttttcattctgtaaggaaaggacagatccctgctttggaaaaagaatacaaatgtgcaggtttgaaagttccccattaggtgcatctaccatttctattatattcaaatactaagctttttaggacttatattaaactccataatcttaatatttatgaccacaacttaacaattaatcaaactattaaacactaaaagagtcaaaggctgagtatgggtggggcaagaaaatttttttttttgagatggagtctcactctgaaacaatcttgaaaagcctccagaaggtacaaatttgctggcactataaaagacaaaggcaacttaaggaggttcaaggaaaaaggaaaataatgctaagaaagagaaaacatgagagaaggcactggggccaataatgcacagagttcagatactaaatagtgaagtgatccattcagcctagaagaatgttatggtagaatggaaaaatgcaagtctttgactctgagagccctgggttttaattctgtctttctgtgaccttgggtaaggcatataacttcactgagattcactctgagcacccacaaaatgagggcaacaatagctatcctatgaaataggtaactaataaatagcagcaatatttaataggcatgcaaattcttttctcttcccttcaccaagtcataataaacctgttctttaattcaaaatcaatatggccaaagccaaattcacaacatcttctcacaagcttcccttctcaaacagcctgtcttatcaatcgagccaccatgtctccactgacccaggcttggaatgtctgactgatagctgcctcaacttcaccttcaaaacaaatgtctgctcaagttatatccctccaacacgattcattttgacctctttatccctgttttgtcaaccacaacccaaatctaagtctgaattattgaaaaagccttccgtccgacccatgtgattcctacttttctccccacaaattcatatacctcccactgcttagcttatctatttcgaatactggtgtaatacatcctggtgatggctccctgtttcctactactcagtgatatattcatccgttcatccaataaacagttactggatatccaccaaataccaagtactgggctatgtattggaggtgcaaaaatgagcaagtcatgcctttgaaagtccagtggggagaagtaaacagatagattataatacaatgctataaagaagagatgaaactagaaattcgctttataggttgaacgagacaaaatctcagatcagagatggtgctgtattggaacagcatctcaagagaggagaggtgtttgtcaggcaaaaaaatggaaaagggcactattctttttcaaaggcacgtacacaaaaaaatcctgtgttttataagtaaaagacacccccaccaactgtagaggaggttgaatggatttcttgcagcagtgagtgtgtaaatgagtgactagctaggatgcaagactcccctcctttgaccaagcaagtaaacaaaggatggattcttcatagaagatgcaatggcaacaggtgacaagtttctttgggcaactactgagtcagttatgtaggtaaaggggtagagattcaagaatcaaacaaacaaaagacaacaaaagcaatacaatatttcagacacagaaccccactggccagagagagagacagattttacccctcaatgacagtgaacacagaacttagaccatttgaaataaaagttcttaccatatctctcctgactcgtacaaacaccaaagggcaatagtaaaggaggataaatctttttgagggaagtgagctgtactatctcatatctcacgggaatccattcatgagaaagtcaaatccagaagtctgttccacttcagctctcatttacaaaaaaagttttctccttcctttcttaaatcaagtgacacaagtcaactcaagatgtgcagcatcacatcgtcactcaaccaaactgtgcacacatcttctgccatgggtgtcaccaatcttaaatctcagtgtttaatactgagatttaaaaaaaaataattttattgtgtgcatttgaagtttatagcatgatgttatagaatatatatagatagtgaaatggttactaagtgaaccaaattaacatatcatctcacatggttatttcttgtgtatgacaagagcagctaaagtctacttccttaaaaaaatccctaatacaatacaattttattaactccagtcctcacattatacattttagatctttaaacttagtaatcctatatatctgctggttgatattgagatacaatacttagaagctaaaagcttatcaaacatgaaggcttttctgttcggatttttttttggagagggttaacaaaatgtgttgttttaatttcattttcagaacaaattaatttatctcaccacactttttgtttctagcaagcatgacaccactaggtatgagctgtgtgcttattgtggataaggacagtgtgttagttacctctttatcccatcacagtgtctgccacttaagcattcagcaaattaaatcatcaacatgagaaacatgagatacatttttatcatgtacatgagatacatgtcctgtatttttatcacctacgtgaacagagctgaacacctcacctattcaatagtaactccaattttattaactttcccttgactcattttcttcatcaataaaacgtggatcagattgccttccttatagagttatagtgagggataaacagggtacagtatacaaaaagtcaaatgagtcttcaataaacggcagacaaatcccaaacaaaaagaggggcaaaaaggcccgtgtcagagaaatcagaagttaaatcaccataacaatgaccataagcagcagagaacttcagaaggtatccccagccttttggaaatgtcctttaatttcttcatgttgggtaaatctagcaattgaaaaggaaagacgctgttaagttcaaatgtggatgttcattataggagctgaatgagagacaggtaaaagtttccagggaagaaaaaggcagtatgcaacaaagagttgggtatcaaaaaataaaaataaaaagaggtgcagaaaacaagctccttttcttctctaaattcgtggtgctcctatccaggtcggcaaccccacatcagtccttaccattgctctacccagtttgtgtccccactgaatcactccccagctccaagtgacgtgtgtgtgtgcctatgaagttttaaggaaaaattacctataattttgcttgatctttgtgaatctctgtagcaacacggaaaactgcttaacttttcaaaacaaatctaatcaccttatcattcttttatttcaagtaatggctacaatgtattgagcacataactaagcactgtatgccagacactgtattaattgctttatatggatctcatttattcccacaactctgacttgtatactgccgctatccctgttttacaggtgagtaaacctggagatgtggagtggttacatcatttttccaaggttatacagctagaaaataagtggtagctagaacttgagcccactgaattttaatggtgtcactgtaaagcctctgcgctgtgtatctcctgtccccatcactccccactctgctccactgtgctctgtaccccaggagtctggcctccgtgaactccaacaagcttccctggcccccctggcccccctggcttcagtgagtttgtgtgatagactccaggcaggagatgagaaggagggaagaacagttcaggatatttattcctcttggtccttcctggaaggtcacctcagtctagcttcctcaaaggacggtcaccatcctctaaaggcaggctcttctccacacttctgtcctttgaggttcccacaactgctacctccccttgtccctaggtcaaggggtggtcacagctctgccgttactcatcccagtaactcatgcagtcactataacatcatctgtggtttccctgcacccagcccacaactttgtaaacagtcccattgtaaatatactctttaatatatgctgatttgaatgtaccatctggtccctcttggaactctgatacagcctttctaataatgcctttggtctaggaataacaaaataattgttctccagtcattccatgcttttctacacctctgtgtgtgtgtactccatgctgctttcaagtgaaatgctcttcaccactttttctgctggaaaattctaactcctcctttataacttatgaaggcagttattttattcaaacctcctttgaccccctccttgccatgggcaaaataatgggctttttctatcatactctgtaagcacctacaacttagacaatacattatactgtatacatgtgagactggcaaaatctcagcatgcaccactgtacctggtatgcagtaggtaaaacaaatgatcactgaaggcttgaatgaatatattgctgttacatatattctttattctgttctacccaggaaattaatgtcacaggcattccattgagcaacacagaaggctatatgtgtacatgctggttcattctatgtgccaatttgactgagctaagagatgcccagataactgataaacattatttctgtgtgtatcagtgagggtgtttccagaagagaatagcatttgaattggtgaactgagtacaacagatatcctttcctaatatggatgggcatcatttaatcaactgaagggctgaaagaacaaaaaggtagaggaagggaaaattcactctctctgcttgagctgaaacattcaccttctcctgcttttggacactggcactcctggttcttggaccttgggcctaattagattaaatcataccataggctttcttggttatccagctttcagagaatagatcatgagacttctcggcctccttaagtacatgaaacaatttcatatatatgtttgtatgtatgtatctatctgaatatatatatatatattctattggttctgttctctctcatatattattacatataaacagaacattatatatataatactaagacctatatatacagtatatattatatatgtatttaatactatattatatataatactaagaccactaaaattgggatctttctggaaaatcaaaattcaacataaatttattatttctttgtaaaaatgcatatggaggagagggaaggcaagttaaccagatatactttgaatgtaaggttacatgttccctttaatcacttgatttactgaaaaaatacatgcttaaacctttgaaaaaggaaagttgtttttcagtagttcattatatactcactgagttttaaattctatcacaattcacgttttaaaatagatcttaacaccacacatatttacattaaaatagtaactgagtcatacttacctaaatagcctaatgactcattaaaacaactttcttttctgttaagtcatatttcttccttcataattcagttctcataactcattagttatttccaaagaaggatgtatcacagtcatagaccacttctgttcttagaacttaggaagccatctctttcagatcaaaatatctaaaatttctatgaaaattttcaatgatttaacatcagtgttacgtcttaagatttattattaagacatggtttctcagaaagtcaactcctggtctagtgtttttaaatgatttgactctgaatgttcagtaactttagttagctctcaattgatttcattatggaacatttttcttcctctcatgaaaatacgtaacaacaaaatatacctgattaacaaacagcttgatccatgcagcatgtaacattcatagatgctaatgcctctttgaagcatacttagtatttagaaatcattttgccttcattgaatgaccaaacaactggtgttcaaaataaaatatatgcctgactataataatatggcaagtacatatttgtcagtaatgggtattgctttgcatgatttatttttgttttcagaaaatgagtcctcgagaaatcctacaaatcactttccttgcatagaactgaattttggtaaaaggaaaaaggcgctatgttcagtccctccgcctttttgagatggagtctcactctgtcacccaggctggagtgcagtggtgcaatctcagctcaatgcaacctctgcctcctgggttcaagcgattctcctgcctcagcctcatgagtagtagagatagggtttcaccatgttggccaggctgctctcaaactcctgacctcaagggatccgcctgccttggcctcccaaagtgctgggattataggcatgaggcacagtgcccagcctgctaaccccttttcacatgccatctcatttgacccttgctatgttttgaatatcccctccaaaattcatactgaaatttaattacaggaggtgggacctctaacagtgattaggttatggtgctctaccctcatgaatggattaatgctgttaccacttatcatgggagtatgttagtgatgttgggaatggctatgttataaaagcaagctttctctcacattctcttgcccttctgccgtccgctcccctgccatgagattaacctcaccagatgctgacatcatggtcttggactttgcagcttccagaatcatgagctgtataaatctcttttctttataaattacccagactgtggtattgttttacaacagcagaaaatggactaagacaatcctatagacagcaaccctaccaaagtcagaaaggctaagggactagctgaggctctgattcctaatcccatgtccttcccattaaatcattttgtcaacttatataggttgaggctatacctatgctaagtgaaaatatccatctgatagattcaacttgagattctactttgccccattatatttgttctctgaggagagtgaagaagaagaaaaggagaggtttttgtgttaggccattatcaatgagactcatcaatactcaactaatctataaaatgagctcaaccttcccctaagaatactaaatactcatagataatgggctggccctttgattttaattctcagaggatcagtgtttttaatgttttatcattagttcctttcaattaagtcaggtaataatgctgcctggacattcaaacccaaatgaatggcttcaattatcccagggtctatttctcaatcaggagccaaggccctgggaccaaatagctaacactcctcaaagtacctctagattattttctgaaaagaattcaaagattattacattttagtgaattttctagagaatgcactgtttttattaaacgggagtttttgctaattttgctcctttctaaagatgttggaaagtctaagaaaactcttactcaaaaacgaggaagtgggaaaatctcaaactaaaccctctcagattatgttcttactcaaaatacatttgatgtatttgaaacacttgatgcctttatgaacaaatttgccttgatttattatgcaaagtcataattagctattttaattcattaactgcttgtttttaaaaaatatccaatttttaaaaacaacaaagcaaaagttacatggtatgacctatagaggttttacagtggatgaattttaacaaatgtatacacacatacaaagctctaatcaagttatcgaatatttctaccactctaggaagttctccagtgctcacctgcagtcaagctccaccactttcatggaaactgctgttctgatttctatcaccaaaaataagttctgcctgttctttaaatcaatataaagtatgtacactttggtgttgaacttctttcaactatttagagaagtccaccatgcacttacaggtattagaaatttttcttcttataggtgaagtatcttttattccatgaaatgaaaatccaacattttatctatgcttttgatggactatcggattatttccagtttagaatctttacaagtaaagtgactatgaacatttgtgtagcaaaacttctgtggatacatactttccttttgtaggggtaaataccaggaaatggaactgtaaaatcataaaacatatctttttaaaaaaaaaaaaaaaaagaaactgaggaactgttttccaaagtgattgtaccatttcatactcccactagctatgtttatgcatttctgttattccatcatcttattcactggatgttttaattttagctcttcaagtggatctacagtggtatctcattcctgttttgaatgtgcactttcatgataaataatgatattgaacaccttttaatggacttattggcatttgaaaaaacatatatataaatatatttatttctttgggcactctgttgaaatatttcaccttttatgttgccttaaattgggttattatgaagcattttagaaatatatatacatatatacacacacatatgttctgcatacatgtcttttgtcagatatatatatttcaagtattttcctccagtctgtagcttgcctttttattttctcaactgggtcttttgataatcagaaggtttttattttaatgaagttcaatttattaacttattttttcttttatagctagtgctttttgtgtgctctttaagaaatctctgcctgagactgtaagatattttttctctaatttgttatagaacttctacagtttttgcatttatatttaagtgtgtaatacatctcaaaatagttctttttcttagtcttttttttcctgtttagataatttctattgatatggctcaaagttcactgaccttttagcatgcagagactagttggctgttaactccattcagtatatttcaatcatggcacttttcttttctctttgtttttttttcctgagaccgctcactctgtcacccaggctggagggcagtggcatgttcagaactcactgcagtgtcagcctcccaggctcaagcaatcctcccacctcagcctcctgagtagctcaaatcacaggtgtgcaccaacacgccttgctaatttttttattttttgtagagggggtctctcaccatgttgcccaggctggtcttgaattctaggatcaaacaatcctcccacctcagcctcacacagtgctggaattagaggcatgagccaccacacccagccatggcactttttgatcctagaatttctatttgatttttatagcagtttttaggtaagattcttcatctgttcttgaacagcatccatgttttcctttaagttctttaacaatattattatagctatggtaactctaatatcttggtcatcttccatctgtttccagtgactgcttgttttcttcattagttgtcttcttcacttgtataataattatgaatgatatatcccaaggtgtctggattatcttttcttcccttaacatattgagtatttttgtggcagttaaattattggcagattctcttgatcctttcacgcttgcttttatactctgttagagtgggcctatttggttttattcttcattttagattgtgattctcctaaggtaggtctccttctatagccccaactgagcttctaggctgttaagcaagaccttctacactggctgcgacaggactccaatatctctcagcattgtgtgaccttcagtgcctctgttaagcattcagttctgcagaaggcaccctctactgtgtcttacagagtcccactctgtgaatatacagcctagccactggccaatggcacacaaggaaccctcattaaaccaatacaaagacaagttcaacagtattttacagaaaatcttttaagccaaagagaaaaacagtcatgattaactatgttggcaataattttaaggtacataaaaaaagatatttgtaacatatctgtattatcctaatagacaaaagtatccgctataggagtacatgattcgctgcctatgtccgagagctttgaatctcaattcctcacacctggtgccattttactcataatatgtaaaaggaagagctgctagaaaaacttacgtcacctgtgttaagtttatagatatacacttgaattaacaatatttttggccaagattcataaatacactttatgttttatgaagcccaattcagttagaacttgaggtcaagcaaagaaatcaagtgtaagagctgacataaaaacaggtttccttttcaatacactttcagctatcttagaaattaactgttcggagtgtttttctattcatactccagaacctctcgcccaataaaattatctcctcccagggctttcactagtgtcaattcactaaagatgcccgtgtcaacatttcaaggtcgcgcctcctcaagagtttaaatattcatctagatatccaccttgaattcaaaaaccccacaacagaattccttctcttgttcccgcaaaaatctgtacctcttcctgaatctgcattctggctgcactatgtacctagtcaccgagaggtggacttatacccctcttctctttcaccctttcatctgtctgatgcatcactaagccccaagagcttcctcctttaattatatctgaagtttgtccctctgtttccatctctgctctaatgcaattttttaaaaatcactcactctattcccacagccttcaaactggtctcttccctcctatccattcacaacacagcttctaagtgctcttcttaaaatactcatttgataacatagtttcctgttttaaaatgtactaagtattcccacacatctctagaaaaaagttcacattgcttttgtgcctctcactgccttttaattcgcttctctaataatttacatcctagttgcccagctacaccaaaccagttgaaattgcttggacgtgtcatatggtttcagaacctaagccgtttgcacaaggcaaaccatccacatgctcatccttgggtctcagatcaaacatgaacacctgagacagaagactctggtttttctgaccgctgtgttgttccaatctgtttattttactggactctatttgaaatgatccatttgtcctctattagactgtaaattccctatgtggagggagcataacaaatatatctttattctcctgtgtctagcacaatgcttcaccatatttgcaataaatcagtgtaaatgtaattgggatatccaccaccttaaatattcatcttttttatgctacaaccattttaattattaaatattttcttctagcttttttttttaagagatggggtctgggctggagtgcagtggctattcacaggcgacatcataactcacggcaaacttgaactcctgggttcaagtgatcctcctgcctctgcctcccaagtagctgagaatacaagctcatgccactgaacctggctctcaagtagtcggtttttaactaaaaatatttacaggttactacaaggctcttctttttatttttcaatcttactggaatgaaaagcaataacttctaacattagagttatcattctgctctatgatgtaacttagaaaatataataaaactgcaaatctatttccaaagcacatttaaaaaatacccccagatagctgagcattcataaattgattttatggtcatttgcaaaggtagcaggacattggggaagtaaagagagagagcaatgattgattatttgagaagttaacctcattttagcagatttttgtggggttttttttttttttttagctcaaaatgtttatctaacagataaatcaaatggagctttctgtacatacctcattacaattctaatttattttcccaacagaatcttcacaattatgtaaaaattggcacggtcctgctagtgacacttcctattctttcataccataaagcctgagcttataaacaagctgcagagagaggcattttcattacatacatcactgcattgtggcggtatctccagaatggcttaaatgcatcatgtacttttacccaaatggtctctgaacaagagtgttggaagagatgtcagttcttgggccctgacaatgttgtttcctagcctaaaaagtctgagaaatgtggaatattcctacctccttctgtgagaagtcagaaaatgaagagacgtattcatctttaagccaaccttccaaatttacctgagcatagagcaccaccccttcaccaccaccctcttttctttcctttggaaattcttattaacattctataggacatcattggaaggttaatctgattgtggcacatccataatttggctatttagaacattatgtttaaaaacagagttaatgtcatgagtctgtctgcttatctctatctcattgtattttccgcttatcttcctggtttctttttcttcctgaatctccaacacatgcccacacttggattttaaattattggtccaagacaaaaagagtcatgagtacaagttcgggccgatctacttcaatgaacaaacaatcgaaagctctttacttcctgatggcaaaaatatataaaattagtgacatctacttcagtatgcattaacctctttttaaaaagctgcctcctttatcttccattctcaatttgctttaggatgtcttttatttcttccttatctatggctcctactttctcacagactttttttttaaaatgtatttggaggctgatatgatcagtgtacttcctctgaaattaaagtttcttttgatattgagttcagtatattcagagtggaaatcaaatgacttaggctggttacaaagatttaagttaatagagatgaatttaatccactggtggtgtgttcataatcaaatgaaggactcatttctgttctagagcctaccaaataaaaatgtcaaaataattggattaaaatcatatgaaatttatttatttattcaacaaatattaaatgtttttatgtgccagacaatattgggtgatggacatactgatgttaacactgagaccctaccttgccttcaacagcctctagtttagcagagaaggcacacattaattctgtatttgtgtgtgccatgatctgattgtaattgtgataaatgtcatgggagagatgatagggctgatacagcccagtccttgggtggggaggctgggtaaggatagggtcagagaaggatgacctgagaaagtgacgttgaagctaagatataaagaatttgaaaatggcttggtaaagttctagataaatgaaacagcatcaaatgcgaaggttgccacatttgagatgagagcaggtcagtgtggttgcagtacagagagcaaggcacgatagtgtgagactaggcagagaataagcagagccaccatcataggagctcagaggccatcttaggacatcagaactttctgttaaaaacaatgggaagccaagaaaggtttttaaagcaggaaatggacatgatcaggttgagtgtataagccgtctccctagctcagtggagaaagcagactcatcttggtggtagtagggagaccagcaattgtccccaaaatgtccagtcactactggcaaaagcacccctaaaaaacatacaattgaggaatgcaaggtgcaacttcattagaagcccctcggcttacaacgtctatctaaccagaatgccattcttaaatcgctcctattcctatttcaaacttctggttcaaacagctctagtagccatggaagaaaagattaaaggcagaaagactggtagcagaaaagccaataaggaggttttagcctaggcacttggttctggtggttcaggaagtagagaaaagtcaattaaaacaagctacacagaaggcggaatctctagtatgtggtgaatctggttattgcaattactacatgtatctttttaaaaaagtaatggttttggttcctcttgaaatttacatgacactggaatatcctcatttctctgaattatttttcttacatataacacatatatgacatttgaccttgtcagatgcttaaaacagaagaattaagccaagaaatatttctatcaatctcaagtcttttaggaacctaactaaaggagaattaatagtttaattataaacaattctttcctgatcattttaaaagacccactgagaatgtgtgccaggcaaaatagtctagttttagttactttttgcaacctaaagtaagaagtctctatttttttaaacaatatttgatgacttagggtgatccagaattaatttcctccgctgctaatgcaattctgtaagtttttactcaattctactctgcatcattaaacaggactaaaagctttacatttagggaagcatatcacttggaaaaaaaacacgttaatgtgaattataacaacaaactttggagactaaaggcatgactagtaggatcttccaccccagattttttatatgctaagaaaatgaagaaagaagcacacacacatactagattacctacaacacggcctcttaggcaaagcattgacatttatgtagaaggacttcaagcgtggagctagagaatatgcatattcaagtaataatttgattttaaaacctgtgcagcccgaagtcaagatcaaattgcatactcaatttttccaccaacatttagaatattttctcaacgttgagacgtgataatagttgtgtggctgtgtgttttttaaaaagtctattaagtagaagagactgctaatcactgaaccagcccttgcagttttctttgctgctctacagtcagttaacaggatattacaaaataaattaagaataagaaacaggccaagttaatgcacatgataaagagttgagtcagggaaggtttctgcaatatttggagcctgaaaggagagactctaagggtagcagtggtgtatgataatgagaagagggagagaaaaatggtaaaatactttatgctcttcaagaatcattccttttgctccttttgaaaaaaaaaaaacaaaaacaaaaaacaaaaaaaacactttcacggtagcaatttttaaatgcttttcaataattgtgagtgccagattcatgattctgtataggaacatcttaatgtaacatccttaagtagaaacccagtagaacttggttttgtatcattacatcaatattgaaagtatagcctgggtgtggtggctcacacctgtaatcctagcactttggaaggctgaggtgggaggatcacctgagttcaggagttcgagactaccctgggcaacaaggaaaaaccccatctctactttaaaaaaaaaaaaaaaaattagccagatgtggtggtgtacaccagtaaccccagctattcaggaggctgaggcacaagaatctcttgaacccaagaggcagaggttgcagtgagcagagatcacgccactgcactccagcctgggtgacacggtgagtgagactctgtctcaaaaaatatatattgaaagtataaatactactataccattttaaagtacacatacatagaggagtagcaataccattctgtgaagacaactggttagttgtagttactttcatattctggagctgtcttctgcctggactattctcccctcaatcacaaattttcactgggtcagtgcctgctcagatatcatatctaggcttaatcaactgttctgtagaaagaccttcccagatcctatagatgcaatgctgtcaaacagagctctctacaacgataaaaatgttccagatgtgtgttgcccaatatggtagtcatgagccacatgtgaccactgagcacctgaaatatggtagtgtgcctgaggaagtgaacatttaattttattcctttttaattaattcaaatttaaattaaatttaaatagctacacgtggttagtggtttccatgcagaagcagaagaagacagctcctgttcttctatttcattcatattctgtgtgtccccttgtaggacttggcatatttgcagttacatagtgtttaaaattatttgtttaatgtccatctttcccactaaattattgagattttaagtagagtaactaggtctgtcttgatcccacaaaagcccatgcttgacaccacaagcccccatgcttgacacatagtgtctattcaaagagctgctgacttaccatttaaataaagcttttaattatcttaaacatataatatcagatattaataagttggttaagtgaataccaaaggttcatgttagaagactggaatactgtttacaaggtgtgaactttctggaaaagtccagaaaatgccaccagaaattataaaaatcagtggtaaaatgtggttgccacagatttttcataaacacaaacatacatacacacacacattctcaaaacacagctgccttcagcaaaagagtcttctattttgctctaaaatctgttgtggttgtgaaaatgatgacacttctctgcaaaagaaaaatttcaatgcaaaacaaactcacaatttagctcaggatgtatgaaaaagttgacacaaagaagctgtcctttcctggtttaaatgacacattttatctttagattttggtagctaatttttaaaaaaatcctttaaaacgtattaccttttccagggacaaatgctctataatgttattctctgccatctttgaaaatgaaataaacatttattaaaataataccatacacgacatagatatttttaatacccccattggaaatggtggcatagagaagtggacagtgtgtataaagctacgaattccagagaacactggttataattcagtgggaaatacagttagtttgtcattgtttggctgatttgttcatccatccatttatctctctctccatatgtaatgtttatcctttcttactttactaaaataatatctttcatcatgaaactcacagtatgctaggaaagttgaaaaaatacacaggtgactgaaatataagcccctaaagaaagctgtgttcaggagaggcatagagttcatccttggaggagccatttatatgaaaacagttctgtttacatgcaacagagaaagccattaagcttttttttttttttttaatggagttttgctctgtcccaggccggagtgcagtggtgcgatctcggcgatgcctcagcctcctgaatagctgggactacaggcacgcaccaacacgcccagctaatttttgttttagtagagacggggtttcaccatattggccaggatggtctcaatctcttgaccttgtgatcctcccgcctcagcctcccaaagtgctgggattacaggcctgatccaccatgcccagccaagaattcttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccgcctcggcctcccaaagtgctgggattacaggcgtgagccaccgcgcccggcccagccaagaattcttaagaaaatatcctagtgagagcctttctttttaatcctgaaatgcatctgattgaggacacagggtttagggagggggcacaaaggaaaactgaacagtacatatgtgttgcataaattcatggactaatgattaggacaattaatgaatggtttaaatatgttagacgaaagctcattttgtaatgttctgaaacacatgaagcaatgtgagagactattattttgtttgtttgtttgtttgttttttgagacagagtctcaccctgtctcccaggctggagtgcagtggcgcgatcacggctcactgcgagctccacctcctgggttcacgccattttcccgcctcagcctcccgagtagctgggactacagacgcctgccactatgcccggctaattttttgtatttttagtagagacggggtttcaccattcacaggatgatctcgatctcctgacctcgtgatccgcccgcctcagcctcccgagactattcttaaaaacgcccatagtttccacacaaacaggctgattatgaagagtgacagaaaagccaacaattgtaacgtttgcctaaattttcttcaggtatgttcctggtttttcaggaggcactctgccttgcagatagagcttacaaaccaagaccatcagggtacatgtggcactttcatttttcttctcagagtagatctagagacatttaaattaatcatttggaggttgaaataccaattccttggtatttcaaagataatgtgccaagtcctattatcatttagcaataatttaaggaaaggaagtatctttcaaaagtacagaacaacctacacagatttaacatgtcaaactaatatgataaaattattttgctactatggtaatttcaagatgggtgtgacattttgcttttttgtcttctaaaaaatgaaaaatgtctttgaatcttgttagcaatgcctgaccttcagacacactggccatgccagggatgcagagttcacagtgattactcctacatgtacctgggcccaaaggccaagcctaggaggttcatttcattatcataaagtaaggtgaaaaaagatcaaacgtggattcaaaaaaaataaagcactaacaaggaggagaatatagcccgttgcaagcactacaatcaagtaggtggtacacatccccagtccttgaagaattgctcatgtgccctgtctaaaactggttttgtagactctgacttttgtctttggttgcacaatgatgaagaatcaattttatcccagaccagtgaaaatgagagcacattactactatgaggagaaccgctaaaggttaattgggttttagatacttagccctaattgttcaagattttatcataatatcaatttctgcattaatgcaaggcaccctgaggccatatgaaatagatttcattctaaatttaaatacatccttccatccaaaaagagaagcattcttcccagataattcccacaatcagaatccaacttcctagatgaaataggtcaaattaaccaaacctcccccaaaatattgctttcagtcagtgatgactgacataattatctagttaatcctaatacttagatacttaatgtagataatctgaaacattaattaaatatgaaaatacgttacatgatttttcctgggaactatattttagtaacactaacacttctgtttaagaagttagagatagttttctttccataactggaacattgagtactgttggttcaacaggaacaagtttggtatgccatttatttcggtattcagagcaggtcattaccaaaatgaaaattaccttaagtattgttaagccattagggcacagttttgtataatcagacaacatcttaatagatactcctatttattgtcacaataaaccatctgttaagttttagagatccatttttgaaaaaaggagatacctagttttcagaacacctggtataggaaactcttaatttacaaaataaatgaaattgagggagactgatgtgcgttgcaaaagaatacctaggttgaagaaaaaacaaaacacctacctaaatattctttgaccagtagtatctctagggcttctgtgtttcaatttacaattttgtttaacatataacctttaaggtattcaaaaacaacagcatcaataataatagctaaaatttagacaggaggttatgtgatccattcactattctagaaactttacatttattatctcacttaagcctcacagcaatcctaaaaggtaagtgctgatatagtttggatgtttgtccctttcaaatttcatattaaaatgtgatccccaaagttggaggtggggcctggtaggaggttttaggtcatgggggtagatctgtaatgaatagcttggagccctccccatggtaatgagtgggttctcactgttagttcacacaagaggctggctgtttaaagaagcttgtcccttgtcactctcactgcctcttgccatgggatctcccagctccccttttgccttctgccatgatactaagtttcctctggcctctgcagaagctgaacagatgttggtgccatgcttgtacaccctgcagaaccatgaaccaaacaaacctcttttcattataaattacctagtttcagatattcctttatagcaacataattggtctaacacagtcagtgtcgttattttcattttacagcgaggatactgagactcacagtaacttctgaaggttgtacaaccttatgggaaaaagagggtacagattttaaaagcaatggattaaaatgagtactgctgtgaatatctacatgtctccgtacacgtccaagtttagttgtctcactgcatgagtattttccatcttttcagacctatattaaaaatgcaagccaaatatcgattattatcattaccagtttctaacacccctgagcattttgacccggtaaggcaaagatgaatatttcttagaccattttatccatcataggttattctaccagtgaatagctgtctgatatcttggtctcaacatgactagaggctttacaagcatttataaatcccagtaatagtacatcttcttgagtggctgcctggttccactatgcgaacatcatggcaaccgcgtaacaaaaaagccacacagagtgttcctagtacttactgatatgaccaagaccttgtagcctttgaaactccatgatttttaacataaccaaaaagttcatgaataagagcttggtgcttcatgtcacatataaatgattttatattacccatatattgtattcccgcgattagccccaaagatgcctccccaatttagcagaagtatattgcttaggagggaacatacaaacaaaacaggctgggcacggtggctcacacctgtaatcccagcactttgggaggctgaggtgggcagatcacctgaggtcaggagtttgagaccagcctcgccagcatgttgaaaccctatctctactaaaaatacaaaagttagctgggcatggtggtgggcacctgtaatcccagctacatggggggctaaggcaggagaattgcttgaacctgggaagtggagattgcaatgagccgagaccgtgccattgcactccagcctgggcaacaagagcaaaactccatctcaaaaaaaaaaagaaaagaaaagaaaagaaaagatcattagacataaaacaacaaaaaaaagcacatataaagctgttctattgctcagataatatttcaaagaacaggaaagagaacatatttaaaagtatatatctgcattgactgccaatctctctttcgatagtagagatgactatgtttgatattaagcttctgtaaatcaggctttcctactttaactttctagtatcaactggtatatacaatcattactctttctttccttttttgttttttttctcctatcctctacatggatagactagaggcttaatagtgtgatgataatggctctgtaactctgtaactctgggtatggcgtgttcagaacacccacagtaaacaatcccaaatccaaacatgtgtctcagaaaatgtgtctcaaaggcctagtgctgtgctgtccaatatggtaggtggtaactacaagtaggtatttacattaaaattaaataaattaaaaattccattccttagccacatttcaagtgttcagtagccacatatggcttaatagctactatactagcacaaatatggttccattggacagtggctagcctagagtaacattttctaacttaccaccttgaccagggtttaaatcaagaccagccaatggattgtgcctcacatgtacacctacttaattttaattggcatcctggagtagaaaaaaagtacagtgtttggaatagacatctcttgcggacatagaattgcggagtggtgcccacatacaccaaacatggctcataagaacttgcattagcagcagtataaaactacaaaatactaaaaatgcaacaagagtgccacatctcataaattacacgtgtctttccacgtgccatttcaaaataagccatgagcgaagtgtttttcttcaggcatacagagttaaataaagtcctgaatacgatccgtaatcacaatctgggtctaatctgagacaattcatcttcttattcattaaaccagaaaacttgtatgaattggtaatacaagtaacaccgataatttttttaaatgtccattttacctacatgtgaacctgatactctgaaaatcactgttgattcttgtcaagtaaacaactatgccactgataaagctccattcttgagtccatattattccctgatagaacccaataatctaatcagaggtttttttacccccacttaggaattgttttttggatactgtgactccaatagggctttcattaactaaaaagaactgtatacaacatatcaaatgcagcatctggtctagtctgaatttctaaatgacaagcacagcatgcatttggaattacatagagaacgagaaatcagacctctatcattagcaatctttttccccaaacactgcttccacttcatgcttcaacacctttaccttccacagacctcttggtaatgtcacgactagcttgtcaaatcaaattcagcagcacacaagcatctgtattaatacttttgcattttcattcactaggaaaaaacaaactctacttagtaggcagattagccattatctactgtaactctaaaccatctgagttacattactaaaatgaattggcattgaaaacagagcgacagaaatgtttaccgatagaaaaatatgtagggaatgggagtttcttttgcgcttacttgccagtgacttcctaaagctgtaatgaggtcaaaataagctggtttatttcatctgtgaccactgggtgagatctcattttataatggccttaataatttgccacttatgattacgataataacaatattttttaaaatcactggaaactttaattaggtatttccaaatcgctaggggttattaaccaagggtcaattttgctcccccaacccccacccagaaatatttggcaatgtctactgatatttttggttctcataattggaggtgagagtgctactggcatctagtgggtacagaacagggattctgctaaatatacttcaatgcactggaaaacttcctgcaacaaagaattatcccacccaaaatgtcaacaacgccaaggtgaaaaaaccatgccctaaagctacatatgatcactatcatttaaatgattattccaggacttctatggacatgagctactgaaaaaaaaaaatcattttgtctttcacagatgtcaagcttaaccaagtccatgtgaccatttagagagttaggaggtacatctactataaaaatagcatttttcaacagaggctattttgttatttgtttcatccttattcatcctgtctctctaaacaacagcaaaatttttaacccatcatcaacctttaaatactgttgggtcaagttctcactgtcaaaaaagacatattaattgcaaaaaagcaaaaacatgaccatctttacagtgctaaatcacttctggaaaatgtttatgtcaaaaatcagcttaaatttttggagataggacaggcgcaggtggcccatgcctgtaatcccagcactttgggaggccgaggtgggtggatcacgaggtcaggagatcaagaccatcttggccatcatggtgaaaccccgtcgctactaaaatacaaaaaattagacgagtgtggtgctgcgtgcctataatcccagctacttgggaggctgaggcaggggaatcacttgaacccgggaggcaaaggttgtggtgagctgagatcacaccactgcactccagcctggtgacagaccaagactccgtcttaaaaaaaaaaaaaaaaattggagataatttttaatagagactattactaatctaataataacttccataatatcttaagtttcacaacagagatgatgatataaagtagaattaagtggcagcctaattattaatgatgttctttgcctttgagataatccagttatacactttaaaggtttggtatctttagccccatgcgaggagagagtcgtatgtttttctttctctcacacacactccaggaaaggaaaagcaagcacagtagttaacccctgatagtttattagtcattcttgctttgtcgctttattaccacgaaactggtcagtcatggacataaacaaaacgtgcaaggataaggcaggctttcactcacataaaaactgccaagggccaaccccattgtgaatcactacagaaaatcattacaaaatcttaaaacaacaacaacaacaacaaaaacccagcactttgaatcatagtatctcttcaacagatacactacaaaactttatcagaaacactatgtgagagatgaacagagctaggaggtattttcacattagtaaaaaaaaaaaaaaaaaaatctcagaaatcatttatataaaaacctattgtgagaagtctaaatttacgttcaatgccttccctttctttcgctctatacagttttaaaatatgttcattttgttctaactgcacagtaataggcatggccttctaagcagaaaaaatatattatggcaaggaaaaatgaagagatacgttgctaacacaacagacttttgttaaacaattaagaggaaaaaaatgcatacaatatagcatttgctatataaccataacctctcccattcctggtgtcccactctgaattctacttgattcaacaacttaagatgcaatggaaataataatgtctattccagcagattaaaaaatacaaggcagcagtaaatgttatgaccaccagctaatgggctatggtggagaagcatccactgtggattaagctctcaagtactcaataacttttaaaaatgccttaaatcacccacaaaatgcagtatacatggctttgtgtatacaactgttaagtgtacaaatatacatcaggtgcaggaaatcaaaagcagcctttgtgaaaacttagttttatagtacttattactacaaactagacataaaggtgctgaataaaataattaagaaaaaggaaatagcaactttgaacaatcttataaatcattttatataagttagttatccttagagtatgtatactataattctgagttaaatatttatataatacaatttttgtaactgaaacaggatctcactttgtcatccagtctagagtgcagttgcacgatcatggcctactgcagccttgatctcccaggctcaaaggatcctcctgcctcatctacctgagtagctgggaataaaggcatgcaccgccatacccagtgaatttttttttctggtagagatggtgtcttactacattgcctagactggtcttgaactcctgaactcaatggatcctcctgcctcagcctccccaaatgctggaatgacatatgtgagccactgtgcctggtccatataagattttagagtattactctaagagattaaccctaccctggggaatcgatgtcaaaagttgggaatatctttcctaggtgaaataatagaaataacgaactctttagagctgactatgtagcaggtgcttctgagtgccatacccagggtaactgatccatgggttacattagaggaaattgaagcataaggcaagtaagtaacttggccagagctgcagagcaaccatgtggcagaaccaagatttcaagatttgagccccggcagtgtggttccatagacgctactcactggtctcttctgcctctggaagactctctccttccctgccttcttgtcacccctcctcccacccactgactaccactgtacagcgagggtcttaagccagagatcctatgagccgcaaccaccatctgtgagctgcacattttttgaggaattacctttccggcagcacatttgagggattcaaggacttagaacaacatgaaacaattcaacaataatgacaaggcaatgactatcgaagtgcagcttcacctcacaatatctataaaaacatccatggttattgcaccatccacttgttcctcttcctgtactcttgtcattgtttcaatagaaaccgctgactaccctgactgctctcatatatacccagaggacaaggtttgagcatcttctggtaaacagcaatctttcttcatgctggcatgacctcacactccacttcttgcctcttctctaaacaatttcttctgttgtatacactactataatcatagcacacatgggtcaaaatcactagtctaatctcagtactctacctgcaaaagagcagtacctaacaaagaaaccaacctacactctcatttgtgaagggcctactgtgtgtgcgttccagacgatatgtggtaggtgctgaccactttacatgcatcaactgacctttaaacagaactatgtccactatagcgtaaacacaatgagggctcagagtggacaagcaactggtggtccacaattccatagcctgttagggttaaagctgggattctaatctggtctgctcttgaaagtccccacttggtaatatttctctttctctgcctttgcctaaggaaattctatttattcttttttttttttggagtgcaacagcgctatctcagctcactgcaacctctacttcccaggttcaagcgattctcctgcctcagcctcctgagtagctgggattacaggtgcctgccaccacacctagctaatttttttgtatttttagttagagacagggtttcacaatgtcagctaggctggtctggaactcccgacctcaagtgatccacccaccttggcctcccaaagtgctgggattacaggtgtgagccaccgtgcccagccaacttattctttaatgtctcccacactaatctgcattctccctgcaggcagggaccatgctttgttcacctctgtttctattatacttcctaaggaatggacacttaaaacttcccgaactgatcaaaataaatgtgagaggacagtgcctagcatctaacaggctccttggtggttgcggtctaagtggacatgtacaggtgggattactcgaattctaagaatggctggatttaacacaagtcaaaagcatttggaaacaataatcatcatcctgaattcccaattctctcccccctcacctttctgcctctgctctaccccttcttctccaaccctatgtctcagtctgtctgtttctccactctcttgacttctctctctgtccctctcacaccattattgtcaccacaggcctttgaagcgactataccctcaaacacaccatacttatcttccacaatcacatctgaaatattttggctatagtttgcttatggtttgtttggccttgctgagtctcatgttgaaatctgatccctaatgttggagttaaggctcgatgacaggtgtttgggtcccaggggcggatcccacagagatggtttggtgctattctcaaaggagtgagccctccctcttagttccttcagaactggtggttaaaaggagcctgacacctcccacccttctctgtcttgccatgtgatctgcacataccagttctccttcccctcctgccatgagcagaagcttcctgaggccctaccagaagcagatattgttgctatgcttcttgtacagcttgcagaacaatgagccgaataaacccctttcttataaattacctagtctcaggtattcttttacagcacacaaatggactaagacaatttctaaccacatctgagataaaattaaccccctaaataagcacacaaatggtattgatatgatgaataactcacctcaaatgtacttcagatagccttctgcacaaggcacgtctcttgagttaacaaaccctagccaggcatggtggctcatgcccataatcccagcactttgggaagctgaggcaggcagactgcttgagtccaggagtacgagacctgtctgggcaacatggaaaaaccccatctctacagaaaaaatacaacaattagcagggcctggtggtcacatgcctgtagacccagctactcaggagactgaggtgacaggatcataagcccaggaggtggaggttgcaatgagcagcgatcatgccactacactccagcctgggtgatagagacccaatctccaaacaaaacgaaaccaccacacaagacctaaacctgatatccagatctgagaagacagaaaatattttcaaatctctcacatatatatgcattcatacattgctacttactttcctctttgtgtgttactgatgtcttcaagtaatcacacagctctctgcacatgccagctcttgtgttccaagtttccatgcagcatctcatggaattgcctcaacaactccagggctagggactactgtcatctgtatctaacagacaaggaggctgtggtacagagggctcgtaaagttagcacagtggagaaggcaggttgctactcagacatccattcctagagcccacattcttagaacacacagcctgtctgtccctccagcaccaccctgcctacttttagtcatcctggtgtcgtctggctgtaagttcctgagaattaccctagttgctaatgtactggaatggcatcttccttattaaaggcactcaatttagcaatgcatttgcattccctgattggttttccatataagtggttcacaaaatatggtccctctgcaccacttgggagtgtcttagaaatgtgtattctcaggctttatcccagacttgttatgttagaaactctggagcaagggcctacctgcctgtgatttcataagccctccaggtaattctgatgcatgctgaagtgtgaggcttactaccctgcatgatatttatggcaagttttaggtaacggtgcctttgaacactaactttcagaaatagaagatagaaaatgtgcagtaaggcatcttgcttcagtaacacccaagggcacattctgtctacagttcctcactctgtcatctgtcctcacacgtaggctttctgcttatacactccaaattacaactacctaacagcttctaaaatgagtgtctggcttggaagatttttaaatgctatcagagaatgtctgtttcaggatttaacttgtccagtgcaaagaagtgaggctgggccacaagtgacccatcacttcacctgtaagagcaaattaattacccctcaacataagtgttatatttatgtgccaagtatggtcgataatgaggtctttaccgtgtagccatatttcaagccattgttcacttaagtaaacacattttaatcactgtcattttattatttattcttgagtctactatacacctgtcagaacattttgtgtttgactaactgtcatctccttgtatctttcctgcatcatatataaaccactgtccacctccacatttttccctcttactgaagtcaagcactacacaagttcatggggacttagaggcaagtgtgacggctgaccaccccaatagtttgcaaagcctttcatctgctcctctgaaaacgcttttcacacattccttccatatatctctctgctgcaatctctctgttgcaaaactgttgttgatgaagtgacatttatctaagcattgtcactttgaataataccaaagaaagaaaatgaaaatcaatgtaattgcaagctatcaacctcaaattttattcacttgttttaaatttgtcaaatgaaaataatttgtttatctgagtaacaatatatgggtatcagtatatggataacaatttttaaagcttgatttcaaatttggatttttaatattaaaaagatgaaaaatttttagtccaattttccctagagaactctaacaatagtcatgtactgtataacatttcaataatgacagattacatagatgacagtggtcccttaagattgtaatggagctaaaaaaaaaaaaaaaaaaaaaaaaaaaaaaaacccgtaccctctagtatttattacaaggtacttttaacgattattttagagtctacttcttctatttataaaagagaaataaaaatgtaaaacggcctcaggcaagtccttcaggagttgctccagaagaaggcgttgttatcacagaagatgacagttccatgcctgttactgtccctaaagaccttccagtgggacaagatgtggaggtggaagacagtgatattgatgatcctgacctggcgcacgcctaggctaatgtgtgtgtttgtgtcttagtctataacaaaaaactttaaaaagaaaaaaaacaaaatctaatatttaaaaataaaaaaatacactaaagatataaagatagaaaatatttgtacatagctgtacaatgtgttttaagctaaatgttattacaagagtgtcagaaagctaaaaaaaaaatttaagtttataaagtaaaaaagctacaataagctgggcacagtggctcatgcctgtaatcccagcaatttgggaggctgaatcgggaggatcacttgaggccaggagtttgagaccagcctggccaacatggtgaaaccttgtgtgtatgtgtgtactacaaatataaaaattagccaggtgtggtgggacatgcctgtggtcccagcttctcatgaggctgaaggacgagaattgcttgaacccaggaggaagaggttgcagtgagctgagatcacaccactgcactccagcctgggcgacagagtgagaccgtctgacaaaacaaaacaaaaaacaaacaaacaaacaaacaaaaacaaaaaagaacaagctataataagctgagattattgaagaaagaaaaatatgtttaaaatttatttttgtttatttattttcttttttagagacaaggtcttgccctgcaagcccaggctggtcttaagctcccagcctcaagcaatcctccttcttcatcaatgtttttaaacaaatttagcatagcctaagtgtatcatgtttataaagtctacagaggcatacagtaatatcttagcccttcacatgcactcatcacttatgtactgactcatcctgagcaacttccagtctaagctccatccatggtaagtgccctgtacaggtctaccattttttacttcttatactgtattttaactgtaccttttctacgtttagatacacaaatacttaccattgtgttacagctgcatataatattcagtacaataacatgctgtgcaggtatgtatagcctacatgtgcagtaggttacacccatctagatttgtgtaagtaactatgatgttcatacaatgatgaaatcacctaaggacacacttagcacaatatatccccttcatcaagcgatggatgactgtattcataaaaatctggatattgaggggctgcctgataatgcattattatatgtattaaaatgtgtcttgagccaaatgctaattaactcttggctggtgcctttccttaatgtttctttcttctttttttctttttttaattctgattactctttgggacaaaaaggtggtgctgaaacaagatatcatttatgatcaactcaatacagagattacttaatatttatcacattatgcagaggcttcaataagttcatcaaaatatatgttccaaaatcctatgcatagatttcaaacttttcttccatcaaaataaattcatactaacttgttgtaacatgtctgagtaggatctagtttgaggcactaagaagattaagacatcagtttgaaaagatcccgtatcagagcaacatgaataacatgaattctgctaatgttgaggcaagaacatgcatcaaatttatggcgaagcttggatggaagaatggtaaagtcgctgatgctttacaagaagcttatgggggcaatgcccaaaataaaccagcaatttacaaatggataattcattataagaataaatgacaccatgtcgaatatgaagcctacagtggcagaccatcaacatcaatttccaaggaaaaaattcaccttgttcatgctttaactgaagaggaagaaggactgatgattaacagcagaaacaggcaacatcgtagacatctcaactggttcatcttgcaccattctgactgaaaaactaaagctgaacatactttccactcagtgggtgccaaaactgttgcacacagatcagctgcagacaagagctttctactgaaattttaaccaagtgagattaatgtcctgaagcattcctcagaagaattataacaggagatggaacctggttttacccgcatgatcctgaagataaagcataattatagcagtggctaccaagaggtggaaatgggtggggcccagtaaaaccaaaggtggactggtcacaagtaaaagtcatggaaacagttttttggtatgctcaagacattttgcttgttgactttctggagggccaaagaatgataacatcttattatgagagtctttcgggaaaggtggctgaagctttagcggagaaacagctagggaagcttcatcagaaagcacctctccaccatgacaatgctcctgttcattcttctcattaaatgaggacaattttgtgagagttttgatggaaaatcattagatatccactttacagtcccgatttggccccttctgacttttttcatttcctaattttaaaaagtctgtaaagggcactcatttttcttcagttaataatgtaatcaagattgcattgacccccaattctttagggatggactaaatggctggtattattgcttacaaaagcatcttaaacttcatggagtttatgttgaggaaataaagattttttttgagaaaaaatttatctttcaattctattttccacaaactttttgaagtcctcttgtactatcctcaaactttgtgcactaattgaaaaaatatatatatttttgtaaaattatttataatgttacatatataatatataattttacatataacttatgtatataattatatataaatttgcatgtaatttttacatatatacacttctacaaaggaaataagtgaggaccaattttttctaagtggcttaggaaaagctgaccaaataaaagatccttcctcacacactgtggagtccttccattgaagaatgtggacaacacactccatagcagaagtcaaaactggtggctgctctccatcatattttatttcttcctacgttttttttatttaaataaattgtcaactttaaaaattcaagatcttacatctaaatatctggatttccattacctcatggaaaaaatgaggcctctggcaaccatgaactcttatccccacatggcaacgattgcatggtactaaataataatgccacctatgccaggcttggattctcttcactccagtaagttctctgtctggctcctgtgggcctctgcatttgccaccctgctctgcgttcagtaataactgcaagagagttcttttgttcccagcttggattgatccaggaagatgtctaaagaaagctggaccaagagcaaactctggagaatggacgggaaagaaaatgagtaggaggggaaaagaagagtctctcaggataggcttatggtgtaagcaaagcctcaggggtgagggtcagggtatgggggaaggatgtgtaagatagagtaaaacactgaatgtactggtttgactgggtcagaggtgtaggaatgggaatagcaggtgaaaaacttcagaaaattcattgaagagagactgaggagagccttgagggctaatccaaggagtttctgagacattctctaaattacagttcttaactttctattgagaaacagatcaacccactctctatgcaatttcaggtaagctaaatgcccacttaaagcttaggcagcatgccctgcctctccttactttccattctttaaatcaaaaaacagtacctacaaatgttatgttaatctgggagcaacatgcccaaaatcaaaaggactgaacatgcccaaaatcaagaggactgaaagcaggaagaatgctttggcacagaaggggaaaggatgaagcggcagtggagagccatggttaaggacacaggtacctgcctgggttcacatcctgaactgagtatatgcaccatggtcttctgaaggttacttattatctctgagcctcagttttttcatctccaatggaggaaatactagtacctacattaaaggtctgctgtgagaattaagtgagttgatacatattatatatgtttagaatagttcctggcacaaagtaaggtctccacgaacattaactgtgctgctgtcagcatcactaccactgttaccactatcatcatcacttaaaaaactgcattaagtccagaaggatagtggctgagagttcatctgcagccgtggccataaaaatagaagtaaatacatgacaaagaagttgtgaaggaagactatataggacttggtaactgcagaaatgtggggaaaagagctatacagaagtatttaaagatcactgcatgaatctgaagctagatgatacaataaaataacatggacaaaggtcaaaaagaatgtggcttttggagaagtcacatttaagatgaaagcagaggactgcagtgggactattcagaagtagttgaaacggcagaaatagaattgagtagaaaggtcaggctagatgcagatttgacagctggtggtgctttgtgaagctgataatttctgcaaggcaaggggatgaggaacacagataagccatatcatcatgatcattgtttttagataccactgcctggacactttctatgttctaggagctgtcctgagcattttatatggactgtctcattaagccatgattatctccccattttatagatgcagacactgaggattagaaagtttaaaatccttgttcaaaggcacccagcttttaggcggtatgaattaaaaagtggaatccatagccttcactcttaatcatttactatattcctttccacagtaaaagaaaagtgagatgtaaggaaagggaataatctaagaagtcgagagacaaaagcgaatgagtcatgcctctgaggaagaaggtaacgagtttatgagctagatagagagtcttccaaaggctaatttgtgcttcatgaatagagaaaggtttttaaaaggaagaaagaaaggggcctaaaagggaaggagttacatttgatcagtcaaatactagacaagaaagtaattcccaagatcaaattccaatttcagtttgaatgcaggacaagtggcagggtttcatttgcttggcatcaccaaagaaatggataccagaattctgatttgacattcatttacaatagaattttgcaattatcaattgccatttttccagcttggacagggttattaactttttcttggaaggtgattagtgcttagattccatccttaaaaagacacagactacagaggtacctgtccggtggtggtaaataatgtcaactccacaacaatggctacaaacaccacatcacagatcaccacaccaacagctaacacaccaagccttctacctaccaggcaccacactagctggggctgataccgcacttgctacccagaactacccccatgtgacaggtattgtcactcgccagttcagtctacctctggtgcctactgtctggccctcttgttgatatttgggtaagtctcctagaatttgaaacttccatttactccctcaaaaaataaagaacggattatgttttgatagctactgcagctttatatagttgatgcacactctgtgtatgttctccgtcactcacatatagggatctagagaaaacagctatataacgttaggggaaggagtaaatccccttgttttctgataagtttatgagcgagtgacaaaaaggaaaatctttcttgtgcttcagaatgagacagcgatgaaaaacaaaaccacttctgtgcagggtgaaacaaacattattgccaaggccatttttgattgggaaatgaacagaagattaaatcatagtggctaagtgaaagaaaccagacacaaaaagttaatatattgtacgattccatttatatgaaatacctaaaatagataaacccatggagatagaacacagattaatgcttatcatgggctggagtggatgggagaatgaggagaaactgcttaataggtaagaggttttactttgggaatgttttggaactatataaaggtggtagctgcacaacattatcagtgtactaaatctaacagaattgttcacttaaaatgattaattttctattatgtgaattacatctcaataacttatttcaaaatgaaaaaatagaaagtttaaattcaaggatacatataaagaatttttttttgctttttccccagaacatttaaagaatcactataaaaaggaaactttatcctcctcatatctaagtttaatttgggaggatgtgggaaggggctttattattactgttacttctttgcttttcattgtccacaaaatcacatataggaatgcaccaggcaatcaagcattttctctacctgggctgtagccactgatgtaaactacatagaaaatgtattatacagataagcaaattcttcactgtgaaggtagtattctctctactcaaaagttttcaaagaataaactgcaactgtagaaaagaagggtaacttttaaattaatttagaagcagagctcagcttgccctttgcattagctcaggttctttgaccaaaagacacaaagtcagcattagacacctaggagattactgggggaggaaagcagggtaggaaggaagaacttccagaccatgatgctaatgcttgtgaagcagaggaagagataggaggtttgggaagaaggagtcttaggctccagggtacttccaagagaggtctggcaggccaactaggagtccttgagcccatgttccagtgagaaagtctcacatgtaaaaggaaggagtctatgctaacagctcattcactgactataggaagtttggacttgccatgagacagcagtggatcaaggatagcagtagctgagttcttcagccagttatgctcccacaacaagagacctcagtggcccatttttatggtgccacatcagcctactgatagcgacaggaggcggccaaatgcctaggcatataaaggcaggtccccagtgcaaccccacttccaagctgaaaacagtttaaagcctgaaaaccaagctacaggttaaatgcttggactggattgagaacttgtcttcctgtttggcacactttcctctgattgatcctcacctttcacctattttacatatacctaccctttcctaattagttgtctacactgccacgcccacctttgagtagcgtctttgctttaaccttttttgcatactcacagaccaatcagcacacactccctttactgagcccataaaagccacagcctcagccatattagagaattttcccactttcgggtaggggaaccgctccccacatcccctctttgctgagagctttcttttcacttaatgaattctactctactaactctccagtgtccacgagcctaattcctcctggttgtgagacaagaactcggacctagctgaactaaggagcaaaaaaccctgcatcactatttttcaaagtctctactatagatctggcagtacattaactctctttctcctgtagctatgaggaatgggaagctgtggttatcggaaacctgaaaataatacctacttttattttaagcaagagtttctgcaacttctctcctgaaaatctttgaggtataatgctagaaagggagaggaaataaaagactcataaaggacaatgccagtgtccatgctctaagaaaaatttcagccagcaagaaactaactagatgagaaagtaataatcgtgtgtgtaacccaaaaagggcaaatctgatcctgcctatcaagtgtgacagtttattaacattgattggaaatttaacaaatacacagggtcagtcacataggtattaatgccacacccaccctccacaatcagttataagcctgttctgttaaagcagtatgaatactttataatctgtattcatcagttttgcagaattgtaatgtttgtctgaaatctagggtgatacttagtaaattacacacttaatatgttagaaaatattaatgttaccatattacccaataatccaaattttgtggaaggaataaggtacctggaaggaatctatttgatttcataggagttaagaaaataatatatataccacataggtggaaaaaaaatctatgttttgggaaaaactgacaaactctggatgtgttacaagaaaatgttttaaaaataataaaaaaaatttatgtatgcatatacacatgtaatcttaaaaataaggaataaaaggtggaaagtctatacataagaatgaaattttattatatattgaaaagcaagtactgtgattaatagacttttttgaaagatgctaacataacctatttttgggccagataatcagtctcttttagaataaaatgtgctttctatcagctttttggtcactgtaacaataatttgctggccaagaactaaataagtggcttaaagtacatctgaaggtatttataacctataaaaagtttcctcttatcatcatatctgctttattaacttcaagggtttttctgcagaagttctctcattttctttttgcactgggattttgtccttcatagttctaaaagaaatatcccattttctccctttcttaaccctcaggatagaagaagtagtatcttctcacagtgtgtgaagactcattctcccaaaagatgagcacaaaggaatagatgctgagaatatcaatgcctgtgacatttgctgtctcccataatgactgccatgggaggacttgggaagcggactgcaatctgatctcaagtcttctgactcacactctattttggactgcttttgtcttggatctggagtatagaaacacctatttcgtggtcggtaggcagtttaacaatcacatacacaatgaagcaatcagaaaggtgagcaggtgaatattctctttcagaggataaattactttttctaggaaaatgattattggctgacaatgaggtggtaatttacttccctctagactataataaacaaaaatacaaagtaggacaccattttcaacagctgtgtgggtgattataatcaccttttagccttgaaactagtccctatctcattagctatgatacataattttttaaaaaatcatgccttcaaaaagaaaaggttttctgtggctgagttaggctagctgtccatagtgccacctattaccaaactttacagaggatgagatttcttttaagtaaaccctgcttctgaattcagagtatcctcttgctcccagcctccaggaactagtctgaggcagtcagttctattacaggaagaggacacaagaggtgcattatgtaagttagcaatgactaagccgggtgctctatggggatggcagtactctggatagtgaaataagtgctcttttaggtaggattgctttagttggtctttgagttacttaagagccaagcctagagcagaagaggttgcaacagaatgtgacatgagttggaatctgtagaacaggaattcaggagttgtccctagatactatagcagggtaagaaatggaagcggagagcacatcatggagacatggagaacagaggaggtgaaagaagccctgtaatgtgaagcacgggatggaggaccctggcagcagcctggggcctgcagaggaaaaagctccaagaggagctccatataagagggtggccaagttcgtggcatcagactttccactggaaatggattcctgctttgtcctataattaccctcttatctctatacctccaggaaaagaatgttctaacaatgttggtgttagaaacaccaaccttgggttagtagagcactggggcttgtagggatatgtaagaaacatctgctggtcaccaaggggaagagctgagcagaggtgctggcatgcacacagaagcaggaatccagagcaagagatggcagaagagcacaacagaaactcacacgtgtctgaaagtgctggggtagacagttggtctccccatggtaagcaggatcacaccatttgcacttagatcattagagaagctgaaaagactgaggaacttagggagtacgaaatctctctaagtgaaatctcagtgcgaaatctcagtgagaggattttgttagtctaaattcaaagtctctaaaaaacaaaattgaattagctgccaacatttaaaagtgagatcattttatttttcttaatccaaattctttggttaaaaaaaaaaattagacaacctgaaaatgttaggcttaaattccttagtgctgcatagaaattggtgcctttacagagaacagttcaaaacagacctaccacctagatcaatttaatcattgatacggctggcctgcccctggagacacccaattctgcagcccctggtagcacctgatttaaaggatctatccatgactaaagacattatctatgcatttgtaaaggttatttttgctttgcttgtagtgattgctcagaagatttttagtgaattccttagttatgtactttgaagtgaaatccaagtttcacctccatatacatgtgatctccaaagtggtttcatgctcatgaaagacagctgtgctggttattcctcattttccaccagatgcattctctttccttcctgatctgcatcctgggaagttatttcctgtgtacctgccagactcactgatcctctgacttactgttaggttcggccagtgagaattatctgcaacagaatggaggccaggagagaagagaagatgggtattgactcactgtcatggttctataaccctccacccccacaactcccattgtgaccccttggataaggtcagctcttatgtggctctgataacacatgatcccttctaggtttagaggtgatgccagcttccctccactgttagtccccggtgcttccccaccccatgtagtttccttaaccctatctataccttataagtaatcccattactaaaatacctcccattaaatctgattatacaatctgtttcctcctggacccctgactataagtcaaatttgaacattccaaattctggtacaaaagcagttggacagaaaagataaaaggaaatagagtaaatttcaaatgagtcttgaaaacaatttggacaagcataatcttgcagattggtccttacaagccctacttgccttaatcagatacctcaacagttgagtgttctgggtcatttcttctctgaagcctttcatttcatgcgtaattagaaacatgccagtctgtaatgatggcagcctttaaaatggtcagtctgtcacttccatggccctaactccagacacaaaatgcatgcttgattactaagagtcttattaaggggctattgtttcccccatccctgccagctcctcctacctcctgatctttatcatcttgcattctacttaaagaaggatttaaagagaaaaaaagaaaatctcatagacactcacatcagattgtattaataagcaaggtaaactacatctgggcttgtcactcacagtttttcttttcctctctaaatctaagaataacatgcagtcagttgcaaaacagggagcaagttttccaaagagcacgtgggtgggagaagccaaccatgaagtaaattccaacatcaacagtctggttggattccactgtggcccccactaattttcccaactttttgggccatgaaatttattattatcaactccaggtatagttataatccttggtaaaactcctctcagacctggcagatagtgtcctttaaagagtacactaattctaaaaactgcttatttctatattgactgagataggaaaaaatagccttcattttcacaagtgattcactctaatcatttaatacctattactgcaacaacatgcaccagatttctgacagacacctgtttgcaaattatctaagtttcagagcagaaagcctggtttagaaatacaataccatctgtaataaagtagcactagcactcatctggactattttggactaaaaatagtccaaaaatgaaacacaatagaattttagtttcttgaggattgggaatatcagtcactgtatagtcattgcttcaagaacagtacccagtacatagtagatgctcaatccacatttactgaaataaaaagaatgccttaatagcccactgtcttggcagactttacctactctcattccagcacttggaacaattacctactttcaaggaccacctttgtacagtcatgctcatgcccagaacaaaattcttatttcacagagataccaatagtgcaaaacaaaggttttgactggttctctgctttagcatatgaataatacactctagtctacagagaagataatggaagccaatagtccaagcgttcaagtggtacttacttcatttaaaagtaaaagcccgggatagacaaagacagaaaaagcagcattgaaataacctgtgtgagaaagcagaattttaacaacagagctgggcaaaggaaaaagcaattagtaggtttgtcttcatgcagcttcaagagtactggttgttaaaattatcttaggagctggtggtgcttggatttcctttcaacagaccctgaactatgcagtgcttaacctccttttctgagaactatccagggacaccaaataggaatggatgtgcacatcgctgctgtcagggctcagaaagataatacccaaaatgaaggcctcagaaacaaaagactcttggaccttctccagccctcctctctctagcctctaattttctccccataggccagccacaaaacctaaaaatattattctaatccctaccaccttcctgcataataactggccatgaagaaactatctgacctaccttgcttaattataggtcattagacccccattccagaaagcgtcctgccccatacccagaagcaaggaatgctgctgagaggcaaagatgaatgcagacacaccttgctgggttttctcagtctaccaggattagatcacattttttgtccaatcatatttctatatggctctctgtactttgttgagcccaagtacaaaattggacaatttcccctgtatctttgggtcatcattctgaaggctcccatgtcatgtaaaattatgatcaaataaatttgtatgccttttcttctattcatctgcctcttgtcagtgttttcagcaatccttcatagagtgaagggatcgtgtattaggattctctaaaaggacagaactttgcaaacccccagcttttctgcgtggcagataggaaattgaaagtacatctgcttggttgctgtccacaaccaatcagactgattgtgggccaagtctgcctttgcacagaagtgcaactttgtaaattcactttagcttctgattggttgctttccacaaccaatgagaatactttcgttttcaaaaaatccctactttttttgcgtcattctttccttgctttgtgtgttttgtctaattctttgttcaaaatgccaagaacctggacacactccaccagtaacaagaacaatggagaaggttcaaaatgtcagattttaaacaaaaatttcgaggctatttattacctagaaaaacaaacaaaaatgtgcagtttaaacaaacccaaaaagagacagagaatctattatttcaggtcactgagtatgtactactcagttgtctcgggatgtgacagtagctaagaccctctttctgacctagagaaaaatccttcattcttcaaaataaggtttgaagtcacttcctctaggtaggcttccataaacctagtcagatgctcattcacaggacttttacagatagctctttgatcctctctccaccatagaacttgtattacactgctcttacatttgattctaatgagactataggcttcaaaagaactaggaccacacctgtcttttgaattcccagccctgcaacagggcttggtttataggaacactgaaagaatagcctttggatttgttgaatgtaagtttttaaagtcagggaccaggctttacacagcccataatacaagctcagtattggagatgtttccagtattatgggtcctaactcaccaagacagaaggaaagacctcacttttccaagttcccattcagcaagggcaaggaaggagtaggaagcaatacaggaattcagtttctgaacgatcattaaaagaaggatgtccaggttgcagcagcagcagaaatcctataatatatttttgtttttcttctcaaatgagctagaaaattggttctcaaactggtgattttgtcctccactcccatcccactgatggccacaggaggcagccaaatgcctaggaagatgggataggggtaggtaccaggtggaaccccacttccaagccaaagacagtttaaagcctgaaagcctagctacaagttaaatcctcggactggactgagaatttgtcttcccatttggcacactttcctctgactgaacccacccttcacctatttaacatatagctaccctttcctaattggttttctaaattgtcatgcccacctttgagtggtgtcttcactttaaccttttttgcttactcacacaccactcagcatgcactccccattctgagtccataaaaggtcccagacccagatacatgggggactttcccgccttctggtagggggaccacccgcatgacccctctccactgaaagctgtttcaatgctcaatgaaattcttctctgacctcctcacccttcaatgttcagtgcatcctcattcttcttgggaataggacaagaacttgggaaccagtgtgcaagccagacttggcccaggtgggctgactgggcagggcgccccctgtggcaggtagagtgccccaagagaagcctcctacatcgctagccagaggtccccaactggcaaagagaccaagaaaaatcctgcataccaccaaacatctagcaaagttgggagacattttgggctatcacaactaggagggtgctacaggcatctactgagtagagggcagggattgtgctaagcattctgcaatgtacacagcagcccccaacgacatcaactgtgctatgcttgagaaaccctcagctagacaactctttgttgtctgcagctaaaaatgaccaatctcctttctaagctccaattttcccattggaatcatggcaacaataatcaaccacttcttatatgttaagtggtgaggcttaagataacaaatgtaaaattcatagagtatagcctggcacataactgctcaattattattagatatttgtagtaatcattattataataaaagccgcatgtctgcacataatatggaggtatcaggtactatgctaaacatcttttaaaaagctgatattatatatgctccaccactcaaaacatgcttggtaaaagaataaatgttgacatatgcttgcttattaaatgattatgtgcataaggcaaatataaaggacataaaagtgtttatcagggcacaatactaaaaacaataaattaaattccttttattccattaagaatgcttttctctaagaagttcctgatcctgagaaccaggcaatcttacatgcaaactcaaagctgttttatccctctcttcagacaaaatacaatcaaacaaggcgtggctgaaacctattactgctagcctggcagaccactggagccaatgctgccactaattctgtcctgctatatgcaggaaagcgaaagagacacacggcacttcagagaaatcaatttcctttattagcttcctttctttatcgtttgctttcactgtatgttttgtggatcaagttaatcattttcatgtaaagatcaatcttaatatggactttcatttgaaagttgttgtcagattttgtggagaagccaaattctagagaaggatggtggggggtggtgtggggtggggtggggtatacacctgacttttgttgtttccagcagcccaaccattccatgaatttttggtaatagtatcccaaaaccttcttccctaatgttggcaactgtttagttcagatgtgtcgtagccaaaattgggcacatttcccaattcaggccaattagatatttctccctaaattctgaatcttgactaaaataaacagaagactgaaaagaactgaaaattatttctttaaatcgtggtgtccttataagactgttcagtagcacttgctatgcataaaccccaatctactctgctttctgtcaattctcaagtctcattctcctatatcctttagtctatatagtgaactactcaaagcctgccaataatttttttttttttttttttttttttttgcttaagctaaatagaatctacttttgtttgcttataatcaaggcaatgctaactgttactggtaaaaacactgtaacacactactgacaatcatggatctggagccaggatatgatatttctgtttctcttttatttagtcatttatttaatccaccttgtgcttcggttgctaagtctgtgaaggaaaaaatgtcggaaaagcctaccaattacagatgcctagtaggtccagagggttgctattacagtttcttattcatcaattcaccccaaaagataagtaattgaatcttttttaatcccctgagatttatctagctcacccacttgttaaggaggatgcatgtaacttctgagttaagaaatataggcaagtttagataatattcaatgggaataggatatgcaaatgtacatactatattttttaaattttatttatttttatttattgttgcccaagctggagtgcagtggcatgatctcagctcactgcaacccccgcctccacagttcaagcgatcctcctatctcggcctcccaaatagctgggattacaagtgtgtgccaccaggcctggctaaattttttgtatttttagtcgagacagggtttcaccatgttgaccaggctggcctcaaattcctgacctcaaatgatctgcccaccttgggctcccaaagtgttgggattacaaatgtgagccactgcacctgacccaaatgtacatatttatgtgtaaataaacacacataaatttttcaaataggagcccctacatttctcttccctttgatgaactgttgaaccctaataaaatgaagagtatcacacaaccattactggaacctgttaaagccactaacagagaaagtcatatttcaagtatcagttgcatactaaacgaaggctctaccaatgacagcacatgcctcattttaaagctatctgagaaaattttcctcaagtcttttcaaccagcactcaccatgtaacttttgaaaacataggtcagtttatatgtgtgtaacacacaggcacattaattctataaacattcttttcaaggaagctgcctggacaagtgctaggttgtaacggcccactggactaaccaccctgcacgtgctgcccagtttcaacacacttcctcagccgagacttgagatgcaaattgagggtaaactcagcttccaggcatagacttgaacatttaatgccaacaaagtcccattgtcagacccctcctgcaactcctaatccacatatgtctatccggcatccactaggacaactacctgcgtccacaacattaacatgatgtggacaccccagaagtccactaaaacccagtggggcaaggaatgactgtactagaaatgtgtgaaaacaatgagatttgagggtctttactgatcaatgatagaggatgaggaaaaagaagaaaggaaaaagatcagtgaatgtctcaagaagacaaaaataaaggagattaggagagacaatcagggagagaaaagaaatgttgacggttaagaggagaaataattgacaacagaaaatgaaggtcagtcatctgggccaagtgtatcatttacttatcaacttggtatttcctaagatctaatgtgataggagatactacagaaattagaatgaaatatgactttaatattgattaagttctatcctggcacttgccctcaaaggaaagatcaattaccataatcagggaatagacttttttaaaaacaaaaaacaaaagccataattccagtggctttcctgagagaatttatgagtattgccatagattaaagaatggatatcctccagcagatgacagcaaaaaattctgtagcacagagtttagggactcgagtctggagtcagactcgggggctcaaacgccaactttgcagcttaagagttgggtgactcctgcaagttccttactatttatttgatcctcagtctccttctcagcaaaacaggagagtacagatttcattggattcttgtaaatactgaatatgatagtgtatgttacaaaagtaaatcataagcccaaagttcttttacttggccttgattaaaattataattaaagcattggctattaggttcagagcatttaggggtaaacttctaagcaaagaaactgttaacccaagcactactgaaaacataaatcctggagtaatcataaccctttgtttagagagaagaaagaaaaggtctaaagactatttaaagtaaagtgaaatttgagaccaatctgtggagttcgtgttcttgtaaagctgaatataggcatcatttggtttaccagagctggcaatgatctatcgcacaaattgaaagatttactttaactgtgaatctgtaaccttggactctggatatttatagctgtaatgagaaattacatttgttagaatgtttgtattaacttttttccccacaggaacttggtttgccaactaaccttgtaataaccatagactaagatgtcagtgatctagttacagtttactcaagccatttgaaaagctgaacattttcttgctgaaagtaatacatctaaagtcatacttccctgagagaataagtcattttggagttaatcaagaaagggacagattatcatcaaaatacaatgcaaaaatctcaatttttcacaacaatgcaattcattcagcaaatctcaatactcccatgctacacgaaccttctttagattttctcctgggtgtatctttgaaggagcatgaggaatatttgctatggctcaaaaaccagatatgcattccatctgtttaaaagcttatagggtattatagatgaagcaagcttctaaattcaaccttaaataatgggaaaatcgaacaaaaacaacaccctaacagatttattttaataattctggcaagaagtacaaatctaaggaaacagaagcaaaatacaggataattcagaatactaagaacctgctattgtttaactgaaagcataggtaaaagttacaaaaagtgatgccacgttttgatgctgcttactggctgcatctagagagaggcaaggaggtatcaggcatttctgccaaagctaggtgaggtattaaccactgagaagataataggaatagatgagcaagttatccagatggtacaagatggcaggtaatgtatggataattgcaagcctctccggagttaagggtactaaagaaaagaaagtctatgtctaaagaggagaaaagaagacagacaagctggttacattggagatttttatttataagactgacacaggttaatttcattcccatcaagcaattattaataaattctcacaaggttttatcgtggataaaagaattgtaatacgtgattttaaatattttaattgccaaaaataaatttccaaagtattcacagcatttttttactttgaaaagtaattagcataagcaaataacacctcctgggtgactacttaacatatatactggctactattcatgaaattgtatttaaaatgcagagtcaaatttccatatgtaagataaacagtatattcttcatttcatttttaaaaatataagagattaattagctaaataatttccctggaaaactattaagtaggacagaggattcaagaccctaaaattaatttttcaaatgttaagaggtttatacatccaagctcacttccattctcatattgcttatttaatgacttcctgcaaacacagacaccacagcccaagatctttctctttcctatatggagtaataagacagagaacttaaagttttggtctttgcaaaatatgtgtactttcttcttgaccattaattcttgagccctgaggcagatagaaaaattggagtagtgtgccaaatgtcaatgtaaaggagacaaatttgacaggagatggagaagcattaaccccttatacctatatatctaaaatggtatgttatatatgttaaatacacataaaggatttctgtctgcaccatcatagaacgatctaagattcaagcacccaaaattacatgatactgatgccagtattctttacatattagaaaaatcttgaactagttcttaaatctgatgacttgggtctccccagtctgttcaataagacattttgactcctattaagaagaaacactcttcttatttcaacttggaaattaacaaagaaaacagcattcattgtagggaaaaatggcacattattttttataacctcctcttacttgagtagaaaaataatccacttaatgtgtctagaagggcagtaaccctacattaggggagaacagactcccagggaaaaagccatttacaaaacattgaggaactgccaaacgttgtagggttcatacagccacagctaattactatgtatattgtatttctggacctactggcaatatattggctgatctttctggattgtgtcttctcagctgaacgttgtttatttcccacatcatgcaaatgacagggaggatgttggtctattttgtgattggcagggtaaaaacttaaaattgtgttttagattaggtcacaaaaaagtgtgccagatggttgttaacaaaaaagaaaatgctttcaacaaacctcacatgttgtataatcttggacaaaatacaaaagatgtaaatgtcctgccacaaatatattggagctggatccacctgacaatgctgaaatatctagtagaaacaattcccaaagaggtatgaatctgacttttctctctagaaaaactgctggatgacttcttagaaaagttaagtcagaacccatgtttttttaaaaaatcatttttcagtggtacctttgtatttattgtctactctagtattttctcttgcctggggtggggggaaacattttttcacctgtattatcttcagagaagataatacacctgcagtgttttagcttggaaagttttaaaaagtaaacaggacatggtggcacatacctgtagtctcaactacttaggaagctgaagcatgaggatggcttgagcctaggagtttcagtctagcgtgggcaacatagtgagactcccatctctaaaggtaagtagatacataggtaaataaaacaaaggcagtatattttcatttccttaataaaaatcttgaggaaggtgggggaaaaggcatgtactagcttgcgttcctcatagtccattagcagataattttctcaatagtgtatgaggacaaaaataaataaataagaccagtttcacatttaggtccctagagattcacaatcatcatctcccttctgtctgccaggatttaaattttatttttaatgtggcctctcttacgcatttccctctctctgcagatttcctagtctctcccaagataactggaattgtactcagtattagtcaagtgagagtgccatttattgaccaccgaagaaaagccaggtactctgcagatctcacttcattcctcatagccataccaggaggtagcccatttgcagatgggcaaactgtaactcaaggtttctcacctaggaagggactgagcagagtctcaaactgatatggtttggctctgtgtccccacctaaatctcattttgaattgtaatttccccatgtggagggagagacctgtaatccccatgtgtcaaaggagggaagtaattggattatgggggtgggtttcccccatgctgctcttgtgatcataagtaagttatcaggagatctggtggttttataagtggtagtttttcctgtttgcacatgctttctctcacctgccaccatgtaagatgtgcctgcttccccttccaccatgattgtaagttccctgaggcctccccagccatgcagaactgtgagtcaattaagccctttttctttacagattacacagtctcgggcagttcttcatagcagtgtgaaaatggactaacacacaaacctagatctaactctcagacatgttgttgatgttgacagaaggtaaaagagtccataccaaatgaacattcttttagctacatacagcaattaattttcaccagcccttgagaaaagatttgaagcactagtcagaaggaaaatttattaaatagaagggaaagacatcaaagagttaataaattcagaaactgtacaactgagccaggtgttgaacagaggactagacatggagttagggtgagtaagagggagagagagagggagagaaacactaagaaaagaaaggcagagaaccatgcaacgacttccctgattttaacaatgaaagtagctcagaacataggagttacttggccaatagagttaaaggtcttacttaagaagtaccatgcaaattccatttctggttgccagaccctgatataccacatgttcatttctcaataagtgcatgttaggtaaattgaccactgtctcttctgaaatggaaatgtctatagtggtaaaggcattgccattggatttgaaagctgcaaagcaagttgactgcagggaactctgtgtgtgtgtgtgtgtgtgtgtatgtgtatgtggcttgtaaattattcttttaaactgcttacaaattagctgtgaaactggtagtatgtagttgtccatgtcaataacaaaaaagcaaacacacaaaaaatgcagatcagaagaaacataacctcagtcacttcatattaacagaccattcactcatccatttgtttaaatatttatttaataactaccacatgctacgcactgtgctacatgttaggggatatattggtgaataaaatagttatggttttagcaattacaaagcttacaatctagtcagaaaaacagacaaaattcaagtacaacagaaataactatgtaactacaaattgtgatagaatatgaaggaaataaatgaggcacaatgataaagactggaatgataggcgggtggatgacagagaaatgcatttacatacagtggttaggaaacgcctttatgaatccaaattctaggatctagatggagctctaacttaaacatatattggaatcacatggagggcttgttaaactagattgctgagccccacccaccaaagtgtctgattcagtagttctggagtcaggcagataacttgcatttctagtaagttcccaggtgatgctgatgtcaccgaactaggaagcacactttgcagaattaccggactagagcatagtgcaggagacagaaaggggcctgagctgaggttggaagagtaggcagggaagctctagataccctgacacatgctcagtgacaatatcagtgccaaattcagaacctgtctaggacttggagtgagtctaatgatcaagacaactatgaccactactgttatctttgccaaaggaaggacctctattactccctcttctaagctaagaacctgaaagcaaatttatcaaggaatacaaagaaccaactctaaaatcaaacaatattttttacaaagcattgctatattaacacagtatctaccatccaaagaacctgatgttatcagagcatatttaatagagaagataaaagagatcaaaaggtggcatctgccttcaaacatagagcgttctgaggattacggcaaggaaggcatttctgttaatagtagaagatgtgagcatgcaattattgtaagaatgatctaaattataagtaaagaagatacccttgacctcatctggtttgaaacatttaactggcttccaaaggaagataatctttattagtatttgaaaagttagatagaaagctaccagaattttgatagtttcgtagctctcaactttagtcttcccccaaatcatttgggagcttgttaatggtgtagattaccagagccatcctcagagtttctgatggaatcagatgaagtgaggcccgggaatgtgcactttaataggcatcctcaggcattctgatgctggtagattaaggaccacagtttgagaaatacctagttaaggcatggtaccctgtaaatggcaaaacccagatggataatctcttatggattttgatagagataattgaagttttactatgtgccaggtactgctgggcacttcttaaaagtactccctttagtttttaacaatttaaaaaaataatactcaagtgatgagaaaatgggattcagcaaagcaacttgtctgtagttgatcatgtaccaaataatttatagagccagaatgtaaactgagggtttctgactccaataatacatttatttcaatgatactgagctcatgattgctaacctttgtgaagctacgacaatcattaaacgatttcctggcaaccacagcttctcctaaaagcattatgtgatttggccttttaaaataaagagaaacagagtgtaatcatatcttgagactctgaaaaatccttagatgtctaaaaatattcacaggtgctggacaaccaagtatatgaatcaataagagaatccctaacttaaagtcttgtccactgatattacactggacatatctatccaacatcaagctcagagacagaatgtttagcagtgaagggtagaaactgaagacaaacgcctgagttaaaaaaaaaaaaaaaagtctctatcatggattagctatgtgaaagtgggtaaatgatttgatttctctgagcctcactttcctcatctataaaataataataattactttgggatttttatataagatattattatataatactattatatattattattacatacaatataattatatataacatattaattccattaattataattatagtgtaaaatatattatatataatagcttacatatttttgaatcatttggcatagtacctaccacacagttgttcaatacatgttatcttaattcttattaaattattacttttaagaggcatgtgatgcagttaataaaatagtggaaaaaacataaaggcccaataaacataacaagatggccaatctaatcagaattttgaaaaggcaaataattaaataaataaatcagcaaaatatcacaaaattccccataagatcataaaaaagtcaatattcataggataaaaatattggtgaagaagaggagaaataggtattctctctcataaaccataaattgatacaaccaataaaagggcatttgacagtttgttaaaaaaattgttttaaatgctgtgatacagaaatcctattttttcctattgattctacactcagtagaacagatttcggtaaccttttcctgtaaagggacaaagagtaaatattttagagtttgtgaaactttttacagtctgtcatgataactcaagtctaccacaattgtgtgaaagcagtcccagacaatgcatacatgaattagcttggctgtgttttaataaaattttatttatggacactgaaagttgaattttatctaattttctggtgtcaaatattcatatcgtgattttttttcaaccacttaaaaatgtaaaaacatttcttagcttgcaggctgtaacaaaacagcagcaggcatgatttggcttagcagctagctgtagttattaactgctaccttagagtgatacctactcatgtgcacaaggaggcatggacaaagacatttactgtagcgttaaaaatctgagaacaggccgggtgcggcagctgatgcctgtaatcccagcactttgggaggccgaggcgggaggatcacgaggtcaggagagcgagaccatcctggctaacatggtaaaaccccgtctctactaaaaaaatacaaaaaaattagccgggcgtggtggcaggcgcctgtagtcccagctactcgggaggctgaggcaggagaatggcatgaacctgggaggcggagcttgcagtgagccgagatcgcaccactgcactccagcctggtcgacagagggagactccatctcagaaagaaaaaaaaaaaaaaaaatttgagaacaactattagatcatcaatagagaaatggctaaaaaagtgtggctacatccataatctggaatattatgttattctatgctaatactatgttagcaaaaagaataatttatcacatacaattgtaagagatactcaagaaacttcatggtgaaaaagcaagttgcaactgttcagtaaaaatgcaagctatgctcggacttagaggttttagtacttgcaccattatggcagtgaaaaaattcgttagagaatgaggtcggtcacttttggttcatcattctgtgatcacagaacacagtgggtccatttgctgagacggagccatttgctgttcataaatgtttggatttgtctttcaacaactagctgacaaaggcataggcttaaatgagaaaagaggcaaagaaaatataatagaaaaactcaaagaacacataattaaaagcacttgggggactcctgaacagattcctactgtgtttttatactgaatgtcatcattctcaatgatcaggaggcagatgacagcatcaagacaatatggtgtcaagtcacatttcagaatgttcccggggctctgatcagcattagcctgactaaccagatcagagaagaaagtggtcacagcaaataccctgtctcagttcattactcaacacctgttaactgtgattaacggccctggctaattatgtgttaagagcatctcaggctgtaatggatcccagaggtctgcaaacttgacttcatttacatgtttgtctcctttcagaaggtctcagccaaacatggccgaaatctcccgagcattttatgaactcccatgtcatcaactcagagtttcaaatacaccagggtcttcctagaaaggacaacgaatgtctgagatgtacatttgtttcacagataaagcaggcaaggtttagattttatggcacataaatgggcctcttgttgcaattaatattataaaaggctgctaatctgtgtgcattaaactaattgttacattttgtgatctcggctaaaagactaaactgtatttagatggcagaatgcactaaaacctcgctttatgtctcaaactaaaactgcaaaagtcagaaatcaaaaaggcttcagagaagctttttgtctactcatttttagttttaaaaatatgtattaacattaattttacataattatgtcatgctatattcatacattaaatattaatacatatacaaacctatatatatgtatctgaatgtgtgtatatatatatatatatatatatatatatatatatatatatatatatatacgtgtatacacacacaccacagacgattagacagcccttaccaaggtatttttcttgcttttcttaaatggtattgaacctaactcttcctacagttaactgaaagtcaactaattaacatccctcccaacttttttttttttttttttttttagtagaggagcagagctggcagcagacattaaatccttcttcattcttatttgcttagtctagcaaagtaatgagaaaaaagtaaatccactaacaattgtgtgtgatggaatattatgcaacatctagtattcatgctactgcactccagcatggggaacaaagtgagactgtcaaaaaaaaatatattgaatgtctacatgtactgatatggaaagacatctatgacatatgaagtggaaaaaatcaagctgctgaacattagatagcatattatgatgcaaataaatgtgctataatagcccaactccacatatgtgcatctttagattcctgtatacacaagaaaggatctgaaaacatatagaattacaaggtcttacaagcaatctggttctgccttttttagcccgaatgggaagtacctatcccaaatgaccttcatcatcttcacaactagaaagagattttcatggtcccttctacccagtaacagcagagcacagtggtttggaacatgtgccgtgcagtcaggcaagtgtgcctcaaatcatatctaccacttactggccaagtcatcttagacaagttactacattttccagtacttctgctgttttctcatttgcacaacagtgcccgtctcataaagtttcgtgagggttgtgatttaatagccgtatagcacatgccttagcaagtgtcgtcaacactcacctctctatcattcttagctagtactttcttcatcttgcctcagttattatttgaaatgtgcttgtttccttagtcattacattttctaatttgccaaatgttaaacaagggcaagagttggcactttctgtgtctctctgcttcctcccaccaccactgtaagccccaaataaaataattgttttttacatttctgaaagcttttcactctgttacaaatcaaggggctccaacatgcccttgtttctaacaattctcaatgcagtttaatgctaggggtgaggtgggctcattgacttttgctcttggctgacatttccattagcacatgtgtggtgtgtattttcctccagtattctttttgctaagagttccgtctttctctaatttcttacttttaattgtcttttcttattgatctataagttgctgtcactttgatgaaacctaagggcttcaagcacatctctgctatttactagctggaatctttaaaaaggtatcaattaggttcagtttcttaatgggtaaaatgggcataatatcatctatactttttcttcgttttgaaataaatttggcttttaccacttagagaattcatgtcaattttagaaaaacaaagaccaaaaaatgaaataaacaaagataaaaccattcataatcccactacagatgtcaaaagtctattctacatccttctagtccttataaatgtacataactaaaggttctgggtcaaggggtctagacaattctgaatcttgctttatttcttattctctcttcccagaccactcaaaatgttaagtctgatgtgttttaattgaatacctttcattgtgcgtaaatatacacctaaaatcacaaatataaaggcttttttactgaaggccatcatgctttgcatatttcctgtaacttgctttgctaactttacaatatatcatgtgcaatcatccatagcagatatacattctaattcttaatgacctaataatcatccatagcatgtataacacagttcattcaactagtctcaagtgatcaaaattctttgttttcatttttttgccactgtgaacaatgctgcaataaataattttgtatatatatttttatctatacagaataattcacaaagagattactgtgttaaaggctatgtgtattttttttatttaaaatgatacagccaaactgctaagcaatatatatagctcctagcatttctccacattctaacagcattggatgtcatatattattaagttgtgcctacatcccaggggaaaaaaatctatcttattttacttagcaattctctgagattaacttttcctttttactggctatttctctctggcaaactgctcattcataatcattgcccagttttcatgtggttcactttcaaaaaacttgcatggagtgtcttggtatttaaatggtttaagtattggtttgtcatgtgtgttataaatgctgcttcacctagctcagtgtttgcatttgcttactgtccaacacacataatgaaagtctgtttaggaaaatacatgctttcatacatctttgtttctggcttgccttccatctctccaccccacatcgtattaccatcatttctcttcctggcctctcttgctttcaaattctaactttctcgtctttatctcctcctcaccagttatcacaattacctctgtaaagaactaagatttctcccactactttttttttttttttttctaaagagagaataaagctttggccgaagacagttttgatgagatggctagaaaaactgcttttcttcattggcattttggaaatattgctcagtggtttgggacccatttatttctactgcctctatccatctttgctttatggcttgacttctgctgctttaactccacattctgttttgctccacttcaactgtttagctgccaggtttggtctggtttcactgatttactgtatctaatctcattccctccctggattctgaaccccatcctagaaaaggcacttccagctcacagactcgcatgtttatcgattgaaatttagttcaatcgataaacattttagcatacttgggttcaattccaatagcacagatgttttcagatcatttcagatggtgagacccagaaattttaattatttttccaaacactgctaaaaactgacattaaatttcatccatgaactgaaaacatttttactaggagaaaatcatgatgctgatatatgcaattatgctataaagtattattttattttgttaggtattccatttaatactatagaagtattatgatatttattacataaagcattattataataaaatctcagtaccacccagaaaaattaaaggtttgaccttaactttctccaatttttccctattaatatcaatttgcttttcttgttaagaaaatattaaggtggaaaacttgaaacaggacattctgttctattatttttatgttgagaattgggaaaatacagcttttgttgtatagaatgtggtatgtatgtgatgagtatggaaaatgcatacttccaacggaagcagagagacttgttcaggggccattgcaaaactccactggcaaggcgctatcagcctgcagcaaggttgtagaggcaaaggtaaaagattagagattgatttttagagggtgagctaaaaggacatattggagagctcttaggcagtgtgagggcatattctgacatcttaaatgcctctgcattttaaaatttctgaccagctgtcaattttgtccatcaaaatctcagcctggttatccttgcttataagcagcagattttttgagtgcccccatatgactccaggtttcaaatgtttgctttatcgtatgtcccaaagtccaaatactggagagtcatatggaaatattccaaagatttgcacacagaagtgtgacacataaggtgagaacagccaataaagctgttaggtataagcagttgtgcaaaagaatcagttgtatagccagccctgcaatgcttggaatcaagcagcatggacacaaagtgtctatgtgtacccaaacagggcatagacttcaatgctttttcctttcatgactagtctaaggtttttgaagctcttctcataccttatcacattttacatacctaaaaagaatcaatattttcttgttctttacaacattcttttttgttgttgttattgctattgttgaaggacaatcaattctgatttacataaactcaagggtaacttaaaaagacagttgcagtaactaagattgaagctggcatgcctttcccgagtgaggtgttagacataaaaatggctttcatttcgtaatggagaaaaaagacttaagtctctgggacacaccactcttctcccctaatctcttccacaaatagcagcctgggtgatctttttgtaatgaaaattctatcacaaactccaaatattaaaactttctcatggctttccatcatcttaagaatgagatccaaattcttcaacctagtttaaatggttctatgccagggctctccaactctggtagacccaaccctccttaatacaaatattttgtattaccctcttcactctcctgagatgaaatctactcttaagatactctacctacacttgtatttttaaaaatgttataatatcttaactttaatactaaaaagaaatattagaatgggacagaatatggttatagaagttctcattcccctagacatacccaacggaacaggcagcctcaattgccaccagcagcctctcatggcaaagcgagggaccagcctcaagtgaattaagcactatagatggtagagtagagagacagaattcaggtccttgagtagagtagagtatagatggtagagtagagagacaaagagaattcagatttcactgcactggtgaatcaaccaaccctgaagcccacattacattcagactttttaatgatccaaaacaaattcctttcacagttgaactttctacaatgggttttctgagtatgacataaaacattataaccaacatacccagtcaaaaacagagcgtgagaaacagtgctttctcaacagcttgtctaaagcatgcttatataattatcaggagaatatgtgaaaattagtgaggtttttttctgattgatatgaatgagatatcttagacttcatagagatgatgtgtttaaagaacagcctaaactaaatgtttagtaatgtttcccctaataattcttaaagtttaagaatgacattttctaatttcttatgtattaaggtctaacatacttctcaggcatttaaggcaatggcgcaataatattcaaaaattgttaaagctactcaccccaactccttctaccagtcctggtgcagctaagtaatgcagctgaccattagcacacctgaaactaccacactaatgtggcttttcagggcaggatgaggaaatacagtgcccctagctaacttcttgcagcaaatatttgtttcaattttttaagtgtagttttcctaataccataacaaaatcatttcccccaccttttctcttcattctttcccaaaagtaatacagctactaaaacactgatagtataacaatttatgttgtacttctttctgcttttatcctagattataattgtactacagtaactatagtgataaaggtaaacacttacatggaaccatttgtgtagcaggtctttattccaagcactttgaaaacattaactcctttaaccctataatatccctacaatggtgattactacttttattttactgatgagaacactgattttactgatgagaacgctgaagttcagagaggttaaatcacttggcccaaagttacacagctgtaagccaaggtttgaacagaaggtcagtgctcttagccactagactaccctgcgtctcaatacagagagcagtctggggaaaatactggctaatatcggagaacatgttttgagattattagaaaatgaactcacatacatctcaaagctcttagatacagggagataaagactgcttttcaaagagaaacaaaagtaaacaaaatgtatttcttgaagagcttacaaagctaaagtcagaaatgcatctccactctgtcctgtctggtcatctttaaacttctacatcctaaagctttggtttccaatcagtcacaatctcttgtgctctgatgcactccacacactcactcacacatgcattgtgcatttcacacccacacacacacaaacatgcccaaaatacatggaagaaagataaaattagctgtcttctctttgttgttgatcaaatgtagctgaagagtcagcaggggataaatatcttgatgcttacctcaggtacaagtgctttgaagaagaacatagaagagcaacttttaatgtagcattgtgaaaagaaaaaaaaatgctataaaatccaacccccattgtggggtgtcatttctaacaatgaggtttgttttctttatctgtagtgcatatagatgatcaaacaaaaataactgatccacaggctctgaagtttttatcagtagtcaccttctgcatggattaataaatcaaaaagggattttaatcctatcttccctttaacattatggcacatacttttgcaataagcgtggggcaaattgggagcctttctgagacacaggtaggcaagtaaaaaccacattagctgaacgtgccttcctaggtggtagaaacacatggatcaagggaggatggttgcaacacatccctatcaggaacccactgcaactatctgaagcaccctcctacaggaggggatgggaaatgtcatcctgcagtggaagtgaatacagggctgactattcagatggaaatggccacttggctcaattatgaactgtggttggcactaatagagaagcaatgattttgtttaattctttacaaagacaaaaattaaaaaccagaaggagataaagccaagaccactgccaaagatgatctttctctccaatgttcagtaaattctactcaactccatgattctctcccaccctgggcctccatcattcaaatgtgaaatcattacctggatggtgaagtaatctgtacactaaacccttatgatacacaatttaactatatagccaacctgcacatgtacccctgaacctagcagttaaaaaaagaaaatgaagattttaacacaacccaaagggccaacagggaagcatcccttttttccttatagaaaatagttctcagaactatgatgtattcatccactttttaaaagtgaaaaattttataaagcaagaaactcctcaaaaaggtcacagatttatcatgatgttaaaagtcataaaaattatagttacaggctaagtagttaaatcagaattacacaccacccaattaattttataatcaatagagattaaaggaaatgaggaagtaaagtaaatgataggatcccagcttaaatcaaatcaatatatatttattgatagccatcccatataagatgccatgaagaaggaaaagtgttatggaaatatgtccttgtctctgagcagctcaccacctggctggggaattgatatgtaatatgcagagaatttatgtgcacagcaataacaatacaaggggtgtcacaaggcctcacacaagtcatgaccaacagaaccatgtagaaaagagcatttgtattaatgcaatggtcaagagcctgggctccagagccagacttcctggatttgaatctcaactctaccacttataagctcattgaccttggactagttatgagtctttcagcaggaataaaatagaacctgactcacatgatgattgtaaaaattaagtgagtgaatacttgccaagtgcttgcaaataaggcctggcatacaataattgccatggaagtattaaatgggcaaaatacaattgaaagaagagaaagatctccattgctctaaagtctcccaaagtcctaggacggtttaagcagtgacggatgatatcatgttcattttccccttcccacgaattccctccctactgctacaaacattcttaggtctagaccatactaaagattaaaaatgataaatagtctctactttgtaaactccctgtaaaaaatgttagactcttctacatatgcatctatttatcactgctcacattcattcattcccttatagctcaaaacctgactccaacccctaccattctacagaaagcactacaaaaaccctaaaatctaaatccaactcccatttctccttagtcaacaccctctctagaacattacaaattattcaccgtttgatcatcacaattttctacttcctaggctctgtcattgccatcagaattttggcttcgagaagtaaggactgctcttcctcatacctacatctcttggcatgcagtagcatgttcaattaaattgctttactagacagtgctctctacgacttttggtcagcagacttctgagatgtccctcaagattcttgcctctggtatatgtaacccatataattcctccctcttaagtatgggcaacacttgggtaagacggagtacacttctgtgactaggttatgttatacaacaaaggtaaggggatttctcggatgtaattaggatgccaaaatcaattgactttgagttaatcaaaagggaaattatcttgggtgggcctgacctattcaggtgagccattttaaggggctgaggcttttttttcttcctaaaggaagaaataattcaaagcctaaaagaaattctactgctggccatgaaggagaaagctctcaagttgtgagagggcttcaagagatagccatgtggcggagacctgagagcagcttctaggagctgagaatgaacgctgcgcagtagccgaaagataatgggtgccccagtcctacaatcacaaggaaacagattctgccaacaggagacagctcggaactgggtatttccctagtcaagcaagcctccagataagagcacagtcaactgacaccttgatttcagccttccaggacctttagctgaggaccccagctaaaatatgccatgttccagcctaaatattccagcccatgaaaatggtgagacaataaatttctgtggctttaagccactacatttgtggtaatgtattacacagcaatagcaatctcccgtaccctctgccttccctctgtcttttcctctggctgttttttcttgatccaacacctaaatgtgggttaatttttcctggaatttcttctttctcaacactctccaaagtgattatgcctaattgagttactttaataaccatctatatgtgattattgctagatttttagactgctcttctctcttaagtcatgtcctatttttcctactgcctgctggtcaattccatgtgggcactaccaaactcctcatttgatatctcccaaatctaccttattattgccccatctacctcttgctcaatatctctccctcctagctgggccagtcctgttaatgtcttctccatcctcccaatcatttagtttgtaaacatcactaggacattcttcctctcctgtttccattagaaccaataattggccaactcctgttttaacaagtttatattcaaggcttcttttctattcccaataggtactaggttggcctttttcttcctaatttattaaaaccttagttcaaaatctctaagtatttacaagtaggtcttccaaagttaatgaaattggcacaaccccaagagggctctcaaagtccaatacatgtaagtttccaatctcagctctgccacttaattgcaatgacctaatcatatttttaatatctttgggtctcagtttcctcattcaattattggagaaggtaacatctatctcacagggctattgtattacatgtaaaggaatccaatcaatgataactgttcgaattattacctggaatcgtggcaataggacccatttccctgtcaatcggacttgaaagcttaacaaggccttcaattcttcttcctatatccctttactgaaccatcagggtaaactgaatcaatgtcctacttggtagcttcatcagagcacgttttgagtctgcatccagattgttaactcttggaaaacattagcaatattgcttgtttatccttctttctgtgaacactgactaccacattcagcaataaacattgataaagaaactgaagagttgttaaaatggaaacttgacagcataaaggaaaaaggacaaagaagcaagtgacaggggtaaatgcaattggtaggctgcatcttagctaaactcaaagtgaagcaatgatgccccagcaggctaaggttactcttaatgagaaagtcccttgggacataaatgtcatcactgagatctgatcttcttctaggacagttagaattttcttacgggagagaggcagatactagtgttgttcacctcatcacatgcaacccaaagaaaatacccaatatgaatgggattcttttgaacaaagggaaagaataaaaataattggatatgcttgacaactttcagttactctgcttggccttaaggtgttaagagttgaaaatctagcttttacctagtgcagctgaaaatctctctatataatgcaaaacttcaaaccaccttaccaaagagaggacagcactgagacctagttatctcttaggaaacttcgcaggctattactttgagtacaaaacaatgacacaactttatttcctgccaaacactgagggtacgacattcataaaaattttggtctagtttatgaaaaataaaccaggaggcatcagttaaaactcttataaataccttctttaagtgattttaaaagatttcactgatttcttccacttatcaatagtaatgaaataaaaaaaagtcctagaaatggttacgctttggacaagatttgagtaagacattaaaaaattctattggaagactgtcccagaaaggagcaagagctaaatatggagacaaaattcaaagaaacccaagcaaaaagaaggaaggaagtcaggaggaatttcctgaacaggcacaacaacttcagacccatgagggatgggaaaacaaaagaagttctagatggccttaccagctagagaacaagcaaaccctggcaagagcctccccaggcagcaggtttaacatggcccggccctgtttaagggtatctatcacacagtgatagatgatgctctaataaggctctgcagggtgatggagggaacccataaacccaatgtggttgggatgaggatggaacaataaagaagagagaataaaaggttactagttgttgagaaccctacatgtaattttatgtataatagttgactttatccccacaacaactttctaaaatatcaatatactcactgtataggtgtggaagcataggtactaagaggctaagtgaggaggtggaagaagtcattggtgagcaagcatttccattctttcctaaacacctatggaagaagcatacctccctgccttcactgttggacttggtcatgtgactcgcatgaaaaggcaacagaagaccatgtaccagcttaagcccgtgccttaagaagtttctgcttgtacctctgggagatactgactgactggagaagaacatacactttccaggcaaacacaaagccatgatcatggcaccaaaatgagacatatggggcagagccgtcttctgacctgcagatttgcagtattaaaaagatgccctcagctgctctgtggagctgtgaggatacaatgagactgttgcattccactggagaatagagcgagtaaccagtttactcaagtgtctaaaagtgattttttcactaagtacctcttactagcacttaacactgtgtctaaaacacagtagccattttctgaacaaacattaccttttttcttccacagagaggaagaaccacagaagtataatacagaaacccacttctgacttccacctcaaaattctaaatatagtacctttatgaggtgtcttacttctgagccaacttgattcttacacagcctatcccattttgttctggttcattgtgggtctaagggcaatatttttttttctgccataaactgctttcttgcactgttacttttacaaatcacattagctaaaaatactgcattttattctcttatatcattctctctctaaggcaggatacttcactcttcactgtatttttataactctcatctggtatttttttatgtctgttttctgcacttatctccatcaagtttagataacagtcaccaacttcttgatgactctaagcttttactgaactttgggagattacatctatgtaaggttcgatgtactctactaattaaagatctctttctattgcttccagcagttttcattccttgagattaagccaatagttgcaagggtggtgagattcagggcagtgataattctcaactactctaaagcaagattgctcctttttctcagtcctggttttgggccaggtgcggtggctcacacctgcaaccccagcactttgggaggccaaagtgggcagattacttgaggtcaacagttcaagaccagcctggacaacatggtgaaaccctgtctctactaaaaatacaaaaattagccagccattgtggtgcgcacctatggtctaaactacttgggagctgagacagaagaatagcttgaactctggaggcagaggctgcagtgagctgagatcgcaccactgcactctagcctggatgacaaagcaagattccatctcaaaagaaaaaaaaaaaaaagaatgaccattaacttcattctatcccttacatgcaacattcttgctccatcatttctttttatgatgttggcctaatgatttagtatttaagttttctttacaaactggataacaattaacaattttatagcaaagcaggggctctcccaactcagaaccactgctcgctcactcttatccgtagaatcaattcaggatgcttagtgtagctgtcgctggctgtttcactgacctatctcttgccgacagctccctcaaaactatctccccacctcccacacatacttgaaagggaactaatgtttatgctttcaatattatttaagtatatattttaattatttcaaatcatttagtattttactggtgaaggacgaaggctcaagttctatcttgtcctcggctacacatgcagtaaatgacaaagccatcttaccaaagtcgggagtctgcatttcctaagcacctcactgacatcctgcaacttggcttacaaacttccctcagctcaaaacgcctctcaaacacccccttctggtgagcacttacagactctctcatgtccagctcagagtcttctcttagtagctttttatggccaccctgagacaaaattaactgttgccccatgtgtgtatccgtggtctcctgcatagttttattagaggaaacatgcaaatacactattcctctgctcaccccactgacctacagctccttggcagtagggcttttatttttgtttgcttgggtttttgttctgagacagggtcttactctgtcacccaggctagagtgcagtagcgcaatcttggctcactgcaacctccgcctcccagactcaagtaatcctcccacctcagcctcctgagtagctgggactacaggtacatgccaccatgcccagctaatttttgtattttttgtagagataaggtttcatcatgttgcccaggctggtcttgaactcctgagctcaagcgatgcacctgccttggcctcccaaagtactgggattagaggcatgagccaccatgcctagtctgggcctttatttttaattctcaggactgactatagtttttgacacattgtaggcactcaacattcaacatccaataaatgagtgttggacctaatctagatagctactacaattattaatgaaaaggaaagagctctgagggaacatgcttccatccatatgcgtcatctataatatactgatagtgataaaaactgagtgtatagtgaaaccgtggtaaatatatcactatatagcatttttatcttaacacagaggttcttttaaaagcttctgaggatggcttatcagtacttcataagcaagagactactagcatgcaggcaatttacaaataaacataattctaattttcacagctaaacaattgagaagggtcataggatccttaaaaactgtttatgaaaaatagctcctgcctcaaatagctcacatggatctactgggggaagcattggtgacaggagtaaaattaacatgttgccaacctaccaatgtgcttttcttggatgttgtcacctattaacatcaaatcacctatacttgtttatatttgattatggtttttgaaaacacatttttgtgtttgttttttacttataagattaaaacacatcaaaacatttgctagaagaattgtcttttttttttttactgtgataacacttaagatacatactcttaagaaaattttaagtgcactagataatattgttaactgtacacacattacacagatcatctctagaactaatagttcatcttccataacaaactttatatctgtcagacagaaactctctattcatccctgcccccatcactatcccctggtaatgaccattctacttttttgaatttgactgttttagatttctcatataagtggaatcatgcacttctgtgactggttaatatcatctgacatgatgaccttcaggttcatctacattatctcctatgacaaggtgaataatgttcatatatatatatgtggggggtgtactatacatgtatatcacattttctttatatatccatctgtggaaggacatttaggttgtttatgtattttaactattatgaataatgctgcaatgaacatgagagtgctaatatcctttgagatactgattttaattctttaaaatactcagaagtggtattgctagatcatggggtaaatctattttcaaaattttagaaatctccatacagttttctataatcattgcatcgttttattttcccaccaactgtttagaaggattccaatttcttcatacacttaccagcacttgggttttgggtttgcttttgtgacaacagcccatcctaacaggtgtgaggtgtcctctcactgcggttctgattcacagttccctgatgattagtaatggtgaacatcatttcatatacctgttggctattagcatgtttctttggagaaatttctatttaagtccttttgctcattttgtaaccaagttgagtggatttttttggctattgagttataggaattccttacatattttgcatattagatgcatcagatgtatggttcattttttctcctattccataggtggcttttccactctgttgactgtttcctttgctgtgcagaagcatttcagtgtgaggtagtttcaattgtctatttttggtgcctgtgatttcggtgtcctatccaagaaattattgcctagacaaatgttaaggagatttccccatttccttctacagacgttatagattcaggttttacttctaaatctttgtttcactttgagcttatttttatgtaccacagaatacattaaaattggacccttttattataccatattcaaccaattactttaatgacagtgggtggttactgtataccttgtctgtaccgtttctctcaaaatttgcatttccctttgggaatcttttgcagttacatcccactatctacctctcagcatttagaaaataaatattttctcttccaaatcactattgacagcaaaatctcaaagtaaatccatatgtgaatagtcacttttaaagaataggcaagttaaatactcagcaggaataaaaagtacaactctgtctttctctttctgacacattttcttccctgctttcctccttcatcctgtgagatgagggatggcagggttgcataggggatacatttgaggtttacatcaatctcacacagcagggtgagaatgatcacactatcctagtcccccaccaggacctctggagtaatgtcacatttccttgccactgaaaatgctacctgatgtacattaccttgtctctatttcaggttttaataacaaattcaaactgtcttttcaaaccattttcttaaatgtcttgacagactggtactagtgttaccgtagataaatgcctgctttataccaaagagatatcagaataatttctcttcaatttcctcctgcattttgcctaattattttgaaacattttacagtatattccttggtcccattaaattaaaatatctctttcattctttacccattgctgcccacccaccaaatcatagtttctactctttgggttgtcattttggaaataacatcttactaactacaacattcatagttaaaccaaagaaaacaggtatcatttgtaacagtgttttttctccactgtggcatgtatcaaagatcttcttttttggtttattttacattgtctccaaacaaataaatctaaagttaaaatacaaagtatccttatcagaccaccccttatcagccacttcacagcaaagatgactgtgtgctgggccagcagcaggccattagcatgcacagccttttctctttgatttgtgctgaaatgtaggctatccagttcatactagccttcagccaaagccctgtgggaagtaactgcaaaccataaacttccagtcctttacagacatttgtaatagaaaaagtatgcaaatagagccaccaacattactagggagtctaacttttaaatgacttagtgttattggacttgatttgtaaatgaaaaattcagatatgatggcaaggctgtttttaacaactctcctgatgtgattgaggagttgatgtactattggggaattatatactttataacgtaataaaaatgatttttttttttaccagcaacttgatttatgaagaatggtgcacacgtctgctgaaatatcaaagtaaactttggttacattggcgaggaagctaaaaggctaatacctccagggcacataaaagcttaggccttcttttggtttcttttcagggtgaagataaatgccagattgagttactttgttttttaatacttaaatctaagactttaataacttttatattgtaagttaaggggtacatgtgcaggtttcttacacaggtaaacatgtgtcatgggggtttgttgtacagattatttcatcacccaggtattaagcctagtactcattagttacttttcctgatcgtctccctcctctcacactccgtgttctgacaacaggccccagtgtgtgttgttcccctctatgtgtccatgtgttctcatcatttagctcccacttacaggtgaaaacgtatagtatttggttttctgttcctgcattcgtttgctaaggataatggcctccagctccatccttatccctgcaaaggacatgatcttgttctcttttatggctgcatagtattccatgtgtatatgtaccacattttttcttttttcttttctttttgagatggagtttcgctctgtcatccagactggaatgcagtagcacgatcttggctcagctcactgcaacctctgcctcctgggctcaagcaattcttctgcctcagcttcccaagtagctggaattacaggtatgcgccaccacatccagctaatttttgtaattttagtagagatgggagatttcaccatgttggccaggatggtctcagactcctgacctcaagtgatccacccacctcggcctcccaaagcactagaattacaggtgtgagccaccacacccagccagtaccacattttctttatccagtttatcaatgataggcattcagattgagtaacttttattcaacaatttttcacaagtatatgcagtgtgcccatcatgccagccactgtcctaggtgctgaggacacagcagtgaataaaacagaccaacagaagctctaggcttttatatgtcctagacatattagccttttagtttcttcaccaatgtaaaggaaatgtttactttgatatttcagcagatgtgtacaccattcttcataaatcaagttgttggtttaaaaaatcattttttattaaatcatgaatgtaatgtctgtggccatacagacaaaaaacgctgccttcatggagtctatattctaagcaacatacgctgctcatcttcacagatctgagccaaaagaggtttctttttatttctaaggcattaatattaactcaggtcaaattttattcattttttacaaagtatggatttttaaaatgaatcatcattagaaaatgtttacctaatgtctaggaaaaacattattggtctgaggttcttttaactacccatctacttcacaaaatgttttgctgtgaattaaactacacagcctacaggaaaagataaaatccaagtataaataaagtaaagaacagcacctaacaagcacctcgtattttgtactttcctatttgatttgattatgttttcaatctcttccccctgttcacaggagaggccaactaaaacctaaagtttagtacaactttctggaaattctgcaaagtggcaaacaaactgagaaaatcgtatgccttaaaaacccatcactgatgttcttgatcaatagttggcataaataaatcgtagacatgtgggcaagactgctggagccaggcaaggatttttcttaatgtggacagtgatgtcactgaggcagagagaaggaaggcatatttacaataaaagggagtgattatacaatacattaaaaccataaataaatactccattaagttataaaattctctctatatgttcttaggaggccttcctgtcaggcacttaacttagagaaaagcaagtaaagctccatttatcattcatttagccaaaacttgctgaatcctgctctatgcccgccatgacacatcatcatcactactgtgtattaagagtttactacatcctatgcactgtgctcagagattacatgcatcatctcattccagcaatgatcaaccctataagctgggtgttctttttaataatcattatatagattaggtaaacgatactcaggttgtgttatttatctgtggtcacatggcaattaaataatcagatgtcatatgagggtatgtagttctaagatataaattcatatttatgttactaaataaaggccttctcatgcaaaacaatcaacatctaaattcaggggaaatccagacctatattctaaaaatatggagttaataggtgtttggctgacatactttaagatattctctaccccatgcaccaaaatcatgactagtcacttgaattaatagatatctacacacttcaacaacagctacctagaataatgtatcatggtaatttacattttttaaaattaagatacagtatgattgtataaacatatgtaaactttcatatagtcatattatataaaaagattctatataattacatgaggcaggataagtagtcaaggaagtaatcatgtccttgggatatggcaactgtggcaaccgtacagtcaaaacaataagccccagcatttgcaccgtagtccagctcactcaagcaaagctatctccagtagggaacttcccctggagggagcatgcacatgtgatttcacctgtcctcagactgaccctgtgctgatgataatagtgaaaaacacaccgatgggtggagatttaagatgctaatgagacatgtggcacatggacaagcatgtacagctactgcacatgtgcgtccagacgaccacccagaacatgcttactagtaacactgctttccacctccttatgaataatcatgtaaaactccccaaaactccctattgccagtctttgctgtctcatccttacaagcagcccaccctgaattctctgtctctcagggtgtactgtctattccgcacttaactttcaaaatatgcttttcttttgcagtaaatgactctgtgctgcatatcctttgctgtgtcttgtttaatttcttttaaactaagaagaactgaggtctcacaacagccttcaaaaattacacactgttaacttaaataacaacttgacagttcaaatttaaagagaactattcctgtttaataatcaatcccctttttactaagacaatgggaaaataacattcatgctgatcaccaactaaccacattgttgggttaaatcaaacctctgcaattcctttgagaacataatgatgtccgtggtacccagaacaccaaaattgcctagactaccttctagaacactgtacaatctagttccatcacctcagttgtatgtttaccaggaaaatatcaattcccaaacccatcatacttttagtgtatttacatgatttaagaatataagagactgatgaaatatgcggaagaaaatagagccattgcttccattacttttttcgaaagatgagataaatcgaattggtgagagtgattggctttatattagatggagaaatctttacaaggtgagaaagatgattacaaaagcccagaagaactgtgccttagactgctttgcaggcatccaagtttttactccactttgaaggaatcatcactggtgcacagtgggtaacatttatttgagaaagtagaggtgagactccaaccagtcaattcatatttaaggaggtctagaaccaagaattaccaaacagatgcacattataatgtcctaaaaacatttaaatagcatttttatttcttggtaaagcaacatttgttgctctagccaagagtttcaatcaactgacaaactagaagtcctaactgatttgaataaagggcttctactgtgctctgtgcaaagccttgggtagctagaggcaagattctctagcaacacaagctctacccaccccggttacccacttcagaaccctgcttttagttttgggtacggcctcgaaggattacaggtgatcagatggatgacatcctgagtcatcagtcagtgattcctggtctcagtcagtgattcctccaggcacatctcccttctgatactcctaaataccagaacagcagcctgggaaaagagcaagtaacactcacttctctctgggcatcatgtgtctcccaacccttgagtgtcaagaatcactcttttctaaactcccaggctcctcaaagagcagaagtgcaggcatatatcattttagaacggaaggaatattccagacttgctgctcaagaaacaaaagatgcaagtgtctttgggcttgttcaaaagtacaccccttctttctttgtgctgtgggcaagagatgcacatgccagtctaaatgaaccactgctgtgtttatgttcatgctgcgttccatcatgtttccaatcctttactctttctcaccatttactgaggtactctcacccctacttcacatcgacagccccacagctggtcatcctcagtcacagtcttgccagttctaagccaacctagcccccagagtctcattttatatgcacaacagaggtaggcgcattgtccattagcaagtcaaagacttcttaaatcactgaatggttcctaggcttcttggaatgatttcaggaacaacttgctgcccttggtccacttctcttccctatccaaatttcaaacaagtaactggtatcttcccagtcatcagttcccaagactagacttttctcccaatcagggaaattgggcttgttacatttccatgacatgtcattctgagtgccctgttacccgtctctatctggaagatggtatataaatgaaatcatttacacagtgccattctaattttgaaaggaattgtaggcatgtcaaatagggctcataccaaataataacattctaaataataagagaggccaccaattgaggtataatatgtaccaggtcctacgcctgtaactttacctgcactatcatttaattcgctcagcaatcctataaagtactattgatatcttaccatgaggaacctcagcgttaaaaacttgcccaaagtcacaggtcatgtaaactcatttatgtcaaatttccaatccaaactatataacccaaagactccccaaaggtaaccaaacagataaaatttatataaatccaaagtttttttcttgcctgtctttctgcaatattcagtggggcaataaatctctggaatctgtcatttcagtatatttttaataaagtagactctttcacacactctcctggaacctctctccagttgctcagcttggaggaactcaaccaaagtacaaataacatagggcaataagtgatacttagaatttaagatgctttgggttttatgttggcatacgattctgatactctaccaaattacaacccagcaagagaaatgtattatgaacttgtgtgatataataacaagttaaaaagagtcatcctttcttggaaatcagcatgttcaccccttttgtttttgcttttgttcttagaacttgctgctgtacctcttgcaaagtcccataaggtagaaccaggtgatatcactatctttacctgatacaggagacagaaaagaatttaaaaaaaaggccattttacacagaagggacctaattctgaatgattcaccaatattcgatgaatcactgatgagctatacctttgccctcttcagattccttcttggctgtactaccagtaagtttgaccatgtcaatgcagggagtttactcacataactgtacaagtttctaaaaatgtctagcaataaatatattattcttggaagttatgttctcgggaaaaagaggtgtctccacttacttaacaatgaagtagctcactgaatcatttaaatagtgggctgaagaaaacaacaaaatctttaaaaaacaatttatcatctcaaacttctccttgaacaactgtttcttttttatttaccttagagaataggcaaaggaaaataaaatcacttaacacatagagaactcaagatagagacacacctttagaaagagtcacatacaaactggttagtaaattaggctattgtcttataaaagttgttgtaaatcttaggccaatacattcttgaagaattgatatttgatgcatctgtaggtatttatatatatatatatatatatttgtatttatatatatatatttatatatataaaaatatatatatatttatatgtataaaaatatatatatatatatatatatatatatatatcaggtcatttttcctcccgctcattctttttttagttgtgtttttttttttttaattttaagagacaaggactcgctctgtcacccaggctggagtacagtggcatgatcatggctcactgcagcctcaaactcctgggctcaagtaatcctcctgccttagtctttcatatacctgggactacaggtgcatgctaccatgcctgactaatttttttaacttattgtagaaatgggatctcactgtgttccctgtgatggtcttgaacttctgggctcaagcgatcctcctgcctcagcctcccaaagcactgggattgcaggcataagccaccatgcccagccctggtcactctgaaaggaatgtcattctcttttttgaaaagagatgtgatttcattataatgcctaattgttttgccacatacctaaggttcctgattcatcctcctaagtgacaaagactttttacatagaatcaaaagaacttctggtggtgggaagatggtctatagaaaagaaaaactccccccatgcctatgtcctgaatggtattgcctaggttttcttctagggtttttatggtttaagatctaacatttaagtctttaatccatcttgaattaatttttgtataaggtgtaaggaagggatccagtttcagctttctacatatggctagccagttttcccagcaccatttgttaaatagggaatcctttccccatttcttgtttatgtcaggtttgcctaagatcagatagttgtagatgtgtggtattatttctgagggctctgtcctgtcccattggtctatatctctgttttggtaacagtaccatgctgttttggttactgtagccttgtagtatagtttgaagtcaggtagtgtgatgcctctagctttgttcttttggctcaggattgacttggcaatgcgggctcttttttggtcccataagaactttaaagtaattttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttatttcattgagcagtggtgtgtagttctccttgaagaggtccttcacatcccttgtaagttggattcctaggtattttattctctttgaagcaattgtgaatgggagttcactcatgatttggctctctgtttatctgttactggtgtataagaatgcttgtgatttttgtacattgattttgtatcctgagactttgctgaagttgcctatcagcttaaggagattttgggctgagacgatggggttttctagatatacaatcatgtcatctgcaaacagtgacaatttgacttcctcttttcctaactgaataccctttacttctttctcctgctgattgccctggccagaacttccaacactatgttgaataggagtggtgagagaggacatctctgtcttgtgccagttttcaaagggaatgcttccagtttttgcccattcagtatgatattggctgtgggtttgtcataaacagcttttattattttgagatacatcccatcaatacctaatttattgagagtttttagcatgaagggctgttgaattttatcaaaggccttttctgcatgtattgagataattatgtggtttttgtctttggttctcttcatatgatggattacatttattgatttgcatatgttgaaccagccttgcatcccagggatgaagcccacttgatcatggtggataagctttttgatgtgctgctggattcagtttgccagtattttattgaggatttttgcatcgatgttcatcagggatactggtctaaaattctctttttttgttgtgtctctgccaggctttggtatcaggatgatgccggcctcatacttcatgtctaaaacaccaaaagcaatggcaacaaaagccaaaattgacaaatgggatccaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaagaatcccatcaaaaactgggtgaaggatatgaacagacacttctcaaaagaagacatttatgcagccaaaagacacatgaaaaaaatgcttatcatcacttgccatcagagaaatgcaaatcaaaaccacagtgagataccatctcacaccagttagaatggtgatcattaaaaagtcaggaaacaacaggtgctggagaggatgtggagaaataggaacacttttacattgttggtgggaatgtaaactacttcaaccactgtggaagtcagtgtggcggttcctcagggatctagaactagaaataccatttgacccagccatcccattactgggtatatatccaaaggattataaatcatgctgctataaagacacgtgcacacgtatgtttattgcggcactactcacaatagcaaagacttggaaccaacccaaatgtccatcaatgatagactggattaagaaaatgtggcatatatataccatggaatactatgcagccataaaaaaatgatgagttcatgtcctttgtagggatgtggatgaaactagaaaccatcattctcagcaaactatcacaaggacaaaaaaccaaacaccgcatgttctcactcatagctgggaattgaacaatgagaacacctggacacaggaaagggaacatcacacaccggggtctgttgttgggtggggggagtgggagagatagcattaggagatatacctaatgctgaatgacgagttaatgggtgcagcacaccaacatggcacatgtatacatatgtaacaaacccgcacattgtgcacatgtaccctagaacttaaagtataataaaaaaaaattttaaaaaaaaagaaagaaaagaaaaactctgactccattgtcttgaaactttgtttttgccatctaattccttaggcacaattttctggctgaggagaaactgcccaaagaccctagttccgttagattgaaaagcgatgaaaggaacagtgcaatgttttcttgatggggcactatggcctcaccacagatgtggcttagttacctgagccctacctggtaactccatgtggattaccataagtactctaaaatatggtaatcaaatactaatgcacgtaagtattgcttggaaaacagagtaagacagtttccccggccctatctccagagattctgattcactaggtctgggtggggctcatgaatttgcatttcaaataaactcacagatgatgccaaatgctagcctgaggaccacattttgagaatcactctagaggactgggattccaaagcactcagggtaacctgtatcacagactgtatctaaaatgttgttcttggattacagtggtctgtagctttaagaagcaattatgatacgtttcttaccaaaggtcatcaaagaaagcacactgctgtgatggcaagctatccacttttataaaaagaagaagaagaagaaaaaaaaaagaaacaaagtaatggctcttctcttggaactgagagaaagctgactctggtttacgaaggcctatctcattcctgatcgtttatcatttgagagaggtgtgaacagtctatgtcaaaaatgctcattcaacattcccaggaagccactcacagggctgaatgtaattttacttaagcctgtctgaacttgcttttcttatttttccccctgtagacacacgattttctttctttgtaagaaagaattcaaagacaaagacacagatgtgatttcaccaaactagcaaactttaaagcaaaaaaaaaaaaatcatccatttctgtttatagcaagactccctgttatccctctactcatcttcctatgcagagagaaaatgtgaaactgtaatagccactcttcaagactgattaaataaaaatcattcaaaagcctgtgttgataacatattcctatcttttgtgtgcaaatccatattgtgtttcttggaagacctaatatcctagaaaaaatagacctgcttcttactgaaaagcagcagttggaaactgaaatgcctacagtacaagtagtaacaaaattaatggaccaagccaggagtgaagcaagggagggtaggagggacaatggagttcttgagagtcctggcattactgggagaactgcaactaattagcttcagaaaaaaatccaattctgataatgccaattggggcatcattgagattctttccattttttgtttgtttctcttggtcctctttcttgatgtgtctgaggattttaagtagaattacagaagctgtgaatgcagaattatagagactctgcatgatggtatctcccaccaaagaaggttcatcctactctctggcagccagtctgaaatggggcgttactttcatccaatttggaattgagttgactcaaagctggttagtgttttgaaagatgtggtccacctctggtttacacacactccataggtgtggtttaaggcctgtggggtacactagtacacctgtcattcgtggatgtgcaactctacttattttaacctcagccctaggagactatcaaaaacacacacagtggctcacacctgtgatcccaacactttgcaccaaggtaggaaaatggcttgaagccaggagttcaagaccagtctggtcaacatagcaagaccctgtctccacaaaatacttaaaatattagccaggtatgctcatgcacacttatagtacaagctattcaggaggctgaggtgggaggactgcttgagcccaggagtttgaggttgcagtgagctatgatcattctactgcaatccagcctgggcagcagagcaagaccctatctcattaaaataataataataataataataataataataataataataataaaaagccttcaggtataaatctacccaaggcacccatcttctctcttaggtcttggttcctctgaatcctggctgctttggcagacccaaacttctatgcttgtctcttcagccttatgagatcaccaaaaattatgttgcccacaaggtatgattttctagctgcctgttttctcaactgctccttgagccaaaacccagcaaattccctgaagggaaaagcagcctgtggactcccggctcagcactctatagttccctgatttctgggtctcttggttgtcttggcagttctttgttatcttcaaattaggtttacatgtggcttttctattgttttcaaagaaacatcagtttgtcacaagccactctaatttagccaaaagcagaagtcctcaggttaatttaatagagtaataatataattacttccccaagaaataatgtttttattctgaatatgaggttaaattcaaatttaaacttaatccatatgttacataggaattattttgttaagaattagcttcaaatatgataatacacatattctattccaaacaacatgacaactcattcttagttcaatgatctcttttaagacagatatatcaagcaatttttgtaatctgtcagcaggcctcaaagaaacttcaaataaccataaatcagtgttatcatttggagtacttgagatgctctagataaatatttgatggtagatggacactaggcagaggaatagtttcatctaatacaataataaaaaaaatcacaagacacccactagtaagtttatcagggagcaagatggagaatgttgctgacagaataccactcctgcagctgccagtaataattcacccttgaagcaaagagatggagatttaaatggggacactatccaacttaagcctttctgtagaatatagtgtcctagatgaagacgtatgtagtaaagatgggggaaatgaccaaattattcgattaccatgtgttacctccaactgggacttccaatattcctgaaaattcacctgcagaagaaagtaaaagagaaacaacaaattctcaccatgaaatgattttgaatgctatttcagaatattaccctgttagatcatctcatcaatgaattcaggggccctctattatgtaggtagctcaagaacgtagcagaagccttggaagggactgtccatggtggatactgacctcaattgctctcggattataacggactatagcagtggatctcttgagagggctttagtctcttccttaacatgcttttatcccagggtgggattactaagatcaaatgcccaggcattcaaatgatggagatgtagaatggtatcaagtttggcacacatcctaaccaattaattggttttcataattatcaagtgttaagatggagtcaaaaaaaatcacacaaaaaaacttaggtctaaaagcaaacaaaaaataattttagctatgtgtgcagtatcaagtggtatcaactgatgtccaaaaaataaaaagaagagcattttctgtatgtggtaggcactgtgccaaggatattacataaaatctgctcatcttcacagtaactctgaattaaataccgtcataatcctcattcttacggataaggaaaatgaagcagagagtgggtaagtaatttagtcaaggtagtaagcagagagagacaacctgaactagctctctggatgcaacattgaaagctcttaaccgcattgctttactggcctcctggacagcattgatcattttccctgcactttaagaatgtaactacggattatggacacgtgcctttcctagctattcttaaattctgagcttaatataaaattaatgacatcctgggagccatgattcttccctactacatctcactaagaacatggtttatgaaatctttatagctagttgaaatgtgtttactaagtcttgccaggaagctcattttatagggatatcacacacaggcaatataaattcctatggggctaagaagccttcattccaaccagtgcttttcctccaagtaattcggtaggtttggaaaatgaagcatctggtctgctcttttccacaagtttctaagcttgaataaagatcactcacttgatacagaaagggttggaaaaattccagatctggcctctgaaggttacttcccagaatgcggctgttaactacctattactgtttagaccaagtatctttgagagggaaaaactcgctttgattgcctaggtacttcaagctgcaaatctgcatttcagtgaacaactactaagtaagcagacaggaaagagaaccagtgccccggtctgtatgcaacatcttgttctagccttttgtgccgaaaagctatgcaactgtgagaaagtcacactgtaagcctcagcttccttctcaataaactgaagatgatgatgatgttcttataaaggtagcgtaagtgaaagcacttagaagttattcaaatatgacatcatatgcgcatacacacacacacacacacacatatgcagtaatgtggcacttaataatggagctatgttctgggaaatgcattgttaggctattttattgtgccaacatcacaaactgtacttacacaaacctagatggtgcagcctactacatacccaggctatatggtatagcctattgctcctcctagatacaaacatgtatagcatgttattgtactgaatactgtaggtaattgtaacacactggcaagtatttgtgtatcaaaacataaaaaagatactataaaaatatggcacaaaaggtagctggcgtggtgactcaggcctgtaatcccagcactttgggaggccgaggtgggtgcatcacaaggtcaagagatcaagaccatcctggccaatatggtgaaaccccatctctactaaaaatacgaaaattagctaggtctggtggcacacgcctgtagtcccagctactcaggaggctgaggcaggagaatcacttgaaactgggaggcagaggttgcaataaaccgagatcggggcactgcactccagcctggcgacagagctagactctgtcaaaaaaaaaaaaaaaaaaaaaaaggcataaaaggtagaaaatgaaaatggtagacctatatagagcacttaacatgaatgaagcttacgggactagaaattgttctgggtgagccagtgagggagtggtgagtgaatgtgaagatctaggatattattgtaaactactgtagactttaataagcactgtacccttaaggttacactaaatttattaaaaaataaagtattaataattgcactatgacattacaatgtctacgtcaacactgggcaataggaatttttcaactccattataatcttatggggccactgtcatatatgtggttcactgttgactgaaatgttttatggtacataaatatatatatatgtgtatatatccccaagatataaatatgtatatatatctctaagagctgagctgtgcatattatccaggtcctgtatagaactgtatagaactatgcaagtgacaaagcagaaaagaataaacagaaaaagtccattaagccactccagaggaagtgagtttgagaggggatgctggattttcataatgagagaaagataatgcagagcaggaagagagattttaaaaaatgaggagctgcaggtcagctacagaagtgggttccagagagttccagtaatgccagcactgggttaagtggggaatttggggatgaaataacagcagacaatgcctcacttattaatggaaaatcatttgatatagaaaagttgtgtgcaaggagccataaaccaaaaacaccaacaaaaaccatgttttcaagaaggaacctgcttgtaacgagccagtgaaggtatataccaatttaagaattaggtactagtgacttcgaattatttaacagccaggtccatatagagaataaatagtagactatttttctcatatgggctatttaagtgagagatataagcagataaaacttcttaattaattgctttcaatagtttagagttagaataggtattttcaatttgtataatgaaaacttgtttttaggagttcttgggccaacgaagaaggcaatcgcaacattaacatagtttgaattaaacatcggtaaaacaacaactaatgaaaagcccaatatgtttttcttactacttgaaaaaatatttttactttattttttttaaccattttatcaaatggttatcaggggcccagtgctcctgaagtcaataaccaaggttcagaaatctttacccttttgctttttgggaaacgtcctaagccacgaaaaccaacttgccgttgcatatcataaggcccacctccagccttcctggttccctgtgttataaatcttcaccttttctccctcttctttcagaccttcttcatttctgaacatccccccacttcaataacccgaataaactcatctccttaatggactggtacatcttgtctttgacatatttaactgttacaagaattccagaaaactgatactagaaaaaaatgaaaccatatagtacatacacttttggtgctattttccagaagttgtatgaatgcaaaatctcaggtaaacaaaatttcataaaggatattaaatatcagttgattatactagtgccacaatcccaagaaagaatataagtatctacggaaaatctcattttgcacaaagataacttagtacaactaaaactagttcaacttttttagaaaaaacattaagcaagtaaacctgactctccaactatgagaagcattccaaactgagcatgaccccataggtagcactgggagattgcataaggaccagaaggtttctagcaatatgggaaaaaaagaaaatcacagctttagcaaaggaacaaagtcctaactatgaagatgacttaaagatacaatccttaggcccacatgggaccctgaggccacccacttccaaatttgagactcccttaatctcaaatccgagccacaattcagtgggcctaactccaattgatgtctcaagacttgtaattttctacaagtttattgctttccctctgagcaaataaacataccacactttatttctatacttctgtgagatttctcatataaataaatgcccaaatcttgggaggagaaatactgtaaccacatatcttcatttcaggccctgcataaatcaatttacagtgcaactctaaggtaaaaaaatgcagcaatagcagccacactcaataataaaatcacactaatttggactaataattagtaacctacttcctgagcactgcaccaagcgattcatatgctttatctcatttcagtatcaggaaaaccctatgaagtggtttaaagtggccccatttgacagatgtgaaaggttaggaccagagaggctttactgtgtacccaagatgactaaattattggaaagtaagtggtaacatagtaattattaagaaaggattcaacatgcatcaccgttatagtcaaaagacattggaatttacatgagaccaatagaatgtgaccaaataaagatatttaaatgaccagtttaatgaattcaaaacaatgattagtaattaacacatcaatctttgaatgtcaatggataattctaaagtgctgcagcttgcttgaaaagtgccttctctcaagctgattaaatattctctccaaaaatcttgtttacattattaatttgctcaataacccctgtcttcagagaagtgtaaacctctagctggtccctgaagagttagcacatatttttaattaaaatggtcttgaatcaattgagttattatttttccaggttatattactaacaatattaactccaaataagatagattaaaaaacaaggtacattgaaagtatgcaaatgtaagtgtcttcaacaatgaaatatctaaagttcatataaagacctgactccaaattatgaaaaatggaaaattagtcatttctgtagtgtacacgaatgatttgcaacagcaaagaatgtaaggatgtgtcaaaagtttacaagttcaaagtacaaaatgaacacttcctttaggaaatgctaaaacaaaattaaataccattagaaagattttgacactttgctcttttatgagccaaattacagtaacagagttgggaatataatgatgcaattatacgctgtcatgaacagtttaattattttatgcctgagcagattttttttttttttaactcaagtgccctatacaacttccacacctgaatgcttctaacttggctttgccattttctgactctatttaattttctggggacacagaaggatggtccttactttaaaaaatggttctatcaaaattcattctcttcacttttaagctcttaaaggcgaggtaacagtttttcagcatacactctccagagggctaaactcattcattcattctttccaatgctccaatgcctccgccaggccaggcaccaggctaggatgcaacatagatagatgtgggaagtcaagggagatgactgacaaacgaggaaaatgaaaatcaacaggaagttgtaaaacataaaggcagctatgggtcatgtctatgccttcaggtttcaccatcagtcctgttttaaatcctagccctgactctatgtaagtatttcagctctaagttaatctcttcaccacctggaaaatgggggccatgaagatctctccctcacaagttgtgaggttcaaatgagatgacgatgcaaatctggcacatagtatatgcccagtgaatatcagcagctaccgaatgataataattgtatttttattactttttgtattatcataagtgtcacaataagctatataaagcatgctaataagaacactgaggaaaagcaataaatcttcctggagtagctcattccgaacagacaaaagtttcaggggagagagggagataatgctgagtaatgggtcttcaatctctatgagaaaaaaaaataacctaagcattgttcaagagaagatgccatgttcatttaaatgactatttcatcttaagaaagcagtctgagctactaatcaaaccagaaccctagccatgctgatgatgatcattaatgtcatcatccataaattcatttgctgtgtcacatcttggtgtaggaatactcatttgttacagttatgtcttcagtttgatgtgaagagaaagcaaccataaagcaacttcaaggaagctcctccaaataattaaaattctgaagcattcctcaagccaaaagcagatcagaccctcactgagggcactttctattaaataagcaggctgctatttgttgttcttgcagcacaagtccttgagctcacaaatcccacagcaccaaaagtcattattttttaaccaaactttttttttttttttcttgagacagagcctcactctgtcacccaggctggagtgcactcgcatgatctcggctcactgcaacctccacctcctgggttcaagcaattctcctgcctcagcctctcgagtagctgggactacaggcacctgccaccacacccggctaatttttggtatttttagtagagatggggtttcaccgtgttagccaggatggtctcaatctcctgacctcgtgatccacttgccttagcctctcaaagtgctgggattataggtgtgagccaccacgctcagccttaacctaacttttaaagtcctaaatatatcttcttaataaaagggccaccatttcttgtgcacatctggagccctttctgggcactagtcactgtgcaaaagttgttacacacataacctcatttcccacaatccttcccaggagacactacttatccagggttgtaaagataaggaaactgaggcacagagatttttaagtcacttacgcaagttttaccataacaaacttgggtattacccaagtttaatattaccataataaacccaagtttactatcaaacagcagagctctgatatgaacccaactttgaactcaatgtctttagtgactatattatagtatgagtaccttgagaatatatatattttaaatttccttatttttaaaaaacaatactcaaattcaaaatacaaattaagatggggtgggtgaggtagggtgaggggagtgaatggatgaaagaagggaaaggaaggcaaattatccagccactacagtcagatgttaaagtagaattcagatatcaaccccaatcgggttgggttttcattatgatcagacaagactcttcttgaccaaagactgaactcaatttctagtcaatgtcttagataacaagggccctcatccattattagactttgaggtcttttccctccatcattgagcttcagctcagcaatcttacggccatttacaaggtgactgatgagccttcatcataaaacaagatgaaagcaacttgcctacatgcacgtcttcaaaaccaaccaaatgaaccaattacagaacaaaaccagtttagtgtgaggatcaaaatgtgataatgttttgttgagcacagagataggcacatagtgggttgcttgtttatttgctttagtatgaataataattattatggatattatcaggattcctaaaaagagtcatttaactattatgggaacaatataatatactagatgccctttcctcaaggttatgcaacctacatgggaaaataactaaaacaaatgagtagcttctgcaattaaggatcctgagaatgacttccctgcttgatttgtggtagtagctgcatgcccaaatggaggaaaattatttgaataaacattggtcagtggggagaagtgagttttaggactaggctgctttcagagaaattcatcaagaggaaaaaaatacataattttaagaagtcaaagcctattattagaaaaatatgttcaccaaatgcagctctaatacctttagcaatgagataaactgagtctagcaagtggttggactcataatgattcgatttctttaactagcccattaatccaaaagatggccaatccacgttcatgaagacactgccagtgagctagaatatctgaaagagttggcataaaaagctccaccacatgcaattaatccacatctgatcacatgcccctgaataatgtcagcccacagatgggtttgtacacacaagatacagtgttgcctttaaatattcacaaatatttttaaagtataactttttaaaaaacatatatgactcagaaagaacagaagggttgcacaactcccagatatctgaaatgatggttaccgacaaatcttcactgatgctaaagaacatttatttcacacctactctgccacattcactcccacacacttccccaaaccagaattgaattgttacttcactttcatgctgacttcagacataattgtcacttctgcaaggtcacactttggggaacactatgtaccttcttaaatacaacattaattatggaactaacctatttagtctcttgccctaaagacttcagcatttaactcgacttccccatagtttactgtatcatagcaattaagttaatggcagcagcagcagcagagaatcttttaacccctaatgggcttgttcctctgattagactagatcaaagaagctgcagctatttggaggcagattagagaggcttcttttttactgatatcagcactgaagagtggaagatcatgtgtgtgttgacatcttacccaaatccatccatgacagtttacactgaagttattcttaatgaagacttttaatacatcaagactatatggatcaggaggcatgaaagcacccttacattcaaagagaataaaatacctaggaatccaatttacaagagaggtgaaggacctcttcaaggagaactacaaaccactgctcaatgaaataaaagaggatacaaacaaatggaagaacattccatgctcatgggtaggaagaatcaatatcatgaaaatggccatactgcccaaggtaatttatagattcaatgccatccccatcaagatactaaggactttcttcacagaattggaaaaaactactttaaagttcatatggaaccaaaacagagcccgtattgccaagtcaatcctaagccaaaagaacaaagctggaggcatcacactacctgacttcaaacaatactacaaggctacagtaaccaaaacagcatggtactggtaccaaaacagagatatagaccaatggaacagaacagagccctcagaaataatgtcacatatctacaaccacctgatctttgacaaacctgacaaaaacaagaaatggggaaaggattccctatttaataaatggtgctgggaaaaccggctagccatgtgtagaaagctgaaactggatcccttccttacaccttatacaaaaatgaattcaagatggattaaagacttaaatgttagacctaaaaccataaaaaccctagaagaaaacctaggcaataccattcaggacataggcatgggcaaggacttcatgtctaaagcaccaaaagcaatggcaacaaaagccaaaattgacaaatgggatccaattaaactaaagagcttctgcacagcaaaagaatctaccatcagagtgaacaggcaacctacagaatgggagaaaatttttgcaatctactcatctgacaaagggctaatatccagaatctacaatgaactcaaacaaatttacaagaaaaaaaacaaagaatcccatcaaaaactgggcgaaggatatgaacagacacttctcaaaagaagacatttatgcagccaaaagacacgtgaaaaaacgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtaggaatgtaaactacttcaaccattgtggaagtcagtgtggcggttcctcagggatccagaactagaaataccatttgacccagccatcccattactgggtatatacccaaaggattataaatcatgctgctataaagacacatgcacacgtatgtttattgcggcactactcacactagcaaagacttggaaccaacccaaatgtccatcaatgatagactggattaagaaaatgtggcacatatacaccatggaatactatgcagccataaaaatgatgagttcatgtcctttgtagggacatggatgaaggtggaaacatcattctcagcaaactatggcaaggacaaaaaaccaaacaccgcatgttctcactcataggtgggaattgaactatgagaacacattgacacaggaaagggaacatcacacaccacacacaggggcttgttgtggggtggggggaggggggagggatagcattaggagatatacctaatgttaaatgatgagttaatgggtgcagcacaccaacatggcacatgtatacatatgtaactaacctgcatgttgtgcacatgtaccctaaaacttaaagtgtaataataataataataataaaagaaatcaccgttatatatttcaggcaaaggtacccagtagctttaggtttttatgcccatctgctttctcaacacaccttgaccgccaactctagatgtcaaaagctgatacaggagtcatacatcattcaattacgttcttcatgatatgggggctatgtgcattctactatatatatttttaaagacatggtctcactctgtcgcccaggctggagtgcagtggcacaaatcacggctcactgcagccttgaactcctaggctcaagggatcctcccaccttagcctcccaagcaagctgggactacaaatgtacaccaccacacctggctaatttgtcttatttttttttttttagaaacaaagtctcactatgctgctagggctggtttcgagctcctgggctcaagcgatcctcctaccttgttctcccaaagtgctgggattacaagcatgagccacagtgcccagcccatttttatcgttggtggaaagaaaagcattttttataatgtgtttagatgtcatactcaattctagcttcatcaaaatcacttggagcttttacattaatgtttaaaatacaagctacatcccagagctagtgaattagtatattttaagggttgagccagaaatttatagtttaccaaagtttccaaggtgattctaataatgacctagttccagaaatcactggtatatgccataatgcaaaggtataaagatagtatacaccaagtaaataaatgtcaaagatcaattaactaaaacaaagagtgggttgggaaaaatgagactgcctgagactaaaatctcattctccatcagctattaaggtagataaattacagcacctctttgagtttcaatgccctcactttcaaaatggggcagtaatagctaccacagatacataggtacaacgcgcttagcagtggtttgaaaccacaataagctgccaaaaagcatggctcattttgctttttaaccagattctagatcttctaaacaataaagctgattataaagacattttccacaaaatagcctttttcctctccttcaatgcttttcacttaatactgtacttcttgcaaagtcagtaggctgagcatgaacaaattaaaattaaaagctgaattacttaattaattttaaggcactctcagttcattaacagcattcctgcaagttaaaaaacaagaaaacacatggaatgattgtaaaccgcatcccaatttcagaaatgttcaaatatattggggttggggaggtgagcagggcaatctactgccatatcaaacccaaaagcttctcttaaaaaggctatgtacatgtatatgcccaccagacaagatgtccttctctcatgttgcaatcagcaacccaaaagtcctgtaaaatagccaaaggtcaaaatagttcagaaaacactacttcttatagtcctcctctccacaaccctcttttcagaagttcgtaactggcatattcacatatcaaaaaatctgaaattaagaaatgtcttcaacaaatatgtctatcaaacttgtcttgaactttcctcacttacctttcggggggcaaatctgatgaggacttattttgggaaacattaaaattagggaaagtcttttggttatacttattaggaaaatcattgtccaagtgtcctgtcttgccagaatgagaggtttataaggaaagaagttccacggctttggactaataaccaaccatgggaatcacagcttccttccaagggaaataacacctttttttaaaatttgcttttatattggttaaaaaaaaaagaaccatgaggaaacatcaagaaccaatattacttctttggaaaaactttttggggatattgctaaggatttatattgcataattcaactaaacgaattttttagttttaaaaaatcccaataatattataaacctagaaactgtttattcagatccaccttggtaaaataaatacattcaataaacacagaatacagacagctttaattttttacatgtgggtcaggaggatccatctctcccaaaacatgtatcaccccacatgtgctgtgatttacaatcctcaaagcattaaagtttaatttgtgaatctactgtttcagattcattggaattctgatccaatagtcactctaaaatagatgcaggctggaagacaattctctacattttaaagccagatggcccataacagctaaatattttttctttccttgttcagaatataattcatgttggaagtagtgaatcaacttaagtacgtacaaatttaagggaaccttagtcatcagtcccaaacttaggaatctatttaaaggaaatatattttaaggttaagtttaaaaaataacaaaagagaataccatatgtaacaaccctggcacagaacactttctttaagaaaactcccttaacgttaacggcaaaaaaatactcttcccatttcactatggtaactaataaaaattttttcttcacactgaaaaataaaatctttatttaatctaattctgtaagtgccaaaaactctgattattttatcaagttattaaatatgttattcagtagtgagccttattgattttccttttgattagaaaaattaccaaaaaaatccagctctacagttcataacctgagaatggtagaaacccaagacgtagagcacattatgcaacactcttaaacaaatctgcctcttgggatctctctccttttatagaaagagactctccagcagcccctagagacattcccatactaagtgagtcagctaaataaaattaagcaactaataaaacaatatgtcatcttgttctcattgtcataattaaaatcctttttctttaagatgaaaggtggcagctatagagtagccttcaaaatcataggctatgccgaagcaggatcttctctccaacgctgtacagacaacgcagctgtccctgacatcaccacttgaaattattccctatttgatatttttgacattaaaaggctgaagtcttttttcttctgcaagttacttccatgcttgcttattaagcattccaagttggtctctcacccaatagccttagaaagcagaccatcattatttagggcaaaggtttccagaggcagtcagaggcaggataaggatgggggatcccaaacaagccatgctctttcctaagcaaagcacctctattttgaatgtgtttgatacactgagcttccaaataagattgaaattgattttaaaaaaagggaacccccgcccccctttaagccaggtaaaaactataaccatccctgtcaagagcgttacatgaatctgtaaatcctatgacagactaccggttgaaaccgaggttgaagtcttcagttcgcctgactcagtgctggtacacagtaaaaactaacactgaatgggtgccccacagtgagtgaggcatttcagcaggaccggggggatgttatgcaacaaaaacagttatagcccttgtctgcctggagttcacaatctaatggaaggatgatcattacatcaaatattaaagagagctaccatgcagtaagcccattctagacatcagctgccgttctaatatcaactcatttactctccaccacacctttaagaatgaggtacagtgatcactccccttttacagaggagccactgaggcacagagttggcaaggttgctaagtggccaagtttggtttgaagccaacggtatggcttgagtgcccatggctcaaccactcaaccctacctcctctcccaaacactgtaagaacccaaatgtcaaatgcacctagggcaagtcctcgacagaaaggcatggggtgtgaaaagaatgtataattagaggatctgaccaaggcagggagaacaccactgaggaattaatgcaggagctgagagcggaaagcagggtagtgaagagaggagggaagagcatcgaggtaggagcaaaagcaagagatccgccaggataaagggcttggagagcaggaggactagaattcagcccatcaggacagagaacataggagggtggcaaacaggaggttatggccccaggcggacaaggaaagacaggaaggtgccaaccatgctggaccgggctaagacagctggggagccactgagggcatgctgcagggagatcactgggctaatacttgtgagtccaaaagacttttctggctgtatctacacagtcatggcacagtcctcccaataggcaggccgacacaaaaccaaccctgctctgtatcactccatgtattcctggtcatattgtcacagcctgatgtgcactgaccacctctgtgctgtgccacactgagggagcagctgctccagctaatttctacccaacattcaccacctggaggcaatgcattggctcctcaggctttagcatggcaagggaacttcacaaataagaaagtttaaaaatgatgttactctcttcaaaatcttttcttcatttgtaggtggcagaaggcaacagatatatcacatcattgagtaccatgggacatgtgttcacactttaaagtacttaggtgttatttcatgtaaatgttgagaaggaaaaaaaaatcctgtttttcttgtctcttgggaatcagctttggttttctgaagaaatagttcacaaatctaaggaaaatgatatatctatacttatttccctaaagagaacataatttttcttcttttggttgataaggatttaattgcatttagaaggatttaatcacataaggctaaccaatgaaacactaactgtgggcagaactctgtttcagttggccctattggccctaaaatgtcattgatagtgactaaatatacacattactcctctcccccgccatcctttctcctccttccatttctccttctcagaacagagaaataaaacgtctaggaaacccatcatttactggggaaaggaaggggacgtgtaacatttcaaactgtaataaggcatgaacttgccaagctgtccatgtgggaggttatagcatgcccagagaagttgcccagaaaatagacatggtttccaatcaaaaaaacttagaccagttgaaactctggctttgggcaatttacttaacttctctgggcatcagtgttaacttatgtaaaatggagacaatcacaatatgtaccttaccctgttgtggtaagattaaataattggcacagggcctgacacaataaaggttaatgatagcagctgttaattattatccacgaatcagtttaactttaagaaaataacaactactttggccattctagcaagtgtgtggcaaagagggataacagaagctccttttgtggaagaacatgtaatttgccctttatttgcacagtttggaatcatcatcataacatcctaatatgccttgaaatcctgtgaaaaaacagaagtaaacaagtaaaaccaccatagcaacactatggcagaactgagttcactaaaagatcttgtctcttgctcaaaaggcttgactcaaggaaaagaactaggtatttctaggttcccctgcattcatttttttaaaaaattgttgtgggtacatataagatatgttgtaggtacatttatggggtacaagggatattttgatgcaggaatacaatacataataatcacgtagggtaaatgggatatacatcatctcaagcatttatcctttgtgttacaaacaatcctatcatatttttaagctattttaaaatgtacaacaaattactgttgactgtagtcaccctgttatgctatcaaatactagatcttatacatcatatgtaacaacatctgtgtatgcattaaccatctccccctccccaactacccttcccagcttctggtaacaatccttctactctctctttccgtgagctcagttgttttaaatttttagttctcacaaagaagtgagaacatgtgatgtttgtctttctgtgcctggcttatttcacttaacacaatgacctccagttccatccaggttgttgcaaatgacaagatatcattcttttttatagctgaatagtactccattgtgtatatgtatcatattttctttatccattcctctgttagggacacttaggttgcttccaaatcttggctagtgtgaacaatgctgcaataaacacgggggtacagatagctcttcaatacactgatttcctttcttttgggtatatacctagcagcgagtttgctggatcatatggtagctctttagtcttttgagtaacctccaaactgtcctccacagtggttgtactaatttacattcccaccaacaatgtatgagagttcacttttctcaacgtcctctccagcacttgttattgcctgtcttttgcatatcttttcattattttgtgtcctcttcaataagccattttaactgggatattactgtagttttgatttgcatttctctgatgatcagttatgttgagaaccttttcatatatttgccatttgtatgtttcttttgagaaatgtctatccagatctctgctcattttttaatcagattattagattttttttcctatggaattgtttgagctccttatatattttggttattaaccccttgtcagatgaatagtttgcaaatattttctcccattctgtgagttgtctcttcaaattgctttcaaatttgctcttcaaatttgtttactttgctatgcagaagctttttaacttaagctatcccatttgtccatttttgctttggttaactgtgtttgtagggtattactcaagaaatctttgccaagaccaatgtcctggagagttcccccagtgtcttcttgtagaagtttcatagtttgaggtcttatatttaagtctttaatccattttgatttgatttttgtatatggcaagagataggggtctagttttattcttctgcatatagatattcagttttcccagcaccacttactgaagagattgtgttttcctcaatgcatattcttggcaactttgttgaaaatgagtttgctgtagatgtatggatttatttctgggtcctctatagtgttccattggtctatgtgtctgtttttatgccagtaccatgctgttttggttactatatctctgtagtataatttgaagtcagataatgtgattcctccagtactttttgctcaggatagctttagctattctgggtcttttgtggtattatgtaaatgctaagattatttttttctattttcatgaagaatgtcattggtatttttatatggattgcattgaatctgcagattgctttggatagaatgggcattttaacagtattgattcttccaaaccatgaacatggaatatctttccatttatcttgtgtcctcttcaattttttacatcaatgttttatagatttcactgtggacatctttcacttctctggttaagtttattcctaggtagttgatttgtagttattgtaaatggaattactttcttgaattatttttcagattgtccactgttggcatataaaaatgctactgatttttgtatgttgatttttatatcttgcaactgtactcaatttgtttatcagttctaatagttttttggtagagtctttagatttttccaaatataagatcgtatcatctgcaaacaaggataatttgacatccaacttggataccctttatatctttctcttgtctgatttctctagctatgacttccagtactatgttgaataacagtggtgaaagtgagcatgtttgtctcatttcagattgtagggagaaaaccttcaggtgtttccccttcactatattagctgtgggtctgtcatatatggcttttattgtgtcaaggtatgttccttctatacacagtttctgtgggtttttaatcatgaaaggatgttgaattttatgaaatgctttttcagcaaaaattgaaataatcatatcgtttttgtccttgtgttcatatgatgtatcattgattgatttgcatatgttgaaccatccttgcgtaactggaataaatcccgcttggtcatgataaatgctttttttaatgtgttgctgaattcagtttgttagtattttgttgaggatttttgcatctatattcatcagggttacttgcctgcagttttttttttttttttttaatgtgcctttgtctggtttttgtatcagggtgatactagcctcctagaatgaatctgcaagtattccttcctcatcagttttatgaaacagtttgagtagcattggtattagtggttctttacgcatttgctaaaattcagcagttaagccatcaaatctagcgcttttctttgctgagcgacttcattatggcattgatctcattacttcgtctgttcaggttttgcatttcttagtggttcaatcttggtaggttgtgtgtgtctagaaacatatccatttcttctaggttttccaatttattggtatatagtagctcacagtatcttctaatgatctttgaatttctatgatatcaattgtaatgtctcctttttcatctctaattttatttgggtcttctctttttttctgaagatttgtcaatttgatttcttttttcaaaaaaacaactttttgtttcatttaccttttgtattttttcatttcaatttcatttatttctgctctgatctttatttttccttctactaattttgggtctggttttcacttgcttttctagttgtttaaaatgtatcattagtttttctactttttgatgtaggcaattactactataaactttcctctgaatactgctttcaccatatctcataggttttgatacattgcgtttccattttcatttgtttcaatatatttttaaaattttcttaattttttcattgacccactggtcattcagaagcatattgtttaatttccatgtgtttgtataatttccaaaatttcagctgttattgatttctaattttattccatggtggtcagagaagatatttgacataatttttaaaaaaatgttttaagatttgttttgtggcctgaaatatggtctttcctcgagaatgatccatgagctgaagaatgtgtactctgcagccattggataaaatgttctgtaaatgtctattaggtccatttggtctgtactgcagattaagtaagatgtttgctgactttctgtctggatgatatttccaatgctgacagtgggtgaagtctccagctattattgtattggggtcttatctaataataactttacataacatatatgagtgctccagtgttgggtgcatatatatttacaattgttatatctcttgctgaattgacccctttgtcatataatgaccttctttgtctcttaccatagtttttgtcttgaaggctattttgtctgatataagcatagctcctcctgctctttttggtttctattttcatgcaacatcttcttccatatctctttatttttagtctatgtgtgtctttatattataggcgaagtgtgttcttgcaggcaacagatcattgcagctagttttatttatccattcagccactctacatctttcgattagagtttagtccatttacattcaatgttattattgatgaataggatttactcctgctattttgttatttgttttctggttgttttgtagtcttctctttcttctttcattccttcctgtcttccttttaatgaaggtgattttctcaagtgatatgtttttattgcttgcttttttattttttctagatctgttttaagtttttgctttgagtgtactgtgaggcttgcaaataacatcttgtaacccattatattaaacagatgacaacactgattgcataaacaattaaactaataaaaacactatacttttcatacccctgctttttaactttttgttgtttctgtttatatcatactatctatgtcttgaaaagttgtggttattatttttgatagattcattgtttagtctttccactcaagatatgagtagtttacatactacaatagtgttatgatattctttatttttctgtgtacttactattaccagtaagttttctactttcagatagttttttattactcattaacatccttttctttcagattgaagaaagaatcctttagcatttcttgcaggatagttctggtgttttgtttgtctgggaaagtctttatttctcctaaatatacatgtttgaaggatattttcactggatatactattgtaggttagaagattttttttccttgagtactttaaatatgtaatatcactctctcctggcttgtaagatttccactgaaacatctgctgccatacattttggagatctttgttatttcttttctcttgctgcttttaggatcctttctttatctttgacctttgggagttcattaaatgccatgagatagtcttatttgggttaaatctgcttagtgttctattaccttcctgtacttaaatattgatatctttctctaggttttggaagttttctgttatccctttgaattaacttttctctctctctctctgcctcctctttaaggccaataactcttagattgcccttttgaggctattttgtagattctgcaggcatgcttcattgttttgtattcttttctcttttgtctcctctgactgtgtattttcaaacagcttgtcttcaagctcactaattctttgttttgcttatttctgctattaacagactctgatgcattcttcagtaggccagctgcatttttcagctccagaatctctgcttgattctttatatctccctctcttcattagatttgtctaatacaactctgaactccttctctgtgttatcttggattccactgagcttcttcaaaacagctattttgaattccctttctgaaagctcacatatctctctctctctccaggattggctacaggtgacttagtttggtgaggtcatgtttttctggaaggtcttgatgctttgggtgtttgtcagtgtctgggttttgaagagttaggtattcactgtagtcttttcagtctgggcttgtttctgcctatccttgggaaggctttccaggtatttgaagggacatgggtgtagtcatctaagtttttggtcactttacccgtttctactttaggggtgccccaagcccaataacactgtggctattgcaggcttgtacagataccaccgtggtggtcttgggtaacttccagaagaattccctggattaccaggcagagactcttgttctcatcccttacttccctccaaacagatgaaatctgtctctgtctctctgtctctctcccctctcctctctctttctttctctctctctctctctctctccagagctgcctgaagctgtgggaggggtgacacaagcactcctgtggccaccgccactgggactatattgggtcagaaatgaagccagcctaacactgggtctcacccaaggcctacaacaattactgcctggctaccacctatgttaactcaagtcccaagggttctgcaataagtatatgggaaatcctgccaggcttgtgtccttcccttcagggcagtaagttctctctggctctggtcaggtccagagatgttttctgggagtcacggcctggagttgggaaatttagaaatctacttggtgctctattctaccgcagctaagctggcacccaaaccataagacaaagtcctttctgcccttccctctcctttcctcaagcagaggaatctctctgaccaccactgctccgggcacatggagagtattgcctggctaccaatgacattcactcgaggtccaagggctcttcagtgagcttgtggtgaatgctgccagtcctgagtctctctcctcagggaagttgtctttcctctggcccaggacaggtccaggaatgtcattcaggagccaaatcctgaaatcagagatcctaggagcccacttgatcctctgccatactgtggccaaactggtacccaagcggcaagataaagtcctctttacttttccctctcttttcctcaagcagaagggatctctccctgtagccaccacagctgggaatgtgctgttcacaactgaagccagcagggctctgagtctcactcaaggcctgcagcaagtactgcttggctatcactgctgattattcagggcccagtgctcttcggttagcaggtgatgcactctgcaagaactgagtccctcccttcattcaaggcagcaggttctcttccagctcagggtatgtttagaaacgctgtctggaagccaaggcctagaacagaggcctcaggactctgcctggtgccctatgctactatggctgaactagtatccaagttgcaaaacaatatcctctttactctctcctctcctcttctgaaacaaagggaagaaggagctgcctggagctgtgagctgtgttgcctagagttagtggggagcagctcaagcactcccttcaccagctgatatcttcttaggtcatgtgtaccccaggtccactggttctgagctcagtacaggaccaggactttccttgcagtccttgtggcctagactgcctttcaagtttatttagaacttcagagcactttagcctgtggtggtggagcttgccggaactcaggttctgaccattggcatggacaatttgcctctggctagggctggtctaaatgctccctccttgggaacctgctgagttcttcctggtgttgctttctactgtgacagggcaacactgagttacaatacaaagtcccacaatcactgcactctccttcccccaagcacaaagattctttctccacgtctcatggactgtgcaggagaatggcggaatggtgacatcaaccattcaagactgtcttttctaccctcttcagtgcctctttccttaatatactgttaaaaccagatactgcaatcacccacctggtcttttgttcttatgaaggtacttttttgtatgtacagttgttcaatttggtgtttctgccggggaacaaccactgcaggcttcaatttggccatcttgctctgtcttccccctgccaccccacccctctcacattcttgaaatgagtaaaaagccttcacgctaagcatggccatggaatcttcccatgttgaactgtaagatgaacagagtcatatttcaaataaagagattaggctgacatgaatgatcatatttttaataacttattaacctaattgcatgccacaattacatagtgagttttcatcttttaaatcaattttggggtgagggatgaaatactacctattgggtacaatgttcactattcaagtgatgggtacacttaaagcccagacatcaccactacacaatatatccacgtaacgtaactgcactagtagctctcagtctacttttttgttaaaaaaaaaaaagagcaaaaacaacagcaagaggaaagatatatatttaagaaaaaagcatttcaatgaggcaaaaacaactggttcatccttaggtccttaggcccatttattacttcgaactgtatgcccacttttttattttataaaggtttgcatgtcttcaaactacatgcccaccttcattttgcaaagtattgtacaatgctgtatttttttttttttttttgagacgaagtcttgctttgttgcccaggctggagtgcagtggcgtgatctcggctcactgcaagctccacttcccaggttcacgccattctcctgcctcagcctaccgagtagctgggactacaggcacctgccacctcgccgggctaatttttttgtgtttgtagtagagacagggtttcatcatgttagccaggatggtctcgatctcctgacctcatgatccgcccgtctcggcctcccaaagggctgggattacaggcatgagccatgtacaatgctgttttaaaagcagcgctcgtctttgctgcctttcaactttacatgctttggtttctcatagagaaaataaaaattgtttttaatccttaaagaacttctgacaggagagaaaaatgacttgtgtgtcccaaagcccccaatcccaaagacatctaagcaaaaccaagttgggggtgggggtggagaatttaaatagcagtaattatcgtatctcaatttgcaagaaaaacaaatgcctcaaataccattattcatttaagttttctgacaacctgacatttatctcctttagtgctatattatagaaatgtttcttattatattcattttccagagactgagaacttttaaaaccaatgaaatgcatgtcccagagttgatcctttgctttaaaaaaaagtttgaaaaaggaaaagctattatgttgattacaaaccgaagtgagttacagtaaatgatgcaaagaaattttgacaaataggtatatgcacttgaaagtggtactactctgctctcaaggtgttgctgttaagatatgaaccaacgctgaaaactccatatccacagatagctggcttcttcgataaaattcaattcaaatcaaagagtaattaaagcacttaatttgcatgagcactgttccaagattaactaaagggctgaggggagctggaggtggggagctcaattaagaacctattcaacatatttcaagagagagggacaatctgaatttaggatatggatgtggaaatagaaaggggaatgtgagagacattatcaagagagaataaatacaatgtgaagagacaacctgggagaagggagaaaaatattgccaggcttaaaatacatgacaatgaaaaggccattaaccaatagggctaactacaaaggtggtgctttggtggcaaaaaattttctttggaaatactgatttgaggtacttgcacatgaaaacttaacctcagctgggcgcagtggctcacgcctgtaatcctagcactttgggaggcaaaggttggtagattgcctcagctcaggagttcgagaccagcctgggcaacacagtgaaaccccgtctctactaaaatacaataaaaattagccaggcgtggcagcatgcacctgtatagtcccagctactcaggaggccgaggcaggagaattacttgaacccgggaggaggaggttgcagtgagctgagatcacgccattgcactctggcctgggtgacagagcgagactccatttccaaaaaaaaaagaaaaaaagaaaacctaacctcacagagaattgtacctggagatgtatgggggaaagacacattattttggaaacatttaaagaacctcatactcagaactagaaaaaaagacatcttcataaattctgatgcatttttcatcctaataccagcagtgacacaatcaggacagggaatgtgtctgcttacccagcaatcaaggaagatgaaggagatgaagcagacagagggcagggagggtcaaccctgactgcaccagcaccaaaggctagagtttcttctggtatagcaaagcctaaataattttcttcattaagcttattttttcatccatgggaaaaggaacatgtgttcatattacattaacttgaaaaattcagaattaatgaaaaaataagcctcagaatcttaaatcaactgaatatagcaacagagaatagatgaagccccaaagggcttctgtcacactcatatataataaaaacaccagtcatgtttacagttcaattttatagagctaaattgatgagtagttttggagtgttctagaaattctacaatattcattttttattgcagtttttgaatttattaataattaggcaagaaatcattaactacattttcaaaacagtagaagtaaagcttaggaggctcattttcacaaatgtattattttcaacacaatacaattttttttttttttgagatggagtttcgctcttatcacccaggctggagtgcagtggcacaatctcggctcaccacaacctctgcctcccgggttcaagagattctcctgcctcagcctcccgagtagctgggattacaggcgcctgccaccacacccagctacttttgtatttttagtagagacgaggtttctccatgttgctcaggctgttctcaaactcctgacctaacctgatctgcccacctcagcctctcagagtgctgggattacaggcgtgagccaccgcacctggccaacacaatacaattccaatttttaaatagtactacttaaatcacaaatacaactgactgttattaatacaatgaaccaggttgagttatctgccattacttactttagaacttagctcatgtcagaaatatacaaaatactcctttgatataaacagatagcttgggggaaaacgaaaaactcttattagaattactactagttgctgtagcaactgtcgaagtgttttactatgtgccaggcactgggccagagactctttgttcatctctttaatcttcactacatttctataaagtaggtatcttgagatgtccattgtactgaaaaggagacaaagcaaaggttaggggagttaagtaactcagtaacttaaatgtttttctcccttagctgaaatgatgcatgccacaggtttgaaaaacattctttccctattcaatcatttatttaagtgataaacattaatctcaacataaacagaaaatagattgaatactgtgattattactttgaaaccaaagctccatctttagagaaactcatactggcaaagcaaacaaggactgatgaattggaggtgcacttgtgcgcttaaaactgcagcagctgatgtaggcactggaggggctacaacccagggacccaggtagtttgcagaaattcacaaggtgcagggtatcagttttgtcatcactttgatacctgtcaacttcatgggcctgggccaatcagccaacttgctcaaacctcacgtttctttcatgtaaatacaggttaagcacccctacaccaaatacccaatatctgaaatgctcccaaatctgacacttcttgagtgctgagctgacgccacaagtggaaaattccacccctgacctcatgtgatgggtcataatcaaaatgcagttgcataacacagtttattaagagtctccaaggggaaaaaggcccttccagtccccttcagcgtatcttttccactcatgcccagatttccctacacaagcatgccacaaagtattgtgtattatgtgggaaataacacacagggaacttggcacaagaactggcatacaattcccgaaatagtagagctgtcatcatcattactggtttttatagtaactgtgaccccaaagagttaatagaagtgagatagtagaaaaactgatggctgtgcagtcacagaaatcttccaagtctacatctctcattgaggagatatgcaccatttgcaaagttatttaacgtacctgagcctcagtgtccctgagtgtaaaatataaataaaaatatttccctggtatgagacagaaaaatagagctaatgtgtcaaaagtaccacatggagagactggaacacaggaagttcctattactgttagtatgaaggcgctttaagaactcaaactaggcaacaggtacaggccacagggggaataaacgcaaacgtccagttaaaaccaaatccagacataagagaaactttatttgaaaaagtaactgctataaggggagtgagactactgcaatagggagagctctggtcatgagatgtgcaagtagctcaacgattgggcagaaaggaattttcttttatagggaggggtaagcaaggctagaaagatcagctgggagcactgactagggaaagcttctcctgaaggtcagctggttctcaggaggggtattcaaggagaggctgctctgcatcccaatgctgaaggcatggtcaaagttcaagggcctagggagcgagacacacctgactgaagtttggttgattatttgggcactgggtataaacaaatcagctgaccatttataaggcgcagaacgggaatgtgaaaactcagcttctggccttgtcggaggtacttaagtgagcatcatttggtctcgtcctggacacccggggaaggattttttttttttttaagaagccttttccagaagacaaagggtgggggatttcttcacctagtgctattttccaaaatacttggctcaggtaaagctcaacattaccataaacagaacaaactatatatatatatatgtatggtttgtatatgtttaagtacgtatatacagtttcgtttacatgcatatgctgaatatagttcagtacttttaagcaaagtattataatatcatattcaaacaatcaccacctttttttcctacaaaaataagcaatgaattaaaagcaagtctgtcattaacccacggtgaggaaggaggaacaattttaactacctgaggtcttcaaaatggatttttttttttcagttcttattctaatgcaatttcctggtcagaatctttttatacataaccttgaatataacaaaaaccaggaaaatggcttgtacacaaaatgaaggctactaagagcatgagaaaatatttcattcttttcctttgatcatctacttttcttttgagagagatgcagagagaggatttgagtgtttatgcctgcctttggatttcttttgctgggttttctattaagtcttctctgacatcattactagcttatgcatactgaatgtgtactctcttgccaggcatcacactaaccacactatgtaataatttctatagatctccacacagctcagtgagaacagtgctactgttaaaaagtttcatattaatgtctgcattttagatctactgcaaataatcacatattatttttctggtagatgaatttcatgccaaaagattaacttaaccttttatatacatatgtaaacaatcggtataggcatgtagatataaacatgtatagaacacaaacttgcatttgtctcaggaatcaggtagagaccatagtaaacatttttatcttggaaggagggcagagagctcatcatcatcaattcagaacctataatgattttacccaaacttctctaatatgatagggagcaacactttttcaccctgttcatagtacgaatgaaaggtgaattatcttggtctagtttgagttctgcttgctcacccctggaaggagaaagtgcataccatagagaagcgtggagattctttgctgggtaataggaaattggtcttcacagcagaaaataataattgcaacaaaagtactaacaaaaataataacaacaattagagcaacaataaaaactacagcattgacatactgattgctcataatatgccaggcactggataagcgccctatttcactaccaaacataattcttccaataatcagcagtaaccttatgcatcccacttacagatgaagaaatgagacaaaggaagttcacacagctaccaaaattgggaaccaggaattaacctcaggcagtgtgactgcacagccagggcccttccaaacaattggttaactaacctgggtcttttgctggccaatgtatcggggaataatcctagccaacaaattcaagggaaacggaatcaagcaaatatgaatgaacttcatttactgaaaacaaagtaggctttgataggactgtgttaccatctctagacctaactatgattatgtcatttcttagtgcctcttgcggcaaagaaagtgcactttacataaaaaaacaatagaatgcatctggcagaagtatgagaagagtaacgatcatggtgatggtggtgatgatgatgatgatgacagcttcaagagcagcagggtaaggatgccactaaaatcaccaccatttatgtgccaggcattatgatacagtcattacatataacctttttctcccactatattgcatgctgcttcacttaccttgtaaaacattttagacataaaaggtgctccatttttttgcacaaatgaacaaatacatgaaataaaagtatgttgaaggcacagaaaaagtattcataaaagacaaactcaaaattcccaatgacacagagagtataatcacaccacatatcaaatccaagccacatagcacagagtgtgctattgaaatgaaacgcaatataactattgctctgggaattacagatgggatccagtaaaagacactgtattaattatattgttttccatggaacttttctaaggttgcccaggacagcaacactgtagaacattcatgatgaaactgtcaaagaggactagacttgaggggccttagggagaaaagagatttgaaaataatgtactgcttgcccatggttcagacgtgcctttctctgcaagtatgatcacattattgattctcaaaggaagaaagaaaatatgactttgtcccttaactgacatcaaagttacagtgttatgcagtgatgcccaaaagcatttgcaaatattcagaaacaaagttttgagtgtcctaggagatgactatcataccaattgatccaaaacacaatggtcaagaggcatggaaaacctatggttggggagggagaggaagggtcataaatatatacagtcatgcaccacgtaatgacattttagtcaatttactggatatatgatggtggtcctataagattataatgtatctggaaaattcctattgcttagtgacatcctagctgtcttaatgacatagcacaagacattacttatgtgtttgcagtgatgctggtataaatgaacctgtgctgccagtcatataaaagtattgcatattaggtacagcaggggtccccaaccccctggctgcagatcagtgcccatctgtggcctgttagtacagtgggaggtgagcagtgggtgagtgagcattactgcctgagctctacctcctgtcagatcagagtcggtattagattctgatagaagcatgaaccctattgtgaattgcacatgcgagggatctaggttgcatgctccttatgagaatctaactaatgcctgaatatctgaggtaaaacagtttcattccaaaactgtccatcccccatgacccctgtctgttgaataattgtcttccatgaaaccagtccctggtgccaaaaaggttgggggctactgacgtaaagtacataatacttgataatgataatacgtggctatactggttgatgttgtattagtccattttcacaatgcaataaagatattaccagagactgggtactttatgaagagaagaggcttaattgactcacagttccacatggttggggaggcctcaggaaacttacaatcacggcagaaggcaaagagaaagcaaggtatgtctcccacagtggcaggagagaaagagagagaaaaccagcaggggagagtccggagacttatcaaataaccacatctcatgagaactccctcactatcatgagaacagcatgggggaaactgatccaatcacctctctccaggtctctccctcaacatctggggattacaattcaagaggagatttgaatggcaagacagccaaaccaaatcattccagtgctggtccctctcaaatctcatgtcctttgcacatttcaaaaggcaatcatgccttcccaacagttccccaaagtcttaactcattctagcattaacacaaaagttcacatccaaaatctcatctaagacaaggcaagtcccttccacttaggaacctgtaaactcaaaaacaagttagttacttacaagatacaatggggatatacaggcattgggtaaatgttcccattacaaatgagagaaattggccaaaactaaggggacacaggtcccatgcaaatccgaaacccagtgaggcagtcattaaatcttaaagctccaaaatgatctcctctgactccatggatcaaatccagggcatgctcatgcaggaagagggatcccagggccttgggcagctctacctctctgactctgcagggtacacccctctcccccaactccccaacggctgctttcacagctgtcgttgagtgtctttggcttttccaggtgcacagtgcaagctgttggtggatctaccattctggggtctagaggatggtggccctcttctcacagctccactaggcagtgccccagtggggactctgtgtggggactctgtttgggggtgccaaccccacatttcccctttgtactgccctagcagaggttttccatgagggctctgcccctgcagtagaattccgcctggacatccaggcatttccatacatccttttatatctaggtggaaattcccaaagagttccacaagactagagaaaaaagaatgaagaggagtgaacaaaacctccaagaaatatgggacttcataaaaagactgaatctacaactgattggagtacctgaaggggatgggaagaacggaaacaagctggaaaacacacttcaggatattatccaggagagcttccccaacctagcaagacagaccaacatgcaaattcagaaaattcagagaacaccactaagatactccagaagaagagcaaccccaagacacataatcatcagattctccaaggttgaaatgaaggaaagaatgttaagggcagccagagagaaaggccaggtcaccaacaaagggaatcccatgagactaacagtggacctctcagcagaaactctacatgccagaagagactgggggccaatattcagcattcttaaagagaagaattttcaacccagaatttcatatccagccaaactaaacttcataagcataagagaaataaaatcctttccagacaagcaaatgctgagggatttcatcaccaccaggcctgccttgcatgagattctgaaagaagcactaaataaggaaaggagaaacaagtaccagctgctgcaaaaacacaccaaaatataaagaacaatggcactatgaagaaattgcatcaaatagtatgcaaaataactagatagcatcatcatgacaggatcaaattcacacataacaatacgaaccttaaatgtaaatgggttaaatgcgccaattaaaagacacagactggcaaattggataaagagtcaagacccatcagtgtgctgtgttcaggagacccatctcacacacaaagacacaaatagactcaaaataaaggaatggaggaaaatttaccaagcaaatagaaagcaaaagaaagcagagcttgcagtcctagtctctgacaaaacaaactttaaaccaacaaagatcaaaaaagacaaagaaggttattacataatggtaaagggaacaattgaacaaggagagctaagtattctaaatatgtatgcaaccaatacagaagcactgagattcataaaacaagttcttacagacctacaaagagacttagactcccacacaataatagtgggagactttaacaccatactgttaatattagatcaacaagacagaaaattaatgaggatattcaggacataaactcagctctggagggctctggatcaagcggacctaatagacagctacagaactccctaccccaacgcaacagaatacacattcttctcagttccacgtggcattattctaaaatcgaccacataatttgaagtaaaacactcctcagcaaatgcaaaagaactgaaatcataacagtctctaggaccacagtgcaatcaaattagaactcatgattaagaaactcactcaaaaccacacaattacatggaaattgaacaacatgatcctgagtgaatcctgggtaaataatggaattaaggcggaaatcaagaagttctttgaaaccaatgagaacaaagagacaacatatcagaatctccgggacacagagtgtcccagtgttaagaggaaaatttgtagcactaaatgctcacatcagaaagctagaaagatctcaaatcaacaccctaacatcacaattaaaagagctagagaggcaagagaaaaaaatccaaaagccagcagaagacaagaaataactaagatcagagcagaactgaaggagatagagacacaaaaaaccctccaaaaataaaataaatgaagacaagagctggttttcttgaaaaaaataaaaaatagacagcaagctagattaataaagaagaaaagagagaagaatcaaatacacacaataaaaaaatgataatagggatatcaccactgacaccacagaaatacaaactaccataagtgaatactataaacacctctatgcaaacaaactagaaaatctagaagaaatggataaattctgggacacataccccctcccaagactaaaccaggaaggagttgaatccttgaacagaccaataataagttctgaaattgaggcagtaattaacagtctactgaccaaaaaaagcccaaggccacatggattcacagccaaattctaccagaggtacaaagaggaactggtgtcattccttctgaaactattccaaacagttgaaaagcagggactcctccctaagtcattttatgaagccagcatcaccctgatgccaaaaccaggaggagacacagtgaaaaaagaaactgtaggccaatatccctgatgagcatcaatgcgaaaatcctctgtaaaatactggcaaaccaaatctagcagcacatcaaaaaacttatccaccacgatcaagtcagcttcattcctgggattcaatggtggttcaacatacgcaactcaataaacgtaatctatcacataaacagaaccaaagacaaaaaccacatgattatctcaatagatgcagaaaaagcctttgataatattcaacatcccttcgtgttaaaaactgtcaataaagtaggttttgatgggacatatctcaaaataataagagctacttatgaaaaacccatagctaatatcatattgaatgggtaaaacctggaagcattctctttaaaaactgatacaaacaaggacaccctctctcaccactcctattcaacatagtattgaaagttctggccagggcaatcaggcaagagaaagaaataaagagtattcgcataggaagagaggaagttaaattgtctctgtttagagattacatgattttatttttagaaaaccccatcatctcagcccccaaactccttaaactgataagcaatttcagtaaagtctcaggatacaaaatcaatgtgcaaaaatcacaagcattcctttacaccaacaatagacaagcagagagccaaatcatgaatgaactcccattcacaattgctacaaagagaataaatacctaggaaaacagctaacaggggatgtgaaggacctcttcaaggagaactacaaaccactgctcaaggaaataagagaaaacaaattggacaaccttccatcctcatggatagaaggaatcagtatcatgaaaatggccatactgcccaaagtaatttacagattcaatgttattctcaaactactattgacatccctcacaaaattagaaaacactactttaaatttcatatggaatctatgaagacctctgtatagccaagacaatcctaagcaaaaagaataaagctggaggtatcaggctacctggcttcaaactatactacaaggctacagtaaccaaaacagcatggtactggtatcaaaacagagatatagaccaatggaacagaacagaggcctcagaaataaaaccactcatctataaccatctgatcttcaacaaacctgacaaaaacaagcaatggggaaaggatttcttattcaataaatggttctgggaaaactggctagccatatgcagaaaactgaaactggaccccttccttacaccttatacaaaaattaactcaagatggattaaagacttaaatgtaaaacccaaaactataaaaaccgtagaacaaaacctaggcaataccattgggcaaagacttcatgacgaaaatgccaaaagcaattgcaacaaaggtcaaaattgacaaatgggatctaactaaactaaagagcttctgtacagctaaagaaactatcatcagagtgaacaggcaatctacagaatgggagaaaatttttgcaatctacgcatctgacaaatgtctaatatccagaacttacaaggaacttaaacaaatttacaagaaaaaaacaaccccatcaaaaagtgggcaaaggatatgaacagacatttcttaaaaggagacatttacataaccaacaaacatatgaaaaaaagctcaacatcactgatcatcagagaaatgcaaatcaaaaccataatgagataccatctgaagtcagtcagaatggtgagtactgaaaaaccaagaaacaacagatgctggtgaggctgtggagaaattagaatgcttttacactgttggtgggaatgtaaattaattcaacctctgtgggaagacagtatagtgattcctcaaggatctagaacagaaataccacttgacccagcaatcccattaccaggtatatgcccaaaagaatataaatcattctactataaagacacatgcacacttatgtttagtgcagcgtcatttacaatagcaaagactcagaaccaactcaaatgcccatcaatgatagactggataaagaaaacgtggtgcatatacaccatggaatactatgcagacatataaaggaatgagatcatgtcctttgcagggacatggaagaagctggaagccatcatcctcagcaaactaacaaagaacagaaaaccaaacaccacatgttctcactcataagtgggagctgaacaatgagaatacatggacacagggaggggaacaacacacaccaaggcctgttgggggtggggggcaaggggagggaacttagacaacaggtcaataggtgcagcaaaccaccatggcacacgtatacctatgtaacaaacctgcatgttctgcacgtgtatcctggaatctaaagtaaaattttttttaaataaagaaatggacaactctctagaatcaaacaccttgaaattccttgaataattaaggacccacggattgttcatcttttcatatacagaccccaacctataattactaattactaattgcagtgagatcagagaaaaaataaatgaaaagtctactttggagtcaaagatatggttatttcaaagaacagtttccctatcaatagtcatttgtctaagactatattgatcagcatgaagtggcacattatagaagacacttctgcacacctgttacagaaaagcctcctcacaatgcctatttctactaactaatctatgctgtccactctaataggaactgaaaaagacaccatttcctcaatttgatagaggatacagtaaatatttacacaacacttaaaatgagagagtatataaacaataatagaaaacaggtaattcagggctagaatttccaataaaaaattttattttgtttttgttttttaattagaggaagagaaagatcaagccatatgtcagatgtacttcattcttttttcacaaaagcattatctagtcataaaatagaggatcacaaaaagagctgaactgatcataaaaagtctgtatttcctgtgcactacaaacaaccataatcccttgaacaattccccaaagctcctaacatcaaacattaatcagtcagtttaggatccatcagcaaatttaggatacctccaaaggggcctgacaggttaggcaaagaaagcattgcataccatcagttctttcactgatagctaaagatctataggtcagagaagggcaggctctgatgtctcctccattaattattgaaggtaatattccagatgctagtaaatcttaataacttcaaatatcagcttcaaagatgtacttttgatgaacaaagccaaaacacttctccttatcaaaaagacatgttataatgcatattttatctttcaacggatatcctctcaccaataaacgtgatctttgatccaaaaattcttagtaatgccactaaaatttctcaaaacaaagtcagtttaaacgtgcttcagttaaaaccactgccctattgctctaaaagaaacattacaaaatgcaactacagactgtcaatttttcaacaactttgggagtgactgtttagacactgtcaaatgatttctaagcaaccctgccacaagcagactggcttgctataaacacaaggtgtaggatacataagaactaatatttgttaaggaatttctgtgtgccagactcttggctgatctctttgggtttgattgaatcgaatagtcatcacaatctgcagaaaggtttggtgacttgatcgcaagaacctggctagtaagggactgagtaagagacttcactaggcaagttaaagtgctgctctacactcccattgctgtctctgtacccagcacgtgggcacaaatgtaagagcctcgtgaaggaaagcataagcaagaacacactgagcagctctaggaagctccttaaggtagaatgagaaacttactcaggcaggctcctgcagttgcacaattatcattcttcttaagtgtgattactgctcaaagtcagaaacatcaaatgtggaaatattatccaagtaggggatccatccatgaaagcaacaattgagagacttctacattctgctctacgacacctggaaggctcatctccgaagtcacattctttcaagatggtttgaacaaaatgcagatctttggtgcagcaattaataggtacagttatgtatacttcaacaggctgaatgtaatctatcttgaacttgcctttcaattactccgtgcttggagcttcctgcagtgcctgactatctcaaagttgctaacgcagggaaataagcctatcagaaattcaaaacacttcatcatcacattttaatcatacaaaatagtaagtcctgagtttagctcattccttgacaagtcagagatgatgaagtctttaatgctcacctatttatacagcaatctttcctcctaattccgtctatcctattctgttatctcaaagatataaccaggtgacagagttcaagttcattaccaagagaatgtatttctccagccaaagcaaatagaatttcgatgaaacttctaagtacctgttataaatgccaagtattaaaggttctttattcagctatttacaagaccatctgtgaagccaacattctgtgatccaaatgcagatgttctatgaaggaaggcaaggctaaaaaagaaaatcctgacaaggcccgtgcagctacttaaagcataaagggaagtgcaatggtcttacgatttaaatataaacctttgttaaatgatgaggaaaccacagcagcagggacctgctaaacaatcactcgactcctgtgattgagctaaaagattatatttgagatgctcggtccatcgacatatttactgagcccctgttatgttcctagtgtgttccaggcaccatagcattattgtaggcctggctcatgtatgctgtgatttggtgtttaccttcgattctgaagtttagaaaacctcttaacagggcttcaagatacttttctcttgtatctgattccaagtaaccctgtatttactcaaccaacagtcactgtaggactattcagaagtcatgttaagtaaaaggtgggttacctagaagctgacagtgtcactggagcggggtcttgaggatctagacattggttctgtggttgcttagaaaggtctgggggccatgagggagggcctatgacagcagggtaggggatattctcagagcaatagctatgtacaatagaaatatttcaatcttttaattaccagtgtgactaaacagaacctcagcagtcctatgttgcctagtatacataaatatttaagtccaagccctatattcaggcagctctccagctaaataatatgctatagaattatctaactttctctatcaagttcaatagattgagagaaagaccagttatctaacagccagaaggaaaatcaagataaaaacttggtgttaagtttttatgtaaaacatgaaactataatattttgctgaataatttcaatgactgcaaatgaacaaaatctattccaccttttggaatcccttttcagttttaattcatatattccacactttctgctacagagatttccatcatgggtcaaggattgaaccagatgatgtccaatgagttgggatttccaagagagaccatgagcagtgctaaaaagtagacattttgtcacaatatttaataaatagcattcattagaaaaatattatccccctttaagcaaatactattattatttctctctataatagaaacagagttctaacataatagtacctattcgttttactcagaggcatcaatcctaattggaaatttttaaaaatccagctcaagttgcaattcacagaggtggcaaatctcctttagagggcacagaaatgtacatatgatctcattttaaaatgtgtgtgtatactttttatttctgagaaagcaacaaaatcctggcttccaataatgtccaacttaatggagcataacttaaactccttttaacaaagtttaaatttttaaaagcccactgaattaaagacatcatgactaagaccaagctggagtgctctagaatctagcttacaactgtttggcctaaggagcctatagcattgaccctgcatacattaaagccacctgtgctcaagtccacttatcactcacacctgcttacaccatgctactgctcactacaataccaataagaacatctgcctgctttagataaagattctctgcacatctaaattagaataacaagtttttgaactattattgcaaaagaaacagcagtcaatgtggtaatttttggggatctctgcctaggtttcattaggctcaccctaatgtctttttcagttttggcaggagggcctgtgcctgttttcatagccaaaagactgccatactcacaaatggccaaaaagtatgaagaaatccttcaagtttcccaggcactgaacaggaggctccaaaccaagtcatctgcttggagtttttattactccaagttctgttataaactgtacctcagtgctcttcatgtacgacatgacaggcaggaaatcatccttacagctttcacatttaacaaggctacttttgaccaaaatgagcaatgaatttcaaaatacagggacatggcaaagtgctgtaactcggaattaaacaaatcaacaccaagaaacaatattctactagcaattcggtaatcacaggcaaagatgataaatatccataatgtttttataagccacaaacatggtttaatctaatcttacactgtttgtgtttataaagccaagacaagggtgatcatctaatattttcataacatctagtagaaggtagttaaaaagatgttacattagacatcgttactgcttcaaaataaactctcaccttagttaacaaaatgtgttatgggttctgtgcacatctgttataggtaccacagagacactatagctactgaactcgtatgtgtgctagacattccattttgctttttaaaaaatatataacaacctattatttatttaccataattatctccattttacaaaagtgagaaggcttaaatttattttccccaatccaaaactgtaactactccagcccaggtgtctcttttaaacctcttgctccgtctccacagacttcaacatggaggaaattcaggggataaactatatccaaagcagcctcaaagattcaggcagtaatttcattatcatgtcttacttgatttgtaccaaaaaaaaaaaaaaaagattagatttcagtttcacgtcttctgtctcttactaattcaggtactaaaaacagttggtatttactgagtgcttattttgctctaagcccttcacatgatttaacaaattcccaaaacaaccctacagggtagatagtagcatcatgctactttgcaggtgaggatacaggtataaagatgttaagtaacttgcacaggtagccaatttgggcccctaactaaggcagtctggtcgatgctttgacctttgtgctacctttcctctacctctgaagacaaaaggtaattgcaaaataaaagtatgatatgctgagaagcaaataaactagatctggtaacccaaaaagtatatgttgcactcaagccctccttgcagtaccaaacccacaaaaccaaatggtgctgagttgtgcattagaaacaggttaaaagacctattaaataagctcagatctgaaaggtaaacaataagctactgaaatatgatttttattaagcaatagcaaacaagtctatttacatttcaagaaagaaatggcaataattcattagcaagacaaaatagagtcaaccaaaccgatgtagtttctctctccacacacccactcccttacacacatactagcagccctatgaaaaacagggttataatagaaatgctgacacaaccaaccttataatgtttcatacgaaaagctacaattatattttctaattgtaaactgggtgaaaaaaaaaaggccaaccagaacaaaaacataataactacctagaaacagtccatcagaattcttggattatgaaaaatgcatataaaacactattatcttcagccacagccagaagatgtcagacaatcaattcatataacatgccagcttaataaaatctgcatacaaaatttatgaatgcagtaatattcctttatatcacaagttattaatggtcaatttaatgaacatctacagctggagtgctttcgttctgtatgatattttaatcatttttagccatggatttaaacgcatttcattttataaccatcagctagtgaagataagaaaacctttacacaaataactgaaatatttggggtaggccaccaattttgtctttatgttgttatttatttccttaaatttttttttacaacagaaacacaatgaaatgttccattataacaatatttgatttaatatttgtatttagaatatgaaaagtttgcttaaagtagcattacatgtttggctagcataaaatcttccatttcatttcaaataaagaactttctaacctcgtttatgtgaaacaatctcgctcagagctattatcctccaaaaactatcctggtggaatgttgacatctcggacataaatattcttgaaaattaatgtgttgtatttcttaagtatcctatttccactcacttgttcacataatctttaaaaatcctattgtgttcaagtctacttttcccacagattctttactaaaactaaattttactatatgatgcttatgtggaaggaacaggcaacataactgcaagacaacagtagctatctgaaaatacaaacattcagcatttaaaatattgatgtctttctgtggtcacaaagtcaaataattgtttctcacatttgagcattagaatttggtatttaaaattacactcatccttcagagttaattgaaagatttggatatataggaaaaaggttaagaaatctaggtcataaatacttcttaaggtgcaagaattggcttcataaactagtaaatgtgcaataatcactattaaagaatgaaagatggcattttttttttttttttgagatggagtctcactctgttgcccaggctggagtgcaatggtgtgatctcggctcactgcaaccgccacctcccaggttcaagcgattcgcctgcctcagtctcccaagtaattgagattacaggcgcccaccatcatgcctggctaatttttgtatttttagtagagacggggtttctccatgttggtcaggctggtcttgaactcctgacctcaggtgatccacccgcctctctcccaatgacagcaattttttagtttgactgtctatagccttataggacattacaggtgaaaatcagtaaaagccatgtgcacaaaagatttagtgcattcatgtgtctttattcattcactctatcttctgttgcttcactggttccttttgggcttcctactatgtgccagttaatctttatttgctctgggcgagtaactcccattcttaaagacctaataaaacaggacacagtacatgtatacccactaattataaaacagcgtagaattgatggataagtgccaaggagaaatacaaatcaagaattcagagaaaatggttcttacttgtcgagaaaagggcaagggaagactttataaaggtcaactggaatttagaggagtaaaagaaataagggtatttttgggtaaagggcacaacatgaaattgacttaaggacaatacacacaaggacaaaaagtgcctatgacgtgagttttaagtttaaaatacagactttcaacaatgcttaaatctgtagatggtaggcattttccaaattcctctaataagtagaatcagcctatatccaaggaagatcataactcattaaatttcattttaaccttcctgaatctgcctaaattttctcatcttatcaggcaagccaatatatgcttacactgtgaggttaaagaaatgaacctgtgaagagaacctgtcaaatcaaattatcaacaagcaatagtcccactattggggaatatataagctgcaatgtcaattttaaagaagtgtgcttacatttgcattttaattaggtcacaccttcaacatcatgatattaatttcagtttaatgctctattttattgccatttccaaaatgacatttttagacatggacataaagaaaaaaatctctacttttgttttgacaacccataaatattgcaaattgaaacaatgttgaacaaagttcaatatttggaatattcaaacgagagatacgactgtgtctaaaattctaaatacttagaattggatttcaaaaatattccaagggaaaattattagattctcatttaagagcataatggagtgttgaatggaacataaaattcaggttcctgtgagtcaccagaagctaaatatgaatagctcagaaaaaatcattttggttaagactttgcattagaattgagacatgctttgtagttttttcagatcaagagggaggtagacaaattacagaatgtatctttgtccattaataaatgacatatactcaaatacataaagttgtaataacattcacataacaaaattcatcaatcattttaaagtgtaaaattcagtggcattttgtacattcacaatgtcatgcaactttcaccatatctgtttccagaatgttttcatcatcccaaaagaaaactctgtggccattacagccattctacattccccactacccactcctaacccctggtaccactaatctgctacctctatgactttgccaattctggatatttcacataaattgtatcacataatatgcgacttttagtgtatagttttaatttttatttttgtaggtacatagttgtatatatttatggggtacatgacatgttttgatacagacatgcaatgtgtaataatcacatcatgtaaaatggggtatccatcccctcaagcatttatcctttgtgttacaaacaatcaaattatactcttagttatttcaaaatgtacaattaaatcattattgactacagtcactccgttgcgctatcaaatactaggtcttattcatgttttctatttttttgtactcattaaccatacccacacctccctgcccaccacctgtcaactatccttcccagcttctggtaatactccttctacttactacctctattagttgaattgtttcgatttttagatcctacaaataagtgagaacatacagtatttgtctttctaggcctgacttatttcacttcgcagaatgacctccagttccattcatgttgttgcaaatgacatgatctcattcttttttgtggataaatagtactccattgtgattaagtaccacattttttaaatccattcctctgccgatggacacttaggttgcttccaaatcttgactattgtgaacagtgctgcaacaaacacgggagcgcagatcgctctgtgatatactgacttcctttgggtatatatccaacagtgggatgtctggactgtgtgttagctctacttttagttttctgagtaacctccaaactgttctccttagtggctgtactaatttacattcccaccaacagggtacaagggttcccttttctctacatccccgccagcatttgttactgtctgtcttttggatataagccattttaactggagtgagatgatatctcgttgtagttctgatttgcatttctttgatgatgaaggatgttgagcaccttttcatatgcctgttagctatttttagtgtatggtttctttcataagcaaatgcttcaagtacattctaacaaatacattctctaattcttctttaagggaatactcttaaagaagaaatggtcaagtacttcatttcccaactgttttctatttttcttttcccaaaactattccaaaaagtttatggggctttgtgtttattgtttatgaggtaaacaaatatgagtttttactcccagatttttccaaattaaaaaggcagtgacaaatatccatttaaattaaaaatccaagccattattgacattggaacttgattctacatatgcattaaaaaaaagacctaacagggggaaacctacattgtgttcataactggggatatccaacagcatcagtatgtcaaatttccataaatgaatccatgtattcaatgccattcctttaaaaaatttcacggccttttcccacagaatttgacaagacggaaaaaaatcatttgaaagagtcaaggtaaagaacagccaaaatgtgattaaaagaaaggaatgcttgtctttctagacataaagatactctttaatcatagtaatcaaaggactgtatcattaaagctcaaagagaccaactgaactcagtggacaggcaagaaacagattcacacatttatgtcaagaccatggggaaagaatagaatggaacactgtttttccataggaagaaaagtagattcataatttatatcacatataaaagatatccagatgatatcaaggcacatatggaaaagaaaacattaatacattagaaaaatatgaaagtactgttatgatattaacactgggaatatattcttaaggtacagccaaaatgcatagaccaaaaggaaattattaaatttcattatactaaacattttagtatcaaaggcactatcccctgtcccgaccccatcacacatatggaaacccactaagattccaagcgagaaataaaaaaaagtcctgtgatggatatgatcacaaaggatttaaatctagaatatataaaaatactaattattgcaaaagaaaacaatgacccaatggaaaaaattggcaaagaatacacacaagcaattgacaaaaagggacacctgtttgcatccaggagcaaacgttttactccactggataattggagaaatgagaattaatccaataatgtggtaccatcttttacccaccagagtggcaaacacttaaaaagtgtgccaatgcaaacatcatgggaaacagatgttttcacccaatgctatggagtatcaactgacacaagcacttaattaggactatagaactgctctccaatgttggagaaatgtgtaccttacaacatggtgattccactgctaggtaaatattctacagagagactcaccagtacactaggaaacacatacaaagatattggttttacatcgtcttaactgagaaaaattagaaacaacctttaaaaaggaataggaaattaatttgtcttccactcagggactagaatacaatacaggaggtaaaaatgaaagaatgagggcttcatttattcatgtagctgtatctcaaaaacaatgccgagtaaaagaaactgattatgtacagcaggacacagtcaagaaaatattaaatacatcaaacaacatgatttcctttttagggatacagatgcacattaaaaacaaataaaaacaaaaaacaaaaaaaaacatgcaaacctaagcaggtagaaaacctaccaacttcaggtcagtaaacgcctctaaagcagttctcaaaagggggtaactttgcctcccacatgtggcaatatgtggagatattctttgttattcacaactaggagggggcatggtattgtatctggtcggtacaggtagagttgctgctaaacacttacagtgcacaggacagcccccacaagaaagtagttatctggtccaaaatggcaatggttacaaggttgagaaaggcagccctaaaaacagaggaaggagaataagatgacaggtggggaagatgaagtgtatctataacttttcattctaagaaaagatctgaagcatgtatgaaaatatgttaaattttttaagaaggactgccacattattctttgtacattcttatatttgaaatatctctttaatcagttcaaaaatataaaaatcattctgcaaacaaacacagttaatttctaaatttgatgaaaattacataattcttttattagcctatttctataaatatatctttggaaaaacaatattctcacactcacgatcaaacgtatttgcactttttttcagtgtttgttctacacagagctataaaaggaagactgtggaagaacccaggattcatccaggatcacaggatcatttcattattacagtttcaggcaagaacattctaaaaccagctcagagaaagctaattccgtcctttcctggttatatagcagatcataataattccaggcaattctctgaagaagctgatgatctagaacagtgggcttgcatcacacaccccatcatgcttccttaagtacatggcttaggatgctgatttctcccaacctcatgggtttcagtagttcctacaaacaactttgagatcaaccagtgcataattttattttttcctttagttccttagtgcagaggatggcaaactttttctgtaaagggcaagatagtaaatattttgggctttgcaggccatatggtctctgtcacagctactcatctgtgtcactgtaacacaaaaacagccatagaggatacataaaggaacaaatgtggctgtgttccaataaacctttagttacagaaacaggcagggagctagacttggctccaagccatagtttcgccaacaccaagatggacagcaaaaatgcaaccagtttaaatactattttaaatttaaggcatttcctccaatctttgaaagtaaagttttatgtatgttttaatcagtgtaaaaattttgtactaccaaaaatgaatttatataaatgaaacaattcaataaatgatgaaaatgttcatttgttacatttatagcatactaacttctttctggaagtatgttataccccctgatttactaaattattaattataattttactagtttaaattatgctattaatgattccttataagaaaataaacacacatattgtatcttcaactaagggttgggaacgacaaggacagtgaaattatactcccaacacaaataatagctttctattaggtttgctatttcacctgaataattccttataatcatgaataatgatgttattcgacaacctaatgatatcatggtgtgtagcttcaatccatctgtctttgtcaagaaggtcaaatatttgtactccactgcactaggcaaagttgaacaaacagttaaacaacatcacacaccttaattactccttcaaatgaaaccagcaactaccattttacctgattctaggacctgtgaaataaaaacctacttcaaagatatttaatctgtatacacttttacaccaaatttaagctcaacttaaaaaaaaaataaaagtggttaaactcaagaaaaagccccaagattttctaagggtattgttaattggttgttgctgtaaaatgttttgtgaataacaaaatattccaggaacttttaacaaagatctggaatacttcatgtgttatcttgacattggcttaaaggtaagaataaagcaatagcgtgatagatgtgaactatagttcctataaatgcttcatagtgtttgctttgcttcgagattccatgagtgaccaaggagttgaaggggataaaaactccccattcactgtttctacagagcctctacaagacctggacccttggggctgggggatggtgaatatagcaaggtatgatgtgggcatacttaaatgatttgcagcaaaataatgtttatattaaaaatcctgttttccttccttccacccttctgctttttcttaaatctcaccaaagctttattgctgcacaaaaatgaagtccttagaaggccttattaatctggttccagactcctagcatcttcccacttcctcaccatgcttcacccccacaggtcttcgtgtttttgaaacggagtctcgctctgtcgcccaggctggagggcagtggcgagatctcggctcactttaagctcctcctcccgggttcacgcgactctcctgcctcagcctcccgagtagctgggactataagtgcccgccaccgcacccggctaatattttgtatctttagtagagacggggtttcaccgtggccttgatctcctgacctcgtgatccgcccgcctcggcctcccaaagtcctgggattacaggcatgagccaccgcgcccggcctctctgtgtttttttaaacattattgagcatgcaaacttgtttctgcccctgagcctttgttcttgtttccttctacctggacttggctgcccattgtcccacaatgggctggtccctcctcgttagttcttacagcacgtgtcaccggcaaagagaagacttccctaccactctgtctcaagcagtccctcactctcaatcatactcttctttttattttattcagaatagaaaatcatgttgtttgtgatttatgggtttacatttatgggtttcatcttttatggtaaacctctgcacacaagaataaaagtaggatcgttatctgactattcattattgtatacctggggtctggcacatagcagaaactaattaaatgataaatttacatattcattcatttacaatagacaactctgtgtctaatttgaggtcagcaaatgacggccctagagccaaacctgcctgatacctatttttgtaaataaagttttattggaacacagccctgtttgcccgtttaccaattgatgatgttgctttcacactagaatggcctagtggtgtagttacaacagagaccacatggcccagaaaagatttacagaaaaagtttgctagctcctggtctactacacagtatatgttctcaaataaataaaataaagtacagtcattgcttttaaaggagttctggtccattgtgtgtttttattcaaacacttttagattaaaattctatggcccaaaagaaagctcctttaaaactgtaagcatcacctagcaagagttgtattggtgctgtggctgggcacggtggctcacgcctgtaatcccagcactttaggaggccaaggtgggtggatcatttgaggtcaggagtttgagaccagcctggtcaacatggtaaaaccccatctctactaaaaatacaaaaaaaattagtagggtgtggtggtgcacccctgtaatcctagctactagggaggctgaggcaggagaattgcttgaacccgggaggcagaggttgcagtgagccaagatcaccccactgcactccagcctgggtgacagagtgagcatccatctaaaaaaaaaaaaaaaaaaaaaaaaaattgtattggtgctctattcattaggtcagctggctgaaatcataaagaactaacacagtgcctggcccctggtaagtactatacaagccttgattggcttctttttggaagaaaacattatatccggtggctaacacagggcttggcacatattcggttggtgcaaaagtaactgcagttttcacaataaaagtaatggcaaaaacctcaattgcttttccatcccaacctaatagcaagtaacagtcaagatctgttgaactgaattgaagtgaacttgactctttcagccagagggactaacaggctaatctgtgaaattagtgggcaaaaaactgattcactcacctgagaacaagccattctgtaaaataggctgagaaaccatttctcaccaacatttttcagggatgacttgaagtaatatgatccaaggagccagatttcaatatacgtttaatgttttttgataactcgttgtaggtagccactatttatcttatttgagttacaaagatacataaacacaaaatttaaacagtaatttgagtcacagactcccagagttgcaatactatcccctgtaatactcagttctatagatattttttcttttaaaagatccaaactaacccacatttacgccagctcttccaattatgactaaccgatgcatattatttctccaaatcttgacggtctaagctaatgcctctcacagttgactcacagatggaagtcacaattatttgggagtggctggctttttgttttgagttccacttcctggctcctacgctcaacttttgaattcagaatccttagagtgagaaatcatggcagagtccggaatctccattttaacaaacaccctaggtgatgctcggtcctttagaaatctgttattttagatcaagagatcatatatccacattaagaaataccaagtagctatcaacttttggaaccactactttcctctattggaaatgtaacgaagtgatactgtgtgttttacttggagttattcatattactgtatattacgtgcatacacatgcatattacgcactcagtacttgtaggagtgaagtactcaaagaaaagctaaaatgtggcatctttgccatccaggcggttctttgataagcagcatacgcataaatgatgtaaacaaatgatacaatgacccatgactgagagaccgacgagtagacatgcaacaagatttcagagaaagaagcaatcaagggggtctaggttgtcagtgatgtgaaaaattgccttctttggatccagtagaggaggcaggaagtacaaaaagtgatagtagttatcacactctagaggtgtcccaggaccttgttcttctctcagttaagacctaagatcttagaacacaggaagagtaaagcaagaactatggccttctaagttattaatcccagcagcctgggaaagattactaaggctttgaaagctggccaaaagtcattgcatctcagtggtcatagaggaagacctgggccaccatgaactgaaccagtaagaagcccctgtctccaaggagctgtcctgaatgaccttgcacggcacagcattctctttatcttcctgtggcatcagtaataaaaatcattggctggtctcctcatttgacatctaatcaaacacttcactcggaagttacttttcttgcgggtttaggtcttaaccctccaaggatcctgcaaagttctagaggacagagtgtcagcaactcccccagtgcttagcacaataatgtcaggcatcataaaaagatcttgtttaatcatttgataattttttatttattgcctaccatgtaccagacattgtgttaagcactcaatagaacagacagctagatcctaaacccaatggcagtgacaaaaccgtctgtagtcatgagggctgacgacaacactatgactatagtaaaagccattaaaatcactttaaattggtgaattgcacggtgtgtgaagtatatatcaaaaatgctattataaaaaaatcaaaatggcagaaaggaagatggtcaagccttagaaattcacttggtgaaaggttagaaaaaacacatccagaacttagttactcctatttagatggtgactgtgacacattagtaatacttgatggtactgtagctgaatactgaatattaagaaaattggaatgcttctcagaagcaacaaaacaacgaaactacatttatgctgtattggttaagaacataggtgtcagaatcagaaaaacatgtgatcagttctaggttctcttccttagttgtgtgactttggtcaaactgcttacctatctgagcctcaatttcttcatcagtaaaataactttaaaatatagtaatgctcaataattcttagctagtaatcaaataatgcaaattagcataatacattctcacttataaaattagcatatattaggaaaattattactattcaatgagtagtagcaaaatgtttttccactttgcttttgggtacatgtgaaattttattgtatgtccactcattgagatctcaaacatttattatcataacatttacataatttatgtgtatgtaccttatccaagaaggcctatgatagcaaagatgctatgtctcagttttctttgaatacttcactcctacaattactgagtgtgtatgcatgtaatatacagtaatataaataactgataaatgtatgggcacatacattttatattggttgtggcatgacttctaatagtgaaagttatgaaacaaactaaatattcaaaaccaggtgaaataattatagttaatcatattgatgaaatattatgaaaccactgaaaatgaagttaatgaataagaaacattaactttaaacaataagaaaaaacttacggtattaggatcaaaagaaagggatatcatactatatgtagagtagtgttgtgttctagttttatctaaaactgttttggagaagatggaagaaaacaaaacattttaaaagattaacagggattatctctgggcagtaggattatgagtctttttacttcatacttttgtgcatgaaaaaaattaacagtattaaattcttgctcattttatttataataaatacatgcagtattgattttaagaaagagcaaataagccttattttacgtatcaccagattatatcacaaagtgacgttaattttactacacagataaatgaccacatagctcaaatgaccagaaaaaaagaattgtgaagtatattctctaaatataagcatccaaccatattgatagccaccaatgtcagtcacacttaaaaagattttttggccgggcagcgtgcctcacgcctgtaatcccagcactttgggcggccgaggcgggcagatcatgaggtcaggagatcgagaccatcctggccaacatggtgaaaccccgtctctactaaaaatacaaaaattagctgggcatggtggcacgcgcctgtaatcccagctactcgggaggctgaggcaggagaatcacttgaacctgggagttggaggttgcagtgagccaagatctccactgcactccagcctggcgacagaacgagaccccgtctcaaaaaaaaaaaaattttttttttggttcaacaaagctgcttagtaagtagtttaaagttatttattattctaacccaaatgtttcacatcacagtaatttgttaaatataattgtataacatagtaaaacgtgaactgccaaatacaatatattgattgaaggagtctcatgaagctttgagagcttcagcgatagtggacaggctgtattcaaccgcagctccaaaggagaaagtgattaacaaaataagaaaataattaattcaaaagaaaatatgctttagaaatatgtgattttttaattgtgagaaggataaaatgtttccttaaggtcatgtaactgttagctacacaggtagcctttctgcccggtagtaagcccaatgtggaaatgaaatttagtagtgatttaatttataattatttttcaaagtttgaggaataggaacaactacattatgttcaatagtctgaaagcacaaattctgacctttaagttcaaagtggaagtcaaactgctatacgtcagcatgacaacatcaagaaaaaccaacaggtcccaggggacaaggggaatacctgcttccctgcccactatcaccccaaaagttttgtcagaactattttggacatttgtcaaagatgtattttttttcctatttagatcatgagctgtaaaaacagaaaaaaacaaaataatgggcagaaatctatctgaaacccactactttttttccttcctttattttaatagataaaaggctaaaccaggtcatctacctaaacaagactggttccaggcctctgctatggctaagtagttaaggaaatgatttttgcaattaggatggtctcatttatattgggacttcactacttactaggtgggtgagtgtggacagcttacttccatacccctaggcttctttcagcatctgtgtaaagggccattaagtcagaattaaataagtggtagctgttattactaaatataaaagcctcatagaaaagatatgttagttattagaaagaaaattttccctaaaacttcttttaaaacatcttatgacaaagttacagaaatatttttaagccgtttgtaactaatacagacgcacattctctctcatatttacacttttcacctttgcttcccatctggaggagatcatcctccaaggtttcttccagcatattttatgataatcagactatgaattgggaatacatattatttgggctctgtttttgattgctatttttcatgtggtaaatcccagaaagctgcccaaatcccctgctgattatcttggccaagatgttgacaaactcttagatttctgctatcccattggcatccattggtattgcaatggcattctttcatccaacggacaaaacctctttccaaattctgacaacttctatattatcatcattcttctaatgttaataagcttgaatttggtaacattaaccccacagttaccaaatatggcctcctcatgccaacccacctctgctttttgtagaagaaactattaggccatttgtaaaagtctggtttgatgactcctcattttgtggcaatttcataaatatgaccaactttatcattagtcttattttctttcaattaatcaacaaagccatgagtaaaatgtgaaaatttaatagtcttttcccatgatttctcacagacaatataattgagctttccatgttattttacagttctttttatatggtaggcactaatgaaggagtccacaaacactggttacatagcacacatggttgatgtctatttttcacatggtactttgagggtggagggtaggtgggaagggatggatgtattccataggatctgtagcaacaagtataaagctaattttgtaaactgcaactcctgaacactggtgcctttggagaaattatttatcatatattatctatattacagagattgtgtttggcaaatccacggttttagagtcagtacacaaggcagataatcatttgtctgaaaatctcggacaagtgtgtttactatctatagtagatggcaccattttcttcacaaatatttattctcctcttctcctacatcgtgggaggagtatactactttgctttactgatttcaagatggtcatgtgatgtgctttggccaatggatcacaagtggatataacacacggccctcccaaaggaagctttaaacgtatgtgtgtggtctgggttggccttctaacctcctgccctctaccataggagcaaaatgttccagataggggctgcttcttcagcctgcgtaaatggaatgagaagacaatggagcagacccaaagccagctgagcccagccaagaccagcagagccacagctgacctgcagatttgtgaacaagaatgaatgatgttgttgtaaactaccaagattccaggttgttgccccataaaaactgacggatatactatccctaagtcttaattacttcatttaataaattgtgatttagtgtgtgtaaaacatagtgctgaagttactatagtgaaaaaaaagcatatactgcccctgctctcatagtctagaggaagaaaatggaaattgcaccatcattctagcacatgtgaattacaaacaagtaaatgctatcaaggaaagaaatgtggttccattagaacatataataaaggaaagtggccaagactgaggtttcaaaagagcccttctagaagaagggatacgtgagttggcattggtagaatgaacaggagttagcaaggtaaaaagacaatgcaaaaacattccagtcaagagagaaacaacatgcaaaggcctatggctaaaggaaacacgatttggtggaggaatgaaagaggctagtatggctgggcatgaaagaaagagggaggcctggcatgtggtgagattagagagaaagactgaagcaagaccagaggcctttaaaggccatgttttaaaagctagggtctttatcctatgtacgaaaggaagctagcaaaggttttttgttttgttttgtttcattttgtttttttacaacaacaacagcagcaacaacaaaacttgtattttaagctcaggggtacgagggtaggttagttacataggtaaactcgtgtcatggcggtttgttgtacagattatttcatcacccaggtattaagtctagtacccgttagttatttttcctgatcctctccctccttccatcttccaccctctgataagccccagtatacattgtttcctcggcccatatgtccttgtgttctcatcatttaactcccacttataagtgagaacatgtggtatttgctttcctgttcctgcattagtttgctaaagacaatggcctccagctccatccatgtccttgtaaaggacatgatttcattctttttatggctgcatagtattccatggtgtatatgtacaacattttctttatccagtctaccactgatgagcatttaggttgattctatatctttgctattgtgaatagtgcttcggtgaacatatgcatgcatgtgtctttatagcagaatgacaaaggtttttcaatggggataaagtaaggagttcttcatcagtttgtgtttgataaagctctgactgctagctacatggagaatgtattgcagggaatgtagagtgaagacaataaataagctgagtgaggaatgctggtggcttggattagggcactggcattagaaattagagaaatagatagatttgtgaaatttaggaagtaaaaccagcaagatcagcactgtgaatacagtattgcatgttagaaaaagaaggatgttctatagtactactatccatgaagcgatagatcttacaataaagaaggaatctaagaaataatgtctctggattatgaatttgacttaatttatcaattaggtttgactacttgaaaataacccataatggtaggtaatttcaactccctgccaccacagttacaggtggaaactgttattactgaataatggtgtgagcataaatgatgtttgtcaaacttgtgaatcttaggaaaactctttggacaagtgagtgaatattaatttagacttcattggagagttcaagttttttctctttccatataatctatgtcatctttttggaaaaggtgaaaacaaaaaaatagataatacaaagtacttcaaaatgccaaagactaccctctgagctagcttgaattctattccttctatttatttggatcaattcttatccaaatctgtgagatttgtatattatgagggtgttttctttgacatcttaaagttcaaagatgtgtttcaacaatctttagagtaggtacttatggcatcacagcttagcttctcaaaaagccaattataagacacagctgttaccatgccaaattcctatatatttggttttaaaaaaaactaattctacacctggctgatgaagtaaagacgaacgtgatagtataaatgtacagacacaaatcactgctttaagattccctctctagacccacatagtacatatctgtggtgtctaccagctaagcttctcttcctatattcccacccaaattcttttggggtacctgcaactcccccattgcaagcagtcctggtaggctatcaaataaaacaccttatctaccaagcaagagatccaggacaggccaaacagatggcgtgctccaggaatgtgactcttggcgattccaaatgataccaggacatgtatggttggagctacatcacttcaatggcagcatcctgaggagactgtcattaccgcaaccaggatacccagagctgccccaacttctattatttctgaggcctgtttgtgcttagctttcaaatttcagtctatgacctgcttcccatagctttccaatcttgtgtactattacataagtagaagctgattctcagataagacaagttgtccaaaatcacacagataataaatagatgaattaggattcacatctctgttagactgaatccacattcataatcttaataaattcattatactgttcctatgatcacatctcaaatggaatttgtaaaaagcccagtaacatttgtttattgccttagcctaccacttagaaattacaatgaaatgttaactatatctgctattttgctattcgcaagtgacagatgacttggaaagcatgtccactttagtcctctaagcacatttacattttcatattgccttcacatgacatttctgtggctacacttgcaatccagactagtctttcatcctctgttgacaatgatctgtttcattttcagagaaaactacccaataagtctctttaacgttatggatatagtctttctaaggaataggaagaaaatattttttcattgtcttacagtttttttgtttcaatgaatacatcacgtacctggtaaagaaaccttgctaccgtctcaacctttgccaacattatcattcacagagattccaatgagtgatacaaaccctagcagcttcagcctacagcttggtgaggttgactacaaagagcgcccatcccagagttactagtactcttattttgccatctttatttttgtctctggaaaatgaataaaatgtcagcttcagtagcaacatactgtggaattcataaaacaaaggtcaggtatgaagaacacaggaaaccaatggtagcaaaaggaaacccaatgcctgagctggccatcttggcgagtggggaaaactagaacagcactgaaaaccaagcatagttaagccaggattgatgggtaacagctgcactttgcaattcacctgcaattcagatccaatttcacatattctgcaagcccaaaaaaggccaattattgttaagtttctataagagtttaaacggccatgattcatttttgttttcctttaggaattttaggaccccctaagaagtattctctcttctacatatcatttctaggccttgaatttgaatggagcatctgctgagtataatggacctatttggccttttatctcattttttgtgaagctagtcaaatatgtatccttccactagggtcagcatcgactagatggactaggaagaatttcattagaaaatgagatctcatgggagacgataaagaccaggcttccaagacagagatgtgagttcaagtctctggtatttactagctgaagggctgtgggcaatcatgttaccttcttgaacctgctcccccacctccccccacacacacaatatagaaatacctaatttgtacaattacgaatccaaaatattaaatttaaatttaaggttttagcacaatggcacataggaatgactatagtgccattattaaaaatccagtaagtgcatttatgcaccatataatgtagtatatgttgtaaattcaatagtacataatagaatcatagtctctaacctcggaggtcttacatctaatgttaatgacaaaccaagaataaattccagtaagggggtgaaaagtgttctgatgatgggggaaatgcaggtaataatgagtagctattttattattaaaaacgtaaaacacatgtacagcagagtggtcaagaatctaaactctatcatcagaatgcctaggtgtgagtctcatgtctgcccattactttcagtgagactttgcataaggttatccatcagtgaaattaaaatgataatattaactatcttaaagggttttcacaaggattaacagagaaaatatgtatcgtactgagaatggtgctggagatatactaatccttcaataaatattacctataattaccaccattatgccaattccatcagtactgagctatacagaaatggtcgacacccttcagaatgtctccttctacacagacaaacatcgctttatgtgttttaagacaatcaagctataactagagaaaaatctaaggtatctctaaagacactttcaactcagaccatttatctttaatcaaaaatttggaaattttgatgttaaaattctgaaattattttgagggtactatagggtcttagaataaatagaagagaaaaataaacataaaatgagaggaagcacccccatagtgctggattttaatggaggtatcagcatcaatccatgatttaaaatatatgtatacatattttccagtcctttctaacagaagggcctagaaacaatgtcacctgagtagccatgagcacacttaatgcccagatcttggtttctaattatcttctatttaaatgaaccatatagctaattccagatctgaagcagggaaagtatgttatgccaggaaatgaggacagcttatagataaatagggttatctcaaaagggcagagacatctgaataaagggacttctgctgtcaaattgggcaaatttaatcaaaatgatataataaatggattctaacaccttgaattaaaagtgatctcagtttactagatgagagagaaacagcaacagacaaaaaggggctaaaaaaattgaggagaggtaaagttcttccttacagaataatgtctgtaaatatatgttgaaagaacgacaaaaatagaaagctaacatcttatatatcccatattataaatgactcaagccagaatcaccaacaaatgctaaaacaaacaattaggggaaatcttattgtggaacaagacatgtctattaattcaagtcacagcaaacctaggaaaagattgactgatatgtagccatggtaataagtagcatcctgaatcagattaaagtctatttaattggcactttctagtcaaccaatcagtaacagccctttattgctaaaagacagccagtcagcaacagactcatacatctctaagtgccaattaagcaacctgccccactcctcacctgaatcaacatgtttccacatatgtcagcttacttacttctgaaaatctacttaactccatactttccactttggtctactcagactgaactcgaccagcatagttctcctttacaataaattcagctttgtctttgaatttcagatgaatggtgaactgcattatcaccccactatataataattaaaaagaaaaaaactgtgtcttttacagtggggtaatctggcagtcatcaactaaccaaatggtgaaacttggcattgtcattagtgatgccaatagcctgacaggatgtactgatgcagaggcaaggggacaacataacctatttggtgtccttgccaaaaatggtttaaatgaaccgaatcaggagaaaacaatgagatggatcaagatagtaggctgttgcatgggccatatggcttggaatcttcaaataatttaatgtcatgaatatccaagggagttagacaattgatatatattttaaaatatttaataaccaaatgcaatttattaatttatgaataaccaaaagcaatttaggaaccttgactggatctgtgtcatggaggaaaaaaagccaactgagaaagcaaattgagaaaatctgaatatggaaaatatgatattactgaactaatgtgaattttcttgggtgcagtaaatggggttagttgtgtaggaatgtttccttattcttggaaaatgcaagctgaattatttaggagtaaagcatcctaacatctgcagcagactactgtttgttagagggtttggcacaaaggaagtgtctacagagacacggcacagatatatcaagatgtcaaagttaatgaatctcaatgagagataaacaggtgatcactgaactgttctttcaactttactgaggttgaaatttttacattctatttacttttattctgaatcttatatacacagaccacccatggaatttcccaggtatttttcttcagcctcaatttctcacttacagtaaaaataaatgtgttgtactctgtttttgtaagtcagctcaaaactttattggcagaaacagtggtccaaataagcaaagttcaaaacatttaataataattttcccctacataaaaaaggcaaatatttttcagttaaggataacaaagataagattccctttggagtttaaaatcctccaatctttcagctttgtccatgtcattatcctcagcaaacacacacaggaacagaaaaccaaacaccacatgttctcacttacaagagggagctgaacaatgagaacacatggacacagggaacaatacacactggtgatatggacaggaagcaggagggaagggtccctggtgagggttctactctcaagcctggacccatggccttaaatgagaataggcatgcttgtttttgtgcccagatgttgccttttccaaaaccactctgacctgccctgcaccctatcctgtgcccataagaaccccaaaccccacgctccatgagcagaagagcagcagagcggcagagcagagaacaggagagaagaggagagaagtgtctgaacgtggagaggacaagaggcagctggacatcggagactaggttggggagaagtttggccagggacagccttactccaagggaagattatcttcccactccattccctttccagctccccatcctgctgagatccactttcatcacccaataaaatcctctgcacacactacccttcaatccatttgtgtgacctgattcttcctggatgccagacaagaattcaggaggcactgggtgtggaaacccaaaaaggctgtcacactgactcttcactgagctggctaacacttaagctgtctgtggatggcaaggctaaaagagcattgtaacacacttggacgctgccatggggcatgcacagggcctgcttctgctggagagaagcagccagcagttccagtgttccttcactccggttcccacacccgtttccttgcacgctccctcccgtggggagtggccagcagtgggctgagtaaaactagcagcttcagttcctgccagcgaagtggtcaagggagctcccgtttcactggggcctgtcgaggaggtggggagaaggagagcatcaggttaaatagctaatgcatgcagggcttaacaccaggtgacgggttggtagatgcagcaaccaccatggcacatgttgacctatgtaacaaacccacacatgctgcacatgtatcccagaacttaaagttttaaaagataataaaaacaagagttataagtggtggaacaacaacaacgacaaaaatcctccagtgtttatcataagccattttgcctccaatgtcagtaagacaacctagaagtctctgagaggagagaaatctttccagatccatcaggagacacagaagtcacatgaaagcgttcctacagacacatgaaaatgctaagggtatctttggacactgaggactctcccaccaacagccacactgacaacagcctttggtgtctcactcagaggagtccctggtgggaagccaggctgtaatctgtcacaagagcatgtgagcagaggccaccttactagataaaatgcagctggttaccgcattccctggagggacagtgacctccgacagacaaggtgaggcaggcagacaaaacagtgggcaccgcaaatgaacaggcaggcgcggagtggtgcctggaggaaagcctctgacctggagccgagggagagctgctagataaacaagccattataagagggtaatattccatcctagtgtgagcggaagctgggaagaaaaccaactgtaggcctgatgtggactgcagctggcaggaaggctgcagagctcggttcaaggcaggagatcctgcccctgtccctggcacagaacacaaacagcaccactggatgtggtgggaggaggaggaaggaaaatctatacatttacgggacgtgaaatgcaagaaattgagggaattcgtccaggaaggaggaatgacaccattaatatcagtatttatgggcttacaagaagataaatgcatttcaagagtagcctcaccccaaagagaactaaccacacaattaagatcaaggctactgtcatagacctggctctgctttgaaaaacaagctacaaagggaagtttgggctttaatttaaaaaaaaaaaaaaaatgttcacggaaataagagaaactttaagaaaacttgtagaacacaaaaatcacattagactcttctataattctcataacaatagaaacttaacaataatggagcttatatttgaatgcttcatatggacgagagagagtttaagcattttgcatatattaactcacatgatcctcacaacaattccgctgggtagatactattaccgcccatttgaagcataaggtaactgaaggaaatctaggttaagtaattcccagggcttgctcttgtaagacaactgagcttggattcacatccaggccctcagctgcaaagcttatattcctcagcccatgaatactgcctctgggtatgcaaaaatcacctttgccttcaggaaataaggctcacatttttaagtgaacactcaagttgatatagtggggaaggcggggaaggcagggaaatctggagctgagacaaaggagtggggaaacatactatgggttcagaggacctatccacaaacctgttggtctctgtacctcttcacgctgttgaaaaattgactacaccgaagagcttgaatttatgtgactatatttgctgatatttaattccaagttagaactaagaaaattctaaaatatttattcatttacttaaaataataaacccatatgttaatgtaatattttaataatattttctaaaacaaaaaaactagtgtgaagagtgacaaatctctaatgaatggcttgatagaagataattgcatccttatttctgcttctgtatgcaatctatcatgagatgtcttcgctaaagcataggaagaagttggcctcatatagacatatagttggaaaaggaactacttcacaaattctgcaaaggtcttggggaccttccggggccccaggaccactggtctagagaaaggactctagagttagaccacctggatttgaaacctggctctgccacttaatagctgtttggtctagatcgatttagctcatattatctcattctctcatctataaaatggagataccaacagtacccacctgataggtttgctcatgagtgctaaattaatatttatcaaatgcctagaacaatctcagagcataaatattatatgttagatgaataaataaaatgacctggctttgcaagaagcatctccgccagagtaacgtctctgtactgaattgtacattctgacagctgagacaatgacagggatcacttgagcgaaagtgatcaattacacccatgttataatagggataattataataggagcttcagtaaattgagaaatcaattgagatacaaacttcgacttcatgggagctaagaaaacataatcatttgaatctctactcctctgaggatggatagcaacatcctttcaaaaccctttcatgttcaaagtcacatcagacaggggaaattctttaatgtaatttctgttgcattttggctataaaaacatgtcgagaagttgttaagctgacaaattccaaggtatctcttaatgacaaaaagtgggtgaatagttataaaggctcaagagttaatgttattttagggttaagttaaatatatttttacctgtgcaaatttttatctatttcatttttaaaaattgataaaggtcattcaggaggtgatttgagaacacacaacttgttgtagatatctttcttatttatattattgccatatatgatgcaatacatgtaaaattcttccatcccatcctactatacctttcacatattctttgacattttattccctccatcaaatatgagttgtcttttagatagcatcggaatcataggatactaagtagctacttcctctgtctctctacacccacctccctaaaactacaggcggctgacccactgatattactatgaattttttgctcttcatcaacggtcaaagggtggtcttcagtccaatggcctggttaactgggaattgccatatatggcttatcatttttaagaaattacaatattgcagaaagcattttatatgaaaattatattaaacataatctagaatgtaaaacagcaccataacgtcatattgaatatagtacatttcatgactcagaagacacattatagttgtgccacaatccccaagatctgtcttttcaatattacccctatgcaggaaacatgtgaaactagcaattaatagtataaagaccaacttaggagttctgtaaagaagttagttagaatgtgaaaacaccgctgtgcttctagaaccatactgcccggttcatcatgacactcctggtctctccatttataaacttggaaataccattctttaccttcttcaagggtggccaggaagatacagtgaatttttaaagcatgcctatgaagttccatgaacttgttggtgatagtggactagcaaaataaaaattagaagaaagaaaactcattcaaaaaaaatcacaagaaaatacgcacaaatatttaatctcaggatagattttgcataaaagaacaggaaaaactcataaatgaccaagttgacaaaactatgacaaaatttctacatgttaataacatcttaaagaaactgaagaggctagggccaaaaaaggaacaatatttgcaacaaatgtgacaggtagagggttaattcgtaaaagatctctaacatattgggtttttaaaaatatcccaatagaaaaagaagcaaagcaccttcataggtaacttattgataaaggtaatgtatatatatgtttaaaagttaactccactagcaattagataataaaatgtaaacagtgagatatgtaaaatctatcaacttggaaaaggttaggccaaaacaaaaaacctaattcttgaagtttatgagatgtgtacccccatgcagtgctagtatacaataacttccgaatgttcatccatttaaacaccacataatattatagcaagtagtgattccagtttaagaaatttagcagaaacattaccaaagatcctgtaccaaaatatttgttacacatatgtcgaaaagtcagtaataactaataaattatagtagatccatatggcacaatattataccatcgttaaaaatttcatttatatgcaggctgggtgcgctggctcatgcctgtaatccaagcactatgggaggcagaggcaggcagattgcttgaggccaggagtttgagaccagcctggccaacatggggaaacttcgtctctactaaaaatacaaaaattagctgggcatggtggcctgtaatcccagctactcaagaggctgaggcaggagaattgcttgaacccaggaggtggaggttgcagtgagcaccgaggtggcaccaatgcactctagcctggacaacagagtgagactgtctaaaaaacaattattttttacatacatattaaaacgtcagaaaaatgtcaacaatgaagtaggttaaaatcatgttataaagtgtttctctttttcaagagaaacatgtaagaacaaagaaaaaagtagaaaggaataaactgcagttttggcaaaggttatttctggaaaataagattatagatggtttttattttgtacagtgggcagatattcttatgattagaaaaaataaatgaaaggtttaaaaatgggttacacttgatataaactagactgcagcttcatagatataatttaaacaaaacgtttatttagtcaagcaattcattagctggttactggtagactgcattaaaaacaccaaatagtttgaatatatttacagttggcccttgaacaattaaggggcaagtgatcctgtaccactccccatctgcatagttgaaaattcacatgtaacttaacttcccaaaacttaactactagtagactattgttgactggaagccttaccaataaacacttgattaacaaatattttgtttatgtattatgtattgtattcttaaagtaaactagagaaaatattaatattaagaaaaccataaggaagagaaaagacatttacagtattatactatatgtattgataccatagcttgacatcatctatttacaagatgaatcatctgtctaaaactgtaggtacatatcaaggaatttaaccttttcttgtaacatcatggcttttctctgcttcttgggagcacgtccagcatcactagtgacccttcatgttagtcccatggtactattccaggtttatggtatgcatcacacacaaagaaaaatgagaaccatgagagatcactttttactgtgaaacaatttactggagtgaccatcagctcagagatgattagtgtcctgaggagttttaaacagatactcccaacacttgagctcaccccaatagcaatacaaggtggctacaaatttcttatagtacagtatgtactatagttaattttatgcatttatgatttcatacaccatctttatatttctttatattcctctcaactgcaagtggcaccatgtccagactgtgtttgtgtgcctacgtttcgataaattttaggcttgtttgtgtttatggtactaaatgatagaacagactagtatctacatatattaatgacatacatttattctttttttagatatttctagctagttttttttcaaattgtcacaaatgtccaaaaaatttttctaatatacttattgaaaaaaatccacagaagtggacccacacatttcaaacctgtgctctccaaggatcaactgtaattccttttctccataacatttcagtagtatcagaactacattaatgctccgtacctcctgtgtacggattatatcaggaggctgagctgtggatgaaagagattttaaaaagaaacagtagtgtgatttgaaactaaataaaagagaaacatctcgtctagagagcatgtcagtcctagtccaaacctttccagcatgtacaggctgaacactccaaaatgaaggtctactgcttattgctgaattgttggtagtctcaatgaccccaggattgcagagatgcttcactttcaaaaaaaaaatccattaaaattagttcaaagaggacactaacatggtgttagagggtcatttttcaatgttgtgggtggaggagcgagacacttagagtaactcccattatggttaatgagagttgagcatctagactcatctaaaccccctgagggtttaatttaaaaccactatggcaaagcaactctaagccatgaatgaacagcagcatttttcacacacctacctcttcccaagtaccaaaaacagtagaaataataaaggtgagtttgtttggttgggtttgatttttactaccatgcctcatagaagagaaaaaaaaaggaaaaaggctcatatcaaatgcctataaattttttggtttattttaaatccagggtgttattttaatgccatttttaaatgactaatttaaacttgagtctgggtttttccagttgctatgtgatgttcacatagaaatgcagtatttttttaaattccatttaagcttcagttttacaaatttagggctaccattatataatgtccattccaagacccatgctcttgatcaaccttaaggcatcaggataatggacaataaaaaaaaaataagtattattattattttttgaggcggaggcttgctctgtctcccaggctggagtgcaatggcatgatctcggctcactgcaagctccgcctcccagattcacgccattctcctgcctcaacctcccgagtagctgggactacaggcgcccgccaccacacccagctaattttttgtatttttagtagagacggggtttcaccgtgttagccaggatggtctcgatctgctgacttcgtgatccgcccacctcggcctcccaaagtgctgggattacaggcatgagccactgtgcccggccaaaagttataattattataccatgcttccaatatgccaaatttattcattcttctgacttccatatcaccttgttttaattctctcacaagagcccaggaggcaggcaaatacctgttttcatagcagaaaatacctttatcttcacatgagcaaatcaaacaaaaaagaataaatgacctaagtttccccatatgggactaaaatacatttctccaattccctgtccaaagctcatttgcagttttgacaagtacaaatgttttgtacccaaagacagtaaatgaggcagtagagccattggcaggcagagctctttcttctcccatgtacattcaacaataccagaaacaggactgagagagccttgtaaccatcatttccatggtttgagttttgtggtagggtcagggaaggcctctgtgtgtaagtgatgacaagggaacaggaattgaaaggaggaaaaccagggaccctgtgtaggtcagagggtggcaggtgaaggtcagaggaatgtcagattttactttaagtgaaagaaacagcaacagcaaccagaagttttttttttttttttttctgacacagagtcttgctctgttgcctaggctggttgtgcagtggcacgatctgagctcactgcaacttctgcccccctgagttcaagcaattatcgtgtctcagcctcctgagaagctgggattaaaagtgcccaccagcacacctggctaagttttgcatttttagtagatacagggtttcaccatgttggccaggctggtttcgaactcctgacctcaagtgatcacctgcctcagcctcccaaagtgttgggattacaggcatgagtcactatgcccagccagaaacaaccataatttcttaatgcaaaggaacaacctgttcttgtttctgtatttttaaaaatctatgtcagctacatagtggtagactggaggatggatagtggtagactggagttgcgggagtgataaacaaggaaacctgagagctcactgcacccagttcagacaagatttggcaggagtagtagagatgttgagtaccagactcagaacatatttttgagaaacagcctccatgtgcattggaaggatgttttgagaatgctgtcaattacatattctggcatcatctccttgaggaagaattcacagaaaatcgcctgatctctggtgttgtgcacatttctgcatttttctgaacaatcagcctatttttacctcaagaattgatgctctttccttatttaggttggtgatagaaagttcagggccaactttgtgacccatctgtttttgttggttttcaggctgctaaagacacacccaagactgggtaatttataaagaaaaagaggtttaatagactcatagttccacgtggctggggaggcctcacaatcatggcagaagtcaaaaggcacatcttacacggcagcaggcaaaaggaaaaatgagagccaagtgaaaggggaaactccttataaaaacagcaaatctcgtgagacttattcattaccacaagaacagtatgggggaaaccatccctgtgattcaattatctcccacgggctccctcccataacacgtgggaattatgggagctataattcaatatgagatttgggtgggcacacagccaaaccatatcactatctctagcaagtatataaatattttatatctatttgatgcactaatctcacttttggtccatcttactttccttttactacttcttgaattttgtagtttgcttttttttaaagcacttaaatcttactctactttttcatagtcaccttaaatcatgttttaaaaattctaggaaataaatgaataaacaaactaaaattgtctaatggaaatttccttgattattatagaaataataaatcagaagaaggtttcatcaaagggatcatcagaaagaaatagagatctacaaaagggcatgttatgtaaggcaacctgtatgcatgggaagccaagatgataaagccataaaaacttgactaaactgaagaaattgcttacagagctgctccagacttcctgaggaaggcaagacagtggcatatacaatcttgggaaatcaaatctcatgagccgacgagttatcaaacccttctgttagatttctctcagctgaggaaataactgatttcatcagcctggctggaatccacatggaaatctatgaaacctgtgctgggcatgggaggggttgagtatttttcatgctcaaaccacctgttacttctctctctttcaaagcaggccactttggaatgatgaatattagttatgtctccaagcatgtgttcatgtgtgttaggtacatagaaatcctggttgacactatgttaaccattgcagtatactgcctggtgtgagaacttaccacattattctacttgttaaatgaggaccgttgtcctcttttatctttagagctaaaaagccaacatggtcaaccagggtcactcatctagcaaatattcatttaacaaatatttactgaacacctcctatgagcctggccctgcccaggcagaggagatgcattcatgaataaacctgagaatcatccctgccctcagagagctcacattctagtcagcctgagacacacacacacacacacacacacacacacacacacacacacacacacacaaataaattatataataatttagtgtataaacactacaaaggaacgtcatgtggtaggggtgcaattttaagataatgggaaagactattctgtgacatttgagcacaatctaaatagaggtctgaaggagttgagtgaacatagcatatgtacatctggggaattggcattccacgaagaataaacagctgctggttcaagggctatgaggcagcagtgtgcttagaatgttaaacaaacaacaaggaatctagtgtggttggatctgagcgaatgtggggagctttgaaagttgtatgtagctgctgtaacaaattaccataaattggtggctgaaaacaatagccattgatgctgtcatggttttggaggccagcgtggcatccaggtgtcagcagggccacgctccctctttgctgctccagcttctgatggctgtcagcattccttgacttgtgaccacatcactccagtctgccttcacgatcatgttgtgtcctccttttctccatgtaatctccctgtctcactcttataaggacactgccattggatgtaggatttgcctggctgatccaggataatctccccacctcaaggtgagatacttaactcacacatccacaaagacccctttcctaataaggtaccattcacaggtttcaaggattgagatatggacatctcttttgagggatccccattcaactcactacaggaaaaatggtaatagatgaaatcagaggggcaatggttgatggcagggggtggatggaggagtacaagtaggaaccttgtcaatcactgtgataactttggctttagttagaagaaggtaggaagccactgtggggataatgagagaagtgacatagattcaacaagtcttaacaggatcactccggctgctgccatgcaaaaaagttccaatagcatttaatccttacattgatactttgttggcttaagagcatgccaaatttagattagaaatgaaaatgagaagaacctgatatacagatcttcagaaaatatttaataattaaaagaatattcctctacctaaccatcctgttttgaaccaaaattaaatttatcccataaatatttatcaaccatctaatatacacaagattctgactctaagaattgaagggatcacaccctacctaatgtggtattgactgacaaccccttttttttaagatttatgtcatctctttgtgtaaacaataattgaagaatctcaacttagtgggagaaagacgtgctaccattatattctttgccattacttttccagccaccctatgttgaatccctttctggctctttaataatatcttgggcagaacgtataactatgtagtcactttccataattgtaaatctctccattttaaaattctagtcttggttcttttaaaattttatatcctatcaagcacagacttgagatgcaacttttattacttagagctctctacaagtgttcccccatagtgaggctaagctatgctagcgttaaaggcagagtggtcttaggtatcaggttgcctgtcaacaggtgacaggtggccaggtgtggtggcacatgcctgtaattccagcactttgggaggctgaggtagattgcttgagctcaggagtttgagatcagcctgagcaacatggtgaaaccttgtctctacaaaaaatgcaaaaattagctgggcgtggtggcccacacctgtagtcccagctgttcaggaggctgaggtgagaagatcacttgagtcctggagctcaaggctgcagtgagtcaaggttgtaccactgcactatagcttggatgacagagtgagaccctgtctcaaaaacaaaaacacaaaatgaaacacacaacacatacacacacacacacacacacacacacaaacaggtgacaggtaagtgtccctggtctagctccagttccatctgctgggagcctctgcaaatacggtagtctgcactggtgaattaacagacatgttttttccaggaaggtagtaaagtctcgcccccgtttgtttctgaggatccatttacaaaaggacagccatgtctcccttttaggtctgccggtgttccatgacccaatcccctctctggagaggccagcacctcagttggcccagcatctacctgagcaacctagtggtgcctgcctcctactcggacattcatggtcatttacaggaaccgggggacctgctgaggttggtgcttctgggcttcttcaaagggctaccgaaaaggtgaaatagtgtagaaaagttgttctcatcttttttcccaggaacactactcctcttcagtgacttcttgctctgctactacaggcctctccaacaagcctcccctgccccaccctacattcaagaatgcaaagatgagaagcaagcactcttgtgtgctcatgtacaattccaaactccacagagcacatgggaagctctccaaaagcaattgtacctccctgcactcccagatcatgacagtacctgtgtcagcctgcaggtcctacagcttcgtagcatcaagccaaagaacaagatgccagtgtcattttgtggaaagcatcccccaagagatgtgacttttgaggcagtgggagtaattattccagaagagggaagaagaaagcatccctacactcctcatttcaactgtcgatctttgtcctcacgtatcctctccctttgcggtttgggggcgtggaggtatgtttcagtgaggtaggaatggttctgctgctgcctctcagtaatgtggatgtggggagcatctgtccccacatgtcagcattcctgcttaggccttagctgtttattccgcggaaatatgaaaagtttcactcaacatctgctgcactcctgaacttcaattacattactgcagatatgactccctgagagatggcttctagagtcatttggtccctaaacagaatagaaaatactaactggtattctaggcctctgcatgtgaaacactctagattttcatgtaattcctgttgatttatttttatcttgacacatcttatttaacaactattaaagcaatcatctttggtgaatggaagggtatcatggctaacttttaaagtattagcacgtaaatctcttgaactgaaaattaatcttaaagataaaaagaagttcttgataacttcaggcatttcaaaacctatcagaaaggagaaaaattggagagccagatgaatttagctcctcctggacccattttatctcagagcaaattatgcggctaaccaagctaaactgcctggccccatatagatggcagtggagagtaaggcttaaaccttctagactttcagaagtcactaaggttggtcttattcttaaatgataatgaagcttacaataaaataataaagccactaacagcaaaatgcccataaaaatataaatggcagagtaaagatttaggaaaatacaacactagaaagtggggctaatgggaaaggtttaaactctagggagaagaacttctcaggacacccaccccaccgtacatagaagtttgcagcacatgtgaaatgtaactggagaaggtgaaatgaacaatggaatgagaatcaaaagtcctgggtaaagcccagactcccatgaactagagccaccattggtctgtgcctcagcttttccattcaaaccactcataggccaatgaggatagaacaatttttgtttcagaaaggttcttgctctgcagcccaggctagagtgcagaggtgcaatcacagcttactataaccttgaactcctgggctaaagcaatcctcctacctcagcctccctagtagttaggactacagatgcatgccatcacacctagccaataaacttttcttgtagaaaagggtctagctatgctgcctaggctggtctgaaactcctggtctcaagtgatccccctgcttcagcctcccaaaactctgggattacaggtgtgcaccactgtgcctgtgtgaaacaaaatattgactccaataatgcattgttagtcataaaatataattttaattatttaaaattatcttaatgtaagatattagttatatgtatataaatatactctccactgccacagttaccccaaacacatatacaaaaggaaaagaaaggaaggaaggaaaaaaggaaggaaggaaggaaggaaattgcctcagtatcccccatgctacaagtaagctttcccttaaaccactattaggaggctaagttcagtgtgaggaagatgaccatttgatacgaagaaagagttctgttggtcttaattaatcagctaacctacaactatgcttgacttaattggtcttgaagaacaaagaacatgcttggtcttaggaatataaaggagcttcttccatctgtttttctccctctaaaatctccctctaaaatctactgagaccatgtgcattggcatgtctattcctgttattacaatattgaaatacacaagtattacttattacccttgcgtgctgctcaccacctcttttcttcctcccctgggactctccagacctccccacaatgcacaaattaataggctgatgtctggcacagtagagagctttcaggaaccacctttgacattggtcagtaccacctgtcatactaattgttacacataaacataactccactgcctaagacatatccacccatatcctgacccccaaatgcaggcagatacaagctaaaccaaggctcctgaaatatatttaaagcctgtagtagaaatctcacaaagatagtttagattgcaaactacttcagatatctggtattgtagaggtttttaaggataagtccaatgtaggatttgtgcccagaagctatttgcaaatttatggttattttttcagttaattagtttgagaaaggaaatggcagctaagtaaataaattagatcattaatttgcaataaatataaattaattatgctaattctaagagttgaacacatatacgtattttgtatatataataaaaataaggaacatacataagactattaggagaggaaagctaccttgactgttgtaaaaaaatccacgtatatgtactcagtagattttaacagttttgatatgtgcatgaaatataaaagaataagtaactacctactgatgttcaaacaaacctattttcattccaaatggaaattagaatatattctgcattatttgagttaattacatgacacttcttataaataatgatgtattattattccattcattacttctaattatattccttagcaagtgcgatgcctgcaacaccatgaccagtcttttcctgttccttaaaatctgatgacttgcatggaaagcaggtcaaaaatatgcccagaatataacgaacagagttcagtgattgttaaccatgacagtttaaaactacttgaaaaagttactgtggaaataaatagaaatggtgaacagctttccaaattacaggatacccatgatagcaacataagaaatatttgaagtgttgtctagatacatataattatcattctaccattcactagaattggagaaagaacacccctaatatccctctcccccagcatacatacacattaacagaattacattctgtgtagatccgcagatcgtaaagatacacatttctggttgcaaaagtgactctacagcctttatgcaattctgagaaatgtacctgctaaaagtcctaatcaaaatgacagttgaatttttctcctgtaatgcataatcaggtcaggccagcccaccccatcccatgcacagcacggtctggggctagaaggtaaaacatagtatggaagacaggtcaagatcaaggaaagacagttaaaactatcattaagcaacagggacctagtaacccacaaggctactttgtacatacatatcctcaccagagagcaggcagcaaggagccagaagagtcaaggaagagaaggcagatagcaggaagtagtctagatgaggtctagagaccaacatgtacatgcctcaggaacagtgtttcgtgggtatgtcaccttcattttgaaggggccagggcaaagtgcacaaagtccacacatttttcttcatccaatttcaaaccttccttgcacacatacaaagtacctacttaattccttcagcatcagcttccaacaatccattgttctgtctatgataaaaaataaagatgtcagtctcggctccagaaacaaaaaataaacttgggagaggaagagactagcaaggagggcttccccttcccctctagtgcccatcacagttactgccttctgaccccacgtgcagcctgagtcctcaaccttggcagctcactaccaactgatcagctggtatgtgagataaaatgaatttgttttctgcattgtaattctttagatggcaagtcaagatggatgatggtcacagcaagtttgtcttacaatgggagttggcaggattctctgtggtggattttagacactgaaaaaagatgttggtcaactttgaatgatgacagcatccaataacttcctttgttcccattgtccagtgctatcagaagctgcttgtagctggtggccatgtactctaataacccaagggtaggtgcacattcatatggaaacctttcccacagaagtaggaaaaagaaaggtccaacttaacagtcactgctaaatgcatgtctttgaacacaataatctgccaaatgaagtcaagaaagaaatgtgaccacaagaaaaccaacttgccccactacaatggacagcaatattgtctttgaacatttctcctccaaaagctcttaagctggctaatatacaacaagcatgcacagagcaaagacaagacatgtgcttagggaaattttaagagcaaaaacctatctttagctataaagatattaaaatagtgcttgtgctcattttacttgtacaggaaggtttgaaaagaactcttttttttttttttttttttttgagacggagtctcgctctgtcgcccaggctggagtgcagtggtgcgatctaggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgaaaagaaactctttagagaaatgaaagatcactaataactgcagtttcctgaacaattaaaggaattcacaagattacaacctactgaggaaatgacaaatatttctgatttttatggaaggactaaaagggcgcttttatgtatagcatctattctgtaagaatcactgttaagtaatgaagctatttttattatttttccacttatttcaggaacactcaacatggtaacggtctgaaaacgggggaaacttaacattgctctttggaaagttaatattccgtattaaaagatatttgtcagagttttcttttttaccttttgaatttggatcttggagcactgtttgcatggtagccaactttttatttctaatgtgtcagcagaaatgttcttaaagttacctagtctaattctctcacaaatatactttgtaaggctgtccctacatgcatcatcctaatgttgtatggccctggtaacattctgcgtgagatggtcttgattggaaaaatctgctctttttaataactgattcaataaactgttgacgtatgatttgtagaatacagtatgatcagtgagcaaggtttctgtcattacacaccctattcaattcatccacaaatgttgctgtgtctccctcatgttgcagctccttatgccattcagaatagcaatgcagagatcaatacactctctgctgaagacgacagaacaaatgaataattttatttacaatgaaagccccagtcttcaaatggataccactaatgtttaaattcattttcatgctcaactcaagaagagagatagacacagcacaaagcaaagggagtgggggtaaggagaagtattagccataatggttcaaatttatttaagccatgaacaatagctgggctgcactgagacacaggaataaaatgtttgctgcagaattctgaatgtgtactcttcaaaatgattctgtcaccaagaaactctgaaaagcattttccagtaacaagaaattaatggattaaagacattctgacatattcttctaagcgttgcaccacagaagccaaagcctgttcaataggctttaaacagtgttggcaaggaacagaagcgtttgcttcaggtgggaacaaggagggactgaagtggctgttttgagaatgaagcaaacgatcctgcttcaaaagcgtatctttggcctctgatttgacagttctttttctttctctgaaagctatgaaaaagtcagtgagcaaagtcataagaaataagtgttggtgaggggcagcaaaatgttataagagagacaagttcaaagatgacatttacaagcctctcatgaatggcacactccccaaagggcacctgaatgccatttttaagaagaagtcatcaaacatacaaaataaaatgttccattttacataaagatgccaatatactgcccttaaaacacagattggtccattcacaaattaacatgtaaagaaatggcaaagaaccttctcccatctgccatcaattcattcactgcttttagatttaactccctacactcacacgcttgtaaacagaattgtaatggacaaaggatgaaggggaagctgggaaaacctagcttggacatgatactgaaacatctggaaaaaagtggtgacaagacttggccttggggatgggaaacgggaaaaggtgggatttcggcacatcctgtctctctattctgttaactggaacaatgcatatactcctgatgtttccagcttcactttagattcagtgaacacagtacatttggatgctaagaaaaaagagatgtgcaagagcaggtctcgtccataggaagcaaagactcagtgcagacagaaatagggatgcacgtactttggatatgaggcagactgggctgtgtgtttggtcttggtacctggaacagagtatgagctcagtaataaagtactgaatgaatcaacatgagaataaggaagtgagtgtcacaaacagaggacagagttttgttttgttttcttccctaggagcaggggacagttatcaaagcacttcagatgaaatgaaaagcatggggaggaatctccagttgaggtgaggggcaggagaaagtatagtaaagggatagtacaacacatattcagggaacagccggaaagaagggagactgagccagtacaatgaaggtccttaaaaactattctaaggaatttggactttatcctcaaaaaacagacattccttattggtttattaacaagggaagagaagaatgatatggtcagggctgtggttcagataaagttataggctacattggaaaagcccagaggcagggagacagcataaatctagatgaaccacacctaagggctagactagggcaggcaggagagaacactggaggaagataaaagcccactccagacatctcaccatttatttatgaaatgttagtggacagagctatccacatcttccattctcaagtctcaggacaaaagactagagctttctgcaagcaaaggagtaccttattaagatgcgtctcccaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaagatgcgtctcccagttgtaacatggcagagtttataaaggtaaagtaaaataaaaagttacaaaatcatcacataaaaagcattgtctgaatacactgtctactggccctgagactgttttaaatactgcagctgttaattagacttatagagtataatgattttaaaaaagctctggttctcattgttcttataatcagagagggttggatccttcttgctaccttccaaacaaactgaagtgtgttaattttaataaaatattctccgagcccttggtatttactcaaatataaagtaactgagcagggttcatttcccaaatggtgacaccagtgccatctacaaagaaacgagttgtcattcactacttgctcactattcactacagatattttcctagacatagacatttctacttttcttgagttcaaactcaggtatgccctggttttagacatcactttttctgagtttgttaaaaagtctgaaatatcaaattactctcaagatatgagtaaaaaaactacaaagcagagttcattccattattaaccattttaaaaagtggccaacatggcaaaaccccgtctctactaaaaatacaaaaattagctcagtgtggtagtgcctgcctgtggtcccagctacttgggaggctgtggcacaagaatcggttgaacccgggaggcagagattgtactgagccaagattgtgccactgcaacttagcctgggctacagagtgagactctgcctcaaaaggaacaacaacaaaaaaaagtggtacatctctgtgacctctaattttcataggaatgagagtgaatttagacaaatggatcttgtctaaattcatattttcatcccaggtccctttatttcttttctaaaagtcagttaaagctggcacctagagagagatggcatttaaaccatattcttttaacacctgaatttacagacattttgctttaaaaaaccccaaaggaaaaagcccactacaaacttatagcaaaataaaatgttacttcaagaaattcaggtcttttaaaagatttcaatacacaattggtattaaaattaaaagtgctgttttctagggcttttctaaatcattctagtgtttttttttaataaacagaagaaaatagttttctaatattatttagactcatttaaaagaagagttttaaatattaagaaaagcttacatatttactagagtattgcttattagttttctaaattaatacaatttatttgactagaatttggattccagaaatttgggagtctataatacaatcacaattatcttttggtacatgtttttcttatttgtattttttttttttttagcatacaatagttacgtggctagaaaagaagcttgttcataaagttctcaggcactttccacattttcactggaaaaaaaatgtagcttactctgaaaaacctcttggcatatttgtacattcagaattactaagaaattcatttcaaagcaaaatcatgtctcagcgtggaaaatacttattatctgaaaatatcaaattttattctgttgccttctgcatggcaaactaagtgaaggaggaaagagaaaaacatcctgaagagtccgtacaaaattcatatgcacacaatcaggagtgaaacttttaacaacataaagataacttcccaagcatttcaccaatacttgttattcccactgcaaaagaataaagctcctattgaagtctataggaggaaagactacaactcagtggtcagagggaaataaaacaactccaccaatgacactggtcaatgatctgcaagctggtatttttcccaagagaaaatgctatttcaggtcctaatattttttaaaaaaaatttgtaagtatatctataatataaatttaattaaaacgcacaacttgaatgatctccaagaggtaaagcaacaaagtcagtctcaaatcctcacatatcttacttccacatcacaaaggcaccactcaatctactattaaaattcacaacagataagctgaaaaccaagtgcccgtgatattcactgggctcattttagaagcacctatttatttactcagctatggtagtgaaaaggtcaagcaaaaattcacctccaaagccacggttgctaagcaactctcctcagaagttctgcaacattgatcaagcatattactggtgccaccaactggattcagaataaatatgagtaacatcttacctggtgtctccgaagtgggagggagatggattctttatttacctttttggacagactggaggccaatcttgtatttatattcatttggctggttaggctcagaagacttttattttccctctccaaaaaaaaaaagaaaggatacgtcctggtaccacaggtttcctattcacaagagcgaaggacagttctgttttgagaaacactacagagggcttgatgagatgttggccaaatctgaacgacatgtcctcacagttgaagtctaaaagaaaagacaatggatagttataaaattcaattaagaaactcagttcatataccaccttaaagaaagcaaattccattactacagattcttagttgcagagaggatgccattgaaattgttcctcattgaatgttcaccaagatgcattctgggaaagtctttctaaaatactccactctccctaccagtgtttccttgattagagttagcaattttcaagcagaagcttccacgtggacaataaaacagcttttccccttcactccctctgcacttcacggtgccaccttaactcaaatccacaaggccctatttgtcagctacttatttttacccatctattttgtcatgtctgctaagctgaaaattttcattaagtattaactataaaccttctaattcttaaatgcttctctcaaatggttttgtgttcatataatagcaatttagaacaagtacgaacactgtctgaccttgcctacaattacaaaaacatgagcacttccagagaactattctagtaaaatctccaaaataaaggagaaaaaaaacatttaaaaagaaggaaggagcaaaacggagttcaaaactagaacaattcctggttgtaacagggccacaaagcagcaaggtacctgaaatgttctgcgtcttccttttgagggaaagccatggggggccgggggcaggaaagggaggctgaagggaatttggcaaatggcacagctgagacaagccaaatccatctagcaccaaggaatgacttttcaatcaggtggatgccaatacatgacaaagttactttgtgaatgactaagacacactttgtgaatgactaagaaacaccatccctagaaaactacttcatttttctaattcgggaacagcctagtatgaaactgaggaacatggatcaatctacagaaaaacagagaaaggattacaaaaaggatgaaattagaaaatagttggctatttgtgatatgcatttggttttcaaccccatttcctggcacgcaactcctaaaatccttagaaactccaaagtgatgtctttttgtatgctaatgattgactggtgtctagcagcctctaagagtctaggtagcttcaggatggggttgatcacaagaaggaccaagcacacttatacaccaataacagacaacagagagcaaactcatgagtgaactcccattcacaattgcttcaaagagaataaaatacctaggaatctaacttataagggatgtgaaggacctcttcaaggagaactacaaaccactgctcaacgaaataaaagaggacacaaacaaatggaagaacattctatgctcatggataggaagaaccagtattgagaaaatggccatactgtccaaggtaatttatagattcaatgccatccccatcaagataccaattactttcttcacagaattggaaaaaaactactctaaagttcatatggaaccaaaaaagaacctgcattgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataatgccacacatctacaactatctgatctttgacaaacctgacaaaaacaagaaatggggaaaggattccttatttaacaaatggtactgggaaaactggctagccctatgtagaaagcagaaattggatcccttccttacaccttatacaaaaagtaattcaagatggattaaagacttaaatgttagaccaaaaaccataaaaaccctagaagaaaacctaggcaataccattcaggacataggcatgggcaaggacttcatgtctaaaacaccaaaagcaatggcaacaaaagccaaaattgacaaatgggttctaattaaactaaagagcttctgcacagcaaaagaatctaccatcagagtgaacaggcaacctacagaatgggagaaaatttttgcaatctactcatctgacaaagggctaatatccagaatctacaaagaactcaaacaaatttacaagaaaaaaacaaacaaccccatcaacaagtgggcgaaagatatgaacagacagttctcaaaagaagacatttatgcagccaacagacacatgaaaaaatgctcatcatcaatggccatcagagaaaatgcaaatcaaaaccacaatgagatacaatctcacaccagctagaatggcgatcagtaaaaagtcaggaaacaacaggtgctggagaggatgtggagaaacaggaacacttttacactgttgctgggactgtaaactagttcaaccattgtggaagacagtgtggtgattcctcagggatctagaactagaaataccatttgacccagccatcccattactgggtatatacccaaaggattataaatcatgctgctataaagacacatgcacacatatgtttattgcggcactattcacaatagcaaagacttggaaccaacccaaatgtccaacagtgatagactagattaaggaaaatgtagcacatatacgtggaatactatgcagccataaaaaaggatgagttcatgtcctttgtagggacatggatgaagctggaaaccatcattctcagcaaactatcacaaggacaaaaaaccaaacactgcatgttctcacttataggtgggaattgaacaatgagaacacttggacacaggaaggggaacatcacacactggggcctgttgtggggtggggcgagggtggagggatagcattaggagatatacctaacgtgaatgacaagttaatgggtgcagcacaccaacatggtacatgtatacatatgtaacaaacctgcatgttgtgcacatgtaccctagaacttaaagtataataaaaatatatatatataaataaaataaaataaattaaattaaaataaaaaagaagaaccaaagcaggattatagggccagaacattcagccccactcctcaatctcccaggaagagagaggggctgaaggtgaagttgatcaccaatggtcaacagtttaatcggtcatgtttacataatgaagcctctgtaaaaacccagaagaacaggtttagggagcttctggatagctgaacacgcagaagttcctgaaggatggctcgccctgggagagcatggaagttccatgctctttcccccatacctcaccttatgcatcttttcatcagtatcctttgtaatatttgctgtgataaactggtaaacttaagtatttccctgaattctttgagttgttcaagcaaattgattgaactcaaagaagggaccatggggtccctgatttatagtcagttggaagttccagaggcccagacttgcaactggtgtctgaaagtcaggtgacagtctcatggcattgagccctcaacctgtggaatctgaggctatctccaggtacgtaacatccaaattcttctgaaatgaatcaaaggacatccagctggtgtccgctgctttgtgtgttggggggaaagaaaccccacacatttggtcacagtagtagtctttgctgattgttgttgctggtgtgaaagcagaagaaaaacatgttgagtgtatttttttccttattttatatagcacatgaataatgcatgattgtttaatgattctaatattctcaatgacacagaagacagagagctgtgcaaatgtcacttactatggacacacccacatagccagaactgtacacatttcaggtactaaagaaataagataggaaggtttgccccagtggtacaagataatggtttttagaacatttacaaccagctcattaaaaacccaacagttctcaaggtgacgtccctccacaatagcatcagcatcacttgggaacttattagaaatgcaaattttgaggccccaccccagacctactgaaccagaaactctgggacaagggcccagcaatcaaggcttccatagctgtccaggtgtttcagaaccactgaccaaacccaactatcctcccaatccctgggccttttcctacagaattcctgccaaatggctgcctagcatatgcttgaatatgtccagtgatgggaagttcatcacacattcctcctaagacagtcaactctacaaataacatagttgctctttataccaagtccatctgtttttcatgactttattccttgggatcatataaaacaagtatcatgcaagtggcagtgcttcagatatttggagttagctatttttcattttttcttgtttttcaagaataaagatggcaaatcacatccaccattctacaaacagcattgattcaagtgacctgtgattatttccctccccagaatctacttccttagagtcttagctgtaccactttgattttttgcttttagtaacaccccaccatattctacatgtggggctattcgtactacctggttctagggatgggcaagtgacccaggcacccatagtcctttgacatatgattggttcgggagtggacacaggacacaaaatgagccaatcaaaggcaaggacatccttcagagtaatactgctattagtaacaatgccactttctttcaactgagttgccaaactggtagactatgaacctgaaacagctacgagttttcctaaaaaagagctggcttgatgtgagagccaatactgaggcaaagacagtgaagacacagagacccatacctgatgacactgtctgagcacatggatctaacattgccagaagaagtcatgtaccagaagtttctttcaggataatggaatagaattgacttagcacaggctctacttgatgagctactattatcatgagcccatgaaaggctcttctttttcttttcacttttccaatcattttcctttttgtcctctgtgttcagtcccattccctcccttcccaccacagaaattcactttttcataattaatgtattattcagaatcctctttacatgtttgtgtacatacattttttgtcaaaaatacacagggcccttatacataatttttaaatttgtatataaattgtaggttttaaatcccattcttctgtattctctcaacattgttttagaaatttatccatgttgccataaacaattccttcactgcattccactgtagtattccttgcccattcctctagtgctgtagagctagcttgattacaaccttttaccacaagttacactgtgactaccattcttacacgtttccctggattcctatcttagcatcccattgttgggattcaggtcagatacttacttagattttctaaaatatatgcaccagcttgcacgcccagcagcaatacattaggatttctattttcctacatccttaccagcacttgatagtacttcctgctttccaagtttttaattattgaatggtaaaatggcgtctcttccttttacttcatttgtctctaatagtgtgatgtgtgtgtatatgcatgtttctcttcttatgaattgccaattcatatactttgtcctctttcatattgctttcctcccttcaattttctaattttgtagagtcccttgtatattctaaatattgatcatggtctattaaacacaataattatattttcaccatctattaatttctctatcgttccctccattgaacagaaatcattcattttgatgtattccaagtccatcaattttctttttatagtttgtgctctgcaaatctctccgaacaaatccctctctaccataagtttgcaaatatatatattcctatattttcttctatcgactttatattttcatccttaacatttaggtatttattccacttggaactttgtttatagtatgaaatacagaaacggcttcatttttctttttgtgagccaattttcctagtaccaattcctgggaatgattacagtaagttcccatatatacacaggaataagtctagactcctttctattctgcttcagagccagacgctgtagaacaaaggtcgcacatttttgcacattttttttttctgtaaaggaccagacacagcaggccacacaatgtctgttgcaattactcaactttgtcatggcagcatgaaagcagtatgagtaggcgtggctgtgccccagtaaaactttatttgaataaacaggcagcagcccagatttggtttatagggggagtttgccagctcctgctgtatcttgttaatgtctaaagaaaaacagagatcctctttctgtatttattatcccatataaattttagcctccactctgcccctttcaaaaaaaaattcttagatgttgattagactgaatttaaattgtaagatgggtgaggggaatgtgacatcttcaaaatattcaacgaagccatttatgaatgctgcatttatgctctttaataccataataaaactcttgtaatagagttttaaatttcccttatatgttttatgcattctatcttagatttattcctagatagcttttagtttatgtcactattataaatggtatcttattattgtcatagtttataattagttactcccaatacagcagaaagctattgatttttctacgttcttatagctggcaatctagctgaactcttgcattgcttctaatggtttctgctgattctcttttttgttgttgttttgttttgttttcagacagagtttcgctctgtcacccaggctggagtgcagcggcgcaatctcggctcactgtaagctccgcttcccaggttcaagggattctcctgcctcagcctccagagtagctgggactacaagcgcccgcaccacgcccggcttttttttttttttttttttttttgtatttttagtagagacagggtttcactgtgttagccaggatagtcttgatctcctgacctcatgatccacccatcttggcttctcaaagtgctgggattacaggcatgagccaccgcgcccggacttctctttgtttttatatatatgatttcacttagaaataatgataatcatatctttcatggcaattttcctactttcatgtttctttgtcatactgcattggtcagctatgtggtaatgtattgagaagcagaagtaacacagggatccttttcttgttcctgaccttaagagggctgagtttaaacttctttttttttgtattatgaatgatgtctactctaggtttttaatatgaagcctttaatcaagctaaaaatatcccttctatttcaagttttctaagggttgatacctttttttaaaaaaaattggttttatgaaatgcttttcctatatcactgatgacacaattgcttgttccgtgccattaatgtggcaaactacattagcaaatttaaaaataataattcactattctttccctattatgattaattcaactccgtcacaaggtattattttttaatatactgctagatttgaattcttagccttttgaatgtcataagtgaagttggccaataatttctcaacctatttttttttttttttttttgagacagagtctcactctgttttccaggctggacacagtggcacgatctgggctcactgcaaactccgcctccccggttcaagcgattctcctgcctcagcctcccaagtagctgggattgcaggcacccaccaccacactcagctaagttttgtatttttagtagagacagtgttttaccacattggccaggctggtctcgaactcctaacctcaagtaatccacctgcctcagcctcccaaagtgctgggattacaagcatgagccactgtgctcagccaacttatctagtttttgttatcaagattaaacataatagtttggtttttcttttttgttccaaagagagtttattaaacgagcattttctgtttcatgagcgttaaacaaaactcttttgtcaaactgtgtctttttctcctgtgccagaaaggactaagttttgacaatcattacaatttattgttttctgatttactaaagattttttttttcttgtatcaatttcttagccatatatccttttcacataatactggtaaaaacttatattctttttactggatttaaaaatataatctgtaattatctcttttacctatttcgtattgtgtttatcatggtacatggagatgttttttcttcatctgttattcaaaagtaagatctatcctatgaagttttttaaataatgaacttctggttctttggcttttatgaattatttttactttattaccacatttgtatttatttcctctgatttgttttcctttattgtttctttggatttactatgttgcagtttttctagttacttgagtcaaaccttgggcttataggattccagacttagtgtttttctcttgggtaacaaaagctatatattgccgtgaaagtattccattagctctatctctcacctactgtgcttttattatcactccgctctaaaactttgctattcttgttattatttcctatttaacctgagggttatttcatagtatgtcttttcatatccagatatataggatgtttttgctatctttttgttaacagtgtctgattttatagcactgttgttaagagaacctctaagctgttgattttttagaatttgaggcttcctgactcattgaaagttgaagcttgtgtctaatccacatgccctctgaaataaagtatgctctgcttttgttgaataagttctatatacatgagacatcaaattgttatccaaatctctctttgtctcattgcttcattggtttctgagaggactgttttaaatttctaactatatttgctaaatcaatgtctaacgccataaattattgttttctgtacctcaaagctacattactacatgtggatatgttcctattcatttcactcccttggtcttcttattcctttttcttctttgtatttgacaagtataaatttttccatcaccttacattagcgtgtgttctcttgaatttttttttaataaaatactatagcatcttgttttctatccattaaagaatctgctggataagtttaatcactacacatttacactaattattctttgagcttatttcagatattttatcttttcgtttgtttcacttcactttttctcctgtctaccttccacgggttaagtctggtttttctctccccatgagtatgaaaattacacattctatttttatttcagtagtggttattcgtgttcttatcctatccatactaatgcttagtgtttaaaagcagatcaggatctttatccttagtatattcctacctcctttcatctcttccagatatcatatcccatcttcgtcatgtcctaacttttatgctgaattgatattgttataatttcaaataatgctttatatgcttttttacccaccatccctctctccccacttactctactgattgtattttcatttgtcttgtttacaaagatgtaaggacattcccttctcacaggcagctgtgggctccagcaccacctgcttcttttgaatcttactttccctttctggcctttagtcctcccttttcctcaaaactaggctacacttttgagtggataaagagtctcagctctgccactctcttcctgatcttccagaattcactgaaccttctaatcctcagacatctcatttgaaaatagtagataatgaagtatacaaagcatgtctcgttgtctgccacatgatgtaggtacccttaaatactaatagttttctctctttccctacccaaatctaagtctacctcttttttaattgtggtaaaaatcctccccatatatgctgctagtacacctatttcttcaagttttaatttcaatgaagaagaaaaatattctaggaactctaaaagggacaaaagcattaaaaagattaagagtcaatagagtttgatgggaaaatttgtgcatctccaggatctgaaactgtctccaagactgagataaatattaaatactttcctttcacataaaaatggcagaaagcaattttattttcagataagtaaaattgctgaatctttctaccaaatataaagactagatgtaccaatattctgtggaattttccagggaaaatcatcttcagggaactgcttcttagcaaatatggagatggtggtttctgtaagccagagaagcaaatactggattaggaacctcagtccaaggtttagacccttagacttgtagtgagcattagccaagaaggaaatacaaggaacttggtttactctagaaatggtaattgaaccctactctctctttataaacaaacagaagtagatacataaatgaaaaaaaaggtctcacatttctagccgattactttcttctttatttttttggtgaaaacttcttttatttgggactaaaaatatatgatttcaacattcttaaatgagtctccatttcccacttttcagccataaaaggtagcctcttgctacctctctcttatgacatatttgtaccctctctacctcctataaactacctttacatctgcatctcctacaattctcgccagctggtagcataacacttttagagctttatctttaaaatttaataaacataaaagaaacaatgaaaagatctctactatccttttgtgtgtgactcagtggatgtgttcagtcatttttttgacagggctagataggcaacctaacttgtagtagagtaaggttcagtgacacaaaagcaaatgcaggccccaaactgggaaatctccaagctgtgaacaggaactgacaatagctcacttcagggtagggcagattctttttccggatttgctttcaaatgttatgttaacatccaactaaagtaacgaaatctcttttggtattgccaaaagagattcacatttgagtcagtgggctggggaaggaagatccacccttaatctggtgggcacaatctaatcagctggcagtggatataaagcaggcagaaaaaaaggagcacgagagagagagagcgagagagagagagagagagagacactcttcatagagaatattattcaaggatttcttaaacttgggaatataagacttcagggccctgatttgggaaatactgaattaataacaactctgtcactttaggcaatccctttgcactaaagccacatagcagtactctgttatcagacaacaagcagctgatttaaaatataagcctatatctgtcattttcatattatttcatcaaatagagaacaataaatacaaactttttgagagcatgagggccttcaaaacccactggccgaagtttaagaaactcaggccttcagcaaatgcacctaagaaaccaagctcatgaagatgtgaaattctaatcaacagattacctgaaaacatttccatcccatttcatgatttctctctcttttctgtagcaaatgatgtttttggaagaaaaagagcgcatatttcccttgcctggctactcaaaatgtggtcctctaagtagcaacaacagcatcacttgagagttgtaagaaatgtagattcccaggccccagcctagatgtaatgcataaacctgtattttaacaagatccccagctaggctgtttgtacattaacgtttgaaaagcacatctcagagcactagttttaaaactaggtctattaagatcaacttgagaactttctcaaaaaacaaattcctatacttcatcatactcttgactccaacaatctctgcaacaatgtagctaacccatcacggggatttgacaaacatggcttccgattgtatcttctttccaattcattttatgaactcaggcaagttccttagcttctttaaatttgagaaatgagtatgacaacagtaccttcttctcaaggacacacataaagcacttaaatatttgataagtgctagtcacaatattggtgtattttgccttgacaaaagtaatgcctaattttattcaataaacaattgttaattgtcaactcatacataagctaatattgttaagttgcttcgtataatgcttatcacaaaaatggtatgtaatggttacataaatacaaataaaatcatgtatttgacaccatactgccattaggtgactactatctctccatattagaggtagagcagtgtcaaaaactaccatctgattaaataatagaaataacagctaagtacttactcggtactttcatctttctaagcaatttatatgatatgttacttaatcctgacaaccctatgaggaaggtccttcatacaccaacatatcaacatttatgcatctctttgattacttctcatgcattaattcctagatttgagaatcactgtgttcaaagtatattgaactattaaggctacgggtatgaactactaaatagctctcaagaaatgtagccaatagttgatatccaacggttgtatagaaaaaagtcccatttccccaaaactttgttaatgccaggcattctctaattctccaaattgctaataaaaatttgtcatgacttaggaatacaacataaagggaaataacttcttctaaatgtcctagataaaacaatctaccatgaaaattaatgtctcctaggcaaccaggaagtcagacacaatgaaaaagaaacactgttctcttcgttaaaagaataaaactgtgtttccttttaactagaaaaataaagttgttatttcattatggccaggaatattaaggttcactgtaaaaaataatctgctatttttataccctggcattactcagtgaatggcaaaaatctagaccaatcctagaaggcacgaatgtctttgggggatgtcagaaaaagccttaactccagacacttctaccaactggagagtaggtttctatttcaattaacttaaacactaggggctcaattgttaaccaagaatgtaaatgagcttattaaaagctgctggctaatggatcccaagatgaaccttgagaggaacaatgccctgtcatctaactgaggaacaacacaatctgatctggccccgctctgaaacatactttattgatgacttggaaaacaaggcacataaatgaatggttggagacatatattgaagtttatatgatttgtaaaacattctaatctacaggcgtatgtcaaaattccacaggagacagtagaagaggatcctagaagaagataacaaagtgaacaaagagaaagagaagacaacttgaagtgtcccagaatttaagcaaacaagaatacctgtaacatttttatacaaagagaattttttagtgaagtatattaagtcatcaacttatgtcactaaaaaaattttcaattgttaacaagtcaaagaaaatccaaaacctcagctatttataaacagaaaacacctaggtatttcaaaatgccaactgccttttcaagatctcacttcatcagttacctcttctctgttctgtcattttttttttttttgtaaacctacttgttttacatatttaacctcattctcaccagtttcttccctgtctcctaaaaagatgttcagggattacatatacttaataacctttcctcatcaaactctaatcacctattcatttaataaatatgtattatatacttgccatattccaaatactattctagtggtaaatatgacagaccagccctctgctctcatgtagtattctaggcacagggtgcatattgcaagcagtagagactacaagccagtcaacaaggaaaaatattctgattgtgacttgaaggaaatgatcaaaatccaagaacaggaagggacttggaggaggcagaagtggctgcctaagtgtcaaaggaaaggggaatctcacgtttgatctgcgagttgaatgataagaagtccactgtatgtgactatatggggataaaatgttccagatggaggaaacagcaattgccaaggcaagaatgatctcaagatcttagaggaatggaaagaagagtgtggggtggagcctaacagcaggcagcaaggcagaggtgaggagatgggtttgaaagatgagcagggatcagatcatacaaggtcttgtgtggcgtttcacttaatgagaaactcgtgataacaaagattcaagctccagagtgttcagggtctaaatttgactttcaaaaaaagattttactattgtacattaaaaatcatctcaggacgcctggtgtggtggctaatacctctcatttgggagaccaaagcagaaggatcccttaagaacaggacttcaagaccagcctgggaaatatagtgagaaagaaagaaagaaagaaagagagaaacagagagagggtaggggagaggggaggggagacgggagggggagggggaagaggtgagacgggagggggggaggggaggggagacgggaggggggaggaggggggaggaggggaggagagaggagaggagaggaagaaattagctgggtgtggtggcatgcacctatagtcccagctactccagagaccatggcacgaaatgcctgagcctgggaagttgatgctgcagtgagctgtgatcatgcccctgcactctagcctgggtgacatagtgagatcctgtctataaaaataaacctcaggagcttaaaaaaaagcatatgccccattcccagattatttttctgttaagacttttgaaaagtgacatacaattcatataccataaaattcacccttctagtgtacagtttgatggttttcagtatgtgtgcaaaattgtacaattatcataactacctaattcagaacatttttacccccaaaagagaaaccatttcctttagcagtcatttcacattttcctctagcccacagcccctggcaactactattctactttctgtctctgtggatttgccttttctggacattctatagaaatggagtcatacgatatatagccttttatgtgtagcttatttcacttagcatgtgttcaagattcatccacattttaccatgtattcatcctttattccttttaaaggctgaataataccccattgtatgtatacaccacatgtttttctccattcatcagttgatggacatttgttactacatttttggacgtttgtgaatagtgctgtgaatattcaggtgcaagttttgtgtggacttatgttttcaattattgaacgtacacctaagagtgaaactgctggatcatgtgggaactctgtatttaacattttaaggaactgccaagctgttttccttagtggctgtaccattttacattaccaccaccaatgaaagagggttccaagtcctccacattcctcaccaacaccccactcccagatattttaaattaattggtctggctgagacctagatatcaggcttttttttggtttttattttgaaagttcctatggtgattctattcctaacgtatagtgaaggccaagaagcccttactccagcctgttcattgccaacttggtaagtatttatacctactccctcttcctgataagtattcatacctactccctcttctgctccagagctctttagacatgttacttggtgcccccagcactctcaatgacatctgctttgtagctgactcatccagtgagagaaggaaagataattaaggaagatacagtcttatacttttaacagtctcatttatttctgagtggggccagtgtctgtgtgaaatcttcatggttatctgcatgtctggatgggttttctccaggcactctggtttcctccctcattccaaaggtgcatgtgagattaagaggcatgtctacatggtcccggtctgagtgagaaggtatgtagagtgagtcctgagagggaatggcgccctgtccagggtgggctcctcccttgggccctgagctgccaagacaggctctggccacctgagaccctgaactgcaatgaatgggtaaataattatcttgcttttattaatctttcttataatatgtagacatcatctttatttctgtatttaatattaacaatattttggtttttatttagaagtttggtgatgtttttgtgaggagaaatatgccacaggaattttttttttaatcagttagcctatggtcaaattggtttcattatacattgttttggttaaagttgtagtttctaagaaacctacctatgactcaagtgaggacttgtgtttttacgtaatgtgaatcagcaacccccttcttccactgattgatccgacggagaccttttatgcaaaaagaggtcactgctttaaaatatatatatatatatattttatatttattttatatataaaaattatatatatttaaaaaaatatatatatatatatatagagagagagagagggagagagagagagagagagagagaggctcctgaagttcttctcatctagtcaagaaagatatagggtgtaaatggatacttctatgttttatgcttcaacctgaccttgagtattaaacatggtatcatatttacaaaaatgtataacatttagaactacttttgtcactttataaaatgattcttccaaaccaaacacaggtgatgaatatctaaaacaccagcatcaaggcctagagctttgtgtttgtacaaaatatcagggaaaagccaagcacagtggctcacacctgtaatcccagcactttaggaggcctaggagggcagatcacttgaggtcaggagtttgagaccagcctggccaacactgcaaaaccctgtctctactaaaaatacagaaaattagctgggcatggtggtgggcacctgtaatcccagctacttgggaggctgaggcaggagaatcgcttgaacccagtgggcagaggttgcagtgagccaagattgtgctgcgccactgcactccagcctgggtaacaaagcaagacttcatctcaaaaaaagaaaaaaaacgtatcagggaaagacagaaacctgaataaaaaggaaacagatttctacactgaaggacaaagtatggcatgacttctcagtctgatggaggccgagattcgtttttttcattctgagattcatcttaacggttaaaaaaaaaaaaagaacaaacaaaacgaaacccaaatcatgtttttcatgtggactgtaatagcagagacgaacttacatgtttaaatacaaaaacaatccttaaagaggagaatcagaagttgaaaatcaccttactgttatgtatctttctggagtaatcaaaatttctactatattatagtctctataccatcaaaaaatccacagatatcacagatattcatctccatggactgtatgaagacattgtggacatattgggacatcaactcagaaataatgtcaaaagcttgtatggtaaatctgaatcaactgtgatctttcagaagcaggagcttccaaaggggttcctgtagcatccctttatcagagcaaggccagtcagaggttaagaaacattgggtcttttactttaacacttctcacatattattttaaaaataaataccaaaagaaataccaaaggaaaaaccacataaattatattttgaacatttacattgaacaaattaaagttcccaacataagtgaatacaacataataattactattctgcatatgagagaaattattccaccattttttgactcctgaattgttggcaatattcatggcaaagcaatgctgctcataggtttttgctaaaacggagtataaggctaattacagtgtcaattatagctatgtatcatttgtactctatagacttactcctattttaagtggtctaccatattcttctaatatctaacggtgttattcacaagataactacatgactgatacattttttacgtaacagtgtactacaggtggtacaaccttgtaagagaacaagtttagaagtatataatgcacatcttccttcaatcctgtttattagcatatggaaaacacatttgaagataaccagatataaattcaaggccttgaatccaaagccgtcccaaactactgattccctgtgttcttccaggccctcagaagatgtcggttaaaggaaatcataaaaagtcaaactatagcctctgtgttatgtccccactaaagccagtatggccagactttactgtagctgagaggttcttgctcatggagtcttgaaatagagcttcccaacttcagcagagatgcctattatacaacattaaataaaagacgaatttaaatgaatcaagtcttgactcttcttccaccatcatgggttttacagaacagcattatccagggctccattcaaggtaattttgctttttcattgcttgacaaatgctttcccatttccctgcaccctagacaaattggtatttctcagcagctcttagaatgacaatggcagttttctcttcatcgttttttcatttcttcatcctctcgccatgagaggcactcatcaggggatctctaatcctacccatctcattacctcttcactctatttgtcaccatttggaatttcagaactcttaattattagcttactgttaccaacagtaatgaggctctggctgcctactggggagcatcatccaacactaacaagctagcagactgagaccggcacctgaattccatcacgtggttccattgttcaggccaggtgggacatttctgtctgcaggcaagctttctgcaggagagctggagtttgcagggtggctattatccattcactttggtcttatgattcacactgactcaaaacagctttcctgtgtggtcatgctcatttacatactggctattgccttccttataataacacttaatgtttatttctgccttgtcctccttttcacttgtataaggacttcctggagctaagagttctcaaagggaacactaattggtcattttcttatagctacttttgatctcctcctgacctggaatgaacagtgagtctctcacagccatctgggtgatccgtctatatacagaccttccttgacactcccgcagtagtcagcatactgcctcaacacaaaagaggctagacaaatgttaagtgacatctataaagttttctgagcaccaaagacagacccagatgcagaggagacagaaaggtaaaggattaagaaggagctggtccctctgaaactatgacaaacatgtctttatatagttaacgagggaagatgcaactgatccaaaatccatctcttccttggcttcatatcctttcacagcaacaagagccttgcaccaatgaggacaaatgagcattggttgaatacttctaaatgcccagcctacattaggcacttgacctgcatttgctcatttaaaccccaatagcctgtacagtagacctggaggaaaacaaaacccacagaagtcaagcaacttgatcaaggtcacccattagtgaaaaccccaaagctcttctcagtacaagtggtcacccaacaccgctcagaaaacggttaggcaaaatgagggcctggggtgggttttggaatagcaacaccctgaaggtaatagaggctggtggtagagaagaggagcagtggcatcacctaggtgtgtaacgctgcctttgtcccctgtagctgctgccttctatccaaggtgaccaccgtgttgaacactgtctaggaaatactgtgctcagggcaaaggatgctctctttttttcacatttttatacagctaagagaagtcatttctgaaaacaggacttggaggtcaacgtttacatatgatgccaccaaggacatctcctgatgatacccatgaaggagagaccattccgttagaaaacttgtgcagtaacatttaaaattggcatttgttaaccatactaataagagctaatattcctgtagcccttgctatataccagacattatgctataaatgctttatgtaaatatctcacttactcctctccaaagcctctgaggtatttttatcaccctaattttacaaaagaaaacactaagagtttaagtcccttgcccaagtacacacggaagcaagtgatggagccgagatttgtacccaggtatgtgacactggtctcctccccacctccaacagtgctaagaaagatcttctgcccacattgcattatgtgctgtacttttttcatgtaaatgatcattccaaatgtctacatcctggtgggtgagcggaggaggtgacaggaagaacaaaaaaaaaaatagacatgatgtcaagaaaggaattaattttcaagtgcacaatcactgctacccacagagtctgtctgtttggttttccataggtataaagagattactcagagtccataaggtggccatgccaggtctctcggggtcaagcagacaggccaagggtgtacccaggctctccttagctctctacatggctctgcctcatctgcttgcttggttcacccatgacatcagagaaacaaagttgggagcaatgctacttcaagcatatgccagttactaagggtaatttatggcaactctcattgccacgtgggctgagaagcacaacataataattaaaagactgataagcaatcactaatgaaatgcataggtattgttgaaaaatgcattttgagtccaagtaaaacaatgatgtgtgttctcccagtgcagaatctctgagctctgtaatcttaaaggcttttgcttttaaaatactatttcaaatgccagctattagtaacccatacatttgcaccctggtttcattgcaaaaatgaggaaggaccattgctttccaaaagaggcaacaaatagaattttttaaaaaacgcttctcttggaaaattttgatccgtttcaagtgatcttgtttagaagacccctacgccaagagtcctgccgggacagagttgtgttggcatcacttgactgctacctgtgtcgtctttgcctttgtgtatcgcaaagcctgttagaaacagctcatggaagcggggctcagaagacagaggtgtgtgctagaccctgccctacctttgttctctaacagggaagcataatgtcaaccaatctctagtcatctccctgacccatgtccctgactggcatacacacagggccacatgaaaccattccatggctcaggccagggtttcaagcatcaattacccttagtaacagcacatgcctgaagtagggttgctcccaacttaaatatttctctgatgtcatgggtgaaccaagccaagcagatgaggcagagtcatatagggagctcaggagagtttgagtatgccattggcctgtccacttgacccctgagtctaatgactcagcatggtctttggagttctaggatggcattatttacttctcctcttgcacagtccagaaagaacatttttccccactaaatgcacattcccaggagctccgacctccagtcaaaaaagtaaaagttgcttggtaagctcactgcctggggtcttctataccaggaagggcccaggcctagcactcatgttgtggcatcttcctcctgcactgtaggcagatgtcgctaattaactatgacatgttctcctgcagggcattaacagaatcttttagataccattaccaatcaatcagagttgctgcataacatggaaaacctattgctcatttcacttttcggctttagactaatgacccagggaaacttttcatggcagccctgagatggttcgatccatttcaagctaaggatgtgataatacgtgtatcttccagaatcttgactctttcaattaggagcatgaataacaaacttctagcattgaaataacatattctacggtaatcctctgactgatcaccttgttaataaatatctaaagaccgcatttttctctgagcttccaacttccatgggaacattctgattgtgatataatttttaaattagcgggtttattcatagatttgtgttagtaaatggcaagcttcttactaattagcaaattgtgtaaatccacagcagtattaattttcaactgtatggggaattaatataagacaaaataaataaggagacaattaaaatttccctagaggcatgcatttctataaaattcagcacaaaacaagaaaacattaacccattttgagggtgcatttagaaaagatcacaaaagatgtgtcagtgtcacagagaacaagtgaagcatgcatttgctgtggcacgcactctcagttacagctaaattccctaaagatattttctcaagttactgctgctgagatgtcccctcttgccttgatgcacttttccagcactttctcatttaataaggtttttattatttctttattgatgtttccactcaaattgctggtgtgctctctctcactttagaggacaatgcacagtataatgttctgatcctcaaaaactgccccacaagaggtctctcactaaccaagcgcttgctaatatccatttcacttttcccactaacccactgagaagatggaaagcatatgtatctctgggctcctgtttaacctcccagctctagaagatgagaaaaagcatgtccctcttacgggcacttacaccatttcttatgaagccatcccacacactgttaaacaaatctgattgtttctcaaactcccctttaactgcttcagcttattgctaagatgttggagtcttcctgtgttggtggccatggaaaccacctgtctatttaatggcatgaggtcttttctttacttttcctggcatgccaggctgttggggaaaggccagagccctaagtttaaacaagtcaagtacagatgtttaagaatgacagctcccaacagcttcagatcatagctaataccaaaattaaactgtaacatggtatgctctgatggggaaactgtgcacagtttctaagtacacaaacaagacagtacacagacaattgtaggttccatttgggggcaattttcttcccttatcatggctatcagtgatacaatctgctgcagaagaatgtggtgttaactaattagtataccatatagaagtgcctgtcttgtattatttacagtgcctgggacacactcctagtacagggcttctcataggcacagtaattatgcatttgcctctctgtcttacatattagataatgatctccttaagggctgggaatacggtcagagattgggattgcctatcagccccctcccaagcagacctaagcagccaggtggtaggcaagaacagcttcatgaatggctactaggcagttcccagtagtgcctggaaattctgtaagtaaattttaaacggcttggttcaggccaaaaccaaaatggatcttcctgttccctcaccccaggtctgcagtgacatactatcctgatctcctctttctgtttgaggttgaaaatggaaatgggaagaaccaggcaggccttatctggcctgcttgccatatggagactgatgggcagactgttcacaaccacaagcaggtaccacagaaagaggacagaatagagccggtcctttacttttaggtgagttttcctccactggcatgttgtcaccaggcaaggcagttgccatttctactgatgtaaggagacacacacacacacacacacacacacacacacacacacacacagagagagagagagtgtgtgtgtgtgtgtcaaggagaggtggggaggaagtgagtaggaagggacacagagccagggactaaagagaaaagtcccttcctgtgaaaagaataagataatattttcatttaccatccccatatacacagcagtgagcaaagtgccaggcaaataattgatacccaacaaacatcagctgaatgaacaaatggattcattcattgcacttttccatgtctctatctctagtatttaagatttttttaatgtatcttagaagagcctactgttgtacaccaaaccaaaccaaaacagcagaatgtcctaaagtactgacatatgtgtagaaattacacatcaaattaccaatcagatagacgctaaggtaggactgaaatgtgggccaaacccattttggaaacaaagaacaaagtcaatactcaaggtcaagctcttagacagctattcttccaaagcacctggaccccaagacacactcaacaaatttcaggtcatttcttctctcattaagccagttacaaccaagttatagaagtggagtccttacaagtcgctattgatagaataagagctagtcaaagaatgtttgagccatttttttcccagcctcagatgatggggagaaaaaaaaaacacctcaatcaaggatgtcaaaatgaaccaatctgcaatagtcatctgggcaggggacaggtgaatagcccaattcttctcacagaaatgaagaaaaagttcaggccattatccaggatgacttgaaaaggcaactcagtgactgagctttgtagttctgacaccattcaaatagaaatgggagccagagatagaaggactgacggctcattctcaggaatgtctgtgactatgcttagatgtgtcagtagacaacagcttcctaccaaatggtacaggctttggcagcctcttttttaaaaggccttttagtaactagtcaggcaccattcttaatatcaaaacattctctcttttttattgcccagactctgggaatctggaaaatgaaagaaaagaaaaaaaaagaaaagagagagaaagagagaaagaaaaagagaaagagagaaacagagagagagagagagaaagataattctgactcttcctaggtaaagttatgctttccagttaacttgatccactagttattacccgaaaacatgctttccctatgtttgagttctcattcatttattcaacatctactatgtgccagaccctgtgttagatgctagggatacaacggttaatgagaaaaagaaaatgtcttatcatggagctcattatttatctgtcttataattaatctatattactttatttaacaactacatacattaaacactgcccttttatggttacggaaagacagcagtgaacaaaacagacagtctctattctctgatccagggggaaaagactaaatgagttagtaacattttcagatagttaggagagctggaaaaacatacattgggataatgccattgagagtgagtgatggagtggcagcaggactgttgtttgagataaattggccaggtggcgtctccaagaagaaaagtctcacttgagactggtaaatgaagccagcaatccaggaagggtgtttgtcagggtggccagcttttccccactcctaggttttaagaggagtctgacactgactattattaggaaaataagttagttggcctacttggagggtataataccagccagcaccttaatattcaatgtgtggtctggggaataccagcatcagcatcacccaagagcttgttaggaatgcaaattctcagctccactccagatgtaattgatcaaaatctgcacttgacctgacccctaggtaattcatatgtgtattaagactttgagaagccctggagctagccaccttgagtaagacctaaagtcatgtccaccaagcctggcctctatcagtcattcctttgtttattttggaattcatttgagaaatttgaggacccaggcatagacaagggctgctatttattggaggtcctcaagatcctctaaataaagggaagaacaagtacaaagccctgatatgggccaggctgaattatgagtgaaatcaacagaaataaacgcaagccatttaaattttatccctataaaatggctagcctttggaagtttttaggcaagggagaagtaatatgttctacgtgaaactttggagcagtgactctgggtgctgcagagagagtggacaatagccaagcaagcatggagaaaccacacagttaagaagctacaaaggcgagcccgatgggaagcggtagggacttgagttggtgaggcagcagtgcacttattctggatatgtcttgggagaagagctaataatacttactgatgaatagaaatgtggggcagcagttaggaaagaggatggtcaaagaaccagtcagtgcaggcatacttcatttcactgcattttgctttactgtgcttctcagatattgcatttttagaccaactaataaccctacaatcgccttttaagtgttcaagtgaaaggaagtgtcacacatctctcactttaaatcaaaaagtagaaacgataaagcttagtaaagaaggcatgccagaagccaaagacaggccaaaagctaggcctcttgggccaaacagccacgctgtgaatgcaaaggacaagttattgaaggaaattaaaagtgctactccagtgaacacacaaacagtaagaaagtaaaacacttattgctgatagggagagtttgagtggtctggatagaagatcaaacaagccacaacattcccttaagccaaagcctaatccagagcaaggtcctaactctctccaattgtatgaagtctgagagaggtgaggaagctacagaaaacaagtctgaagctagcagagattggtcatgaggttcaaggaaagaagccatttccataatataaaatgtcgaggtgaagcagcaagtgctaatacagaagctgcagcaagttttccagaagagctggcaaagataatcaatgaagttgaccatattaaacaatagattttcgatagtgacaaaacagccttctattggaaggcgatgccatcaaggactgtcctagctagagaggagaagttagtgcctggcttcaaagcttcaatgaacaaactgaatctcttgttaggggctactgcagatggtgactttaagttgaagtcagtggtccttgagcattctgaaaatcctggatcccttaagaatgatactacatcaactctgcctgtgctctgtaaatggaacaacaaagccgggatgacagcacatctgtctgttgcatgatttactgaattttttaagccccctcttgagacctactgctcaggaaaaaacattcttttccaaatattactgcttactgatgatgtacctggtcacccaagggctctgatagagatgtacaaggagatgaatgttgttttcacacttgctaatacaatatctattctgcagcccacagatcaaggaggaattctgactttcaagtcttattaattaaatacattttgtaaggctataactgtcatggacagtgactcctctgatggatctgggcaaagtaaattgaaaacctggaaaggattcaccattctagaagccattaagaacattcataatgcatgggaggtcaacatgaacatagtttagaagaagttgattccagccctcatggatgactttgaggggttcaagacatcagtggtgaaaaaagcaggaaaactagaattagaagtaaagcctgaagacgtgactgtattgctgtaatctcatgatcaaacttgaacagatgagaaattgctttttatgggtgagcaaagaaagtgatttcttgagatgaaatcaactcctagtgaagatgatgtgaacattgtcgaaatgacaacaaagaatttggaccattataccaacttggttgataaaacaacagcactgtcaaagacgattaactctaattttaaaataagttctactatgagtaaaatgctattaaatagcattacattctacagagaaacctttcattaaaggaagaatcaatcagtatggcaaacttcatttttattgtaagaaatcgccacaaccacccaactttcagcaaccaccaccatgatcagtcagcagccatcaacattgaggcaagaccttcccatttttattgttcacattttttagcaataaagtatttttaattaaggtatgtacactttttaggaataatgatattgcatacttaatagactacagctaagtgtaaatatagcttgtatatgcattgggaaactaaaattcacatgactgatttattgcgatagtcactttttcacagtggtgtgtatctgaacccataatatctttgaggtatggctgtacccctacgaggcatggaggtgggcatactacccatgctgcccccaagcactatggctgaccccttgctgggctgatcccaaatacaaaatacaagaattcataaacaatacaacactttccgttaatggagaatgctataacacctagttcccacttctattcttcaccgttggattctaatagatgcctgttattcctttaaaaatatgagagcaatggatttcatttacaaaaaagggaaattagttacacaacaaaatgaatactcagaaaaatatttcaagcaaatagataaaagaccacttttaaaaatctgaatatccaagataacttgctctcgtaaaagtttgtgattggcaataagagacagattgaaaactgctagacttttcaaaaaaccagctcctggattcactgattttttgaagggttttttgtgtctctatttccttcagttccgctctgatcttagttatttcttgccttctgctagcttttgaatgtgtttgctcttgcttctctagttcttttaattgtgatgttagggtgtcaattttagatctttcctgctttctcttatgggcatttagtgctataaatttccctctacacactgctttgaatgtgtcccagagattctggtatgttgtgtctttgttctcattggtttcaaagaacatctttatttctgccttcatttttttatgtacccagtagtcattcaggagcacgttgttcagtttccatgtagttgagtggttttgagtgagtttcttaatcctgaattctagtttgattgccctgtggtctgagagtttgttttaatttctgttcttttacatttgctgaggagtgctttacttccaactaagtggtcaattttggaatcagtgcggtgcggtgctgagaagaatgtatattctgttgatttggggttgagagttctgtagatgatcaagtgggtttcatccctgggatgcaaggctggttcaacatacgcaaatcaataaacgtaatccagcatataaacagaaccaacgacaaaaaccacatgattatctcaatagatgcagaaaaggcctttgacaaaattcaacaacgcttcatgctaaaaactctcaataaatgaggtattgatgagacgtatctcaaaataataagagctatctatgaccaaccaacagccaatattatactgaatgggcaaaaactggaagcattccctttgaaaactggcacaagacagggatgccctctctcaccactcctattcaacatagtgttggaagctctggccagggcaatcaggcaggagaaggaaataaagggcattcagttaagaaaagaggaagtcaaattgtccctgtttgcagatgacatgattgtatatctagaaaaccccattgtctcagcccaaaatctccttaagctgataggcaacttcagcaaagtctcaagatacaaaatcaatgtgcaaaaatcacaagcattcttatacaccaacaacagacaaacagagagccaaatcatgagtgaactcccattcacaattgcttcaaagagaagaaaatacctaggaatccaacttacaagggatgtgaaggacctcttcaaggagaactacaaaccactgctcaaagaaataaaagaggatacaaacaaatggaagaacattccatgctcatgggtaggaagaatcaatatcgtgaaaatggccatactgcccaaggtaatttatagattcaatgtcatccccatcaagctaccaatgactttcttcacagaattggaaaaaactactttaaagttcttatggaaccaaaaaagagcccacactgccaagtcaatcctaagccaaaagaacaaagctggaggcatcacgctacctgacttcgaactatactacaaggctacagtaaccaaaacagcatggtactggtaccaaaacagagatatagatcaatggaacagaacagagccctcagaaataatgccacatatctacaaccatctgatctttgacaaacctgacaaaagaaacggggaaaggattctctatttaataaatggtgctgggaaaactggttagccatatatagaaagctgaaactggatcccttccttacaccttatacaaaaattaattcaagatggattaaagacttaaatgttagacctaaaaccataaaaaccctagaagaaaacctaggcaataccattcaggacataagtatgggcaaggacttcatgtccaaaacactaaaagcaatggcaacaaaagccaaaattgacaaatgggatctaattaaactaaagagcttctgcacagcaaaagaaactaccatcagagtgaacaggccacctacagaatgggagaaaatttttgcagtctacccatctgacaaagggctaatatccagaatctacaatgaactcaaacaaatctacaagaaaaaaacaaacagtcccagcaaaaagtgggtgaaggatatgaacagacacttctcaaaagaagacatttatgcagccaaaagacacgtgaaaaaaacgctcatcatcactggccatcagagaaatgcaaaacaaatccgcaatgagataccatctctcaccagttagaatggcaatcattaaaaagtcaggaaacaacaggtgctggagaggatgtggagaaataggaacactttacagtgttggtgggactgtaaactagttcaaccattgtggaagtcagtgtggcaattcctcagggatcttgaactagaaatgccatttggcccagcaatcccattactgagtatatacccaaaggattataaatcatgctgctataaagacacatgcacacacatgtttattgcggcactactcacaatagcaaagacttggaactgacccacatgtccaacaatgatagactggattaacaaaatgtggcacacatacaccatggaatactatgcagccataaaaaatgatgagttcatatcctttatagggacatggatgaagctggaaaccatcattctcagcaaactatcacaaggacaaaaaaccaaataccgcgtgttctcactcataggtgggaattgaacaatgagaacacatggacacaggaaggggaacatcacacaccagggcctgttgtggggtggagggaggggggagggatagcattaggagatatacctaatgttaaatcacgagttgatgggtgcagcacaccaacatggcacatgtatacatatgtaactaacctgtacattctgcacatgtaccctgaaacttaaagtataataaaaattaaaaaaaaagaaaagaaaacttctagacttcccaacactttgagaaacagttgccacctaactactaaagcaaaatgaactaaacctaccactggaactcaacctttaggcattttaaaaggccatttttaatgaattccctttcagctcttagtcaagctcatctttttgaattcgatctttatttttaacaggagcacatacttaaagaggtagaaggtatgaagaggtcagcagtgatcatctttacttataagagacaaagcattcctcttggaaaagtcaccataccattttggggacttaaactttgaatattttttcaagaaaacacatttatgacaattcattatgctagagattctttttttttttttcctttcaaaaatattttccattttatgtcttctaaggctgatgaaaacaggccttccaactctgggcttgccttattgcctgtctgtggctgaaacccaaacattttcctattacagtttaagtgtttttatgtatgttttatacccaaattcagtaaaggtttgacatagaccaaggtaacatttcaggcagtatctttaaaatagaaatctattttcagattccaggatgtagaacagttggttttgaatttataactttgataccagcattttcctctttaattgtacttctaaggatacctcctggccaccaaaggacactggcgtggtttatttcagtactgtgataaagtgattgagaactgagattttattcccaaagaggctaactcctttatcttattctaaagccaattattttgcaaattagatccactgcttacatagtatgacatgtgaatagatgtaaggaaatccatcactactactccaagcatatgcctactgagtaatgagttagcaggatcaccttcatgtttgaagacaccaggacgatatagtagaggagaacgtaagctctagtgtcagaacgcctgggttcttattccatctggctagctaggagactttgggcaagtccctcccctacatctcagtttccccatttatactcaatggcagtacttcccaaattagtcacctcatatttagagatatttatttattaatactatatatatatatatatatatatatatatattttttttttttttagacagagttttgctattgtcacccaggctggagtgcaacggcacaatctcggctcactgcaaccttcgcctcacaggttcaagtgattctcctgcctcatatatagctgctttattgagatgtaattcacatatcatacaattcacccattgatgtaattcacccaaatgatacaattcaatggtttttaatctatttacccagtggtacaatcattactacaatcaattctagaatgttttcatcactgcctagggatctttaaaaattccaaagcccagactatgccacaaatcaattatatcacagtctatggcggtgggacacagacatcagtagtttgcgaagctccccaggtaattccattgcacagatatgtttgggaagccatgctgcactggaatcactgtcagagtttcagggaaaataaacacagaaataaagaaagaggagatgttcagcagagagactgtcctatgataacataagcacagaagtggtggtgagaataatcatactgaggacgaatttaatgggaaagactatttaaagaattacactgcaacttttataatcgggactaaaatagcaatttttttactcgttggtaatacatctccaggcacagcatcctctgagagtatgtataagttgggaataagagtgttgaggtaggaaagggatcaggaggagataagaacctgtaacttatctaacacatttcaagacattaccaagcttcttggccttctaaaaagctcctggttagccttacaggatgccactgaagtgccacccctttgtgaaatcttttcccactgaagtcacagtttgatgcttcttaaagctctgcgtttggcataatacagcaattatcacccagagtcatatacttcagaagttggtcaccttcaccagggcaagagttctttgaaggcagaaacaatacttagtacattaaaaaattaaaaaaaaaaaaaaaaaactatctcaagagcctagcgcatgttatggcacagtgttgacaaatatttgttggactgaaccaaagcaaattcacatccactactgtcaacacaaaaatgaaaaaaaaatagtgcactagttccaaagttcccagaacacttaggggccattgtagctctcagaagactggcaagcaagacctgcaattttactctataagggacattgtaagagcaaagcttggggtacttaataactccactaaataaatggcacaaccacaagctgttattaggaacactgaatagaggctgggcacagtggctctcacctgtaatcccagcactttgggaggccgaggcaggtagatcacatgaggtcaggtgttcgagaccagcctggccaacacggtgacatcccatctccccgtctctactaaaaatacaaaaattagccaggcttggtgatgtgcgcctgtaatcccagctactcgggagactgaggcaggagaatcacttgaacctggtaagcagaggtggcagtgagctgagattgcatcactgcactccagcctgggcaacagggcaagactccatcgcaaaaaaaaaaaaaaaaaaaaaaaaaaaagaacaatgaatgacgtattaccaacactgagatcaagaaaaaaaattgccatccaggggaaaaagattaattaatatcaattaattttcttttacaggagtagattatacagaagtctttaggcttctgaggagaatttgagaaaattttacagtaaacaggaatttgcatacgctctgggagcaaaaagtgtgtccccagacaggtcacctggggtatgttcaagatgaagaacaaaagtcgggcatttctctaagtgtagagtcaggagggtgcaaataaaggcaggctttagagggaatagagaaacttttggattcaaaagaaatacaattatcattacaatagagctacatggttacacaataagcaatactattaagcaccctctctggaaagagtgttctttgaaaaacaaaatgcagaacagatccaaaagcaaggtaacaaaagctattaggtgaagtccatcagaggaagaattctctttccatagcatcttccttcaagtacaagataattatgttttatttatggcacaggaatagaatatgagattcaccattcaataaactcaggaaaatcatttctttggtcattgctttttatttataaaatgacggcttggatcaaggtagtgtttcccaaggttttctttctttcttttttttgggggggaagatttaacaggcattacttgaagaaacttagagtcaatagattctaaattatggtcacttgaaaccagcaccacaagattacccatcaagacctaatcaaccaaattaacaattagtatttgggcagaaagttgatgcaatatctccaatatcaaggcagtacagactgctttgaaactgatattcttctctgtgcatgcatatacacacacagacacacacacactcatacacacatatatttataattccttctaaatatttgaatgttcatatatataattctttctttttaattactccaagctgagcatgtgtaggttagattcactctgttttataatatttattgtgtttatagaatatgtccatcacatcctagcccctaggcatgtttacaaataagataggaaaaaaagagactgttgataacataatggctaaaaatccacagccaatattttcagaaagatcacacaaatgcacatacatgcatacacacacagacacacacacactctatctacagatcatcctggtatccaatgtgaattccatcagtattctcagtgcaaaccacaccctgtggtttcttttcctactccctacacaacttctgccatcttgagtcttaaaatataaaacaaaaaaatatatggtccattgatggaaaggatagaaggctttagatgggagacagggtcagattcatcacatcatttcttttgacagcctagcacaggggttaatgttggctggggagatggaaaaaggaaagaggtaatgggagcagacctgggaccagttggtcagcaactcgcagagttctttaatcaccaacaacctccctgtactgaggcaacatgctgctaaatgctcaacatacagcatttcgtttcatcctcttgatgtccctacaaggtagttcctattatttccatatttcacttgataaaactgaggcccaagttacaaaatatcccaagttacaaagctactaagtggcaggctcaggacctgcacccaggtcttcccaaggccaaagtttagactcttcaccagaactgcttggctttttgctagaaagcctggggtcaggaaggttaaccattcacaaagagctcagaagtggcaaggcctggatggaatgcaatcatgaggacaacatggggcactgtccataactgtgtgatattgcactttccctgatcaaacgtcccctctgagggtgtcctagggacatttgagaccatttccctctgacacatcccttcttctgcagaagcacccatctcctttagaatttgaatttctgctaaaaagtagatgctttcctcacaaatgtcccctcctcctgtattctttctcctcttggatctccaaactaaaaactgtagtgggtatagaaaggagagtctcaagtgctgtgaaaatctttctagaggactttcatcccttcccaacagcctgcaatgtggacttctgtcccctcagtaacaaaccgtacatgtccttcctgaactgagaacgaacctgcagcatccagagcagctctaagaagcaggagaagacaaaaaaggcatgcagctccctgctgctctcaggaaaggggagagaagcgcagctgcctccgttcaaggctgggtgagagtgatgagtcaaatgactgtcatcatttggattctgacatttcttcctctacagagaaaacgaaagagtctgctattggtgatcattcattctgcgttcatttatgtcttgtgtactttttttttttatttttcgagatggagtcttgctctgtcacccaggctggggcgcagtgacgtgatctcagctcactataacctctgcctcccaggttcaagtgattatcctgcctcagcctcctgagtagctggaattacaggcaagcaccaccacacctggataatttttgtacttttagtagagacagcatttcaccatgttggccaggctggtcttgaactcctgacctcaagcgatccacccgcctcagcctcccaaagtgctggcattacagacgggagccaccacgtctggttagtattatgtacttctgactattgtgttctactttccgatttaaacaatgatcccagcagctatgggagctacaaagagccaggagtttggaagcttttcaagacactgtgagccctctccttttatcctgacttctttctcactttctgccttttcttgaagaacaagaaaagcaactccagtggaaaccacttaagcctgcaatttagctcacaaattgtccccagcatccttgtatctccttctccaactccttttttttttttttaaccttagctcttcctgatgattgtgagcatagctcagagtaatgccaactgttgctgtatcagcttaaatcagtgtggtacctggtgatggggcacagttgaggcaggcactacgagcttagacgagccttcagccccaactgaaagggatatattgtggagcactcacgcattctatagccccctcctaatccctcaagaatcccaggctgggaatggctgcaacttcaggattgtaaagttgtgtaaacacatctttacattgactacatcatggtccaacgtaacactttgaaacaaagggcttgagtgtgtccctgtaccccttcattcctgagttaaaaacaaagctccatcagtcgactcatatttatagagtgctccctgctcatctcctttcagtccttccgcttgccagggtaagaaaatttagtgcagacgatcccagccttcccagacttccctcctccttcctgacagaattagttgttgccccccaccccccatgttttatcatagccctttgcacactgtgttccccttatttatatgcttgtctctccagttgactctgagcttcttgaggttgggaacatcgtttgtgcctgtcacatctttatgggcccaagaatagagatgataggcaaaagtggagtaaagaataaaggaagaataaacatttttaaaatcagtctccaaagagttttccttctggcaggtaagacaaggcatacagtgagacatgaggcaaggcagtaagtaataagggtcagaataaaaaggaaaaagaaagcgactgttggacttggctgagtaggttgatagcaagctagtaagaaacatgagtaggtatcaaatagacacaggtgcaaaaacagggctgagaaaggtatgtcggaagggatgtctagttccaaagtgtgctgagattaaggaattagaaatgtaagctgagctccagatactggaagacttttagtatcaaacaaacaattccatttttttcttttgtctaaacattagagatgggtacacaaagaatatttacctggttggaatgtccagaaggactgtagtggactggaactcatggaagggagacccaatggaaactgtagaaacaggcttacacaatagcagaggaaacccttaatagttattttaatcaaataagattttcatttaaaagaatgaaagaattaagaagaccacagtataaaatgtaaggaataaagtttatagagagcaactggcatcggagacagaattcacaggtcagaagagaacttacaaacataagttccagttcttggagagatgcaagaacatactgctcctataagttaagaacaggttgtttgttcatcagaaaatagaattttatgccttacggttcacatgaagagttgtgaatgaaagtatgagcagtgcaaaggaacaatgagggatgccgggacaccaaagactagcaacgggaggaagccatgactaccacaactgctgaaaggacaagggcaaaacagcattactcaaagccactggcagccacagtcacggaggccaagatgactggtgggagatgtagttgcagaaggacacagttactatcgtctggcaaataaaggagggaatgagtatactcacctccttctcttcacaccctgtaaacttacactaatgcctcccattgagcaaacaccagggaggaagtccaggagacgcaagacagagacgggtagaagttgaacctcaggcaaaacaaagattacccaacacaaggctgtataaaaaaggaaaaaatcagtttaagaggcaagagcgtcattggaaattaagaatatgattggtaaaatttttttaaaaaatacaagaaatggaaggcaaggcaccaaacatttcctaggacaaaaagataaggaggtggaaaatatgagagaaacgtcaggaagcacagaagaggggtcccagagagagctctgagtttaataaacaccaagggtatggtgtctgcaaatgctccagggaaaaacacaagcaaaaggaaagaaatgcaacctgaaaattctttaggattcaataacacgtaatgataaaacagtttctttgccccgagtccttggagcataaaaaaatctgggacaatccgttcccttaccacatcagaaaagcaactttttgtttcgaaaggtctgtggtgaaacacaattccatgacgttaatcaatttatttcaattgggagtgaagcataaatgaaaagttcctatttcagaacagaccgtgaaaatgtgaagatgttattatttccaagctaaaaggagatgtgagattctctgcctggcacatttcagaaaggtacaatcagccggggcaggggaatagatttaaaatagaaaagtaatgggaaaagtgctttccatgtaacagacagggtggtggatgaaaacctatccccctaaagcccactttattaatatacattttactaggcactttggaaagtttgaaaatccacatgcttctcatttcccatagcttctgggtctaattacatatttgcatccatttgcatacacacacacacacacacacacacacacacaggtctcatccagtgatatagataattcaatattcaacttgtcgatcatcaccttaaaatagagatctaattatggaaaaaaattgtatgctgtttttcaaataaataaaaaggaggacactgattaaaaatataacacccctcattgatcaacaggtacctttttggttttaacctatcataaacatgaggtttggtactacatggttctggccctcccaaattaacactgagctagttcagggaacaagctctcacataccaaattctgaagctgcctttcagcagcaatttgagggaccaagaacataggctttccaaatgtctagaagctaaccagattcctctctccttaatttagccccttacattaggtgccccatgctctcttttgggtcaaaaataacagggacaatttaataccctatgactgtccattaaatatctgaattatgaggattcagatgtaaagtgcaatagtattttaataaaagtacactaaataaggaagctggtaatagacctcttaacgaaaacgtagtcaatggttcatttaatttgatggcagagtccactttcaaataatcccaaaagtgtatattttgtaagaaaaaggttgcagagttcacctcagggtattcttaaaaaattgtttgcacactgagaagacatcagtgctaagaggctttcctgattactgaaatttggttggaagtcttttttatttctattaaatgaatatatacaaccgttcggctgcctcaggacatttatgaaaatgagatgctctgtcttaaggaagttagctttaagagcgacatttgaatcattagatgcctcattggctgttacaaaaacaaacttcaatcttctgcttccccttttctaatattagctaacaataattaagttgcttagacaattccaggtgactcaaatttcatagcacgctcttcaaaaggctaagggatcactttaagttcctaaagccctaagactaagtgtgtttcactcactttgtgtagctccagcccagcatcatgtaccaaagggataacatgattaaaaatcatcaacttgtcttccgaaatctgtttctaaaccacagcacaaggaacagacatttaaatacagaaagggatggagaactacaatcttttaaaagtgcacactttagtgcccagtgtggtggctcacacctgtaatcccagcactttgggaggccgaggtgggtggatcacaaggtcaagatattgagaccatcctggccaacatggtgaatccctgtctctactaaaaatacaaaaattagctgagtatggtggtgtgcacttgtagtcccagctactcaggaggctgacgcaggagaatcacttgaacctgggaggcagaggttgcagtgagccgagatctcaccactgcactctggcctgggcgaaagagcatgactccatctacaaaacacacacacacacacacacacacacacacacacacgataaatattcacatcatctgcctttggttattcaacctatagtttatcatgggaaacaagatcttattcttataaagtacctgcatattttcatttgctagaaattaaccaattcagcttatatcatatgtggcacaaggttttgtcatgaggaggacatttaaagaataatttaaaagaaaacaagttcaaacgttcacataaaacaaaatagccatctctaaggagaaaatgggtattgctgatcctaatgttaatattctaaaataaatgaaacatttttgaagggagtattcaccaccacagctaaagaaagccacaaaaattagtgtatatgtgcctatatttatataggtacatttcccaattttattcttttactattacagatagctaattcctaggaaacattttctagatgtcttcttttatataccatgtctttggacattaattacaggcaaagaaagtaaacactcacaagaaaaagggaattttacaatctgatcttcaatgttatctcaagaaatgctgttatagctccttggttctggtttccatgcacctgcaaattgtcctttcacccatcacttgtaagtagtagaggagcaagcatacctgtacagtcatgcattgcttaacaatgagaagttctgagaaatgcatcattaggcaattttgtcatagcacaaacatcataagagtgcacttacacaaacctagataggtatagcccactatacacataggctatacgctatatgctatatgctgtaacctattgcttttaggcaacaattctttactgcatgttaacatactgaatactgtagataactgtaacacaagtatatttgtgtatctaaatatagaaaaggtacagtaaaaatatattataatcttatgaaacctcagttgtatgtgtactctaccactgatcaaaatgtcattatgtggtgcatgactgtatgtgaacatttcttgatcataaaaataaagtgtatgttgacttagttagtgccctggcaagttaatatgtatgttgacaaactataatgcttaacatgagtatggttaaaataacactatgtgaatatataaacacatgtctatacatatacacatatatacctatatatacacacacatataaatatatacatgcttataaattacagtctgtcttacattagctaaactattactacagtttgagataaatttgagatgttacaattggaaatctcctgtttcaatttgagaagggaaaatgttggcatattctcctgagtggagaaagaggctttctatgtcagcagatacttcagaggaacgttaatgtctcgaggtttctagcaaattaacagcccaggtaacaaaatgcagggaactctggccagttgcttacttactcagttggatctggccacttctccatgtattcccaccacactaaatggagcatgagtcatttgagtaatgagtcagaaaatgtctagcagcctccgtgcaatagcagacgtgatgcttaagataaatttcagagatactaggatggtgtttttcatgtctgcacatctctcattggtgatgaataaaattccttctcccttcccaagagacaaaaactgtatcatatgctatcctgaggctcgttccaactctaaaatttaaaatttcaagcaaaacctatagaaagaggcaaatacagtgtataaatgtctacaatttgtgtcctattcaaaattagtttttgtggaatgttgtctaatggattcagtggtcacgttaatgacaacttcactcccaagtactacatgccctgttaaagaaaaaatgcttaagtgaacaaaaaatttaaacaaattttggagttcagtgaaattaatgaataatctctttttcaatcatccctgattttttaaaatcacaatacctaaattatgatgataggaattactactagactttgagttttaatcccagtaacatctttagctgatttaaacctatttcaacttccattttaatatttcatctcattttatctgtatggttaatattaatttcctttttgcaccttctggttgtagcacaaagccagctatacaatagttgtgtgctgctgaatggaatttgaaggcaatataaaataatgtacagcatcactgaactggggattaaaaatcccaagtttgagtactgtcttggcaatgcactgcctttgtcactcaggtaagtcacttcttccttacaaaagtttcttccattacaggtttcacctctcatgacaattcctatcaattagttgaggctgtctggagtaattaggcaggacgctggtgggatggagtgccatgattgatgagtgatgcctgccaagggtgtatgacagcgaagtggtagcaattttgtcctgtacttggcaattgtagattagaacagggctgctcaaatgtgcatctatcaccaggaagcttttaaaatgcagattctgattaagtctggggcggtggctgagattgcatagttctaataggattccaggtggtgctgatgctgcggagttagagagtacacaagaagcaaggcaaagtcccttgcagctctgaatgaatatggaatctcaacctctcattctctcttgctcactcgcacacacattatttctactttatgtatgtgaaaaggtgcttacatatgccaagaatactgacaagcacattaaatacgtaattctcatcctcccccacaaaaggtagttagaagttttcaggtaagaaaatggagatttaaagagggtaagtaatttgtctaacatcacagagctgacaagtagtctagatgagagatgaacctagagaacttaattctagtaccttgctcttgacctctatcatatgctgtcttgatactgtaacaacattagactgcttacttagtgccagccactaggctgttttgtacatattatctcctctacttttcttaagaactctaggaggtaggtaatatttttgttttacagataacaaaattaattatccttccactgtctcaatctcggtaaaaccatagtgattcctattaagtaaaacattagattcatatctataatgaactaaacacaaagaacagtaggctaataaaagcaacatgtatatgcataaggctaagagtaaatatataaaaatattcttttataaattcatcctatgtaaatgcatttttgacaggtaaactcaaatgtttctgcagagtttagtgatgaggttatcaaagtccaagtgattattggtcccaaacagaatccatcagtgggatttacagtgggagaagtatcaaagattcttttttcatcatactcttttactacctaaaagttctttattagcaagcaaatgaaataagattggatcagtaaatttccctggagatgagatttcaatataagcaggtgacagtggatgctgcaccgatgcacacttaagaagagcaaacaccattgcaatgtgagggcaggatttttgctttactttgtttaaaaaaacaaaagtgtgcttcaaaacctaagggtctgaagcagtgattctcaaccttggctggaggctgcactttggaatcaagtgtgtagaggggacttaaaaaatactgatgcctagatcccctagagattctgatttatttggactggggtgcaaccgagacatcaggatatttttaagcttcttagtttttaaatgtataaccaaggttgagaatcatttgaatataggcatacctgtcccatgtggggggcgactagtcattaaaggcatgaatgtctaattgatgaatgccctcgtcagagcagactggtggcattcagagagcagcaaagactttctcccttgaagttaagcttaaatttcataagtaagtctattttaacagaaaattttataaaacatttgtagatagtctgaactacgaaaatcattttctccccttaccagaattatttccactggagggcagtctcctcttgggaagaaatgaatgcggatacaaccttcttaacagaccaaagtttaaaatattgactaagactgtggcattcacatgggtttcatttcaagacaatttctgggagatggagtatttgggataaaaaaaaatgtgtattctatgtgaagatactgccaaattaaaggtttatttctgtctgctaaaactaaaaggataaaagcttaacccaaaagataaacacatccacatatggaagaccctggggtgtacaaacataacaacaacaaatagaaagtagcatttattataggtttactgtgtgtcagatcctgtactaagcaatttaaatatcctacttgattctcagaacaaatctatattttataggtaagaaaactaaagctgagaagtgttcaaagaaatgtgtccaataccacatatcaaaaaagtagctgagctaggacttgaaccctatctgcctgacttcaaaaccagcccttgcaatcaccaatgataccgctttactgcttgagtgagaagcaacatggtccctatgcgtaagacaagcgtctaaatcagaacatgtcaacacaagaaaacaggaggaaaaaactctctttacacagcattaggtaatgaaagaaactgaaaggaggtgattcgggcagaatgagaaattccttattctccttactggttttatattttaacagttttcacaaactgtttttggttcctcttcatttcttatgcaaaccctttccaatccattaaaaataaatttggcattcccattgctatgtcttcagccgctgtacagaaccttggactagctggtcatattcctcagagacttatttcctagatcaggggttgtcaaacgttttctgtaaagagctggatagtaaatatttcaggttcttcaggccccacggtcttggctgcaactactcaattctgccagtgtagcatgaaagcagccagagatgatgtgaggatatagatgacagacgatatgaacaaaaagggcaagactggattccaataaaactttatttatggtcactaaaacttgagtttcacatcattttcatgtgtcaccaattattattcttctttctattctttttcaaccattcaaaaatgtaaaagttatctttagcttatgagccacataaaaacatgctgtggcctggattcagtgggcaggtggtaatttgccaatccccgtcctgaataaggtgtcctgtattcatttgccataacgcaaaggtcttgtcacaaagatatctagcaatggctccatgctcaaagagcaaatgtatccccagataccatcagctagtatttcagaatcagctgccttcccccaaaccactttttgctattgtatacaaattctctcagtagtaaaagtatcccagttaaatcacatcagcactctgggaaatattcttcttggggaaatattacagaatctggaatctgaaaatgatccagaaggtcacagagggctgtcatttcccaaaggcattctccagagcctccaagctcctcacagctgcagatacaggtataggtacagttccttagagaaaatagctccacagaatgaccaggacctaagaaagctcttagcaggggtgtgctagagccatctcctatcagctcatagaagaactcattatatttttcagcattttgtgagccagttgacatgagttgataacctgaaattggccatggtgggagcatcagcaccacagaaattcagaaatgtgtattcacaagtgttacaaattaggctttttttcccctctgagagcaattgttaaacattggccagcatacctctatccattacccctttccaacagacaaactcctcttagatctgttttacacatacacacatacaacccttgtgagctgcggtggcggtggcagtaactgtgggttcagggaaaggaaagaatttccccaagtaataaacaaatgtatttaggattaatcaccattttagatcatccttgagttactactccctttggaatcccaaatgcattccccttttatattaaatatggtcaactggagactaaggagttcaatcatttttgcataggatcagaaatttatcagaatcttttatcttcaattatcttctgtaattttatgtgttcatctaacatggacaaaaggaaagaagttacaaagtcctgcactgcattgtacaactgtgatccaagaggtgccattttcacttctgcatcatgctaattatccatgagcctattcccttttttatttttgctactactgaatgaagatccttacaatgtaatatctagcaatgttctaatgttcctgaactatatattatttgtttttaagcaagaggctctctgattatttctggttcctggtctcactccactaaactacatgagcccataaacctaatctaaacaaatcattttgaatttattttttctgcatttgctgccttcatcttagttttgcatcacttcaggcatcaacaaaactattttaatacaatcctttccctctacttctgcaagattagaaaataaaagagaacatttatagctactaggtgagctggaatatctaaaaagggattatatccctccctatttgtcaataaatatgacaatagttcatgtgagagtaagctgaagctgagtggcctataactaattctgaaaatttctaagctttagaaaaggatatccaggacttgaatgctcctgaaacgatacaacacattcatgcgtaatcagagatacgtagattcaaataaatctacctctacaatcttcagaaagcaatttttggagtcagacacaggtgcattttgttagagtttactgaaactctttacattgtaaagctgtagtggtagtcacccttaagttattcatagacaatttcaattatttattcatagactcacatgatgttatttttcattcagatccaaagcttgttacacattctgcaacaaaatatttaatgaaattccaagacttaaaaaatcttgcagtgaaagcaagaaagacctatcaatactgagtcaacagagtggacctaccaattcaaccaggcttggtacccaaaggcacaactcaacataaagttaacatttcactatgtaaattctaactccagtttctttttgaaacacaccttccggtcatctatttttccttcttgatctgttcataagtcataggacagaatcaattacctaggaccctttcattgtcaatgaaaatatatttcccaaagtgggttctgtgaaacactattataggcattattacagttgttttactattttttttaattccagatttggataaatttgggagatgtgggttttcactccttggggacttctcagagcccttagtatattaatgtacatcagaactctccaagtagggcattagaacatacagtattatccatacattttaaaacaaaagaattttcttctcatggagaatctcattggactagtatcccacgaagcacactttcaagaatgctggtttataagacacagctgagatttgcatataggcaccaaaagtggaaccacagagaaagggggaaatcatctgagatccctctcacatgagcacactggctgcagtaaaatgagcaatagaaactgctgagttcttttacatctatttccagatcctgtcaaaatgaataaataaaggtaagcagggtaggaggacagcaatcctgtgaaataacctccccccagtctatttgatagtttccatgacttgatcattgactcatcaaaatagacagatgtgctcttatccagcaaagtttaaagttagagataaaaacaacaacaaaaacctgagcttcaccttcagcaaagaagtgtcagctggagactttagaaattcaaagaggtaaaaacagaactatcattcaacccagaaatccccttactggatataaacccagagaaatataaatcattctaccataaagacacatgcacaagtatgttcactgcagcactattcacaaaagcaaagacatggaatcaacctaaatgcccagcaatgatagactgaataaagaaaatgttgtatatatacaccatggaatactatgcagccataaaaaaagaacaagatcacgtcttttgcagaaatgtggatagagctggaggccattatacttagaaaaccaaagcaagaacagaaaaccaaatactgcatgagcttactcataactaggtgctaaatgatgaaaactcatggatacaaagaggcgaacaatagacaatgggacctgcttgagggcagagggttggaggagaaagaggagcaaaaaaaataactattaggtactatgcctagtacctgggtgatgaaataaactgtacaataaacccacatgacatgagtttacctatgtaacaaacctgcacctgtacccctgaacctaaaataaaaattttaaaaaattcaaacatcctgcctaggattacaaatttattaaaaaattatttccttccatctaagctctctatcagaaaagtaatcatggaaccaacccaaatgcccatcaataacagactagataaagaaaaagtagtatatatacaccacggaatactatgcagccaaaaaaggaatgagataatgtcatttgcagggacgtggatgaagctggaaaccatcatcttcagcaaactaacacaggaacagaaaaccagacacgacatgttctcactcataagtgggagctgaacaatgagaacacatgaacactgggaggggaacatcacacactggggccagttggcgggtggggagcaagggaagagagagcattaggacaaatagctaatatatgcagggcttaaaacctagatgatgggttggtaggttcagtaaaccaccatggcacacatatgtaacatgtaacaaacctgcttgttctttacttgtatgctggaacttaaaataaaatttaaaaaaaactcaaaaagagaaaaaagtaatcacctgatattcaccgggataaagaaaggaatttagagaaatgtcttttgtccctacagttgaggcgtaaaacctgacagtgaggatgaaggcccttagaagccacgcagttccactaacaagcccatgtagttatttctacctccattacctgctgctttattaatataattaaccactatttattgagcttctgctaatgccaggcactatgctaggctgtatgcctatatttttattttatcctctgaccatggtaacatcggttgtcttattatcctgatttcacagacttggcacagagaagttccgtctcatgtcaaagatcacacagcctggctggggtagaatctgtatcaggaggcaagtctgcctgactccaaagatcatgcaatgccccttctccttttttttttcccttccaccactcttctgtcatgccttttccctagctattaccatttaaaagcagttgtgattaaaaacaaaggtcagctgtccataacttaactcaaatgttctttcttccttgctcttagagacaaattaccatcttccatcattcacgtggaccaagaaggatttaggctgagatgattatgcataataatctgggtctcattacaagctgagcacttggaagggccattctctcagcccttaaggcagctgaacttgatcatattttcattttcttttctccctatatccactaaagatcaactgacacagaacaaatgaagttactaacaatttactgatttctttaaaatatatatcttcaataaaggaagaacaaacagtcaaatgactgaaatctaagtacggaatgtgaaaaatgccactctctaaaattctcaaaggaagagaagaaaataaagaggggaaggagaaagagaggggaaggagaaagggagaaaaagaatcgaaggagggagagaggaatggaaggagggaaggaagggtatagagatcatctgcattagaatcttctcaggctgggggtccctgagcccactccagaccaactgattcagaacctctggggtgggatccaagactgcatttgcacacactcctctcgtgactataatttttttaattcatttatttttgagacagggtcttgctctgttgcctaggctggagtgcggtagcatgatcatggctcactacagcctcaacctctcaagctcaagtgatcctcttggcctcagcttcccaaagtgttgggattacaggtgtgagccatcatgcctgtcctggtgattgtaatttacaccagattcaccttaccctaagaagtgacttgtatatgtgttgcttatggaagtcagaagtttcccaagtttaagaattcagcatttagctccaggaaaaattggtcataaatatgatgatgacacatatgtgagacaatgactgcatgagtccaggaaagaataaagacattctcctgagaaagactcctcgttggagcctatgggttctaccgggcaggtgactcacccgttggagtcacaggtgactcagcaacagggttatgtaacaagaccaccttccttggtgctaattttagatttaaatagagaaactatttgaatgtcaaattaacctttttatatagagagagaaaaagtataacccaatgtaagcacaaggtaataagcacagggcaacacattcaaacagatgcaaagcacgtggagtgaaaagtgagttttccttccaggcccaaccacttctttctggcacttcagaaacacactttgtagaaccaatcacttgtatttgtgtgaactcctccctgttaatacaaagggaggaagcccattatacacacagttctctccttcacttttcccagaataacatatcctggaggccattctccacagtacatacacatttacatcgttcttttgaacatcatcacagtccatgtatttgaccagttcactttaataaacatttagactttttctaatcctttgctaatagaaatgatgctataaggaacactcttcttcatatggctttgtccacgtcgggggatatatttttaagataactctgtggaagcaaaatggcaagggcaaaggatacaggcacttttgagatattgccaaattttccctcccaggaagttgtagcaatttaaacttctattaatagtatatgatactacttgtttcccccacaccttcaccaaagcagtatatttttgattgtgatttaatttgccacttcgacttcttactggagaaagtgctgaccagcaaacatgaatgtaacttggcagctatatttctcctggagaatgaatacattggcattctaatttatcatcttcttatgcattaggtaagtatgaatctgtggccttgaccctcttcaactctgggtaaatttacaaactttagtttctgggcctgctaacacaggtgaacagtgatgcctccaagagaggacacatctacaagactgctggaaggagtcctcttttaattttactcttccaagttttaaaaataaattgcaaaataatttttctctaataagttaacgatttaaaattgtaattcaattagaaatttttttaaatattatgaaccaaatttttcttgctcaagtctgcaagaagggaggaactctgtggaacgcttcagatcagaccaccttggcggacatcaaagatctaattcaaatgacatctactcacagactcagtggtctgcttcatggattcaaaagttaatcaaaattcatactacaaatgctgttactaatcgccacagcagcaaactagaacccctccttgcccaccacttttacactccacccccagagaataacagacaacatgctgtttcttccagtaattcttaggatgttattgatgtattgtttatttttcatagagtccatgcacttaggaggaaacagggcataatatatatgcactttcagaaaactgttttaatgttataaataatatccaaaaccattaatgagttttagaggtggctgccttgcagcggggaattacttaagcactggaaagccaatcaacaaatatttattttgcaacttctgtgtgcatgcctaaaaaatcttattccattagtaaaataagtccatctagaaaaatacattaattcaacgcatatttactccacactcacatgttgcaccacagctccaagtgtgaatgaggcagagaccctgcactcgagttaggaagacacagccaactgaactgatgacttaaacgcaaagggacagagcacaggctatggcaggattacagaaaaagggctcctcatcaagccttgagggaatcagggaaggcttccaggaggaagcaaactgatatgatttccaagaaggattcatccaggggggaaaaatggacagaattagggaaatactattgcttaatcatagaagttcacctaaaccccatgaaagtcagcaatagtaccgtttctacctgaaatacagtcagcccaggattagaatatgttcagctctcatgtcataaaatccctaaagaactttctgaaaagctaagcccactgataagaataaaggaaaagcatagcaccccacaaactaaaacatattttccattacaaatacattttcaccaactctgaaaaaccaagtggacatttaacagatcctagaagactttgctccctaattgcctcccaataaccctcactctcattaaactacagcatgaccctctagtttggaggcccaccttctctttactcaaaaatttccaaacctaatgagagatagtcttagagaaagatgatggacttaacagactgagacgtattttccttccttggtgtttacattatttgacagcaaggagccccagagcaggagctagttccaagcaaagtccccaaagaatatcaacaaggaaaaacagccactaggctgtataaatccacttgctataaaattccaacacacacataataaccagcatatgaagctgaatccttataggaaaacaattcaaaatccaggtacattcatcaggccctccccatgtcgtggaagactaaagttagtagctcttccatatgttacactatgaaacaagatgaaaatggcagagaggaaaatgaaatgagccttctgagattcattctttagtttgttcgttcaaatacacggcagaagagggtgctttccatacagaaattattccgttttgacacactctaacttaggctatttggaggagaattgtctggctctaccttacagtacacacttcccaaagtcccacaaatcatgtggctttgggagaagagagagttcggggagcatttaccccgaccataccaaaatgaattaacagggattaatttgggttacatggtctatgtgccagtcagaacagcttccagtgtgtttcagaatttaaggtggggaaaaaagaaacagaaaatcggatttcaaaactaccctttaatgaaaagctgttaaagtgatttatcttaacaaaataatcatcaaattagaagctatatgtattcttaagacattttgaactccacattgtatcaaaattaggtagaatatatatattattatatatatattatctctctatatattctctatatgtaacctctatatatatatatactatatatattccatatatatactatatatactctctctctatatatatatatatataaaatcatagatacaccatgataatttactgagaatactaaaggagatgcgaataaaaaatatgtatctagtctatttgttagaaatcaggtatacctatctgcaacagacaaaaataacaatggcttaagcagacatggtctaatttgctcatgtaagtctgaggaccagcagaccagaacttgtctggccactggcaccgtggtcatctaaaacccaggctgctttcagattctcttctaccacctctgtgatggttcttattctcctagcccaagatggcattccagccatgccattcactgcctgggcagcaggatggaggcagggcaggcttccaatctttaatgacatgttccagaagttgcgcccatcacttctcattgtcacttgtcagaatttgattatacaaccccacctagaaacaaggaaggttagaaatgtaatccttcctctaggcagttgtgcaggctcccagaagaaacagagctggattattcaagaaaggtaagcgtcagaggtagtaggaaagtagcctgagtctggagagagtgagtagagcctccgtgagatcttgtcctctcttctagcccctcatctagcaagatttacagtgggttcctgtgcctgggatatagcactgtcttgatggttatagcaaaggtcccagtggctgtgcctggcttgaaagaagtcaacagcagcaatagcaaagcttgacctcaaattgatggcacagacaggcataaagagaagcctgcccatcgctgggtatcctgaagacctttctccaacatctagggggaaaatgtgggctttcattcagtgggcagagcccacactttcattttgactagaacatacattctgagtatgtaatcttctattggttaaacttagttatactctctcactttgtacccttaacaccacatacaagactgcttttgataaggaataaggacaggagatccttttttgtcctccaactagcctgcaaaaaagtattactgtagattgatattgtataatattacaaagaatagcactagcccaggtgacctgacacttctctataataattttctctggcacattaatttacacttgcatgcatatcactgaagaaaggtatttggggtttctatcaggacaataacaggcttgaaattagtgttgaaaaacattcacagccaggatttcaccccctgcccctgggttctctattttagctttctacattggcaactttcaacttttgctgctcaatgcaaataataactagcttaatgatttagaagaaaatattcttggagtatgttatagtcgtatgttaactgcaaatggctgccacctccaaataattgtctgacactatgtctgactatctgttcctccattctattgatctctcctatgaacaaagcagacagatatgcaggtacagctcttttaggaacaaattgccctttctccaagctgacatctttagaattaagaactcagagacagccaatgtggaaaaacatttctcccctgccacatgcttggtgggtcagaaagtcaatcaaattctatttcacaaaaaaaactaattcctatgagatgggaggctgcattaatatttctaagaccaaatattctccctcaagtaatataaatttataggtataacttttcccaatgctctatcgacttctcatggtatatgaaagtaattaggcttctctgaaagccagagctgcgttgagaactatatttgagtaaacacaaaagaaaagcattttgagtgttacttttaatgtttccagaaaagttaacacctataaaaatattgtttccagttttctgtatagaagtcactgaaggaggatgtgtgaaagtctgtggaaacagtacactggcaaactgccagctggaatcgcacggagctctgttgtaactcaaatctggccaggccgcaagtcaaagcatgtcctaagaaatatagtacacacatacagcgaacacaaccattgtaactctagcccatgggaagctgaacattcaatggacagtgtccagactatatagaaaaatagaacactgacccaccacctgcagaaaccagtcgaggaaaccacaacttttgcagccatcggccccaaatggttggtacttaatcaacaactgccaacttccccaagtgttgccccctgcatccaacacaggaccaaccagtgaaagctgactctgatcacataggacatctggcttctaggttagccacctccagcttcctgtgccaacagcctcaagtcaggtcacacctgaatcctcctcctcccttccctctcctctccccttccaacactataaagggttttctattcccctacttccttttgagtcttcaccagccacatgtgatgatggctgccacccttgttctagaaagcccagaatagcctctgcttcttctcatttgcattgctttttcccccatatctggttctccctgggggccttctatcctgcctgggccctctgctaggagttccttaacttttcccttctccatcctgcagcatcttcatccttccctgcttccaagggctgtgtttctgtagatgaactgtttctcccctatttgaggccagtccttccaactgtattctttcctcattatttctattccttcttcctggaccttttgtttccacctgttgtatcccttgctgtgttcctcacatgccactgggacagcacagaaacagtcccaaggcgtctacctggccaagcacagtggagctactgtgaggacaggatataaagaagcaacagtctggcctcaccaagaaaagggagcattacagattgattcatctgcattacatttcaagccaaagttgaacagtctagatttggatgcaaagagaacagagaaaaaagctaggagccaatagcaaccaattcaggggtcagagtggcaggcatcaagaaagtaggatggacaaaggagagccaacgaggagaaattaggggaaagcgaaacatcagtaggcagaaggcaattgtacaggattaagcctgaggacaccatgttagtcttttttttttttatacttggctcctgtaaattgcagtgagccatgtattaaagggaaagaacatggaggatcaccaagcatttctgtcctaaatatatacatatacatataaatatgtatatatgtgtgtgtgtgtatatatatatggacacacacacatatatatgtgtgtgtatatatggacatatgtgtatatatatatacgcacatacgtatgtgtatatacgtgtagatatatgtgtgtatgtatatatgtgtgtgtgtgtgtatagtgtgtgtatgtgtgtattttaagagactaggtgtcactcctgttgccagtgccgtcgtgcagttatagctcactgaagcctcaaactcctgggctcaagttattctcctacttcagcctcctaagtagctgtaactacaggcatgcaccgccatgcctggctaatttttttttaagagatggggtcttgctgtgttgcccaggctggtcttgaactcctggccttaagagatcctcccacagcacgggaattataggtgtgagccaccatgcctggtcccataatatattttcctttgcaatacagtctatagttaacatccaaatcccatgcaaagtataataaaacacctcttaccagcttcttctagggctcagaaaaactctcttctctccatttttgcctcccttctgatttctccattattattgctctattaattcttctttcttacaaataaaagtatacttacccattatgaacttttaaataatcaacttctttttctcctgtaattaaccaaaaaagttcttggaataatctactaaacacccagtctccactatctcctcagtcaaatacagtgttggcttcttccctaggccattcttagagaattcctctccaaggtcattcgagcccaaacctcatgcccttcttcagcacgcacaggctgcaggctctcctgaaccaccttgaagttctccaaccttggccttgccgacactgcactagcctttgggatcaccctttttcagctcagctatttttcattctttcactcctgcccatccctcttttatcatccctcagtctcatctgcaatggaaacatgacctaatctccaaaatcctttccaattgctatctccttctggatctccaaaacagacaagattgaggctcccgtttgctgttcttggtgtttgaatcactcctgcagcaatttcctacacagtctcatagtaaaggaatctgcacccctgtattctacttctcactgggactgtaagctccttgtgggtaatggctaaatctcatccacctttatatctccaagtctaacaatagtactagacacatctcaggtagagactctggagtgtgactgcctatagagagcatgataatactttctatctcataatacaacgcctagcatgctggctcttaccatcatcatcaagagatgagagttaaattaaatgaacctaataatgtgaagacagatgttagtattgtccccctgtgctgtttctactgtatttgatttcagatattttagtgaaaaaaaatgtgctttgaactatctagatgacaccaaaactgaaatttatcagagacctctggtattctgttttgtgcagacatactgcttcccaaattattttacacagcaccatccccacctcatttcctgtgcttatggacaacggaggcttgcagaattaaagtatgcctatttattccataagaaaatgggaataaatattaagataatggttgggggaggagaaagtgtacagaaaataattaagtcaaactcacccaacattaacatgggggagaagagatttttttcaaaaccctgcctccctagagccctaaaccttttcatcgatttccaataatagtgagaacttttgctataaaattgttttacagcagctaacaagcagtaaatgtttaatcattatacatacttaggagagcagcattgttattttatagattttaaaaccaggggctcatatagatctaagagctttcttcttgcacctagaaagcagcagaaccataccttgaactgtagtttttcagactcagttcttacccgctgtcattcatatccataccattctccaaaagactcatgtaagaaaataatcaccatgcaaagaaaccatccagctcttcatgaaaagctctagttcagtctctaggaggacccaaatgacagtgaagtctaagtctcagtctctaatgccaaggaaatgtcagggaattaagaccctcaagtgtgaacatgggagggtaactcaggctcctcttctaataaagtctaaatgggagttcatcaaactgtttaaaagccgatcttatcaacctaactaaacctaattcttcttgctttatctgaaaccctgttttaaagttcaaaatgaccaagctatgcaatttgtatgcagagaagctaagcagctgagagatattgagccaggactctctgtctagtaagttagaggaagaacaacaaaagtagattgccagatacaaagaaataagcaacatcagagagataccaaataaaagaatgttgacagctcttggcttcaggaaagccaagaagaatcatacattgaggaattggcatttgagcgaaggaggtttagatcatattctttcatcttgaaagtataaaaaggtctggaaagatgtatcatcctaagcacccaccatcgaagttagatagcagcaatttaattccagccttcatattggagagcacataggcaacttaatattcagaaacaagatttggggggacaatttaaagagagggcattttccagattaatggatacagctgaataaatgtgttctttgctttaaaaatccctcaaaataattagcaggaaaggtagcgatcaagcaaaatgttgactatttttcaagctgtgttttctctcctctcagaattattaataaacttaccatattttggttaaaatatttgctcacaaggagtattaattttcctaaaatgaatagggttataatattttaaaatgtatttcaccaacagcaattaatttgtgttgagtgtttgaggatagataattccactgggcaacaaaaatcacttaatcttccatgttgttgcaagagcaaagaaaagcaactgcattttaaaagtttaattagaagtaaaagcaagtttatataatgatatatcacactgctagcaagtaataaagataaacatcctcgcatattatcagcaccaaaaaacagtcaaatttcgctttgcttacagattgcagaaacttctatagtatgaaatggctttttcagataccgcttctgagtttggtggatttttttcccaagaacttgtggttaggataatttgagggattacagtgtagacagtgacattcccttgtatttgagagaagtttgtgcaattcagacatgactgtgtttgcttttagcaaacatactgttcacattttgagaaaaactgctgatgcagtctggtgaaagtgttctagcaatgccaaatcactgacagatgtgctgtctgccaagggatttccctaggaatgttctaattttcttctatctgtttagagaaagttcgtttaaaatctgttaaaatgtattaatgtgcagtgttccattgtatcttgctgtgggcatactagcaaaagaaaagttacaggaagattggtactggggtgcctaccaaaaacttgatcccgccagatcagaaacctgcccaatcctcgatcttacagaagggagagctcatatactctgtaataacttgcattgtctataattttattgtgttagaacacaaaggggctcactattcttccaaactcatttaaaaatatacctgctgttgaaactgcagtctagagagattaggtgatatatccacagtcacagtcaattggccagtgacaaacaatgtggtcacctgcaaatatcaatagaattaagaaaacaaaaggtagttcttaccagtgagttttgcatgaaggatgtgaggctcaaagataagatactttgagtacggatctaaaatttttatttgttaccaaatcaatgttttctatatttcctaaggtgactattaagtcggagtcaaatatcagaaacatcatcacagttataaacttaaccattgtggggaagattaacatggctttcattagtgaattaaaattgacttctgcatgttggtacaacagtaagacaatatcacaactgtactcccaaggaagtaaaatgctaaaaaggacaagttaaaaaaaaaaaaaggaatgcaatactaccagaagtcctaatggtaccagcacatacacactgtcccacatcaatgagaatgctcacctactgcctgagaagtataataatgaacagctatcgttcttgcccatctaaactccctttctttagggcaggagttcttgacctcagcactattgacattttagaccacataattctttgctgtgaagagctgtctgtgtactctaagatatttatggccactacttactagatgccagcagcatctccttcccagtagtgacaaccaaaaatgtatccagatgtcgctaaatgtgttcagatggggaaaggggagatataaaatcactcccttttgagaaacacaactttaaggaagcagccacttcctcactgtactggtagggctgccattcacatcatatgcccagaaggcacttagagctcagtaatctcatggccatggccttcccaatatccacagatccatcctgctaaaggcaccaatgatcagctcttctctgggacttgttctttaattccatatcctacacaacactctcccaaacctcttttttccataagttattcaaagttgggtctgctacttacaaacaaggaagcctacttgattaaaaaaaaataagcagcaaaaataattgttttcatttgtgtaagaaaaaaatagtgcatctgtcataaactaatagtagagtaaggcaggattacagaatcacactccccacctccaccctgcaagaaactaatttttaaaagtaagaaaatgataaggattttaaaaagctaataccttacccaacacctataaaaccaataaagtggtataagctttgctataaattttgaaagcctaagaaaagaaaacaaagattctgatacgtcagccccaccaactcaccctaatccaaccctacacacacccagaagcggtactaatcaaagaaggtaagtagacagatttctgaagtttctcagaactaccctaaatatgaaaaggtatggactgacagaaggggagtgatgaggcaaacccagacaaattcgagaaaaacaactttgttatagaagctcctacatgtccttttgagaccttatcaggactacagtacatattatagatgttctttttatgagaagatgccccctctgggcagaccaaattagaaaaatgcatccctctcatgagcggatgcaacagccctgcaccaagcatgcttttttggaggcagagcacagactggaattgagctccccttccgggcccctcacctatgtttctccattcaaggacaacctgcacacagcagcagttcacagcagccctgccagcagaggctggaagggtccccagagtttgttgacttccacagcaatgtgccaagtgacagaacctttgaaagcccaaagactgcaacaatgctggttgaggaatgggcccagggacagaatattaataggatctcggaagatacagcagggatcaggtcgcccagtgtgggctgcaccctgcttccccacagccttctccaccctcaccctccacatttcctaccgcagtggcttcctaatgtcagcatgtttcagagctgcctgaaagccttgtgataaaacaggttactgggccacatctccagagtttctgattcaatgtgtatgaggtgaggcccacagattccccctgttaaatgatgttgctggtctgaagaccacattctgaaaatcagtcatctttagaaaagtatgtaaaaagcagcagctagccctcaaaccatagctcagaatagggaagacaaactagtgtcaaggaacttgaaatcaaggaagatgaagatcaactcacaccagttaagaaaaacaacaataacaaaaacataaaacacccatcttaatagtgagcaggataaaaataaaaggcatgactaccatgcaaacttactacctgaatgaggagagggtggggaatggcagaaagaaaataacagaatgtaaaagacagatgaagaactcagctggaagaaaatgtaactgaaattaaacaacagtttcctcataagtgttttataatattaaggaaactaaaaagaatcttcaataacagctcaaaattgagaagataaaacacaaacaaggttttgaaaaggaaattccagagttaaggaagtactctgaatatattacataccaataaaaacttaattaattcattagaaacagaaatagaaaaagtcaaagctgaaaactaaattaccatgatggagaaactcaaaataatttcactgaatacctgagaaaaaaggcaaggaacttgttcaagcaaacaaagtaagcattaatttggaagacagatagagtaagccaagaaaatcatcatcagtgtccctgaaacactggaccgtaaaaagaaaaattctcagttttcacacaaaacatttatctaaagtgaagaaagaactgaatccatgggtggaaatgatacagtatcctgagaaaaatttaatgatcagcattgtcatcctaattaagctattacacatcaaggataaaactagagctgttcaaacatctaagaagaaagcaagtcaattacaatagggaaaagaaaatcagcctggcctcacactttctacagcaacagccaatctcggaaaaccatggagcaatgtctaaacttcagagaaaaagaaaaggtgacccaagaatgtcctatcagccaagttgttattcaggtataaaggtaataggtagatattctcaaaagtgaaaaatctcagagaatataaccttcatgaaaccttcttggagagaaaaaaaattgcttgatgatgaaaggtacccagctaagagataaataaaaagaaacaatcctggcatctagaaaccatggtaaaaagactaccagagctggatccaaataaaaatacaaccaggactaaacaaatgggagaatgacatttgcaaaacagaatgaggatgttatgagcctgtgcaatggactgaatacttatgtcttctccaaattcatatgttgaaatcctaacttccaaggtgacagtattaggcagtggaagtcatgagggctccattctcatgactgggattagtgcctgtataaaaaagacctcagagagctagctaatagccccttgcactaggtgagaaaatagcaagaaagtaccatctactcatgagaaagcaagcctttgccagacaccaaatctgccggtaccttgatcttagacttcccagtctctataactgcaagaaatatatttctgttgtttatgagctacccagtttatggtattttgctacagcagcccaaacagactaggacagcctgtcagggtaaaaataatatgagcaacatagtttgaaggtagtaagagaggtagctggaaagaaattagaaatcaatcatgtaatctctcctagtgaataacatctaaaattggtgtagttaaaaactcataaaaactccaacttttgaatgtttttatattttttcttaacctttagaaaagtctttaggaacaaatagctttaatggtgaaaaaatacatagctgaagctcaacaattccttggatttcactttcagtttctttttcttctgttaaattcaggtaaaattaaatttaacatctttattgataaagcagatatattatgatctctgaattattctcatccttacaatgttaattcttactatctatccattttactatcttcctatctgtacatgtgtattaagagatgtttagaacgatgctcttcaactgttcagagggtatttctcggtggtgggatttagggtattgtgttgctttcttctgtataattttgtatattgcctacattttttaatgatgagcataagtcacttgtaaaaatatacaatcaccactctaaaaaggaatacatgaaatataacaccacttttctgacacagtgagtataaatgtatctctttcaatgagcaacatcataaagtgcctctctgggtaaggcatcattgtgaatatccaccctcattgcaaagtacactagaagtgaatgatacgtaagaatgagtagaatgtatccaaggcaataacactataaggctctgtttcatttttgtaaatagatctctggcttaggctcctttaattagcagtacctaacatttcctgagcatttgctatgtgcccggctgcatgccaccatactttataggtattttgttatttaattctcacagtaactataaggtaataataataatggtgacgaagagactaagaacagctcagagttgttgagtgtctactatgtactaggcactgctccaagtgcttttcaggcaataacattcttcagtaggaagtacttatagcaatgggagtacattgtgcagcagaagagaaggctatcaaggccagcttttaaaaatacaaggatttacatttagtacagtgagagaaagtgcacaggtgagtctggccttgtgtagagagaaaacataaagagaaaaaactggcagaaccacgcaattaattaagtacttttgaccacaaaagtgaggggaatccagggtagagcaggactccgaccaagaagatataaaggccttggtcagcttctggttgtcgtggaaatgggatttcaaccattataatgagatcaaatcatatgctaacaaagaaatcagtaattagagttggggccacccacagagctcacctccatcttgggataagatctaggaagagccagacatgcatttttgccgcagataaaatcccaaaaggaaaggttttaagtatgaaagggttgggctgaaataacatactcaagaatattgctattctgagtgttgcttctgcttccagctctgaccaggtcactgcagataacaaattatgtcatttcttatagctctattccactcatcagctccccttctatgcaggaaggagcatgaaatgggaaaaaaaccgaggttcccactcttggtgtcctaagtgatcagccacaggaagaaaaagatctctgctcattttccctctcacttactattgcccaggaatcttggatctcttcagaatagtgggcaaactgagagaaagcaagttcatttaatcctcaaaacaaccctatagattccattctgttatcatcatccccatttcacagatttcacaatggacagggaggagcagcattgaagggatcagtaacctgcccaaggtccattttaacacaagagctttctgacttcattcaggctcccctctctgtgattgtgatttctctcatgtctaaaccattcacattttttaaaattaggatttctatgcttaagtatgtacctttgttcacaactaagttgaggattctatactcaaacacacacacacagagagagagagagagagatgcagttgattttccccaatactaatgtccatgaactgaaagcttaggcaataacttagtatagccacagctttggtttggttcagttctagggtactgctttgcaaattaaaggtgtaatcccttcaaatcactgcaataaaagtgatttgaaatcatactatttgcagtcataatagaaacaaatgcctacttaactactcatggctcagctctggtgagaacacatcaatagagtaaaatgcttttagctttccagagaaaggttccacctgacagataccaagagatcaaatattcactccgcttaggacaaagaagtgtacggattaggacatacttgagaagtcagtttcagaaggcaccagtttagaaaagaaccctgaaagacctctaccatttatttatatttcaatgtattcattccatttcttcctatgtcttttcattcatttgtttatctccttggtctgtgtgctgcaggctaaaactacagcaattaaacacaaggtccttgcatccaggagttcttctcaatccagtaatggaaacaactaacatcatatactattttgctttattttctgctagaggtacggacaggaggtgctgtgggaacacagctaatggggcacctggttcttgcctatgagagttttgagaaggatacctgaagtagggtttagaaactgaccatcacaggggatgggagaggaggaaagataaagttataaggaattctcaaactttgaacatgtgaatgtcctatatgtatctgtaaatagtatataaaaacactatagtatctgactgctctgtcacagatgaaaaccttcaaagagaagctgatcatagacacaattatagaaaccaggggatgttatctcgcccaagtctgcctgactacttttaaggatgctaaattcctaatctctcaaggatgacattcttcttgccccagagtgtgctagagccagagggaccaactctttctccctaacttcctacccaacaaagaatcctcctctacaatattcctaatggatgtttactatagcaaacatcacttgttcagttttggttcctcagtccctattccctcattgtaatagcattttttttttttttgagatggagtctcgttctgtcacccaggctggagtgcagtgacgcaatcttagctcactgcaacctctgcctcccggattcaagtgattctcatgcctcagcctcccaagtagctgggactacagatgcccactgccatgcccaggtaattttttgtgttttagtagagatggggtttcaccatgttacccaggctggtctcaaactcctgagttcaggcaatctgcccgcctcagcctcccaaagtgctgggattacaggcgtgagtcaccgagcccagcctgtgatagcatcttgattcacttttagggacttttctcctattataagccaccattaggatagtgaattgggtgccttttcattccactccagaatttgaggtcctggagacttctggtatattttctgctgtaatggaaaaaggatgagcatgtgtcctaagctcagttaattggaccttctcttccagggctctgaatcctaagaagagtgacatgccactcactcactcattgctgtaatggcttcttaatagccaagtagactccatcttgatactttcctgtttctaagcctagtccctcctgcccgcatcttgattctgttaactccccgatatccttctatttgtaacaaattccttttctacttatattaacctcagtctctgttacctgcttccactggaactctgattctgcttgaatccttccattaatgggaatattactacattgagaggctgctcattccattgctggacctctatatttgtttcaaaagttgttaattcaagctaaagccgggttctctattactagtgtctgtcatcaggaattagaaagaataaattttagtccctcttccatatggcagtcactatagtatccaaggaagggcaaataatcattgataaccacaccactaaagcccttctcccagctgaaaaccaccagggtttttataaatcttctagaataatataaattttcagacaccacagaaatagaagctttgaattgccgatgagcagattaatcattttcagatggtctcagggaactaaacagtcacttcctcggtgggcctctttcgaagagggcactttcatgtttattacttgcaagggttggcaaatggtagaattcttttttaggatgataaggatttatatttctatctagtctgccactaattaaaagtatattatcttccctactgaagttggggtaattggtggttattttcagagcaactcatcagggtgagacagattctttctgattgaggtagcagaggtgttgaacattcattgtgtactgagttcacgtttctagtatcacaatttcccacaccacatgcgtgatagatgtgtcttcaacatttgcaaacaattccaagtcatttctcccttcaattattccctcttctctgacatcctaacaaggttttcattttgtactaatttcactaatttaggaaaacttttgtctgcaatacatacatatacatatatacacacatatacatatatacacacatataaacatatatgtatatatattcatattcttgagaagtaggccagaaacttggcttgctgtgaaaatcagaggggaaataaaaaggatgaatggagaatagtgtctattccctttggcacttcttacctaatactcaagccccttacttgctgaaactcaagtcttctcctccctgctcccacttgccttatatcttctctcaatgagtgaggattaagggcaggtacttctcccattccagagaagcagcagctccatctggagcactctgcctctttctgatggagccctcaggggtgtacactgtaatgtccatcttccctcgtctgctcacgcagaggacaagactctcactctcaccctctttctttccctatctaattttctctcctttctctctctctttcctcttcatttctagtggccaccagctctgaaggtaacatcccagcctgagtaggcctgagccaattattctagaccagaatcagcgggggtaaacacaaacactctcattctctagctgtttcctcaggtgctatggctgttctggactgttctccccttccactgctcagatgatatatgacactcaattacagttgaagagaaatggatcaactgctctagatccaggcccctgaagctactttaatatgtacataagtgttcaccagaggttcagtccagctctctggggtgctacatgggtgcagaaggtccaaagacccagctaataacgaaagttgacttagcttttatttagcctcctttattttttttcccaccaggaaaaaaaggagttgggtcaaacaggaactgggcccaatatcattacaacaatactgcaaggtcccccttcatcccaatgccacaatctagactttgtttttaggaatatattttaggaataataaatacaaaagaaaaaataaatcctaaattatgaacatcgttatttggttttgcaagtcagtcaaagtcatgtaaagagagagacctagtcattatcaggaaataactatcttgaattagtctgtaacaatttcttctcattgagtatttttgtgtttcccttctcttcataataggtaacatgatttcctacttaaaacggtggcagagtttcccttaaaaacaaatttatgttttaaaagtcagttgattcaaataaatattaaatatatgaatgcatatgctggtcacgcacaatttggaaaaaaaaaaaaaaagtatataaatgtcctggagacttctggtagattttctgctgttcctactctgaatggacatggatcattttcatgccactttggggattgatgcatgactcctgttgcttccaaactgtctcaaaagaaaatagcattccacctgacagctgcatgaactcaagtctttctcatgtatgggaggcataagtatgtccatccaacaaatctgccagcattgcctttattctggtactgtctaaggctgcctattcccttctgcacagagttcagccttttgcttccttttttatttattttttttttgagactgagtctagctgtgtcgcccaggctggagtgcagtggcgccatctcagctcactgcaatctccgcctctcgggttcaagtgattctcctgcctcagcctcctgagtagctgggattacaggtgtgtgccaccacacccagctaaatttttgtatttttagtacagatggggtctaaccatgttggttagactggtcttgaactcctgaccttgtgactcacccacctcggcctcccacagtgctggaattacaggcatgagccaccgcgcccagcccttagccttttgcttcttatggaaaagcattcttcattgttttattcactaggcttaggcaagtaccaccctaactctcaaatagcctttccatctgggcacccttcttcatgatgtctttgttcctggaatgtgcctcaaaggtctgatttcttaggtgccaagcagagtaaaacttctaatcttccttctatcaatccggagttcctgctatctcaacaatatactgcatacccaaagcacatgcataaaataaagtttattacaacaagactttgtttacagaagaaagattagactgattgaatacattgttctacactgattttaattggtgctataatctgatctgtctctaaccagctaatcggtatttaatcggttgctttaattttattacaaggcagctagaatgcagctgtagctagagaccacacagtaaataaactacattattattatatttatgcatatgagttttattctgcttgtgtcaaaattatactcacttccactcccctcctaatttgtttgtattaaaccattgctgtgcacttgcatagtgggaagagttaaaaaatgcctttttattgccaagggtaagttatgtgataagtttccagatgtacccaccttcatttgccaaacaatcttgtgattgatttaaatatttatacagtgcttcaattactgacattgtttctattaattaatgatattagggtttaattctacagaatacagaaatagaaacagaacaaattcatgcacaaaaaagcatctgatatgatcaccctgaatgtagtttcatgctagagtttctacgcaattccccagagaatgaagcataccagcattaataaaactctaagtgttttaggggctttgaacatgggtgcgataggttccaaagccctatgtaagtatttgaacaacttgaccttatttcagcttcttgagagaactattagggacagtcacagaatcaacatgaaaaattattaagtacccacatactgcctgcctgaaaggactcagacaactacagcaaacttcgaaaaaatattaataatatcaaaacaccttgcggctgctcttttagatcgctgcacatttttaagatgtaatttactggaagctctcttttgctctttcctgtcatttcagttatgcaagaacacaatgctctcaccctacgccagtctggagagctttgcttttctcttgggaggaggcatggtgcaatgatgagaagaagggcttagcagcaggccgaccctggctccagtcccagcttttacatactccctgaatgacatcaggccatgtactcttaagcctaaatttcctcatctgtaaaataggagtcatcacagctactctgatattagtgtgaggattaaatgagacaacaccataaggctctagccaaggggtccagctgttcctttggctactgtgatctcaggctcatttagcccagtaattgtggctcatctcatagttgtcttctcatcctgctgagattcatttatttaacaaatgtttattgggtactgatgggggtgccaagcatgggctagaaacctggaacacaacactgaaggtccagtttgcaacacaaagtccagttggtccaatgaaaaagaggattagatttgccttttaacaaaacattcctaggtagatgtttatggtaaagctaacatcgagccaagtatcacagaaatatatggcaggacattaatgcctagtgttccattataggaacgctaagcatgtgggagttatttataacctacagctcaaggtcatcaccaaggtctgatttttcactcatgcaaaaattcaaaaaactgaaacctctggcataaacgggttaaggaagggaaggccccttagtccaagcctttccttataaaggtatggaaagaaaccattgttcctcatcagcatgagagcaatacgtgttgtttacatagtattttgccatctgtgatgatttttatgtagtgtaggacaaggactttctaacgctcggctctatactagaccaggtccaaaaatctacctgagtatcactacctctgtcactgaactactgtaacccaataacaggataagatggctaacaaaagatgccctcgtaggaggaactatccagtagtttgatttcatacttgtcctaaacctttaaacttgttctacccacatgtcacagatatggaggttagtgaaaactacctgtgtgtgtacagagcagctgggaggacattttggctctgttctaggcagtcatgtagggcccccttactttgctcctgcagagggtcctgatactgtcactgttctgctcagcttcaaaactctcagcaggatgtcccattcctcacctagccctcacctgctctacctaatgatgctcaatcactgaactggcccagaaataatacctgcctatcctgacttcttacccaaacctggggctacctccctgactggcatcctaggggggctctccatggcctttagtgaagtggtcaaagagaagggtcaactctttatacaaaagaaaaatgagtcatgagctaactgtgaaactctcaataagtcacatattctctgatctccatttcccaaatcacacaaattgagagccatctaaattgcctcccaactctgagactctatggatatacatatatgaatcatcatagcaaatatatatctattatagaagctaaaggaatcttctcactttctccaattagtaccaactagattactccacaaaagatacttgaccttgttaaaacaaaaagcaaaacaaaaatactcttttacactattatcaggaaatctatgcctggctttagcagcagagtataaatatttggttattggatacttttcaatttaggggaaaaggtatatctattgcttaaaaacatttgtgcccttcttatagccaggtcacccattccaagtctgaagaaaataaattgaagtggtggtaaaagttagttaaatttcagaatttttaaaagaagggatatcattcatctctggctagataactctgtaaaagatctatctgtaagaacagaaaatgctcttataagaactttgagactagataaacaaatgcatgccacacagaccaccactcccatctcctcaggctgtggcagacattattaatcaataacagaatccttcccactatgtctatacacagccttcaaatggctctcaatgcagtatctcaggtaactgccagcaacgaatcatatttggcatgaatgataaaaggtatttggaatccctggctttatgactttgactgttaccctgactgccatttagaggattaacagccaagaatgtcacagtgtcattatttaaataaaatagaaagggatcttgcctgcaggaacatgcctctgaatattagtaggggatttcaagcttgaaactctccagaagtttctttttcatcactctaatgcttgactttttcttcctctgccccctccttccttatgaactctcaaggatacttacaggtcagaagggtcttcaggttgagttctggccaaaatttgtggcatttccaagtctcacttcactgaatgagtacaaccctgagacctgtctgggaacatggagtgaaacagaaactaagagagccaccactgctgaggcagggagggatggcctggtgatacacaggaaaggtaagtgtggcagtgcagtgagagatgggctggggagtaaggtagacaaaaggatctaaagagtggagtccaaaagcacaatgatacaaagtgagtgaagctcagggtttagcaagttaacatgaaaaccctagctcctgaatgaagagtaccttttgcatggagcctggattatcttttctgcttatatctttcttttctcctccctccagcccttccctccttcctatatgctccattttcaactccctttatattccttcatctttctctccctacttccttttctttaacttccatttctttctttttcagtcattcctacatttccctttttctctcattctcctttgtctaagctttagacaaccctgctcactagctccttggcctttaagagcttataagggctaaggggctactagtagcttctccccatgcaacatatcacacaggtgtcttggagggacaaagtggggcttgagactcctggatgctacacagcagaggtaagggctcaggtacccaagagaagaaatcaatgaagtaggaagcagaggtgaaaagagtatatcagctcaacaggatcaacaaagtccaggaacactgtcaaaataagcttggcagaaaatcaacagagcagagaacagcatgaaacatgaagtgatacaggttgtgggtgggtggagaaagagaaatacaaggcaagcaaagtggcagcattaataagcagccatgactggacacagacctgaagatggatattaggaagtaggtgcccactgagaatgagagtaaaaaccaaagtgatgaactatgcctttgtaacacctgacacaaaagaaaagaggtatgccagttaaatggcagcaccatgtacagaaatgagtagatatttcttggttttgcttaatatcgctctggaagcacagaattcatgttctaagacttaagaataacctaaaccagcccagtgtggtggctcacacctacaatcccagcactttggaggtggatggatgacctgaggtcaggagtttgagaccagcctggccaacatggcaaaactccatctctaataaaaatacacaaattatctgggcatggtggcagatgcctctaatcccaactactcagaagcctaagtcaggagaattgcttgaacccgggaggcagaggttgcagtgagacgagatcgatcacgtcattgcactccagcctggacaagaacaaaacacctcaaaaaaaattaataaataaataaataacctaagtctatttgggtgccaaaaaatgtgtattctatttggacattacagtggattgacagcatagaaattatttattaaacccatcctactggacctgaaggtgaaccccatcgtaacagggtgcctggtagagtcattcttaactagccatcgatttgtaaaaaattgcaaaagttgttttttttttgttttttttttgttttttttttgttttttgagatggagccctgctctgtcgccagactggagtgcagtggcatgatctcggctcactacaacctccgcctcccaggttcaagcaattctcctgcctcagtctcccgggtagctgggactacaggcgcccacaaccacgcccggctaatttttgtactattagtagagacagggtttcaccatgttggccagaatggtcttgatctcttgacctcgtgatctgcctgccttggcctcccaaagtgctgggattacagtaaaaatttcttatatcaaatgaccgttcttgaattgttaccttggattaacagggagcaactattggcatttccatacagcaatctactatctggggataatctagctttcctggagggatggaaacaaagtgcataatggttgtttaccaatcatataatatcagacaccaataatttgtcattcactctagtgttctacaatcattagaggagctattcaactgctctcagacataccagctatgatcatgtaggaaacgtgattccgtgggctgaatgtaccaactcttcactaacatctcaatactctagactgaagttaatgaccagtgcaaaccaccagagtattacagtaaaagaacagcagtaaaaaggccttaataaatcagaaatttaaattggctattcattttagttacagccattcgtcagagcaaagtgatggtccaattcacctatgcggtaacttacattgatcataacagtactttaagtaatatcatccattaatttattaagcaaatatttgagtaatacctactatgtgtacaaccctctgccagatgctgcaagatatattcagacataaaagaaacaatcttaacctttaagaaacttgtaatccagtaggagaaaaagacattttgtagaagtcttattcaaataaaatatgattccataagataaggctccatctaagctctctgcattgcaaagctgatggcaagaactacatttcccagaatactcttccctggatggttcgagtgaagtttaccaataagaatagagtgagatgtggaagaaaaagagataaagaaactgttctttggaagtcagacaaatgtgcacaaatgaagtcttcctcattgctgtacattgagagatgtccctgctttccttatcgaaactctgatctgtctatgagttattaacacccttgtcagtaatatcacttgtcattaggtcacaattcttgggactaccattgtctaggttcttctattccacatgctttgtttctgtgcatgttgagtccaacatgtgtgtatattttaggtagtgtcacctgtttggatatccacaagacctatttacacaacacctgttacaaaaactcaccccagatgttttcttgtttgttcagtttaatttattatacaaatcttcacatttgaaaatataagcaaaagtgattctaagccactacaggaaattcacaaaagcaacacctggtgtcaacatatttcatcacattttaatgattatgatgtgcacaggtgtgctgaaagtttctcctccatactctttgattcttttttaaaatttttttaattatacaagtaatacacttctagaactaataagcaatcatagcaagcttgtgggacaaaagttaatatacaaagtcaattgtcttcttattgctagcaatgaacaattgggacttgaaattaaaaacacaataccatttacattaatgccaaaaatttaaatacttaggtataaatcaaacgtgaaagatctatataaggaaaactataaaactttgctgaaagaaatacaaaagatctaagaaaaaggaaagctatccacatacgcagacaggaaatctcaatattgtcaagatatcagttcttctcaacttgacctatacattcaatgcaacctcagttttaaaaatcccaagccaaagtaaaagccatctacggcacacagcattccgaaaggtttgggctacctgactattatggcaccaagaaatctctggtatatgagaactttcactttaattcaaaatgttggatgacctgattttcagcagaaatgctcttcaaatcagtttcacttaggctttttggtgtgaagtgaaacgatgcagacaatgagctttggagaatgaggaaccactgaataacttactatggaagtggatactgacatggcaaagaaacgacagcctggagtttttaacagaatgttcccaatgagcaggacctgaagatgtttcttcgttccaaaggagctagcaaagaagtgattgttagcatcatatcaaaataactaaaagctataacacacactcttgaacgtctttcaaaacaatgggatctatgaaggattatgatatcagatcttgatactgtaaatattttgggccattctcctgaatgctttcttttgtcccatgaaaacctaaacttagggattctatgagttcctctactcagctggatttacctgtaaatgcctttgttgattgttgaccaatgtcccttgtaccttttccaatagtctcgatctgaataaacagatggttaaagttttgcaggaagtatatttttcattgggtcacaatgatcccacagattttgtaagaaagatgattttttaaaaccctttcatcttaattcagggtaccaagcaggtaaaaactaacattgaatttttacaggcaagtttcaatttgaacagtagggaattgctattttaatatgtggtccaggaaccaaaatcctagacctttccaatgactatgccaaaacaaactacacaaatatcaaacagaagctgttttctctctgaggtactgaagaagaggtacaaaagcttgccttaagttatccagatgtggggaaaaaaagttatccagatgtgatcttttggcagagaaaaagtttagtgagaagaatattttagcttggtgcaaaagtaactatggtttttgggcaaaaaccatagttacttttgcaccaatctaatggattgtctcatagaataataaattagccttctgtgaaagtaatttgtgataactgaaaaatccttgggttctggattcaagcataagtactttataaagtcaaatcaaagaattagtaaatgctggctgtaacttgaggacatcaagcatcactcttctactctggagttaaaaaaaaaagatacaaagtaaatttaaaaagttaagcagaacactggggaatttttgaaagccagtcatataatgtagtggtatcttttcattttgaatttgggcctttcaaaaaggaggggtatgatttcttaaccacagatatatatatgtaataattctttggctattttgttttacaggtttatggaaactcatggttgatatgctcaggtgcagtcctcctagctacctattttccagtttgaattactccaacataccattatttgatacaggctgtgctgctgtagagatggtagtgccatggtgatttgctacacagatcatcccatcacctaggtattaagcccagcatccattagttactcttccttatgctctccctcccagcagcacccctccaacaggccccagtgtgtgttgttccctccatgtgttgacgtgtgctcattattcagctccctgttgtaagtgagaacatgtggtgcttggttttccgttcctgcgttaatttgctgagggcaaaacctgattactttgaaaacaagttctactgtggcaggcagaatcatggccacacctaaagatgtcaacgttttaatttgaagaagctgcgaatatgttatgcaaaaagattttgcaaatgtgattaagttgaaatttgattaagttaagggccttgagatgaccttgaatcatctgagtggacctaatataatgctaagggtccttaaaagtggaagaaggaggcaaaagaggtcagaatgatgctgtataagacagacttgaccactttgaaggaggtgaaaaggaggctttgaagaaggaagggaccataagccaaagaatgcagggggccacaaagaaaactgaaaagccaatgaaacagaatctcccctaaaggccccaaaaaggaatgcagtacggctggtaccttttcagcccagtgggcccagtatcatacttctgtcctacagaaccacaggatgataaatttgtgttgtttgaagccactgagtctgataatttgttacagcagcaaagattaacatagcaactaagtagatgatttgttgcattataggtggtcacaaaatacaatcctttagtatcatgtattttttcctcttacaagagtaattacatttaaaaaagctatctactgttctagaatcactgtcgttgtttacaataaagtcctttaaatgtgcgcataaaaaactaaatgtgaataaaatgtaaataaaggaatatttttgcctaataaatacaaagaaaatgaaaatcccagcaacctattttttgtggatattaacaaactgattctaaagtgtacatggaaaagcaaaagattcagaatatgcaagacaatattaaatgagaagaacaaagtaggagcactgacactatccgacttcaagagttagaacaaagctatagtaattgaaacagtgtggtattggcaaaagccaccaaatacatcagtgaaacagaagagaaagcccacatagtcttttccacaaatggatctagaacaaatggatacccacatgcaaaaaaaaaaaaaaaaaaaaaaaaaaagaatctagacaaagacctcacactattcacaaaaattgactcaaaatgaatcacagacctaaatgtaaaatgtaaaaccatagaactcctagaaaataatgtacaagaaagttcagctgatcttgagcatgaaagtgactttttatatataataccaaaggtgcaatccatgaaagaaatcattgataagctagacttcattaaaattgaaaacgtctccttgatataagacactgtcaactgagaaagacaagccaaaggctaggagaaaatatttgcaagaaacatgtatgataaagaactgttatccaaaatattttttttaaagtcttaaaactcattaagaaaaataatttaaaaatgggcaaaagacttgaacagacacctcaccaaaaaatacatacagatggaatacaggcatatgaaaagaagctcaacatatattattaggatattgcaaattaaaacaatgataccactatgtacctattagaattgtgaaaattcaaaacaatgacaacaccaagtgctagtgaggatgtggggcaacagaactcacattcactgtggatgggaatgcaaaatgatatagcaacctcagaagacccgcaatattttacaaaatgaaacgtactcttaccatacaatccagcaattataatccttggtatttacccaaagtagttgaaaacttatttctacacaaaaacctgcacacagatgtttatagtaactttattcaaaattgccaaaacctggaagtaattgagatgaccttcagtaagtgaatgaataaacaaatcatggtatacgcagaccattattcagccatactaaaaagaaatgagctgttgagccacagaaagacatggagttactttacaggcatactgcgaagcaaaaggagccaaattttaagggctgcatactgtgtgattccagtgatgggatacattggaaaaaaaaaaaaaactatgaagagaatacaaagatcaatggtttgcaagggctcagaggagggggagggaaagagggatggctagatagaacataggagattttttagggcagtaaaactattctgaatgatataacagtggttgcatgtcattcaacagctgtcaaaacccataggatgtacaatgcagactgaaccataacataacctacagacttggttaataatagtgtatcaaaattggctcatcaaatgtaaaaaatataccacactaatgcaagtgttaattataaaggaaactgggggagtggtggggcgtaggcaaactctgcactcgttgctcaatttttctgtaaacctaaaattgttaaaaaagaaatagtgtattgatttcttaaaaccaaataatatataaatagccttataaaaaatgtcaaaccactcagaagtatccagactaaaacatttaactcccaagtgatgttttcacaccaatcctttcattcctggggcaaatgctcctcacagtttggtatttatgcttccagtctacttttgattttttttttttttttttttttgagatggagtctcacatggtcacctaggctggagtgcagtggcactatctggacacaccacaacctccacctcctggattcaagcaattctcctacctcagcctcccaagtacctgtgattacaggtgcccacgactacgcctagctacttttttgtatttttagtagagacagggtttacattacaatggccaggctggtctcgaactcctgacctcatgatctgcccgcctcagcctcccaaagtgctgggattacagccactagctaccgtgcccagccccagtctaatttttaatatgcttactattacacttatttccaaaaagtgttcaaacataaatggaacattttataaatatcattctgaaatttggacagttccttaaagcaactactagtgactgcactgagcattatgtgaaaaaaaaaagactccagaaaatacatgtgcaaggtggtcactatacaaacacacttttggctttccagagcattgtacagcaatagtcacatagtatgggctctagaaatacttgagtggttggcaattaagtcaagatgaaaaggaatcaggccattaaaatatagctacaactgggaggctgaggagggaagatcgctggagcacaggagattaagggtacagggagctatgatcatgccactggactccagcctgggtgacagagtgagacactctccaaaaaaaaaaaaaaatacaattacatggtctgacagttaaattctagagagaatcaacctttcatccacacagctagtatgccaatgaggtgtccactgtgtagggagaattaaccctctgcatttttcttaaggatttgagctctcttagctacacaaacataggaattgttatccccatcttagaggcaagaaagctgggagtcagggagcttaaataacttgcttgagatgactcaatgattggtgatggagtcaagattgaaaacccgggcaagcctccatgtctcacggtgcccctaaaagtactttctacaggtaacaagcacccaagtggtcttttcctcatcagtcccaaattggccgaaaagatcatctgtgaccaactggaacaggattatatccatatctcaattaaaaccatgtttccatttgccccttccttaaagcaaatcacagttctttatgtggattttttgaaacgtacaaatctagatttttttttttaacacattctggtgctcagttgcttaggaaactgcttttgtcattaggtgggaaggactaacacacttaagagagagaaaggcaaagggggaatatatagtaaacccagtgctgatgtgaattgtatccacagggactataacaaaacaatcagaactcaaagggaaaaggagcttttgagtgggttgtgaaataagctattaagtcatgcaaataaatccaatgtcaacacttcagcctgggctgattggatgcatgcattaaaactcatacttcataagaatttaaggcctctggtgttctcagtttttcttctttttcactttggggttttttggttggagggaggcatttctagagaaagcatgcctgctttacgctagaatcgctcatgaagtagagaatttgtgcatcaaggtttgaaacaatacattattccaagaccttgtccttcatcagtagtttcagcctttgccacatttctgagctccgtgctcaaaagaagcatctcttctcccaggctcctgcacccaaccaggcagggatccaacattcagataattcagacggtacacacattcatgacttcaagatgctgctgttgacagtcgtacaccttaacttgcagtgggtgcaaacataatcagccttttctcccacgaagcccatctttagaagcactgtgagatttttgcctgtcttgttcaagaccatacctacagtgcctagtgcgggacctggcacacatagtagatacgtaacaagtaatcactagtctgttacatgagcaagaaataacttttttaatgcaattgcgtggctgatctatttgtcaccaaagtgtaacctcccctgtccaatatgccatcactttattttccactgcaagcacaagatcttgcagctcaagaaagaactgtgctacatggcatgctctaaattcgacatgccatctcaatttaacatgatacttatgtaagccaatagtcccactttacagatgagatattggagctttatagaaatcaagtaatctagccacagtcccagagctaataaatgataggacaaggatttatatcccatcattttagctgtaaaacatgttcatttttttctttttaaatctgtgctgggctgtgttctgacctcaagtgaaatactgtgtgtttgtatcactcaactcgcacataccaaagtttaagtcaagagcctttatgacttataaaaaacaattgcttgagaggcactgggtgatacataggctcagttaaagcagaaggaacagcactagcatgtcatattggtaagatacaaattaaattgcagttagaaatggactgtcatggtagtaaaactatgggaagagcaaggaagtcctcgtttcggcgtgtcttcaggaacacaccggttaaccatctatttgcccaacccgatttggtctttaaacttgcctgaagaagccagttggagggaacagaaggcttctctcaaggtcaatgtctccctccataccccccacttcaggatctcctatgcatcaggcactgtgctatacaacgagtaaaacatagtgtttgcttttgaaaaattctacaatacatgaacagataattatggcagaacatgctaagtacaatgttatagtaatacagagaaaaacagaaaaactgactcagagcacattcaaaagggctgtttaatccatgcctaagtggagtaaggaggccaaaagttaatgaggagagcatcccagagagaagaaatggtagagccagtggtgtgaaggcaaaagccagtaggacgtatgcagagaagtccatgcagttcagtggtgccagaatgcaaaatgagaagcaaggagtggtaagagacagcaggaaagcttagcttactttttaagtcagccatgctgagcagcttgggcttcaacttgacaatgatgaacacatatttggcaagatttggcagaggacaggttggatatgaagtttagaaaaatccctacagctggtgtggatttgaatggaattggacagaagaccagcccaagttaggaagctgatggagagtcccagcaaaatacaggaatctgagcaagttttatagttttataaatataggaacatgaatgagaataggaatgaagagagaggactgctttgacaatgattccaaaagtaaaatattcaagaagggtgggaatggagtctaccaagaagaaaaactggataaaggcagaataaaaacttggaataaataatattactgaaattacttagcaatgttaataatgttaaatgtgtctgtggtaggcctgaccctctggctgtccattattccatatgtggtcttttctgactggcttctttcacttactgtaatgtttataaggttcatccatgttgtaacatgtatcagtacttcattccttttttttacaagatgatattgaattgacaggatatgccatgtttgtccattcagaaattgataagatatttggcttgtttctagtttttttttttgtttgtttgtttgtttgtttttgagacagtcttgccctgttgctcaggctggagtacaatggcacaatctcagctcactgcaatctccgcctctcaggctcaagcaatcctcccacttcagcctcccaagtatctgggactacaggcacatgccaccatgcctggcaaatttttgtattttttgtagaggtgaggtttcaccatgttgcccagactggtcttgaacttctgagctcaagtgatccactcgcctcagcctcccaaaatgttgggattacaggcatgaacgaccacgcctggccttgtttctagtttttagcaaatttaatgttgctatgaacattcacgtacaagcttttgagtggacatatgttttcatttctcttgggtatatatctacaggtggaattgctgaatcatatggcaattcgtttttcaaccttttggggaaatgatagactgttttccaaagtggctataccatgttacattctcaccagcaatgtatgttcaagttcctctatgtcttcttttcaattatagccatcctatgaggtgatgtggtatctcactatggttttgatttgtattttcttgatgactagtgatgctgagtatctttttatgggcttattggtcatctgtatatcttctttggataaatatctattcagaccttttatccattttttaaattgggtttatacaaatatttatatattctagatacaagtctcttatcagatatatgatatgtaagtattttatcccattctgtggagtttcttttcagcttctggatgttatccatggaaacacaaaagtttttaatgcttgtgtctttttccatttgttgcttgtgttgtctttttccatatgttgttaagacatcatatctaaaatattttgcctaatccaaggccatttgttatgcttatgtttccttctaagagttttatagttttagcttttacatttgaggccaagattcattttgagataatctttgtatatggggtcaggtaaggatccaaattcattcttttgcatgtggagacctagttgccccagaatcatttgtttaaaaggtttttaccatgaattgtcttggcagcacttttgaaaatcagttgatagtaaatgtgagtttatttctggaatctcagttctatgccattgatctttattgttatgtcagcactacactctcttgatcactgtagagttgtcatgagttccgaaaccaggaaatcctccaagttcgcactttttttcaagactgtttcagctattctcaggatcccttgaatttctgtatgattttaggattatcctgtcaagttttacaacaatatctgctgagattttgataggagttgcattgaatctttatggcactcaacaatttttggcacttttaacaataactcttccaatccccaaacataaaaagtcttgccttgtatttagatattcttcaacttatttcaaatatacataaattcagagtttatattttttgttgcttttaatttattcccaagtatttattctttttgatgccctcataaatggaattttctcagtttcattttctgattgtctatcacaagtgaatagagagaatgagtttgtgtatattgttcttgtatcctaaaaacttgctcaacttgtttatttctgataggttttttagtggatttaagatcttctatatataagattatgccatttataataaagtttttcttcttttcaaatatgaatgcagtttctttttcttgcctaatttccctggttagaactgttagacaatgttgaatggaaatggcaagaggggatatctgtgccttcttccttatcttaggggaaaacactcttttttttttttttttttacgttaagtatgatatgagctgtgaatttttaataatgctttttatcaggttgagaaagtttcatactattctatttccttgagtgtttttatcatgaaagggtgttaaatgtttttcaaatattttttctatgtctattgatataatcatgttgcttttatcctttattctattgatatgctatattacatttattagttttcatatgttaaaatgatcttgcatttctgggataaattccacatggccatggtacaaaatatgttgctggatccagtttgcttgtcttccactgaggatttttacatctgtattgataagatattggtctgtagtttccttgcattgtgatgtctgtctgttttggttaacaggatgctattggcctcatagaatgtagtgataatttttggaagagtttctgaaaaactgatattaattttttaaatgtttggtagaattggccagtgaagtcatctgaacttggacttttatttgtgggtagttttttattataaaaaatatatattcagtctttttacttttgatgggttattcaggctttatatttgtagaatcagttttgtttgtatctgtttaggaatttgttcatttcatccaagttatccaattcatagtcatacatttattcattgttttcccttgtaatcctttttctttctgcaaggtgagtagtaaggtccccttttttaatttttgagatggagtctcgctctgccacccaggctggagtgcagtgacaggctggagtgcagtggcgggatctaggctcactgaaacctctgcctcccaggttcaagcaattcttctgcctcagcttcccgagtagctgggactacaggcatgtgccaccacacccggctaattttcgtatttttagtagagacggggtgtcaccatattggccaggctagtcacatactcctgaccacgtgatccgcccacctcagcctcccaaagggctggaattataggcgtgagccactgcgcctggccaggtcccactttttattcctgattttaataatttgagtcttctttctttcctgcttagtcagtctaggtaaagttttctctggtttgttcatcttttgaaccaactctggttacattgattctatttttctattctctatttcattaatttctgttccaacctttattattttcttctgctttgtgtggtttactcattttatagtttattaaggtgaaacataggttactgatttgagattttttaaaaatacaggtacttaagctatatgtttccctcaaagccctgttttagttgcattctatcagctgttatgttacatcttcattttcatcaatgacataaaattgtttctcattttcattgtgattttttaaattgactcattggatatttaggagtgtgttgtttaagttctgtgtatttgcaagtttccaaaaatatgttagatttctaatttcaccttattgtagctagagaatatactttatatgatttcaatcatttgaatatattgaggcttttatggcttagcatgtggtatatttggaaaatgttccatgtacacttgagaacaatgaatattgaaggttttatctctttctctgatatttctgttgtctgcctcaattggcctcacacccagctgttatgcttcactaattactggataatcattctattgttttgaaaaataccctagaggcataaatttctccacagtctgacccaattaaattcaagggcctttgggagttagatcttcaggccaatttttcgttactccaggagggctctcttacctttacctttctttgattctctctgatcatctaggtaatcgatgggttagcttgtagattttatagagctaccagcctccttttaatggcttatcaccacaatgtctattgctttggacaatgaccttagttaggcttgacattccccccactgtttcaaatgaaatcaattcctatgagcttcagagttcttatggactgcttctacccctagcaaaatctgagcctggagctccagagctggcaggcagagtaacacctatactttctgagtaggggacttgttgggggtggcagcctctggctttcttagcttgcctctctcagcttgcctctctcagcatagaatctgcctatgagtaagctgaggcaagggggactggggcctcaatattctcagcctcccatacccggggtagaacatccacctaattagttgggggtaggtggaagaaggtaattcctaaactttccgccactctcaccaagaacttagcctctgcagtttagggcagagggaatgagaaattctagtgacctgttcctcagtgagataccatatcccttgactggaagctgaggggaaaggcagcaccatctctttggccacatctgcccagagtggaggctccatctcacagagctacatgaaagggatagatagcaggctgtgtctgacatgctacagactctcatgttcttagggagattcttcagatttgctcacataagtgcttttgatttgtcatattccattacaataatttccagagactttaaatgagtttctttatatttttcatcagttatggatgttttctgggaaatggtccatggaacaccttattctgccattctggaaataaaactccaagaaacttctctttaagcctctgagacttagaggttgcttattactgcaggaaagcctagtttagcatgatgaaagccgtgtctagtattaaagcagaattaaagtcaactcaaggaaagtaaaatgattttccaactctatctttctctgataggttcttgtcccttaaagctgagtagccgtcactggccagattctagaataatgcccttcctgtttttcttttgttctgttgtccccacttgattgctttaatgtatctaggtagactgcctctattaagaagtcccaagttaatgtaggctacttgcagtctttgaaacacagtgcccatttaaagatgacaatcctagaatcataagagcagggatacaaactattttattcactctagtattctcagagcctaaaacagtgtctggctagcctgacacttgatagctgctcccaaaaggtattttttgaatgacagtgtcaggaccttgctcctgttcctttgttacactggctgccctggggatcaaagcgtatgggagggctatttgtcttatgttatctttctgaaagtatcctcccagagactggttcaaacaggaaccctacctgactcctatgtcctaaaggactctatcaataaagtattccaagattcttctagccaggaggtctggcttcattttcgaagttatctcagaaacctaaagtgtgtactctggtatcattaactgatgtgacacaactagtgtgattccatcagttttataaatgacaaccagtgtgaggaagtcgacaccaaaagaagacactactggacagaaggcaaatgattttgaataatcagcctctaccctattcccccagggagactaaaatgcctaagcaatgctctcgttgatcacaaaggatacatgtttgtcctcttgtttagagttgcaagaacccactctttccaaagcaatcaaaatcctatattaaggggaccatgtctagaagctctggaaaattcctggaatagtaacacaaaaaaggagtcactgtaccaccaccacaagcctctctgggaactaattgtgttctagatgcaagagacacttaacccagcatttgtcttagcagtgtctgcctactatgtgagccttacgccatccctgagactctgccaggcccctgcccatccactcaacacttacagttgaactttgccaggaaatctagctcatctagttctccagctttctaatccttcctctcacccaagactgacccactccttgtcctatcttgacgtccctctggtttatacagagtaattaaatcactggttaattgatgaattcaattaaatcaatgtcttacctgagtccctgttaggattctttaaccttttttggaaaatagccacatgtcaaatttactcacttcttcccaggtcattaaaaaaaaaaaaaaaaaaaaaacacacagaaataactgagtaaaaaacactctcaatctttgccctcttggtatcagctttgagacacctggccaagtacagcctgtgctaagtttcaaagaggaggcagataactttgaagattttatttcacaggggacaacagataaaagtctctgtcaagttgtcattagatgcttaatgctattcttggtggggagcttgaggcgcccctcctcctctgtagacttctagcagattaggtttcagagctttaatttgaggaaggatttacagctgtgaagaggtataatatcattttgatttgggttgtactaggctggggaagccagattacatttgtatgaaactgtattagaccatatgactgaaaccaccaaaatcaaataaagggaaaattttccagagagcctaaaaacaagagcctgtctttccagcacctgagcattgtttcactaactattattctgatttacatctaggggatccatgcagaaatgcggagggagatggcaacaatgcctgtgcttgctggacctatccattcattaatctgtcatcaacctaatccaggggcccatcccctagaacaagaggaaaaaaattaacacttagagaagaggggaagttggcagggggaggggagataactttatgaaaaatagccttctttcatctccggaggcactgtctaattcagagtctcaaagaaatccatcaaattgtctctctgggcctcagtccatccaccgccaccatatgctaccatgtgcgtgtgtcgcacggcatccccagataatgacttacgtgggcaccgtgcctttcctctagaaccatcttaatgctattttaaaatccgactctcatttgcatggaaaacaataaatcactttgggtaacacagaaaacccagtttcttctgagatgaaacatgaaaaaaagagttagctgttgtttgtaccacacagctacacagaactgggcagactaccagcatcttctactgggatttagagatggacgcaagaaacaccacgggtaggactctgaaaattgaaattatttttgtgccagtctctagattcaactagaatgtgctcttggctggggagaatttgggaaagaagtgttttttttttgttttttgtttttttttaattgcaactactaagtttcaaaaatgggggaaaatcatgaagacagccacagacatcttcaggggctgactaattcttaaatgattggttcctctaagagtggttagtggtgaaagagtaaatgatgtatgagaacgatttctctgatttctgccaggagttctactcactcagtaaccacagggaatagaaggatcaggttttccacagaaactacttttagcacatgctgtgtttctacacctgtacttctcttccgaacaactatcttagctccaagttgacatggcccgttaccaaggggctccatgtcttttgtttttgtagtaaagatgacttgaatacagaagaggtgttgtaggagagcgcgtcttctccaaatgctggcagatgacagtttccgcagggacgtaaagaggtgacaaaggcacagaatataatttagtcctgatttccaggtctggctcacaaaactaatcggatgaaaatgtggccaaaagaatacctcggagataaactttctagaacaagctaacgccataatttgaccctaattccaaaaatcatgggaaggacatacttcttagtatctttatcttattctcaattaatcaacaaaccttaatgtaaataaattttctaaaattcattgtcaccgaggaaagggttaaaaaaaactaaagttctcttttgagaatggatttctttccctcactaccttcttagacaatacaacagaggttatttctagacccagaggagacaatgcaacatagcttctccagcctttggacactaagcaagttatcaataatgcagaatcttgaaacctgacactaaactccttcagaggtaggtatcttgtgagcaaaagagaacagagtaaaaggggcaaggatgggagagtgtaagaagaaccatgctgtggacattttacttcttggggtgttagtttccttctatgcaaaatacaactgtagattgccacaagcctaaacaaaatctgtaagaaataaataaccttcaaagcaatttaataaaaagaaatgtgcccaaaatatcctcaaagactttattaatctagggaggcaatagttaggaatatgagacatgagtcaaaccacctgattccacatcccgattgcacgatgaactagctgtgtgatattgagcaagtgacttaacccccagatttcctacctgtataagaggaataatgaaagctccacaactactgcaaaagctaaatcaaataatatgtgtaaagctgttagtacaatacctgcccccacagtaaacacacaataagtattagaaatacaacaaattattatatttaagtataaagcggtaatctgtacatacttggaacatttctgacttgagaagctataaaatcatggatcaaaacagttgtacaaaagatggtgttatgtgaggtcctttggatttaatataaggagccaaataaaagcagtccaaatttagaaaaatctttcaagctattccgcgatgactgtgtctgtcatcacttgggaaaggaaactgtatgctactcgcattctagagagctgttaggaaatgctagctgaccctcaacaaaccttcagcctccccaggaacacagttaggcagcttaatttgggcaagcgaggagaaagcatgagcccgtacccaagcactgcctggtttccatctgcgcgatttaaccacaagccacagagcgcctctgcggacaccaagtccagctgccagggaaaggtttcagacccacggtggtgtcccaacaatttccagttcagtggaaatctggggaacgcacaggctcatagcatatgatttcttcatgtttcattagtttccaggttttaaacaattttaaccttctctctggcacagagctgctgtactgtaagtagaaatcactggactttgagtaacatgagcctgtttcacgtttgtgggtggacatccaattggcacagtgaccttggccatgtcctgactcctctgagcttcactttcctcatctgtaaaatgggtgaaagccaacttcagtgagttctggggacacaaacatgtttcacatgtgcctagatagatgctgttagtctcaactcatttgctatcctgaacttaaacgggttgccaatctactctcacaccactctaaaacaacaaaaaaaaaatcttttcaaaagctaacaaactgaactaggagacgaagaaagaaaattcaccgctacataaattagccaggagcaaagcaagaagctgcccgagtagggcagttggcttcccacaattgattctttaataacttctgtaatatttctgaggcacatcaaaggacagtaacagcccagtgttggtaatccctctcacatataaaaactttcattacagagtgttaaaggcatcactctgcttgagaaatcgcaatcaatagacgttggccttttttcttcttttctatcctggggtaacggcaccagcattttctctccagtaatgcagtgctgtgtggccagagtttcctctgatgctgcagacgagcaccaagatgaaaaaatctttgtgataaatgagaaagaggagaagaagtttgggagaatacctctctgtgttagaaacccgaagtgttccatgctaattcaccctaaatgctgtttgcaaatattggcttagacatgcatttaaaagtcacagggatttgttttaacatgatttcttttgcattcccatgtggaaaataccttattttagagtgagacgccatctctatttcccaggctggagtgcagtggctattcacaggtactatcctcaacccacaacagcctcaaacacctgggctcaagcaatcctcgcacctcagcctcctgagtagctagagctactgcatgccccactgcgcccagcctataaaagatttcaattgaaaaatgtttccaattagcaccctaagagcaggataattttggaatactgcagcagatcttagggacacaaactaaaaggacagcaggcagtcattaatttctttgttccttattatctataatacaattgttagagtcagaaatataaaattacttgcagaagtttttttaaattcagcctatttgtttcctttgaaagattactccaggttctttaaaaagccagaatcacatttttctttttattatgaatgcataaaggccaaaggccactcatagcatctccctcgtaaaccgcatcttgccaaagcccgtggccaatttctggcctccctttactgaaccacttagtggcatttggccagttgaccactcccctccttcataagccgttttcttgcacataaaccccccaaccacactaccctttccccacctctactacctggctccatttgtcttcatagttttataggaatttaagtcatctatttgtgtgtatgtttattatcttactccatgtcccatgcctagaaatccctggtaagttgtagatactccataaatatttgctgcctggctgactcttagtattttcttttgacagattaaaagctcagaggagtgaagccacttgcctaagactgcatagtaagtggccgagtcagaattggaactctgagcccatactcatgacctttatataatagaaaaagcagcctcgggataaatgtccaagagcagggttggcaaacttttcccttaaacgggcagacagcaagtatttttgcctttgtgagccacatatatatatagtctcttgcatttttaaaaaagaatactttaaatacataaatctattattagctcaaagggtcatacacacaggccacagctgaatttggtcttagtttgtcaacccctgctcaggagaataggagcattttctactggattcatgactttaacccaggcccaagaatcctgtgcagaatcaattaagctttgtacaatgattttttttttttgagacagagtcttgctctctcgcccagactggagtgcagtggcgccatctcaatctcggctcactgcaacctccacctctcaggttcaagtgagtctcctgcttcagcctccagagtagctggaactacaggcatgcaccaccacgcctagctaatttttatatttttagtagagatggggtttcaccatgttggtcaggatggtctcgatctcttgacctcatgatccacccgccttggcctcccaaagtgctgggattacaggcatgagccatcacgcctggccagaatgaatgaattttaccttcatcctctagacaacaagatcctcaaggttaccagacttgggcatgtcctacagttaaaaaacagttcactttccacaaaagggagctggataaattcctatggatggacacaatgatcaagaggaggaagaatcctgataaattcctatgtagtaagagaaaataacgcaagatcaagagtggcaaaatgctgaaaattttgtgttattctttttccaattaagaggctttcccccgctatgaagtaagcaggcatcaccagaagtgagaggaggaaaataaccgctctcacctctccagcgtcctgtgctcctatcctgctgagactgtcttttggctactacataaaaagccaaaaaagtgagtccttcacagcatgaggatacttttagctgttggacacggagaaggttttctcttggtcttttattcaatcattcacagaaagggacatcctgtgacctcattttcactctaaagtaacagagaaagccaagtggcttcctgactctgggttctatagaaacccttgctttgatggtgcctttctcctcctctgaggccaagtcatggtgggggctggtggggcttccttccatttccaagacaggtggatctccttgggaaacagctgctgtctgggaatcctggcagcaccagggatagagagagaagagaagctccagtttcaaccctctgagtcactgcaaaagaatccccttcattaaaactagttctcaagggaaaggtgcttagagaaaaaaaaagactcagcaaaatgcataggacacttgggtaggagacatttcattatggccactttgatagcaccactttgaagcagtcattttgattttggtatgaaacttcttggaattttagtagaagttagagaattacctaagtaaatgctttttgatcaaaaataatttatatttgccagtttgtctttcatttctccccttaaagataagggctatgcctgtctcgtttaccattccatctctagtactcaatatggtacctcacatataggaagggtatatttatttaaaaaataactactatgaccatcactactactgcctatgtccagtgcttacattagatacataataatttgttgaaaaaatgaactgctaccatcactactaccattattgccacataattactattgtcaccatcattattcctattggctgtctattgtaaagccaatgggacaagcattatgcttagattatttcaattatcattcccatttcatagatgtgaacactgaagtgcagagaagtatcctaaaacatatatacagtatgtggtaaaaaattgaattaggttattattatgattagtcttgtcaagtaaattgggagaaatgaataggctgagagataaggataaggttgtacttagtgcctctattttggacttttaagcatttcttttcacggaaagggaccagggattcttaaagaaatgactgattccagatctgctccaggaaatagacatgatgaattggcaaattttgttgtggaaagctatcaaaacctactagagtaatgtcaaaaggacttggagctaacttgaaaggggctcccactggccaagacaaatcaacttcaataaaaacaatgaaagtggtagaatgaaatagatcaaatacacaaacattcaaacatttcttaagagtaaaaatcaatggtcacccttagaagttgccaggacaccaacttatgatttagaaaatattaacaaaaagaaactaagggaaattaaacacttaccctgcctttcctgtatggacaacctttcaaagtaacaacacgacatggagggaacgtttttcctcatagaggaatcacagttaataaaagcaggaggaatgacagatttagaaaatcaccatttcacagctcttaatgaaataatgggtctagacaaccaccattcatagctgcaaaacctttgccttaaagcttaattggaaacttgatatttaaggcatcacactgacaacatgtgaatctaggatcaatcctaacttaactaaatgtgggataatagtacattacatcagtggttcccatactttgaagcacattagaatcacttggggaactcttaaaaatcttaatgttcaggtcgtgtaccagatcaatcaaatcacaatgtctggggtaagagtatcagtaattttaatttgagatgttttaggtgattccactgtggagcaaagttcaggaatcttttcattttatggctcatggtgtgatgctccctatgatatattaatgttactatcatagggagatatattaacatcctatgatatataaccaaatatttaccagaaacagaagaaacgtgtttaagaatgactacaaaaatgcaaatcagaaatcaaatgtgtgaaaaattcaaagagggtgtgaatggcatatcttctcaacaaacaaatgtcattttaaaaaatggtgtgttgggggtgggaatggagggctttccttaaaacatgactggaaaagttatgcttctggctatgaatgaataacttcatacatcagactaatcctcctgcagaaagtaattgtgatagatgcataaattaaaaaaaaaaaaaaagctgttcaaaagcatcagagcacaaccaaggcatgcaagattcaagcatcctagatgatgtaggcaaagaaagcccactgaggtgagctctatagttaaagcaactttgtgtcctaagggcatttgcgaatttgcatcgtgagggaataaaccaagtagaaagcagcagctagagcttgatgcagtttctgagctagagagagaagtttggaagttaagggctatagaagcagcagctaggacttgagggactaagatttgtgagaacggtgaaccaaagaaaagtgatcccaatactcctaacgtaatttccccttgagatatttgcaaattcctaaactgcaaacatatgaagagaccaattaactaagcaaaaatcaatgctaaaagaccaaaaacgaaggagccattttgtcagtctaaaagggttggggagacaaaattgcaatttagaagacactaaggagaaagggccatcgtaaatgccccaaaatttcatttgagaaactcaaaaggcttgaattgttaggacaaactagaaatagaccacagaatttgaaaaatatcatttctggattaaatcaatataacttgcttatactgtatccacctgccagaatgttaacatatctctgcaagaagataaaatccacattaaaggaaacactaaaaggaactaaagggggttatttgggcagattaaaaatttcccagatgaaagcatagaatgtaggatggaagaaagagtactaggtaaattggggtaagtaccactctaacaatttaatcaagagaaatgaatacatgtccacacaaatatctatacataagcagcttcattcacaataatccaaacttgtaaacaacccctatgtgaaccaagtgaatggatacacaaaatgtcgaataaccatacaatggaatactattctgcaataaaaaggaacattaacacatgcaaccactattctccaagtcattatgttcactaaaggaagcgagacacaagggagttcatattatgggttaattcattaaaaatcctagaaaatgcaaaatcaccgctagtgacagaaaataaaatcaacggttgcctgagagctgggagtgacagaaggaaatgtccacagtgtggcacaaggaaagttttaggggtggcagaaatgttctgcaccttgattttggtggactcatgggtgtatccctcttttaaagctcaatgaatgaattttacatgggcacagtttattatatacacactataccccaataagctttttttttcctaaaagacagttgaaattccccaaagacagatcaaaaagataagttgctgtattattctattgaagtttaaaaacagataaaatcaatccatgattattaaaatggtgtatatcttgcagagcaggtgttcacttagtgaacaggaaatttctgggtactagtgctagtgagtggtattttctacatctttgagaaatagttacatgggatgtttattttgaaaatatttattgagctaaacacttaaaatgtgtgcacttttgctgtttttgtcatacttcaataagaaaatttaaaggtggaggattgagagaaattaaagaaaatccaagagacaaagcaaccaaaggcaatgcatggatgtcatatggcttatgattttaaaaactcaactgaaaaaaatgtgaggaaatgaatgaaaatcaaacatggactatttatcatatattaaagaatgcttgctcattttattgcatgctactgtgattacatttaaagtccttatctgctaaataaacatactaaagtatttataggtgaaataattgagtaggatttgctttaaacatcagcaaaaaagaaacacacaggccaggtgtggtggctcatgcctgtaatcccagcactttgggtggctgaggcaggaggatcacctgaggtcaggagttcaagaccagcctgaccaacatggtgaaaccctgtctttaccaaaaatacaaaatttagccaggtatggtggtgggtacctgtaatcccagctacttgggaggctgaggcaggagaattgcttgaaactgggaggtggaggttgtagtaagccaagattatgccattgcactccggcctgggcaacaggagtgaaactctgtctcaaaaaaaagaaaagaaaaggaaaaaatacatgtgctcaagtataggttgatcatcatggaagttggatgacagatgcatgagaatccatactattctcttgagttttgcatatatgtaagaatatttttacaaagtaaaaatacaattcaagtgaagatgaggtacaaggatgaggcagagggcccaggagggtgtgaagatgtctattgtgcctatgacctatattctattctttgcactttgaagattaaaatacccacagcatcaaaatggctatgtcaaaatgtcttgcttcagaatttgcatggcaagaattttctcaggggcccagaaacatgacaagcatgaaaagaatgaaatttacgagagtccaattaggtcctgaatgacagccaggcagatatatgatgacaaacagtgtccttcgtttctccagagactgatctactttgggcccaaagagaggaaagtgagcttgtataatcctgggaatttcaccatccttcttctggtccctagttatctccatctgaagcctattcaggttttggaagggagagaataaaatgggcagccaaaaaccagattctgatggcatcagtcagaatcctgacaggacacagatgtcatactcctctgcaactttgaagagaaataaactattttcagaggtggaggttgggttacaaggtaaggatttgaagcccctggtactagctacagcagaatgcctttagtatcctgggcctaaaaaagcaaagaaagagaacatgttatcagagcctggtgaggtaaaggtgggtgggttaggggtagggggtggggagtgggacgactatcatcactgctacagccttgaagggacacagaccctgaaaaacatgatgagaaagacttccatgggagtaaacatcccccatctctctctctctgcccattgcctggtctctttccagtacctcccattgaccaagcccaaactggaagacagagacatggaagcccaggtgacacagtcaacctcctgggtcaacaagcagggcagacaaggtcgcctaataggctaggaaggcgggggatggagaattaccagcacatgcccccaaagggtaatttacaccacactggaatacataagatcttcaaagccacagttagttagaaatgatggccatttggcaaaagctaattcagtcagacccagggttgcagatccttaatttaaatggaactgagtatttctaagcatttcacaagaggcccaaagacaatgaatgataacagattctttacccacacacacacaccctccccatgggggaaacggtaaggagctactcatgctcattctcaagtttgtaaaacaaaaatcttttcttctatattagaaatttccaaagtaaatgcacaaaaaaggggagaaatgtggttgcattttccattgggctttaaccatcactctgcgaaagagaagagttcagagcaaagtcatcacaggtggaaacaatctcaagatcagatgggagaggagtatcctcttccccccacctcccccgctccaggggtatgtggtcctctcttggttggtgatgccaaccctgcttcctctggccctgggttttgtacctgctgctttctctgcccttaatgtgctttcctcccttccttcacttgttaactcctattcctatcttagctcaattgtcactttccagaggaaactttcccatgttcactaatgaggtcaaagcccctaagacatactgtcatagcatctggaacttttccttcatgaaagcactttcacagtttttggtatggctgtttgatattgtctatctccccagctgaactggtagttccacgtggcaaggactatgtgtatctttgagtaccattgcatttccagggcctcacatataatctggctcatagtaggcacccaactattgtcgaatgaatgagtcttcactgcaagataaagtgacaacagttttccactctagagaccatctacgtttttccctttcaatgtacaacatgattttgttttctttcccccaccccccacagcattaaattactggaaacacatcctatgctcatagatgggtagaatcaatattgtgaaaatgaccatatttccaagagcaacctacagattccatgcaattcccatcaaaataccatcatcattcttcacagaactagaaaaaacaatcctaaaattcatatggaaccaaaaaagaacctgcatagacaaagcaagactaagcaaaaagaacaaatcttaaggcatattacccgacttcagactatactacgaggcagagtgatcttaactgtaccaagctaaatcctacatctagattcacagatgcaaaagtgtttaataaaaccaagttacttgcattcttaggctcatgtagatgctgtacgcagatggtcttctaaataggttttagatatgtcaaaactttctccagccacaaagtcaagaatgatcaccttagggttgcagtatactcaattatttatactccttctatgatcaagggtagtagtatctgcattaagtagtttcctccaaaccagaaaggaacgaattggcagaatatatttccttgcctccagaaataacttatcatcattagaatcatctgatatttttgggatctggaatctatgttctgtatttgtgagggtaactatgagacttgaacagtccaccagggatcttaaaggcatgttttcaaaacacagcccccatcaaaacagtgtgctgttaccaaatatgtttgggcaatgccactgtgaaatttacaacatacactaacagagagtttgagaaatcccatggctggtagagcttggcaaagggaaatgtgtttccctcacatatctaactaggaaaccgtcatttcaaatacttcctcttactatcctgaaggccatattttaggaaatgctgcactggaggaaagatgttctagaatagacaggtactacaagactgaaaaagagaaaatttaacatgctttcctgctactgaatctattctatatatcctgtttttcttcataggtgtttgccccacaatatttttgttttctcattatctctaatattaaaatgggagaaaacagtaatacaagcatgttgaaaaactgataccgtgaaatattgaaaatttgaaattgattaatgttggttcctaaagcaaattattttactgaaaaaaatggttctattaatctaaatagatacatttattaatatgtgttgaatacataggtatgtacctaggagttttgtagagagcatgtctgtttagaaataagcatacaaatacataacttcatgtaacgagtatgctgaacaagcatgatccattgcataaaacacaacattttactctccttgcccctctaaatttgattaggtggtaataatcttcctttgcccttggataaaaactacagcaggcccacgagtttgctgttcacaggtaatgggcagttctaaaacaacttcaggttacacatacagtcccaggtgagaaaacaaactccacaaccatgttgcttttgtatggaatctttccccttctcagcttggccctgcttcagactgaaagcctccagatcaccctgtggcccctccaccttattagccagcattctgcctttctcaaggttgaagaaactaagagacagaagggctcctccttgtgctagttctgttataatctagcttggctgtctctgggcctggcagatagttagggctgacactttctcttttgataagcttttatggattctgcagaggtttcctgttgggttcttttctcaaacagctcactagatcccaggtgggtggccagggatcccccatcccaagccccaggtcatctaggcatctgccttggacttcatatgctacttttccatgactccttcagttactgtattgaagtatatcaaaaacaaccccacgttggccctctcctttgcacagtccagaactgatccccaggaaacacacacatctcatgccttgacaaaaactgggaaatattggccacttcgcaagcaggagcattcctaccctaccacccaagcagttggccagcccctcttctcctggccttccagagtttcagggtgagtctcaaatgcatgggccctctaaacttcccaggcttgatgcaggcacaagcctctggttttccaactgcaagaaataattcagagctttctgattagtcctcttaatgcctcctattggggttttgggttacaagatagtacactctactttttctcccaagagggtaatgatgactcaatacatggccacagttgtctctaaagagacatcttctcttgtctcctctggactcatatatacaaaagccatggaccaggatcatgactttctatatgaggcagctgtcttttggtcgctgtattatgggtggctctgtgaaactgagacaatagacaatacaaccattctaacatcctactacctacgtcgtacacatatatatgtgtgtacgtcatattttactatacggtttctataacaacttcaaatagttaacgctataagagcctcaacactccccaattcaattataatctccagctttcactgatcactgctgatttggttataaatgacttcacaaccaaaagcttaccttgagaatttttcaatccctatgttcccagattcaaataaataaaacctacttgaaatatgtggacttaaaatagtcttccaacgcattcctcacacatgaaattactctcgaataactagctattggtgacattcctgatagtgccctagatttctcaacttttgcaagagcccagatggtcagaaagaactttaccaaatttggttacttgtttttaatggaaggattttaaatgttcttttaacaatcatctcagctgcatttaaaggctacttagcagtgtttgcagctaggagaacagataattaccggagtgaactagcaaattcctactggttataacctgaaatgggaagtaatacatggtcaagaatgtaaaaaattacttatatatatatacatttacgcacacattttttaatatcaagtgagcaaaatggtattaaatctggttaattctgcccatgtccatttgaaaaacaaccgtgtaatttgcctaagaaaaaaattctctcatagttaagtcagatgcctaattatatcatcctttatctgggactgtcaaaaataaaacattttggatctattcacaataaaatgacattttcagattcaatttcatacaagttttttatccattatgctcacagatcaaaagtgactggattcatcagccaaaaagaatattttaaagagctgctgagaactttataaaaataattctgattttcttttgtgggggaaacaatttcttttagaggagttagaaaaaagtgagaaaaaattttttgaaagaaaaagaaccaccaatgttactagagagcagagttgacatggcgttactcacagtgactggttaagggtaaaagtgggggaaaaaagcaaaactgtaaagtaactgattatttcactgtcttcacctggccttaattcaaatcagaacacttctcccacctgcattacttcaaacaatttaccagaaaagaagagaaaatgtggattacataacccagagcatatagagcgaaactgcaatgctatcattcagcaatcacagtgctctagtttatttttaaaatagctcagaattggccatgctcaagaagtggtcctacatacagcaagagagctcttcgtttaatacaatacagatttttcctaacagcttcctctactacttcacatatttcttccatatccctacatggccctcctaagaaatatacctttagcaatgaacactaggaaaacatatcgttgtggaaaggcatgggagagagtctactctctttacttgctttagcgtgaggcagaaaatatttcttacagggtagccatccaatacctgagcactttcaaatactctgcagcaggtaatttgtttttcagaagggtgggagttaaaagtaacacagaaagtcataatggggtgagagattagacttttctccaaagttacagcctttagatttagctcctgcaattctgaagggcctcagagataaggaaatcatgttgcaaatgtgagaagtgagatttagagaggtgaagggacctgcccaaggcctcctagaaagaagaagagactctggtactcgaggccctcaagtccagggttctttccacttgcccaggtttatccctggttgtcctctcctctgccccttgatctgacaaatgttcaaaggattacttaaaatagtcccctgctcaaaataacaagggcttgccaaaagaagaaaaacaccttgaaatagagattccaattaactgcctctgattgctggataactcttcaagactcccagaaaccgattctagcagtatgtgttatttgtttatagccaacctttgttccaaaaataacttgatatgttttacagaaatatgtagaatacatacaatgcagaaaattattgcaaaggaggaaaaaggatgggaaaagctagtaatcttggggatgaattgtcatacaccaagaaagcaatttatatacctggtggcttaacagcaaatattataatcaatgcaataatagtgacccagcagaaatacactgtgagttgaaataaaatgttaacaagagtttgtggggaagaataagacacaaaagtcctgataatgtctcaatatgcagggtttggacttctgaagcaggtcactcctaagccttcaagcttaggaaaaaagggaaaaatgagaggacagaggatagatgggacgacaatggggtggggagtcagggagtgggtagagggaaccacaacaggttgacgtccacctaggtatcacttatcaatgaactgaaaatttatcaggtaattggaagctcaaattcatacgtcacctggactgaactgcgcttttgttatttataatgcaatatggtataaatcaattggcttggattttaaaattagagcccaattacctgtgtaagggaatcataaatccaacttgtatttttctaacagggttaacaactcatgatgccagcttaaactcaggaaaatcaatggtctgggcttaagaacaattgtgcgtggtactttatctccctggtctagtgtagcaggtgggcagtctaggagttgggggtgaaggatttgggggagggtagaagcctaaagcaaaggaaacaaacagaaaacattgaatattgctaaaaacaccacatgccaggtaaacaggaaggggggcacttacatatagtagacagtgaaaatctggacacctgttacttgatgaagcatcgcaggagcaaaggcaaaacactcctgttgcttttcttgttctgcaaaactctccagagctaagagagctaatgtgagatgaaaagctaaaaaaggagcgagtcagaactcccactgacagctcccaaatctggcccttcctaaaggcgtttgcgcctgccttaagccagagactcccttctcaggtgcagtttgttgaccctctcttcaattggaaacatctgaggttcactcagtgataaggggcacgtggaggaataaagctgtggcagtggtggaggaattaatagtccaacttttatggagggcagttaacattgtgtatgcctgtgtttatgtaagtatatatacctacatatacacacatatatgttatatattattgacatagaaattccattttcataaaattctccttgagaaatggttgaagaacagtgcaaagatatacatacaaaattcttcattgcggccgggcgcggtggctcacgcctgtaatcccagcactttgggaggccgagacgggtggatcaccaggtcaggagatcgagaccattctggctaacacggtgaaaccccgtctctactaaaaatacaaaaagaaattagccgggcgtggtggcgggcacctgtagtcccagctactcaggagtctgaggcaggaggctgaggcgttaacctgggaggcagagcttgcagctagccgagatggcaccactgcactccagcctgggtgacagagcgagagtccatctcaaaaaaacaaaacaaaacaaaaaattcttcattgcagcattgcttctaagaaccaaagttgcacacaaactagaagtcattcaaagggggtgatccaagccaagtgtattatatttcactcatacaatgtaatactatactgaaattataaatgacgatataaaattctatggacatgatacgtggtaaaataaaacaacaaaatagtattactggatgtgtcaattgtgtgagtgtgtgtatgtgtgtgaataagaacgtgtgggagaaaatcctgcatattaatcaagcttattgctgttgtaggataactgatattttttaatatttttctgttgtgttggatttttaaattttaattgttataaaatagtcaggtattacttttataatctggaaaaaaaaacccagcaatttccattttggatcttgaatacagtaggaaggatagcagggtagcagcagttactgggcaaagcagacgtcaaccagggcctaacaacaaggctctcactgcacaaagcaccagcacctgtcccataatggcttctgttttcacacaaaattccgccaactgggtacatcttctcaaagaggggaaacaaatgcaccaaaattaattgtagaacttatctttatgttctgggggccagaaaactcagtctatactgtgcttctgagagcaaataatcctttctaggcctaaaatacagtctgtcttctattttgggcttgtggtacctctgttgtctcattgttcaagtggatgtaaaagtattaattcaaaaaacccatgttctctgcttaaagcacagaattgtcaacaaaacatactacagaacacatgcctctcactcagtcatttctttgtcttagtttcttgtggtctattccatagtaaggaatttgcaatgttggagtaagagacctaagaggaccttagagatcaccccattcagcatcctcatttttcacaagagaaagcccagactagtcatcaagtgagctagccaggactaaagccgagggtctggtagtcagtccactgtttatcacttcagctctaattccattcaagacacagctatagcttcccccttctggacaatctgaatattcctttagctaatgttgaaataaatcagactttcgacatctgatgtgacatacagagagaaaaaggcaggaaatctaacataatgtactagttagcttttccaaatgcatgagaaatactttcaataatggaaaacactacatatactactttatgcagtcgacttttgcttctgtgatagaaaagggaaaaagttcaggggaagaaaactacgcgggtcatttggtgacgtttttaagatttttactttcagaggcacataatttaaagtgtttttctttttcttctatcaaaaccaaacatagttactagaaaacatctgaaaaatgcaacaaaattttaagaagcaaaaaaagaaaacatgtcacacaattcagccaacaaaaaaaccacagttaaaatgttagtatagttccttctaggtttttttcctttttgaatggttgagcacttcatatatataccatttccaagttttgttttgttttttacctaaattatacctaagcattttatgaattcattaaaaactatttataaacattatttaatgtatgaataatattccatggtatagagtgccaaattttattttttctttatttatgtcatttagggtttttctattatacattattctatgatgagcattgtaagaaatccatcttgatcttaatttctgattattttcttgtcttaaattcctaaaatggggaattgccagattaaatactatgagcattttaaattaccaggaagtttataacaaattttgttgttcctaccaaaagtacatagaagtacccattttataatcctttttcagtaaaacatattttcaaacctttgttaattttacaggtggcaaaattaaaattaaaatttattttaacttgaatctttattattgaaaaatttggtatacccattggccattgtggccatcctttggcagatctactcttgaggtcttggcccatttatttactgagaaaaaaggaaagcattttgatagatccaatctttttttttttcaataaataaataatgaatttttaaaataaattaataaacttatttaattcactaaagcttaagaaacacaaacttctgggctgatcagttggaggctgtagaaaaatgaacggaacacactttttttccaagtatattttgtataagctctatctaattaatgaaaccttcctgcaactttctgcatctgctcattccaagcattagattaacaaacggttgacataaaatgaagagctacatggtatttctttgacatgtggcatataaaaatcacaaactctgtctttaaaaatagagtgttctggttcacactggtccactgagcaaacctatttactgcctttcccacccaaaatactttctaaatgatactaaagaaatgcaaaagtgcaaactcataaccacaaagagaatgggaagaagccattagaagataaatgatttgaataaaagtctgttggcttctgaaccacacagcaaaggaaaccacagcctaaaaagggattgcggcaaaggagggccgacctgcctggttattccagaaagaatcgagcctcagaaatagcaggtacaacacaggatggaagagattggtggggctgaaaaggggggttaattacaggccaggctgaatatgtaacattgaccacccttcctcctggctctccatgtggactagcctgaggccaagcaccagcttcaaggcaataaaaaagtggggagaaccatcacagttatcattagtgttaaaacctcactctaggccaggcgtggtagttcacgtctgtaatcccagcactttgggaggccaaggcaggggggatcacttgaggttgggagttcgagaccagcctggtcaacacggtgaaatcccatctctactaaaatacaaaaagtagggccaggcgcggtcacgcctgtaatcccagcactttgggaggcccaggagggcggatcatgaggtcaggatatcgagaccatcctggctaatatggtgaaaccccatctctactaaaaatacaattagtcaggtgtggtggcaggcacctgtagtctcagctacttgggaggctgaagcaggagaatggcgtgaacccgggagcggagcttgcagtgagctgagattgtgccactgcactccagcctgggcaaaagagagagactccatctcaaaaaaaaaaaaaaaaaaaaaaaaattcaaaaagtacctcagcatggtggcaggtgcctgtaatcctagctactcaggaggctgaggcaggagaattgcttgaacctgggaggcagaggttgcagtgagccaagatcacagcattgcactccagcctgggcaacagagtgaaagttcatctcaaacaaaacaaaacaaaacaaaacaaaacaaaacaaaacaaaacaaaaccttactctagcacattgcgattccccagttcccatgcacacaccctaaactgaaactcttcaagcttgctattcacaagacccacccacttaaaaatagaccgcaacaatagccttcttattgcctcattctttcacacacaccacagatcaccagaaatttaatatgacaagaaagtctaccacagaaaagaaaatgagcaagtaaaacaacagaaaacatgacactggagaaaacagtttaggggaaagacacaaactttaaaaataaaatctagttaatatcgtcaagaaagatttgaggagatttggtaactacaaaacaaaaacagggttctattgaaaaggaataatcagataagaaagagctctttggaattttataaatgcgtaagtaaaaaattcaatagaaagtttgtaggcaacgttggaaaaaatctcctagactatagaccaagtacagaagtaagtgagaaaaaaataaaatatatagatgaacaattcaggaggtctaaggatgactaaccaaattttcacaataagaaaaaaagaaactggagtggagggaattatcaaagagattgcatggtaaaattccccagagttaaagagaaagatgaatgttcaaagtataggaatctacttgataccaagaataattaactgtaaagtggtagaaaaatgaaattcctaacaatttcctgaaaagtaaaaaaaaaaagaaggtggcctacaaaataagaatcagagtagcatcagacttagcagcagcaggattgcatactaaaagacaggaaaaaggattttcaacagagaagtctacacccaaactatcaattgtcttttgagggcaaaataaaaaattctaaacctgcaagcatgcagaaagtttacctcccattcaccctgatatggcttggatatttgttcctgcccaaatctcttcaaaatgtaatccccggtgctggaggtggggcctggtgggaggtgtttggatcatggggacagatccctcataaatggcttgggctatttccttggtgacaagtgagctattgctctgagttcacatgagatctggtggtttaaaattgtgtagcacctcgcttccccactctctctccctcttgctcctgtcttcgtcacattatgtgcctacttccccttccgccataattgtaagcttcctgaggcctccctagaagccgagccagcaccgtgcttcctgtaaagcctgcagaaccatgagccaattaaacctcttttctttataaattatccagtctcaggtatttatagcaatgcaaaaatggcctaatacacaccctttcttaggaagttaatagcaaaatcagaaggcaaattagaaaagaaagaaaacccattcaatccagcaaacagtgactccaaccctggagagcaatggggacatctcaggatgattctacacagcatgtctacagagccacctgtccaaatgggagcaaaatggaggtctgtaagagacaggaccaatagaacaaagagtgtaattatgagcttgaaaaaacttgaagatattattgaggtatatactcagaaaaggcaataggacatcagaaattccagcaaaaacaaacaaaaataactttataagaaaaacttgaaatatatattacagaaactaaaaggtggaatgattttgataaaatgatttaaaggaagagaatccatttgcacctgattctagacacaatgtctttgagtatcacaggaattgtgacagagaccatgtggggctgcactaaataatttagcaaatcttaattgtgcaaatattttcattatttccaactttggaaaaatcacaaaaaaagactactctggtgacagagcaaatgtcaattaaatttgacaatgcaaaaataatggtatatagctgaccgagaatggaaagtggaaggaaaagaaaagcagtgaagaaaagggtattgagtgcccatatctcatcctgtgatgtgtggaggcaagagacacaggctagattgatggaccaatcaggggaggtataaatacaatttagaagtggcaagcccaatagaagttgagaataatgtcatgttatggtgggagcatgtgaaaagtttagtgtaagttagtgtaaggcaaatacttcttgtctttagaagaaaatcagtagataacataaaaaataaataagtgttaactagcaatatggaagtaagaccaggaatgttgaaaagtgattgcatttagggagctcagctggaggtgggaagggtgggactgggaactgttactttgcactacaggtgtttcaaaaccatttgatttttaactacgtgcttatttttgctttcataaaaaacaattccaaattatgattataaaaagcaagtacattgttacaagctcttttactaaaaacaacaacgcataattgagcctgtatgaaatgctgtcttctaagccactggacacgctggaggaatagcgaataaagtataactggatttatttataacgaggagagagcaaatgcagtgtacggaaatgagacacatcattttatctcgacagaacaattaagctttcattagggcttaatgacaggatgacattcgggggtttggagggtaagcacatcaccttcattatcaaatcaaagattatccagtatcaagaggaacagttttatttattctgtattctcctcgaactccccaccccaagctctgtcatgaccctagataagatgggaattgaacaaaagtccccaagtgctaattgcatattctctcacatccccaagattgctgtctcctagccatttgatgttaatatcacagaaagcagacagcaagtgtatatttggatgcacagctaggtacatttcccagaatgtattttggaaggggttagttgttggaaggttggcaagacactagtgactccacgttttggctactacgcctttctgtcctgaaagcctggtgtccatgttatttagaacagcctgggtaaacttattactgcaccctgtgttcacagaaaaggttggttctgagttcaattacaatccctagcagtttaaacgatagctgctgtgctataatctaaaataaattgcttttctcaagaagccatgtaagcctttgcactgcatcttagcagagctgctggttttatctcatctgaaactcaagaagggtacaaaagcaggacctctgaactcctgttgttacctcaaatgtcattcttctacacttctggggctctctcttcaccccaaattcctatcccagaactagatttatgggaaagcaacagtgttttcattttttaatgcaaatcatcattttgtgtttattgttttctatataagctgcatactttgcctggggtcttttgaaagaactctattactgggggcaagatttgtttttcctcttcccacagctagaaggctaacctgctaccatgggccaagatagcaagtatgaggacgcccgcacccaaatgaattggggcacctctacagactctccattcaaacgcacatcctcctcctctctccaaagggaatggaggaaaaggaaacaaacttgtcaagcgctcaatacgtgaaatgataattctggctttctccaccctccacctccccaggagtttttcccaaaggtcccattggcccaagctcaagcctcagcacttctctaaacaagatgcttgtagatccctttgatgtctttccacaaaggcaattagaagggtttccaacgttaactatgtacattctttcagatttaacaaggcaacttaattaacactgctgtgtttctgctagtcaacaagagaaaattgtcctttcaagagattttgcacattgacaaaaataatccagtaatacttttccctttcaaatatttttcttctattgagattgaaagaggtggtttgcagagtgctatatggtatgtgctcagcagcatttttctgaaagggaatttttttatgtccacacaaaaaaaaacatccaggacaaataaaagccaaatgaatactttagacaaattcaaactcaaacttagagccactcagaaggcaaggaagtcctatttctttttataacatacatgcaaccatgccacgggaggatatgaaatgtagctcatgaattatgtttatccttaagttctcttggagctataataattagaaagagacaaagtgctgattctcaaccagtatccctaggaggcactaggaaatggaggaggtgaggacatttctttgatgtctcagcaattggagggcaaaactgacatttggagagttctcaaaatgttgctaaaagttctgtagtgtgttagcaccacagagcgaagacttttcctgcccagaatgccaatagatcccccttgggaaacactgacctcaaatgggaggttgtcaatgctgcactaaggcaaaatgagctccttgtcctgggtcctttgatttctcattttgcaaacttaggtgtctggcagatagtcaatgactaaaggaatcatctagtggtgaaatgatggtaagtcacttatccattcaataaatatgtattatgtaccatctgtgtacagtgaaagtactgctattgaccaagagtctctccttgaccaaacgttaatcaggctcctctgattctctccctaatcaggccttaacttttggacttctgtgtctttctctgtattgcccaattttagcaagaatcctcttagactggtttatccagaacccttcatcttcaatattggattaccctcaatatctgatcagattccatatccaccaccatcccttaggtggtttaatcacatggcctgcctttaggtacatttcataacaatgtatccaattttcctgatccaatttttctgcatccttgccagcatttggcgttattattatttttttccaatttttttgtggtaaaacatacataacataaaatttagcatcttaacaattttaagtgtatatttcagtagtattaagtacattcatattgttacaaccatcaccacctatctatctccagaactcttcatcttgcaaaactgaaactctataccatttaacaactctcaattcctacttctcctcagcccctagccaccattctactttctgtctctacgattttgaatactcaaagcaccacaaatagatgaaatcatacagtatttgtctttgcgtgactgtcttatttcacttagcataatgtcctcaagtttcaatcatgttgtagcatatgtcagaatttacttcctttttaaggccaactgataaggagggacttccttctgtcccattttgctattgattttctacacaccttacagtttttttctgtccctcatttcctgcatcactgtcttcttgtgtggttagtttattttttgtagtgaaacatttaaattcctttctcatttccccttgtgtatatctattttctttgtagttaccacagggattatatttaatatcctaaagttatcgattctaatttggaattataccagcttaactttaataacatacaaaaacattgctcctctacttctctgtccccacttctttaaattattgatgacaaaaaattaacatcttcatgcaatatgctctaaaatataaactgatattttaaaagatgtattagcttctcaaattatgtagaaaacaaaatgtggagttacaaaccaaagttacaataatactagcttttagactaataatttaaaaaaattagtctcatatcatgtagaaaaaaaatggagttaacaaagcattattacaataatactagcttttataattgcccacatttttacctttacggagaactttatttcttaactaagattcaagttactattagtgtcctttcatttcaacctgtagaactcattttagcatttcttacagagcatgtgtagtggtaataaacttcctcagctttttttttttttttaatatgagaatgccttaatttcttactcacttttgaaggacaatttgctgaatgtaggattcttggttggcagttttttttgttttgttttgttctttctgtagccctttgactatgtcagcccattgcattctggactcctacatttctgacaataattctgataatcgtattgatgattccttctacataatgagttgcttctctcatgttgttttcaagattctctctttgtctttcaacagtttgagtatactgtgtcttgtgtcttggggtggatctctttgagttcatcctatttggaattcattgagcttcttggatttttatgtttatgtcttgcatcagatttgggaagcttttggccattatgtctccaaataatctctctattctttctctctcttcttaagcttctgaactctcacaatgggtatgttggtctgcttcatggtgtccagcagctctgttccttcttcttcaatattttttctttctgttcctaagactcataatttccttgtcctatcttcaagtttactgactctttcttctacctgttcaaatatgcctttgaatatctccagtgaatttttcatttcagttattatacttttcaactgaaaaatttctcgttctatttttactttttctgaatctctgtattgatgttgctagttagttcatacatcatttattttttactttttccatatcttttagttttttgagcatctttaagatacttgttttagactctttgtctagtagatccacaattataactttttcagggacagacctcgttggttcattttctttcctttgaatgtgccatacttgcctgtttctttttatgtgctgtgattttgttgttgttgttgaaaaccggacattgaaataaaataatgtgataactgtgaaaatcagattctccttccccttccccagggtttgctttttcattctgaattgttgtaggttgtctctgtgctgaggataagcctgagatgtaaagttaagtccttctcacatcttttgtgagcctgcatctttctctaggtatgagcggtgactttctaatttcccatgtatatgtggctgctttaaaatgtactagtctttaatgtctggctccaaacacaaaaggggaaaagaaaaaaaatgaaaacaaaaggaaaagagtgctagccctttaaatcccctggaagtcacttcagctggagaaagaagggcttgcaacaatggaaggaaatgcaacaacaatggcccctggctctgtctgcacctttgtaatcagaagcaacaattagctatcagagaacagattcctgatttttgaatgacagtggcctttttgcacaccctggctcccataaactgtgtgcaggctactcctggaatctgtgcaaggatgcctgcgagtggggtatgagtagctgatattattctaagagctaaagtcaaccacagttaagggcaatttactgcccaagccttctcttggaaattaaaagccttcaatagactctagagttctaaaatagttacatcagacagattatgccatgcagttgttctctaggtgaggagatacattcctggtgctttctactttttgatcttcccagaatcccctccttatcaattttttttatttagccattttaatagatgggtaatgatatctcattatggtttatatttgcatttctctgatggctaatgatgtggaatatcttttattgtgctctttttttttttttttttttttgccatctgccattctcttcagtgaaatgtctcttcatgttttttgcccattttctaattggactgtttgggtttttttactcttgacttttcagagttctttatatattgtaaatactagttctttgtgtaatatgtggtttgcagatatttccaaccagcctgtaaattgacttttcattccttgtagttgggctttcacaaagcaaaagttttaatgttgatgaagttgaatctagcaattctccttttgtggattatgcctttggtgttaaatctaaggacactttggtttgtttttttatttttattttttatttctataggttttggaaaaataggtggtgtttggttacatgaataggttctttagccatggtttctgagattttggtgcacccaatacccaaacagtatacactgtacccaatttgtcgtctctcatccttcacctccctcctccctcacttgaatctccaaagtccattgtatcattcttatgcctttgcatcctcatagcttagctcccacttatgagtgagaacatagaatatttgcttttccattcctgagttactctacttagaataatgatctccaattccacccatgtaactgtgaatatcattatttcatttcttttttacggctgaatagtattccatggtatatatgttccacaatttctttatccactcattaactgttgggcatttgggatggttccatagttttgcaattggaaattgtgctgctataaacatgtgtgtgcaagtatcttttttgtataatagcttattttcctctgggtagatacccaatagtgggattgttggatcaaatggtagttttacttttagtgctttaaggaatctccacgctgttttccatagtggctgcactaatttacattcccaccagcagtgtaaaagtgttccttttcaccacatccccaccaacatctattattttttgattttttgattatggccattcttgcagctgtaaggtagtattacattgtggttttgactcgcatgttcctaataattagtgatgtcaagcagtttttcatatgtttgttggttatttgtatatcttcttctgacaattgtctattcatgtctttagcccagtttttgatgggattgtttgttttttttcttgctaatttgtttgagttccttatagattctggatattggtcctctgtcagatgtataaatggtgaagattttctcccactctgtgggttgtctgtttactgactgtttcttttgctgtgcagaagctttttagtttaattaagtcccatctatttatctttgtttttgcttttcgtttcgtagtcatgaagtctttgcctaagccaatatctagaagagttttccaatgttatcttctagaaattgtatggtttcaggtcttagatttaagtctttgaaccatcttgagttgatttttgtgcaaagtgagagatgaggatccagtttcattcttctacatgtggcttgccagttatcccagcaccatttgtggaatagggtgtctgttccccactttgtgtttttgtttgctttgttgacgattggttggctgtaagtatttggctttatttctgggttctctattctgctccattcgtctccgtgcctatgtttataccagtaccatgctgttttggtgactatggtcttatagtatagtttgaagttgggtaatgagatgcctccagatttgttctttttgcttagtcttgctttggctttgtgggctcttttttggttccatatgaatttttggattgtttttttctagttctatgaagaatgatggtggtattttgatgaaaattgacttgaatttgaaagaaaaagatttctttaggcaatataggcattttcacaatattgattctatccatccctgaacatgggatatgtttccatttgtttgcgtcatctatgatttccttaagtagtgttttgtagttttccttgtagtggtctttcacctccttggttaggtatatttctaactattttatataagaacattttgccttgccttacatacagagattttctcccacatttattttttaaaattgttattattttacatttaattctatgatccactttgagttaatttttgtatgaaggtatgagatttagatcaatgttcattttttttcccaatggatgtctaatgctctagcatcatttgttgaaaggctggacttccttcattaagttgcttttgcatctttgtcaaaaatcatttgagcctatttatggaagtctatttctgggtcctctattctgttccattttgtatattcttctgccaaaaccatgttggtttgattactatagctatatagccctaatattgggtggagatatatatctctttaatgttgggttggttgattcttcccactttattttatgtcaacattgttttagctattgtaggtcctgtgcatttccatataaatggagatcaaataagtttgctagaattttgttagaaatttaatttctcaaagatcaatttgggcagaactgacatctttaccatgctgagccttccaagtctctactcatttaagtctttaatttctttcatcagcattttgtaatttcattatataaactctgtacctgtttttatttacttatttatttatttatttctgagacggaatttcactcttgttgcccaggctggagtgcagtggtgcaatctcggctcactgcaacctccatctcctaggttcaagtgattctccagcctcaggctcctgagtagctgggattacaggcacccaccaccatgcccggctaattttttgtatttttacaagagagggggtttcatcatgttggccaggctggtctcaaactcttgacctcagcctctcaaagtgcagggattacaggcatgagccactgcacccggcctctgtacctgttttattaagtgtatacctgaatcttttattttctttggaactattgtaattgatacactgtttttgatattggttcctacacattctttgttagcatgtaaaaatacgattaactgttgtatgcatcctgcacccttgctgaactcacttgttctaggatttttgttgttgtagatttctagggattatatatgtagacaatcatatcatctacaaagagagatttatttcatttatttccaaactgcatgccttctattttcttttcttgccttattgttttggctagactttccagtactggttgaataaaagtcatgagagtgaacctcctggccttgtttctaatctcagggatgctctttagcaagtcgagataattcatcactatttctaaattgctgagaatttttattataaatagatgttggattttgtcagacgcctttttatatgatgatattatttactttttttatttttaatttcttccagtgtttcctcaatgaattttcttctgtagcttatttctatggtatattacattaattaattttaaaatgttgaaccaaccttacatacctggcatataataaatcctacttcatcatattacataattctttttattctttgctattatttcattaagaatttctgagtcaaaatttacaaaagacattgaactatagtcttctttcctccctcccccttcttcctcttcctccttcttcttctttgcctggttttggtatcagggtaataatgagttgaaaagtgttcctgcctcttctattttctagaaaagataatataaaattggcattatttttttttaacatttggtataattctccagtgaaacaatgtagtcctagagatttcttttttgggatatttttaattattaattcaattttttaaatagctataggactaggctagggctgttcatttcatgttggctgagtttagctagttttttttttttttttagaaattggtctatttcttctatgttcgttgaatatatgagtgtaaagttgttcatagtatttttattgtgttttagtgaccacaggatctgtatttatatttcctatttccttcctggtattggtaattttgttattgtcaattttgctagtagtttatcaattgtattaattttttagaagaacctgttctttgtctcattgactacctttttcttatttttaattccattgatttattcttttatccttattatttcctctgtctacttgcttttactttatttttctcgtttctcaaaataggaacttaggttattgatgtgaggcctttaaagacttactctttgacctgttgataacttagaagtgtgttataaattttcatgttttagagatttttctgctatttttttgttatggataacacattctgtaaaaatttgctaagcattttttatggcctatgatatgatctattttggtgaatgttcttcggttgcttgagataaaaagtatattctgctgttgttggatggagtattctatatatttcaattagattctatttgctgattgtgatggcgcaatcttctatattcttgatgattttctgtatagtagttctatttgttgttgagagaggacattgaagtcctgaaatataattgatgatttatttgtttctctttcagttctatcagtttttgctttgtgtattttgaggctctgttatttggtatgtacataagatcattttgtcttccaggtggatccattcttttatcattatataatgttccttcttgtttccagatattttctttgttccaaagtccacttttatcagatactagtataagcactcctgtttttttaaaaattaatatttgtatgatatatgtttttccacccttttactttcaacttaactaatcatagaatttgaagtgagtttcttgtaggcagcatacagttagattatgttctattattcactttgtttatctctgtcttttgatggtgtttagatgatttaccttcaaggtaactattgataagttagcatttcactataccatttcattacttgttttctatttgattcctctggttctcattcctctgtttctcttttcttgccttcctgtgtgtaacctaaacattttttaggatttcattttgatatacagtgttttgggaagtacttctttgtatagttttcactgtggtttccctgagtactaaaacctaatatgtgacttgttacaggctacattatcaacatttaactagtttgaaacttcactcccatttaaatctcttgtccttcccatttttcaataacattgaattgagtatcagatggtattataatttttgttttaatcatcaaacatgatttataaaactcaaagagaaaagaacagtttattgtatgtacccacaaatgtctttccaatgttctttcttccttcctaatcctctaagatttcatcttgtattgtttcctttctgtttaaagaactttctttagccaatctttaagagtaggtctgctagcaacaaattcatttacttttccttcatctgagaatgtttttatttcctcttcactctggaagtatagtttttccagacatagaatttacagttgataattctttcagtacttgaaaaatattgtggcatttccttctcatctccattttatgagaaatctgctgtcatttgaattggtattcctctataggtaatgtgtcatttctcttactgctttcaagatttcttcagtatattttatttttaaaagattaattatgatatatcatagcacagatttcattgggattacgtgtggggttcattcagcttcttgaagctgtaggtttctgtctttcaccaaattagttaagttttcagtcatcatttcttcaaatactcgtgtttatttgtttgtttgagacaggatctccctctatcacccaggctggagtatagtggcacaatcacagctcactgcatgcagccttgacctcataggtgcaagaaatcctcctgcctcagcctcctgagtagctgggaccacaggtgtgcatcaccatgcccaatttatctttttcttttttcttttcttttctttttttttttttttgagacagagtctcactttattatacagggcagtgacataatcaaggctcactgcaacctctgcctcctgggctcaaccaatcctctcacctcagcctcctgagtagctgggactacaggtgtgcaccaccatgcctggttaatttttttttttttttttttttttttttttggtagagacagggttttaccattttgcctaggctggtcttgaactcctgagctcaagcaatatggccacctcagcctcccaaaatgctgagattacaggcatgagccaccatgtctggctgtcagctaatcaaatactctttcagtcccattatctttatcctcttctgggactccaatgacatgaatgttgggccatttgtcattgtctcacagatctctggggtcctgttcattttttcagtctatttttggtctattgctctgattgggtggattccattgttttgtcctcaaatttagtaattctaccctctcttatctctaattaacagtagatagtctaacctatcgttaatactatccagcactatttttatttctgttattttttatttctagaatttttattcagttgttttataacttctatttcttttctaatattttctattttaaaaaattgtatcaaaaatttgcagctgctttataggtcatttatatgacagatgctttaaaattattgtcagataattccaatatctgattcatcttggtgtttgtgtcagttgattgtcttttctcattcaatttgtgattttcttggttcttggtatgaaggataattttttattgaatcctgggcattttgcctattatgataggagagactaggtcctatttaagtctttcgttgtaagtcagtaaccctgttaaattaatcatgtgggtcttggctacttttatcagctgtggctccagtggcactctaattttcacagactttgaggtgttattttgttctgcttgattaatctggttgcaagaggccactggttcctgcctctaccccactgccttgtggggcagaacagatttccccacactgggcctcaggtatctctcagtgggagaggaatacggtggggtctgccatctgcctcagtgtctttgggcagggaaggagagtctcaggcatgtgagaacaaagaggcttcctagaattggccactttttgtggttgcatccttgttgctggttatgtcttcttgccccagtgactctagacaggggaggatcatttgaggcacacagagaaaaagaggcttccctgacagtattatttgctatagttcattctttttttacgtgttctgcctgcccacttcagtatttcttggtggaaagggagagtctcagggctgagggagagcagagtccttcctctggccaattatttttggcgaggcttccaattaatctctttggctggtagcgttgaacttgtctgatagttccagagggacatccgctcaatcaggaaaaaaaaaaaaaaaaaaaaaaaaaatcagcctccctgagctgcttcttgttgccaggcttggacttaggaaacactcagttaggaaacactcggtctaggtgaccatcttctgttgggttgggacactctaaacactctgctactgtgctgttcctccaggcctagggaggccagctcattctttttttttttttttttttttttttgagacggaatctcgctctgtcgcccaggctggagtgcagtggcacgatcgcttctcactgcaagctccgcctcccaggttcacgccattctcctgcctcagcctcccaagtagctgggactacaagtgcccaccactacgcctggctaattttgtttttgtatttttagtagagacggggttccaccgtgttagccaggatggtctcgctctcctgacctcatgatccacctgcctcgccctcccaaagtgctgggcttacaggcgtgagcaaaccagctcattcttactgtctttcagcgctctcatttggttgtctcttgtaccattaccagagttggtagttgttcttagcaggaaaaagcaggggaaaatgggtctacatcatcttttctggaccagaaatctgtttattatattttaattgcatatttccattcattttttggcaattaacccttttagatcttattataattatttgtgtacatccacggatttgaaacatcttggtaatttatctttgtgtattttacagtgccttgaacaaagcagattcttccttaaaggtacttatacatgaatgaatgttcatgcatattttctctggggctgtacaatggaacaagacctacctgttaaaagagtggttgttggtagaatgtaaacatgacttataagtgttcatccttgcaaatggacataggagtaacagggagaaacttgcttaatgtgatttacagaaacctggttcagaacataggctcacttggtcatcacttccctctggtcatcacaatctcacaatcatttttctgctttcagcagatgggaacatgtgataatgctgtgacagatttccccaccattacttcctaaagccattacccgcttctagcttaaaaccttgaacacacaaacacacacatatatacacactaacatacacatacatgtatgtttcaagcatccaagataggaagtaggggaacatgatgaattttcttttctagaaataaaacaatcatttgtccaatgaaagatgagcataaaacacccatacctaataacaaatggcacagaacaacattgctgggaatccccaaatagacctcacgaaaacatcactgaagattgcatgtgagagctagaaggcctcaggcagggaatgccatggaatgtaagaccaggcccctgctggggctcagaaataggaatgatagaaaagcaagcaggaagagaccctgggcaattgagttctcccactgagcaagaaagaattgaaaataacagcattaggcaggaaaacaatggatgcctgacctcccatttaaccattgtaatcatgcattgttatcaattggcttggtcttttaagattcctagtcacttgtccctcatatctgtggcacatacttatcactgtgtggatttgctttttggcaaacagaagttttaatttttaatggagtcaaatctattactcttttcagaaacgatctttctctttgtcttcaagtttatgaagtcccctctcactccagtagggataaatactcatttctattctgggtttctaatgattgattttatacatttatttattgctttaatccagctggaattaacattagcatatggtgtaggaagactgtaattcttccaactctaatgcattcttgataagtaaaaaataggatttcctacagtagaaaactcagcctagaaacctgcctttcagtatcctgaggcaggaatggagtgaatgaggcactttcctcaaacctaaaaacctcatcctgttttactggggacttgggataaccttctttatttctcagtgtctcctcctttgtgtacagtagcgacacaaatatccactgtgtttccaaagagaagtcaagtgcttaagctcctcaaattttctgagtacattctatgtagaggattttccattactggttacacttaatacacagggccttgctggagaatgtgaccaggagaactagaacttcagaaaacacaaaatgagctatcaaaggcttggcactttgtaggggtgtaatcagaagaaaaacgagtcctaatatttagaacacattagatgtaacctcttaaactccaaagttctcttcaaatcttacctatttaatttgaaagcaagcaatgttccagtgttaacatttctgatttgggggatgccagatagtgaaatttggattaaacagagggaatttatagtcttattctaattaataaatggacttaacggggttctgaaaataaaacaacctcataattagttggtaattaacatagctaagagccaggtagaactgtccaacctgtgtcatattctcacaggtgtgcccacaaaatacaatattatatagaataaatacattgcccaccttcattcatccagcaagatgtactgacttttcactgtaggcatgaacctgaagggaattaaaaatgaaggatggtccttgctctcacaaaagctgccaaattgggtacactcactcagtgtcttcaaggaacacatggtcaggtttctagattatgcttaactagattgggagagtggattaccctcagaatacccttgataaaagctttcaaaattttcctttactcacaaaaccatgttttcagggaacctaaacagaagtccaatatataagatagaataatagataaaagtataaattatttggtcaaatgaggactactagtgttctcaaaacactaccccacttccaaaatacacacatacacacacacacacaattcctggaactttacagagtagagtttcaaaatcactgcagctgatgaattgacaaatagaaagaaggggtaacagataggtacaaatgtaatataataaacacaatagaatgttaatgttagacaccaagcggtggttacacagggtgttcactataaaattacttcagttttcatatacgtttaattttttcataatacaatattgaaaaaaaaatcccgctcttgattcctatatctgaaagttcttaaagttttagttgagtaaacatttagaattattggccgggtgcagtggctcatgcctgtaatcccagcattttgggaggctgaggcaagtggatcacctgaggtcaggagttcgtgaccagcctgaccaacatggtgaaaccccatctctactaaaaaaaaaaaaaaacacaaaaattagccgggtgtagtggcaggcacctgtaatcccagctacttggcaggctgaggcagcagaatcacttgaaaccaggagaagaagattgcagggagctgagaccatgccattgcactccatcctgggcaacaagagcaaaactctgtcttgaaaaaaaaattggaattattatttgttcttaattgacccctttatcattatgatatgtccctctttatctttggtaaaccttcttgtcttaaagtttactttgtgtaattgatgtagccacattggctttctaaaaattatttctataacatatatttgtattccttttacttttaactctttgtgtttttgtatttaaagtgcatatgttgtagtcagcatattattgggttttatttattttgtatctttcatgcacgtccgtgtgaagagaccaccaaacaggctttgtgtgagcaacatggctgtttatttcacctgggtgcaggcgggctgagtccaaaaagagagttagcgaagggagataagggtggggccattttataggatttgggtaggtaaaggaaaattacagtcaaagggggtttgttctctggctggcaggagtgggggtcgcaaggtgctcagtgggggtgctttttgagccaggatgagctaggaaaaggactttcacaaggtaatgtcatcacttaaggcaaggaccagccatttacacttcttttgtgatggaatgtcatcagttaaggtgaggcagggcatattcacttcttttgtgattcttcagttacttcgggccatctgggcgtatacgtgcaagtcacaggggatgcgatggcttggcttgggctcagaggcctgacagtatccatattgacaatctatgactattaattgggacatttagtccatttatatttaatgtaatgatataattcagttttaagtctaccatctgaatatttatgccatctttttttgtttccttcttccttctttcttgccttctttctgttaaaatgcatatttctaaagtttccatctttataccactattagggtttttaattatacctctttgtagcgtgtgtgtgtgtgtgtgtgtgtgtgtgtgtgtgcatgcatgctctaggactaacaatatgcatccttatcttatcaaaatctacctaaaattaatattatactatctcatgtaaaatataagaacctgacatttattacttccttgtccattatgctgtcacatgttttacttctatttgcattataatcctttcaatacattgtcatgagttttgctttaaatagtaagttaccccgtaagagcttaacagaaaataaagacggtttaaaaatatatatattattccatatatttaccatttctgtgctcctcattccttcctgttaatctgtttccatttgctttcactttcttttaggctgaagaatttgctttaacatttcttataatgcgggttgactagcagtacattttcttaggttttgtttatctaaaacttaggttttgtttatgcagccataaaaaggaattagatcatgtcctttgcaggggcatggatagagctggaagagatcatcctcaacaagctaacacaggaacagaaaaccaaacactgcatgttctcactcataagtgggagctgaccaatgagaacacatggccacagggagggaaacaacacacactggggcctgtctggggtgggatggggggcagcggtgggagggagagcatcaggataaatagctaatgcatgtgtggcttaatacctaggtgatggtttgataggtacagcaaaccaccatggcaaatgtttacatatgtaacaaagctacacatcctgcacacgtttcccagaatttaaaataaaataaatttaaatttaaaaaaagaatttaaaaatgtcattctattgtcttctggcttgaatagtttttatttaggagtctaaaataactcttactgttgttctcctatatgtaatgtctctccactcctcccatcctcagcagcttttttctttacttttggatttttatcagttggccgtcatacatccaggtatggttttctttgtttttatcctgctttggtttgctaaacatcttcaacctgtagtttgattttttcactatatttgggaaaatttgttcatttttttaaactattttttttcctccctcattctctctatcctcatttctggacctcaaattgtacaaatgttagacttctcgcttttgccccacagatcactgaagattcatatattttttctattttttcctcctgttcttcagatcagacaatttctactgatctgtcttaaagtttcctgatcttttctgtagtttctaatatgttgctaaggccattcagtaaacttttcattttggaaattattatttgcagttctataatatagatttgtttcttttttatagtttacatttgtttctctgagatttcccgcctcttcattttatgtcacccattttatgtcaagtccttgaatatacttatctagttattttaaattcctcattttctaattctaatgtctgagttatttcaaagtctgtttctatttattgcttttttctgattaatggagcttcctcttcacacatccagtaatttttttgttgtatgctaaacacagggcgacacatttagggaatctgcattatattgtcttccttatagggtactgagtttttttctggcaggaaattacatttctaaaatattctcttgaacctttcattgttagaactggtctagttcaaatttgtccttagttgtagaacacagccttatggtagtgtacaggtctcactcctgaggctggcctttctggggtttcaactgaatgcccaggttctcagggaaatctgccctctcagactaagaattccaacgtctcccatctctgggcaaccactagtgtctttgttcggctcttggtcccacagtgaaccctctctgctaggcctcatggtgtcttgccctgcttatacatagtcaatccttcagacaatgacctgcaaagaaacctccatgtacactacctccacatgccctacctcatgcatctctcttattcagtaccctactctgctaattccagcccctcagcagcaacaaagtacaaactctgccttatcagttcattgaaacaagcatgtaatgcttggccccacctccttactagccagtccagtgaatgcacccctaggcagaaagccaaggtgaatgcaaggcttgcctcaggggtttaccttgtctcaagggtcacagccctgcattgcctgttagccaatttctgaaaacagttgccgcatacattttatctaattttatagttattcatgaaatgaggtcaagaatgataccagttacttcattgtggcttgaaaactaaaatgctttagtatctctctccactaccaccatcaacacttgaactttacaaatgatcctatttattctaccacctgctactaaatgatgaaaaataattatcaagtgagttgccgaggcttcctgctcttatttctcttaccatgttctcagatatctgactgctagctaatgtctctgcccgggaacaaaagaagccagagaaggagaaagaggaagctcaagttctcccatattctctcttttcaaaagttacgaagagtagaaaatagtttaacaaggaagtttagagattacatgaaaattgtaatgagtctgatgcaccagcttccaataccgtcatcacaaccagcccttccttggtggtagttatgtattggttgcacctgatacctaagcagtagtctgctctcttttgcaataaatcacatctgtctctatgatagactctgacctcagcctaccaacagcatgttttttaatgacactggcttgcaaatgcatctgatttgaaataaactttctttgtaccatttttaggttctgtacttttgaataaaggtgcaatcacagcaaatcaaattctcagaagactacaataagtaaacattaagcagtgttcctttttgaaagcaggagagagtatatgtttaggaatgttcaaggattagtctggttcttttttaagtttttatttattgattttatcttaacagcaaaatacaatgcctggctagagcctttaaatacagataaacaatccaaacaagctgcaacttacgtatatcaatcttctaagatcacctcagaaaagagaaggtggctcccaacttgtcccaagttaaatacatttaagagaagcaaatgggaatagcagctaaagctgacggacagggcaattcgaggcatcagatgctccctttcaggttgctgagatgcttccagatggttcctgtatctgcatggccaaagtggtataatttattttcttagctttttcaatctctctgcatattacatcacaattttagctcaagtttatttttgttgtgtgtatttgacaatcctttggtggtgtggaacttaaatcatcacttcccagagcaagaaaacaaaggctgacacttctgatatagaaggctgcaatctggaaaggacgatggttggaagggcaggtggatgattgggaccaccactaggtttattctttatttgttcaacatgttttcattaaattagggtacagaggtggacaagtcagaagcagtctctctcattatggagtttacactctaccagaggtgagaatggaggacttaaaggtagacaaaaatgcctaatgtgtcacctagagaacacaaccaaaaatgagttacccaacaacttcatacagctgctacctgcagttagtatgtacatgccaggtaagctaggaagaggcctacagcctctcctggaaaatcttgggagaccaaataggttttgatcttgaccattccctgaaaatcctcatctataatcttcaaatgcaagaaggaaccaggaggtgccattatgtttcaccacaagaactcattttttttaattactgtttttttcttttagtgagcataattttttcttttgttgttattgttgttattgttgtttttgagacagggtctcataatgtcacctaggctggaatgccgtggcgccatcttggctcactacaacttccgcctcctgggttcaagggatcctctcacctgagcctccatagtagctgggattacaggcatgtggcaccatgcccagctaatttttgtatttttttggtagaggtggtgttttgccatgttgcccaggctagtctccaactcctgggctcaattgatctgcccgcctgggcctcccaaagtgtttggattacaggcatgagccactgtgcccagccaattttttaattacgtaaattaaaggggtacaagtgcagttttgttatatggatataccgcatagtggtcaagtctgggcttttaatgtaatcaacacctaaatagtgtacattgtactacctcactcccctcccaccccatcatcattctgagtctccagtgactattattctatactctatgtctacatacacacattattcagctcccacgtgtgaggacatgtggtatttcactatgtttctgagttttttcacttaagataatgacctcctattccatccatgttgttgtaaaagacatgttttcattcattttctgtggctgaatagtattctattatgtatacatatatacacacacatatacataaataaaatgtgctgtatgtatatatgtgtatatgtatatacatgtggtgtgtgtgtatatatgtgtatacatatgtatatgtgtatgtgtgtgtgtatatatatacatatgtatacacttatatacacacacagagcacattttctttatttaatcatcttgatttttttggaagagtttcagtaggatgagtatcagttcttctttgcacattttgtagaatttggctatgaagccatccagtcctgggcattttagggggaaggttttaaaattattgattcaatcttactattcattattggtctgtttaagatttctatttctttctggttcaatcttgggcagtcatatgtttacaagaatttgtcaatttcctctacattatctagattgtgagtgtacacttcttcatagtagtctctgatcatcttttgtattcctatggtatcatttgtaatgtcttctttttcatttctgacttttatttggatcttttcttggttagtacagccagaggcttatcaattttgttcatcttttcaaaaaaccaactttttgtttaacttatccttggtattgttatcttggttttcattttcattttatttttatttttaacaaccaatttatatcattcaaacagatagaactgccttgtgcttgtttcagccttgttttctggttattaaaagaagacctgaaccagatacaaattcaccatattttccttcaaggacacttctcataaaagctactaatatgcatattttggcatacaaaatcacatttgctaaaacttttttctgcttaaatacaattcttttttcatttagcaactgcatgttattatagaggtcaattcattgggttataagagaaaagaaacacttattgaagattcacaacatacattccattatatatcgctgttcaatagaatgcaaaattagtaaatatcacccctacaattggaccatgtaactgatagattttcctgtaaggagttaccaaaatgtcatcaaaatctagagtttgacaatttccaggccttatcctgaccttctcaatgcaagttgcacaaatgaaatcagttatccaagagaaaaactgggatagaaataggggttaatagattatgatcctaagttgaaaaatacagagctctcagtttccaagatttaccattttcaagtgtccctaattttgtcccaagagtggctccagcctgggcatgacagctggctgtaatggggacagatagctctttctttctaagaacaagatttaccatttgttttgtctgctctctccacaagctcttcctgaaacatatcagtggcataataaatatcatctcgttttccatcttaaggactttagtactcaaaggtaactgttttgagtccttaaaaaaaaaaaacaagcaaaaaaaaaagtggtttgcaaacttttgtctgtgacataacaccaaagccgtagtaaagtcaatgataataataataataggtacttacttgggctagggactgtgctaggcttcttttcattcattatctcatttaatattcacagttcctacatggcttagtatttcttgcagaccctttaaatgcttacatatagaaatctgccctactatttcaagtataggcagaagttggcaatacaagaaaagacaaagggataagaatccgtccaactggacaaaacaacttcaatccttaaaaagtcctacccattttagaaacaggtcaatgaagctacctgttatgattgtagaagtcatgtctgcttactgcacctaatttgagaattacagaaaaacatttttaaaaatcacatattattctatcactcagagataaacattgatagtgtttttatagttcccagtcttatttatatatttgccttctttttttgctatttgtttaatttttaaaccaaattcggattacatagcaatgcaattttcccatattattagatataatttttgaaagattttaaaacactaccttatgttccataatttatttaacaatttcactgtttactgacagataatttagagtacttaattattctataaatactataataccaaagtataataatgaatttttgcctgcatctctatttctttaagaaagatttctataaatgagattactagatcaaaaaacattaaaaaattctttttctagggagaatatccccatgcccaattccactacatttgccaactagctgaaaatgatggggttttttttgcatgttttaaattgttatataatggtattagattgcattcttctgaaactcattttcaaaacatctttactcaacatatatttatagttattcttgttactatatgttgtttttactcattctttttttgcttttcgaaaatcgtctcttagttgaataataatatttatgtattagctattggtgaacatgtacgttttcctgaattatcaaaaagatactattgtaagtatgttgtgcacattccccttggcatgtgggccatgggagttgcatgtcttcaactattctggatgatgccacactatattccacagtggctgtaccagtttgctctgtgaatgataatcttcattgctttacaacctctccaacacctagaattgttagatttatttttccctttaattttgacaattggatagatgtaaaaagctatactgtgctgattttagaaggcatttcctgattacttttgcagttgtacattctttcattcattaattgtccatttctgttgcttctccaatttatgtttcttcagaccccttagttatttttctattgatttttatttctgattacttgtttgtattaactctttttatatttcatattaattttctactatgaaacattctgcaaatacaggcataacctgaatgatgttgcctcgattaacattttcatggtaaaatgactcttggtttttaaaatccaaatttcatcatctatttttttttttttgccaatgttcatgtagcaaaactttagatttataataccaaactctgcaaaactttcaataaaaggaaatataggaaaatcatcaagatattttcaaaacatattcagtagaacatcagaataatatatagatattttggaaagcaagctgagtgacaacacacgaaacacccatttcagaagttgctgatgctaaaaggccatcataccatcagtgtgagccacacttggccaccaggcactagagcacatttcccagtgccttccccattttactttttttgcttattgttgaaatccccaaattgttgagaaaacactgaagacaattgtagagaagaaaacaaaacaagtgagaatagctactacgtacaaagcaaacattttataacatgttaattgtagaagtcatcaaggatataatttttttaagtacaagtgatcgaggatataatttttttaagtacaggcataccttgttttactgcactttgtttcattgcacttcacagataatgtggttttacaagttgaaggtttgtggcaactttgcatctagcaagtctattggcaccatttttccaacagcacgtgttcatttcacgtctatgtatcacaatttggtaattctcccaatatttcaaactaattcattattattatgtctgttgtggtgatctgtgatcagtgatcttagatgttcctattgtaagtgttatggagcccaatataagatggtgaactttatcagtaaatgtttgtgtgttctgactgctgcactgactagccatttttccctctcctcaggcttccctattccctgagacacaacaaattgaaattagtccaactaataagcagacaacagcttctaagtgttcaagtgaaaggaagagtcccatgtctctccctgtagatcaaaaattagaaatgattaagcttggcgaggaaggcatgtcaaaagctgagctaggatgaaagctaggcctcttgcaccaaatagccaagttgtgaatgcaaaggaaaagttcttgaaggaaattaaaagtgctactccaatgaacatacaaatgataagaaagtgaaacaggcttgttgaggatatgggaaagtttgagtggtctggatagaagatcaaactagccacaacattcccttaacccaaggcttaaaccagagaaaggccctaactatattcaattctatgaaggctaaaagaggtaaagaagctgcagaagaaaagtttgaagatagcagaggctgattcatgaggttcaaggagagaagccatctccagaacataaaaggcaaagcaggaagtgcttatatagatgctgcagcaagttatccagaagatctagctaagataactaatgaaggtggctacactaaacagcagattttttttttttttttgaaacatagtctcactctgtcactagggctggagtgcaatggtgcgatctcagctcactgcaacctctgcctcccgggttcaagcaattctcctgcctcagcctcccaagtacctgggattacaggtgcccaccactacgccctgctaattttttgtatttttagtagagacatggtttccccatgttggctaggctggtctcgaactcctgacctcattatttgcctgcctcggcctcccacaatgctgggattacaggggtaagccaccacacccggccaaaggcagattttcaagagagatgaaacagccctctgttggaagaagatgccatctaggattttcctagctagagaggagaagtcgatacctggcttcaaatcttcaaagaacaggctgattcttttgttagctgctaacgcagctggtgactttaagttgaagccaatgctcattgaccattctgaaaatgctaaggcccttaagaatgatactacaccaactcttcatgttctctgaaaagaaacaggaaagcctagatgacagtacatctgtttatagtatggtttactgaatattttaagccctctcttgagacctattgctcagaaaaaagattcctttcaaaatattactgctcactgaaaatgtacctggtcacccaagagttctgatggagatgtaaaaggaaatgaatgttgttttcatgcctgccaacacagcatccattctgcagcccatgggtgaaggagtaattttgactttcaagtctcattatttaagaaatacatttgtaagactatacatagtgatttatcagattgatctgggcaaagtaaaatgaaaaccttctggaaaggattcaccatgctggatgtcattgagaacattcatgatttatgggaggacaacaaaatattaacatgaaaaggtgtttgggagaagttgattccaactctcatggatgactttgaggggttcaagacttcagtggaggaaggagctgaagatgtggaagaaatagcgacaactagaatcagaagtaaagcttgaagatgtgactgaattactgtaattttacaataaaacttgaatgagtgaggagttgcttcttacgggtaagcaaagaaaaggatttcttgaggtaaaatctactcctgaagaagatgttatgaacatcgttgaaatgacaacaaaagctttagaatattacataaacttagttgataaagaagggttggagaggattcactcattttgaaaggagttttattgtgggtaaaatgctggcaaacagtgctgtatgcaacagagaagtcattcgtgaaagcaagaagccactgatgttgaaaactttactgttttcttactttaacaaattgccacagccacttctgccctcaacaaccaccagtctgatcagtcggcagccataaatatcaaggcaagaccctccaccagcagaaagattatgacttactgaaggctcaaatgatcaccagtatttttagcaaaaaaaatttttaaattaagataacatatttttttataatgctattgcatactagactactatagactgtaaacacaacttttatattcactgggaaacaaaaaagtttgtgtgccttgttttattgcaatattcactttattgtgatggtctggaagtgaacatgcagtatctctgagatatagatatgcctgcattttaagtctcagtgtgacattattgttctactatggttattttactgtgttttacttacacttcaagaaattcactagagggttggtttgacatataacacattttttcccatttaagtaatggcaaactgtctcaaggaaatcatttttgggtaatacatctgatcatcaggaatcaattagtaacatcaaacaaggggtgtctatatttttttctcagcatgttccttatcttttctttgtttgcttgtttgtttgttttctattttacatgtctcatttaatcctggaaaaatgctataaagtagctagctgattctatcttacagatgagggcactgagattcagagaggtcagtagctggctttattatcttcttcactgtggctgcaataaaaaataaccacaaactttgtggctctcacagctctggaagccagaagcccaaaattaagatgtttaagagcaaagatccctccagaggctctaggagggattccattccttgccactttcagcttctggtggttggtgggactcttgtaatagcatttaggtctcccaaaataatccaggatgatttcctcatctcaagatcctcaatttaatcatatctgcaaggaccattttttttgcaaacaaggtcacattcacaagctctagaaatttgatgtggatacgtttgcagagccaatattcaacttggcacactcaccgaaggccacatagcagaatacggtgtcaagtccagatataggagttccagactccagagttcatgttctttccactccatgtgcggttttccatcacattgtgtgacctgtcgtctccatccctcctcacacctcagattcccttagtcttcccaacctcagagtgaggttaatactctgttctctccgtgccagggtctcttccaaggagagtattcaagagctgtgccacccctttacaaattccattgcgcatccgtgacttcctttccaatacccagacagtttcctgagtctagttcacagactagatcaccaaagcaaccttcctgggagtaaatattacatctttcccattcatattagtttctcaaaagtgctcaagagcctgaagaatgacagaagagaaatgctaaagattgaaggagttcagaacacaatactccaaaatatgttgctctagtatattgactattttgagcttaaagacacttggaaaaacagcagatacaaaaaatatactctgagctttcttcttttccttagaaacaggagataacttgtcctccctacgccagagggaaagtagcgttcttatcatcaaagacgagaagttgatgctgagagaaatctgaacaaacacaccttattaaagtaacccttatcttcctagttacttctctacccaattaacctccctagcccaagcccgttggctttgtcacatactcacaattttctattcctttcccaattcagtacataggtgttcaactttcaactctgtctttgggtttcatttccttaagagggctcttgtgctcacataaaaattgaatgaattaaatttgtatgcttttctcccgctgatctgccttatgtcaattcaatcctcaggcccagctaaaaaaccctaagagagaaaatttggcctcccctacaatgtcatcctctttcttttttctggaccttctatctgctggtacttaagatactaaaatggacgggagaaagaaagcaaaccatgttatgtcttctgcattggcctggtacactccgtttgaaggttactcgaagccagcttgctttttgtcaagagattgcttgatctggagccatatagaaaatggtgacatctccaccccgtgacatatgggccagtaagggcttgcaaagttccattctgcacacttctcttcattctaagaacgagtattcattccatttaaacacatattaccaggaattcaatccaacctctctttttacagtctacctagaattactattatactatttacatacaatatggaaacctcacacatgtatgaatctatttacaaactccctctaaattcaagttgtcattgaaattacatctacctgtattataaatcccataaaaatgatgctatagtttttacttaaacaaacatacatattcttaaaacattaggaggaaaaaattgatttttatatttatcttactatttatgatttctttatttttacataaggatctgagttttcatctattttttcttgtcatcccaaagaacaaagcattttttacagtgtaagttggtctgctggcaataaatattctgtttttgtttttctgaatgcaactttattttgactccgttcctgaagtatgagtatctttggatatggacttcgggattggatagtcatatctccttacagcacattgaagatattgtttcattgtcttcttgctttcatagtttttgaaggtaggttggcagtatttagcagtgcagtttcatgtatatagtgtgttgtttttctccggctattttcaagatagtgtcttgggttttcagcagtttgattacaatgtgcctcagcatcttgaacgtgtacatttatctctcaccaattttgggaagtgtgtggggccactgtttcttcaaatattaggttggcacaaaagtaattgtgggttttgtaatgaaaagtaattgcaaaaccacgattacttttgcaccaacctaatatttttatgacccattctctatcacctttccttctggggaaccaattactcatatgttaaaagaattatcccataggaacctgaggctctggttgctttttttttaatcctttttaaaaatacaatctctgttcttcatagagaaaatctatattgatattatcaaattcactgactgctttggtctgcctgtgtatgtatattccaaaggtcagccagagatttgagcagaatttacaccaaaaatttgtaatgctccttttctggccctctttttaatgacattcctcccttactttccagtagctggggttgctccaaactctgtcccctggttcataaggccagaaagactgagcttcctacaggagtttcagccactctgtgtggccctacctgtggcttgacctcaggataatagtcataagaaatttaacctatactacttccaggtgtcttcaacccccttcgagaatcttgctgcctttgttcattcttcagatccctcagagagttttgttgttgctgctgtttgtgttttgtgagggtttacagactacatgggaagcagaaattgttctttgggatttaacttttacaaaaatcacaagcactcatctcatttgtggcagtgaaagtaatatttacaatgttaacgttaaataacataccttgctacaggtttccagtaaatatcttgtattatgctgcgtaagctcctcctatttctagctcattaaataaatattatttgcttgttggtcttatttaacagaaaaaaaaggagtctctatttattaattcattagttttattttccacagattgattttgttactctcctttaataatgaaagttctcagggctattaattttctgctaaatacagctttagccatttaaaatattgatacatagagttcttactctcctaacagtttattatatagtttcctttcctgtttgaatctggagtttttagaaaaaaatttggtttttgttatcattatttctcttttccaagctactgatttttgcatttaaacttttgctattaatgtctagctctatttcagtgtaggcagaacatggaggctgttaacactttatatttcataatttaatatggtttctttgagatataatatatgatcaatttttttctaaatgcttcatggctccttaaaaaagtgtattgcttatttctagagaacaaaatttaataaatatttattaaatcatctttgttagattattaaaatattctatcaattctgtgtttatttgacccatgaaagatcaataaaagtgtattaaagtgtcatacaacaattctacttccatcaatttttccttatatttctaacagcctttgtttcatgtattttgaggctgttaccaagtcaataaaaattcagaactgccttatcttcattgtgaagtctatcttaaagaaaatataaccttcttgattgcatttaatatttttatagcctttgattctatttcatctaaatattgccaagattacttttttttttaatttcgcttctgcctaataaatcttgtccattctattgttctttcttttttaatctaatgagttactttgttttaggtatatttcttctcagtaccctacagttagattttgctttttagctgaaatatacagttgttgtattttaatagactagtttaataaacatttcacaatgagattcagctttacacaatgctttcacatttatatttcctcttttcaacatatcaggtacaggggaaatgtcattcctatgttatgcataaggaaattcaaagccagataggttagatgcatttcccaaggtcattcaggtaatatatggcagtggcaagacttaaccaaaggatgataatactaagaaaatggctttttacaaacatatactatccccttgctgaacatcaatattcagatagactatttggtcaaattatgttttgtgtttttttttttgtttttttttttagacagagtttcgctcttactgccccagctggaatgcaatggtgcaatctcagctcactgcacccttcacctcctgggttcaagtgattctcccgcctcagcctcttgagtagctgggattacaggcactcaccacaaggccaggctaatttttgtatttttagtagagttggggtttctccatattggccaggctggtctcaaactcctggccccaggtgatccacccacctcagcctcccaaagtgctgggattacaggtgtaagcccctgtgtccggccatggtcaaattatctaatttttcttccactgggggactttatactatttatttttattgccgtaaatgatatgtttgtaacactgtaatcttatttcatgctttgtgtagtttatgctttactcttttttctttgttttatatactattggccctccttgtctgtgggttccacatctgtggattcaaccaatcatggattgaaaatgctcagtgatatggtgtggctctgtgtccccacccaaatctcatcttgtagctcccataattcccttgtgttgtaggagggacttggtggaagacaattgaatcatggggggtgggtctttctcatgctgttctcctgatagtgaataagtctcacaagatctgatggttttaaaaacaggagtttccctgcacaagctctctctttttgcctgctgccatccacataagatgtgacttgctcctccttgcctttcaccttctgccatgattgtgaggcctccccagccacgtggaactgcaagtcaaataaacgtctttgtttgtgaattgcccagtctcaggtatgtctttatcagcagcagtaaaaaggactaatacactcaggaaaaaaaaatggcatctatactgaatatgtacagacattttattgtcattattccctaaacaatacaactatttatatagcatttacactgcattaggtattataagtagtctagagataatttaaagtagtctgtaggttacatgcaaatattatgccattttattccagggacttgagcatccacaaattttggtatctggaagcaatccttcacagataccaagggacgacagtacttggtgatttagatcaggctgcacattcttttctctctccattggtttggaagtcatgcatcctacttttgtttctaatagtggcacctggtatatcaaaaagaatattaatatttgttgaacgaatacattttaaaactttcaaatatttagaatatttgagtctacccctagaaaaatgagaatttgtcacaaatttatttctggaccttgtaaatatgatcctgggtttcttattgcttagtgttaaatattaaggtattaaatatttaatgcttattaaagcattattttgtgtgacatattttctctttcaaaagcatagttttacatttgcattcagtattataattaaagttacaatcacttaaatctcactttttgttaacttggtttaattattaacaaccagccacttctctgttactgaattcttttgttgttgttgtggttgttatttagtttttatttcataatcataaacttaactctgcaatccagctaggcatggaagggaacaaggaaaacatggaacccaaagggaactgcagtgaaagcacaaagattctaggatactgcgagcaaatggggtggaggggtgctcccctgagcaacagaagaaatggtctggtggttaagataaaacacaagtcaaacttattagagctgtccacagtcagcaatagtgaccttcttgctagtcttgccattcctgaacacaaagcgctccatggcctccacaatatccatgccttctttcaccctgccaaagaccacttgcttgccatccaaccacttggtcttggcagggcacatgaaaaactgggaaccatttgcgttgggtccagcatttgccatggacaggatgccaggacctgtatgcttcaggatgaagttctcgtcatcaaatttctccctgtagatggacttgctaccagtgccattatggcatgtgaagtcaccaccctgacatacaaaccctggaataattctgtgaaagcagtaaccctcataatcaaatcctttttctccagtgctcagagcatgaaaattttctgctgtctttggaagcttgtctgcaaacagctcgaaggagacgcagcccaagggctcgctattgacagcaatgtcgaagaaaacagtggggttgaccatagctggtaatacggggctcccagtggcagcaccatctgtgaagtctctgttactgaattcttaacttcaatttctctctcagttacctgggcagtgcttcctaaatgttagtatgtttaagaatctcctagagagactgttaatgcacagattgctacagttcatccagagtcctaactgttctaagcagtaggttttatagcaatattttgtaccatatagtgtggccaaaaaaaaaatatctgattttttgctcctttataaggctaactgttttgtttgcctgtgtgtgtgaaggattttttttactttattctttaaaaaattaccaagttgaaatgatataaaacccttttcattaatgttgcctggagtacggaaagtcccttcaatttttgttttttggtatcgggttttgtttttgtttgttcgttgtgctccgaagagcttttattaatctttcactactatttgtgttctaattgcttctgcctcaagaacatctgtgattcttactttggttctgggtgttcaaatctatgatctctattttctatatttttaatcatctcttttgttattttaatttttattgcacctgttcatttcaacagaaattatcaatttttttcccctcttgattttttctttttcttctttttttttttcttgagacagggtctctgtcatccaggctggagggcaatggcacagccacagctcactgtagcctccacctccccaggctcaggtgatctacccacctcagcctcctaagtagctgggactgcaggtgtgtgccaccacacctggctaatttttgccttttttgaagtgacaggtttacatgttgcccaggctggtctcaaactcctgggcttgagcaatctgcctgcattgtctcccaaagtgctgagattacaggcttgaggtaccacacctggccatgagtgttttttaaatagtgatttcttttcagcttccaacacagacttcaattgtgttatgacattctggtctctttacaatattttcttgactaatccatctccttttccaaataatcctactttttacaatctaaacttattctctcatttcactttctgtttcctgatgctgttgaggatgacaaaaaatcccttcagatttctgtgacatatcatcttgggaggtcaacatttactctgagtctctgagatactgttcccttttccttgtccataatgatttctttttactttagtttatcatgaaagagaccgtgtttgccaagaaaaagatgaagattgtctttatgtgtcacttaaacataaatctcttacagctaaatgacatgttggtttacaaaacttatatcctaatttccatcctctagcaggttttccacctagcatacctgttgggattggcatagactcatcttgtatcactacctgcatctgtattatgaaaaacaacaatccccaaggccctcgtagtttcagcatagatatagtgctttaactgtgacagatcctgacaaacatatttccaaaaatattactgccctatttagtaagcaggataatggtcttccaaaggtgtctacatcctagtccctaaaatctgtgaatgtgttagattacatggcaaaggaaaattaaggtagcagatagaattaagtttgctaatcgtctgaccttaaaacagggagattatcctccagtaccagggtgggaccaatgtaatcacaagggtcattaaatctcaaaaacagaagtagaatagtcagagcaatgcaataggaaaaagagttgactggccattgctgatattgaagatgaaagggggccacaagctaaggaatgcaggcagcttctggaaggtaggaaggacaaggaaacacattttcccttagagacctcagaaaggaattcagcctaacatcttagcccactaatatccatctatttcaaacttctgacctcccaaactgtaaaataataaatctatgtcattttgaacctcaaagtttgtgttaatttattacagcagccacagaaaactaatatatgaccatttatttgagtaaccactatttgcattcttcacatgcatatgcaaaagatgtcttcattaaaagtgatgcttcacaaaagtacttacatgcatagtaattcttgttcacttttctgattagcgtttgcatgtttctgaagcaggggaaagatagcagccaaatgattaaaggtcttccctctgtttggccacagcataagggaatcacctgttgaaattgttcattctagttccaccaaacatctcattagtagaattctctacaagaatcaagactagcttgactataaaaacaaatttttagtggcagcgacttctttttggcatatatcttcttgagtatttttatagaaagttgaaccaggtataatagaggctactactccaatatgaatttaatttcattcattcttcaatcccttcttggataaggtgctgatccacctaagtcactccctcataagtgaatgcaaacttaagaaattataccttcataaaatgggcatatttttctaactgtaaaaatgttttctttaaataggcatgactatggcctgtctattttaatttcgtatagcagtaatttcccttggggaaggagtaaaagacaatattttttaaagtttctctctatctagataggatgctagtagaagcaagatttctatatgttctgatgtgaccaagtagatatttctctactcaccagcctctgaaaatccctgtgtttacccaagatttaactaaagaggctaaactcgtgggtaaatattaagagggaattgacaaaggcatattaagtctaaggagtagactatacttttctaaaataaacacataattacagagttaacacagcagcaccttctgccttgtcagtgctgaaggccccatggcagccagtactcttcacttgacctcgtcctgcaaactttctgtacagcagataaaggcccaaagtacactatagtttagtgaatagcataaactcattcatctgtaagtactagatattacaacatcaggcttctcactggtcctactataaaaataattttatgcttgcacattggacacaattgttctggtggcatagctctttagctacaccagcactgaatagaaagaggcatcctctactattagtctgcaacagaacccagcatttccaccattgcaaacatcaaactggatgaagactttttattcccagcaggattaagtcaaaacatagattgacctaggagaagaagcattagcccttgtcaaataagtataattacttgatgacattggttagtaaagctgcaaagaatactgaggaaattaaaccagctaatttgggaaagaccagaaaggcaatatgaacaccataaaaacatgggtaaggaacagtaagatgctgacctttactgttttctctgggcatgatcctgcctggcagagctatgtttaggctcctcagaaaacccgatgctctctttgcattactagccaatgtgaagcaacattaaataaaaaaaaaaagaaaggaaagaaagaaagaaaacaatcagagaaatgcaaattaaaaccacaatgagatatcacctcacaccagttagaatggcgatcattaaaaagtcaggaaacaataggtgctggagaggatgtggagaaataggaacacttttacattgttggtgggactgtaaactacttcaaccattgtggaagtcagtgtggcgattcctcaaggatctagaactagaaataccatttaacccagccatcccattactgggtatatacccaaaggattataaatattgctgctataaagacacatgcacacatatgtttattgcggcactattcacaatagcaaagacctggaaccaacccaaatgtccatcaatgatagactggattaagaaaatatggcacatatacacaatggaatactatgcagccataaaaaaggatgacttcatgtcctttgtagggacatggatgaagctggaaaccatcattctcagcaaactatggcaaggacaaaaaaccaaacaccacatgttctcactcacaggtgggaactgaacaatgaaaacacttggacacaagaaggggaacatcacacaccggggcctgttgtggggtgtgggggtgggagggatagcattaggagatatacctaatgtaaatgacgggttaatgggtgcagcacaccaacatggcacatgtatacatatgtaacaaacctgcacgttgtgcacatgtaccctagaacttaaagtataataataataaaaaaaagaaaaccattaaaacactttagaaatatataaaggtaggccgggtgctgtggctcactcttgtaatcccagcactatgggaagccaagacaggtgaatcacctaaggtcaggcgttggagaccagcctggccaaaatggcaaaagcccatctctactaaaaatacaaaaatttagccaggtgtggtggcgggtacctgtaatctcagctacttgggaggctgaagcaggagaatcacttaaacccaggaggcaaaggttgcagtgagccgagattgtgccactgcactccagcctgggcgacagagtgagactctgtctcagaaacaacaacaaaaaagaaatatataaatgttttcatttgtatgagaacttatgaaatagtgattaagagaatgggctccaaagtcaaactgtgagggttcagatgctggtcttccccttgtagaaatgttatgtaaattatttatgcttcatttcctacatctgtaaactgggggataatactgttacctcactggctgctttgggaggatcagctgtgataattcatgtaaagcttgtagcagagtgcctaatccctaacaagagttcaacataattgctgctgctgctagggagaggctgcaaagcattctgggtaagaacagggacgctgggacaagattgtagaggctctgccattgacaagctgtaatcttgagcaacgtatttaacttctttgtacctcacttccctcacctacaaaatggaagtaataataaccattatgagggttgttgtgagaattaaagagttaatatttgttaggtgtttagactagtatctgatacatgtctgacaaactattcagctgtacatgaatggttttaaagctgtgattatggaaaaccaagggctttgtacggaggaatggagataaggagagtgtgcagcccagtcccactctgtatgcaaacaaagtaattctagctcttttacatatttaactttcaagcaagattttctttgagtaaagggtaatgctgctttaaaagaagaaaggaaggaaggaaggaaagaaggaaggaaggaaggaaaccatggctctatatgtatgagcctcatataaaatatatcagtacaggtcttacaaaacactgaatgtttttatacacattccctagcagatttaaccagatcagttttaaggttccttctagaaaggaagttctccatacgttgaaaagtgaatttcagtacattcaaattttaaagacacgacttcccatacttcttcagggtaaacaaaaatctcaataattctaatttaacatgcaaaagccatgaatattcactacagtcaaatgaataataaatcacccctgggttcaagtgcttgccatgcaaaattgcctatttcctagaacatccagaaatctgtttttaaattgctttttattacttttgctcttgtgatggttgctcttcaaagcaacttggaaaaatgtgccattctcagcattaaggcgataaaggagaagtgaggacagcagaacacggtgccatccacaaaaggaaagagagtctgtggatcagagggctgggctccggaagacagtttttaaatgtcactagataaaatttatgagataaaagggaatgttccttagtcatcctgagcattgatatctacatgaataataaatcaaaaggctctttatccatttactggtaaacattacgaccttaggttgaagatgtgatttactccactgatatcaacacaacagaaatccagtgaaagtatcactggactggccccaagttctggaaaatcaatgatgcgtgggagaacaaacattttgaggggaagagtatttttttaaaagtaaatatttgtggcactagcaacatgagtgcactcattaagatttcttttaaaggattaccctttagtctctcctacatggaaaactcaagtatactcaagttgtcaattgtataatttgatggaaagttatccctagtattttcccccaaattggattgaattattaatatttcacctttacaaatacatgcagtataattcaatttatataaaatttaaaatatacagaacttacagtgattgcaagtacctaagctggtaataaaggtatcaattaatgaaggaaaatggatatgtcaaaggacaggatagtgactacctctaatatgatcagagagagggttcagatcagggaattttcagaggactgctggggatgctagaaatacaatgtattgacttgggtgaaccttgagataggtgtttatttatagttattcattaaactgttcatacatgtcatatgcacttttcctgtacaaattatatttcacaattttatttaaatagtatgtttcattctgagatgactctccaatctattacatgagacacacttatactcaaaaaggtgttcattctttttctctgaaattcagatttaactgggcatcctgaattttatctggcaattgtaaaccaatcagaatagcatggttagattacaaataatatatatattttaaaagacaggaaaataaaccacagataaaatgcattcttaaaagtcttagtcatttcatttcatattctattaatatgatacatttgtgtttcatggtttctgaccccttgtgtccagcggactataaacataagtatgctacctagacccaaactaatttacttaaaggaaggcaaagaagctgaccattataaatacagcatgccttagaaaggagagtttcaagtcaaaaacaaatctggaaaaaaaattaatttgcttcttttttgtaaagcaatgatgtgtcgtttttatgtgcatttgtttacacagtaaaagaaaagacaatcaaataggtaaaatggatgctgtattgctcccttatacacacaaggaattacacatctgtctaacaatgctaaccactctgagcgataattatggatcaatgctttaaaaaatatcctgaattgcctgcagaaatggcaaggagaatacaattaaattatttgtaaaagccagagtctttttttcctatccatctgctacttgaaatgggatgacctttcaaatagtgcttgctgttctcaatgcaaactctaaataaagaagtggagtgtggctttttttttcctttccaggttcagcatagatacagcatttgtactgacattctacaccactccataagaatgcagatttggcttctagaacataaaagaggcgtttcaggaatataaatcaggcttttgtcccataccttcagtcatgacatttggcttctatcagaaaggtgtgcggcttctgagataagtgtttgagaacaagctacatgaagtaatttactccctggagaaaaattgcaaacctcacccccaaacaaaccgcataaagtaaatgtgttagtgaagaaccttttgttaaactacctatggctggggagctaaatagaaaaggtcagatatttaagctaacaatgggctcaaaacaaaccttccaacaggtctctcaataggcctacattatcaactaacaacttgcactattaagactattaatagtaataagccatgctttcttcactgagtctatatatattttacattgttttattgctcccctaccctttttaatttttaaagcatttccagtttggtcctttgtgtgcttttttaaaaattaggattttggacaaactttcatgtatttttcttaataaaagtgtatcaagcacatttcaaaaagttcaaaaaatacagaaatataaaaaataatctattagcacatcacccagagaaactgacttttaacagtctggtgtttatactcccattcatcttaatacataagcgtatcacaaaattagatgatattatataacaatcaaaactaatcaactgttttatgaacatctttctatgccataagtaacaatctgtatcattatacaaaaattttcattacaccttttaaatgttttatgggtatctctgtgtgtgtatagttgtaaaatataacttttaagtgaatttatttaaatacccaactacttatgagtacatagatttacagctttttccactactgtaaacaaaattgaaatgagcatccatacacacatctttgcagttatttccttagtattactttccagaaatagtatagctggaccagaaagtataaacattattagagccttttggttaatattgtcaatctgccttccagaaagtttactaagcaaggtaggtagatttccctctactgtataatactgagaaatatcaattttttggatacttgtcagtgtgagcaaaaatgtcattattgctctaattattattgctttgataactaatggggctgagagttttactggtgttttataactcttcctttgtgaatcattattcagatacgtttcaaatggtaatttgtaaagtattttgaattttggcccatttttctataagataaaagcattatcgttagtgggtgcagcgcaccagcatggcacatgtatacatatgtaactaacctgcacaatgtgcacatgtaccctaaaacttagagtataataaaaaaaaattaaaaaaaaaagcattatcttaaagtacaacaccattaggatttaagataaatacacacacacacacacacacatacacacatacacacacacaatgagaaaaatcattttaattttaaaaacaatactcagcataacaaattaaacaaaaatgcacacatacgccaggtacagtggttcacacctgtaatcccaacactttgggaggccgaggcaggtggatcatctgaggtcatggagttcaagaccagcctggccaacctggtgaaaaaatacaaaaaaagtagccaggtgtggggtgcatgcctgtaatcccagcttctcaggaggctgaagcaggagaatcgcttgaacccgggaggcagaggttgccatgagccaagatcacgccactgcactccagcctgggcagcagagcgagagtctgtctcaaaaaaaaaaaaaaaatacacaggtatgtatgtatgtggtatataaaataagtcaatacgctatcccagcactatttccaattccattttcccatggcaactaaaaaaaacaaaacaaaaaatagaaacaattacttgtttatccttctacatctttttctagtttcataccagtacatacaaacaggttttgatatagtcattctttgctttctaattccaacggtctcatatcgttccaattagtcaaatgattagatgctgccatatcatggacatgctggacatcacatatagatgtatttagttattattattagttccataatatttcacagtatggttatagtataaatatattcaacaatctcactattcatgtgctgtttttatgttaatgttatttgtcttgatttttttttgccactactaaaaatgcagccatctttaaatatacattttcacatcagagattactgactcccaaaattaaggttgcagagtcaaagagcaagtgtaccattaattttgataaatatatccagatttagcaatatatgaaactcttccatttctaagcacctttaacaagcatggatattatcaatattttccaattttgtcaactacttgactggaaaagtatttatttcattgtgattttaatttgtatttccacaactactagtaaagttgagcagagttgcatgtctcttggtcacttaaattttccctctgtgaattgccaattaatatccctagccatttttctcaaatatggtatataactgtatgtcatcagtgtctaagaattcctatttttctaaaatttatattgtttaatgtacattcatatatttaattcatctgaatttttagatttttattgtaaaaaatagtggtctaacatttacaacttactgatgaaaagccaattttcatagcatcttttattagataaacatacatttcccaactgaactgaaaagacccttttttttttttttttttaagacaggatctccctttgttgtccaggctggagtgcaggggagtgacctcggctcactgcagcctcgacttccctggctctggtgatcctccaacctcagcctccaaagtagctgggactacaggcatgtgccactgtaattgcccagtgggttctccttgcctactgcctagacagagccaatttctcaagacgagggaactgcaatagagaaagagtttaattcacgcagagcaggctgtatgggagacgggagttttattattactcaaatcagtctcccccccaaactcagggatccaaacttttaagaataatgtggtggatagggggtcggaaaggggggagtgctgattggttgggtgggatatgaaatcacagggagtcgaagctgtcctcttttgctgagtcagttcctgggtgggggccacaagaccagatgagtcagtttatccatctaggtggtgccagctgatctatggagtgtagggtctacaaaatagctcaagtactgatcttaggttttccaatagtgatgtttccctgtggagcgatttgggaggtttagaatctcgcagcctccagctgcatgactcctaaaccataatttctaatcttgtagctagtgtgttagtcctataaaggcagtctagtccccagacaggaagggggtttgttttgggaaagggctgttatcatcttttttcaaagttaaactataaactgagttcctcccaaaagttagttcagcctacacccaggaatgaacaaggaaagcttggaggttagaagcaagatggaatcagtaaggtcagatctctttcactgtcataattttctcagttataatttttgccaaggtggtttcgccaccatgccttgctaattttttgtatattttatacagacagggtttcgccatgttgcccaggctggtctctaactcctggggctcaagcactctgcccatcttggcctcccaaaatgctgggattataggcgtgagccactgcatccagctgaaaagacacttttactgaatattaacttcatatatttggatctgtttctcttttttctgtttcatttataaaatgttctcgtggctaacaacataccattttaataacagtaactttatattacattttaatgtttagaagaaaaagtaaaaatgaaacctgttgccattctgataaattatattaacatatctattttataggaatgaatgacattttataataataaaaactattagggaatatgagtatgactcttttgacaggcagttttatctccataacatttttcttttttctatataggccttttttgttaaattgttactaaggattttatattttttgtttccaaagtaatttttttctatttctagataactagttattgaaagtataaagaaaaaatttgatttttatatatttattttgtgatcatccagctaacatgttttcttagtaactgtgtaacagtcataaattctctatgaatataatcatatcacatgacagtgaagagagtatcattttcttcgcttaatttttttgtttgattacaacaagcagaacccataacacagtgctaagtaacagtgctaatagcaaatattcctgtgtattcttcctgatttaatatgagtgacttttatattttactgtttaatgtaatgtttgattataggtctttataaatattccttattgtgtttaacttccttccatgcccattttatttagagtattgctagaaatttctaatacattttatcacatttcttatcagtatgcatactgagttgaatacagtcctccataatttatagtcatgtggaatctcaagtgactttattttgaaactgggtctttgcagatgtaatttgttagattacagtaattagaggtcataagggattagagcggcccctacccaatgactgttgccctcataagaagcaaaaccagagatatagtcagacacgcagagagaataccatgtgataaaggagacagagactggagtaatgtgtctgcatgccaagaaatgccaaggactgttggcagctactaaaaggtaggaaaaggcaagggagggccaccccttagagccttcaaaggcaggatgtccctgctggtaccttgattttgaacctctagctttcaaaactgacagacaataaatgtctgttattttaagccactcattaccaaattaccaaacggtaatttgttatggtggttttaggaaattaacaaagcatatgttgtataatcaaatcatttaatcttttaattaatggtataaagttccaattcagaaccagtttgtaatttttgaaatgaagcctattttaaacattttatcatgttttcataagcagatagatacaagttgctattttttaattatatacttccacatatgaaaatgaaattagcataaaatatctcattagtgttatttatctcaagttttgatataacattttgctagatttgtacagttgagccccattctattttctctatagtcttgaattgtttaagaaccatagggaatatctgttttttaaagctttcgtatgttacaagtatcttttaatcttttaaagtacctgtttttaaatatctagtttacatgtaaaactatctgggcctggtgccttttttctagtggtacatgtttaataattttccactttcttctatgattattggtattaaatgtttttattttgcctatgggaataatataatactgaatgtatatatacttttctaaagaatcatcattttcctagatttgaaagtgaatggctataaaatttttttttaaaaaaaatctagccgtaccagtattgattggcagagttgaccaagggaagctaagagggtacataccatcttcctcccacacgactacatatgcattaaatcagaagacgacagtcttccaagaataaaatgaatcatcaagggaataagagcagttctcatccctagttagaatctctaaacaaaccaaagcaaatgtttttatttgaatcatcaggactgtgtcacaatgaaacctagatggtttgtcttcaagtcatttactactcccctaaagtcttatcaaaagtatgctaaaaaagtttatgacatttccactgagctacaataaagcttctatttttttagatacttgacaaaattttaaaaagaattatttttcccccacacctgcacacattttaaaatatcttcaacttttctacaaaacaattttctctacagctctcccagacttcacaaacatattcttttattcatagcagatggaggaaattagagtaacatatttgctctaaaatcattagtgctgcatcagcacttctgatctaaatgacatttcaaggggttattgttacatagagcaagactttgctccaggcagaaagagacagaaaaacaacttgaaaaatgaacctttttttgcaattagcttctgcatcttaatttgttgaatgccattctatttggattttaaatacaaatcaaaggaagaataaagtgatccaattctgtcagggtcataccttccttactggtcagtcgtctgattaatcattatagctgcttcctaaaaaataatgttgttaaaacttaccatcaactacttgattctctggaaaactaacatattcttacttctcagagatatcttgagaggctgataagtctgctctttagcctcaagaaatgcctaaaattaaactatttaactggtgagcttcacatgactgccactctgtccaagagataaataaacatccctggctgaagaatgaaccaacccataggtgtttctttagcacatactctgttaagtccactgtggaattaaaaaaaaaaaaaaaagtttaaggtactacacacctggaaaatgcaatcttgtaaacataggagaaaccacagagaatgatacaagatagcaacaatcatactttatatttttacactgcattacaattttcaaactactttcatgacacttttcttattttatcctcacagtaaatccataatggaagcaggataaaagaggaaggagacataaacatagaacttcagagatgaaagcaacattaaaggcatcaataaccttctttacagataagaaaatggagaccaaagggaaataagaaccttcaccttgtttcagagtcaggcaagcaaagctaatgaagtgaaggcttgtcaccccaagttgcaaaaagaagtcacaaaaataagacaagaaagagaaagatgatagaaatacaggacactaatttggatttaatgtacttttttaaaaaatagaaaaggaaaagcaattctattgaattcgggtttgaaattcaacgttggtctctagggatcacttggctatggtggttttatgccattaccagatccctttgagaaaaatactattttgaaattcatggtttccagtaaatatgttcaaggctttgaagaacatactcctgtaggtgtaaatggtgtatacacatatacacaaaagcttgaaaacactacttaattactgaacggagtctaaacattctacagctcagttaagaagctacacatgcgtctcacacccaccatctctccagctgtcctccacacaccatcccagcaagtcctagctgaccctcttaatactgtgacctctctgttgtataataaaggttgaaaatcatccttcctttgaataagaatatattataactatattattttttgttacagccttctcaaaaatgtatttcaagccacacataggccattgtcatggcatcttttatttaacagacaatagctattttccatgactcagtccagaatattctttaacatctacatctaggatattatcataattataataagagacggcactacatggatgaagctggaagccatcattctcaggaaactaacacaggaacagaaaaccagacagcgtatgttctcactcataagtgggaattgaacaatgagaacacatggacacagggaggggaacatcacacatcggggcctgttgggggtttggggggcaaggggagggatagcattaggactaatgcatgcggggcttaaaacctagatgacaggttgatgggtgcagcaaaccaccatggcacatgtatacctatgtaacaaacctgcacgttctgcacatgtaacccagaactttaagtaaaaaagaaaagaaaggtgcaaaagtgaaaacattaaaagtggaatcatgattttaaaaaataaattcacagtggtgttgaaagatcatatcagggttagaggacaagtctttgggttagaatgaacacttaatttattatcagagtgaacaataattacctcgacattttaaaacagcattttgtcaccttttaaacgtttgggaacagagaaggcgaaacaccatgtctgacacactatggaaagttttataattctcctcaaaaaggaagaaaaaatatttctatttccattccagatctgcacaatatattcttgcatcccatttggtctgattcatttacattttgctgaattctgtttttgtccattttcatcattcaaaagattttaaaaattcaacaacatcaaaaagccatcaaaagatgctttcagatgaaattgcaaagaaaataagcacatgaattagtgaagcaacttccaagttatacaattgtggcacttacatcttttctcatcttgtccgagaattaattgtactgctgaaattagacatccagcctgctccatgcagacaggagcccaagccggaagaaaactctttgaataacaacactgccttctgattcttttcacatggctacatttttgacatttacttcaatattctacccagttgcagtgtgactatgacaaaatatttctgtaggcatgactggcacctctgcggtaagtggcagggaatggaataggaaacgagtccctttagtagctccaaaaagcccacaggcactctgcaaaccttttgcatacatgctgttaagtaaaggatgtgaaaaatggaaaccgtgatgacaattttaatcaccttacagatgattctatgatctactataactttataatggcaaagccactgacacaggagactgacaggcatatattctctctctgcctctaagtctattaaatgtttatttggggggtttacacatggatagagatgaacttaacagagtatttattgaatctatccacggataaattataaatgactacaactttaactaggtggaattttcatggttatttttaatttctaggcccaaatcacttccctaggctctagaactgtcttccaggagatgtcagatgtcagtaatcagagggaacccatctacagtcaatgcagccaaaagttctgcctacaaggtagcaattagagtccagcagtctcttctggaagtgccaattactgttctgtcttcccttttgaatgcctccttaatataagaataacatatcatttttatcctatcagattagaaaatattgtttaaaataacactcacagttggcaagaatgcagagagagaagcactcccaaacagatgctggtgaggatgtaaattggaatgtcctttctggaaaacagtccagcaaaatttatcatgatgtttttatcttcctgacattagtttgggtatactgttgcatatttttaaatagtcttcaaaagctagagttttaaaactctgtgtggcattttgttacgtgaatacgctatagttttcaattatttccacatttgtcagcattttagttgatttcaacttggggtattataaataatgctccagtgaacatcttcataaatacacatttaactcacattctgtttatttcttagtatagattcaaagtgaaaatacagtggttggcaaggcttatattcaagtataattttatcctagtaattatggaattagtatcagcaaacggattcctaagctagaattcaccatcatttactaggagaaagatctgtggtggtaaaacagactctgcttatttacacagccttactaatgggcaatttgccagaggaatccaaaccagagagcatgtatgattgactaaccattacatggaaagaagaaatcagctcctaccaaaagcacattcatttcaagtaatgccagcaacctgctgagtcagttgtattcagcccctatagaaacccttcccaagttcattgatatgtgacacccatgacatatttttaccatcattggttttcatgaatttgcctgtctttgagacctgaaaaacaatctgatttattgaactgaaaaaggcgaatgtagtgaaaccctatcctgtaattggcaaaccttttacctccctggtggcttgagtagagaagttactggctggaggctgttctaaaggaaaacatgaatggccctaaaattaaaattccagactttaggagccaattaatgaggacataccacttttaatccatcactttgcaatatatttaaaatgttaagactcattgttggcaagggaacagtattccccaaagcttattccatgggaaaatgtttttgtggacaaaagagtttgggaaagagtgatattggaatgaagttcaagctgaacttttaatgtgctattaccaactgtgaatctccatggggggctgtagctagtaacatttgtaaacttcttcaaccacaaattattcctgctttatattgcctttgtttctggcaactgggtttctatagcgcattgcaaggcagagcattctatggaacgtactttagagaatgtttctctaggtcagcagttctcaaacattttggtctcaggatccatttccactcctaaaaactgtggaaggccccaaagagtttgtggttatgttggttatatctatggatatttaccatgttagaaattaaaacagaaaactttcaaaacactatgaatttattttaaaatgacagtaataaccaattacatgtaaatatacatattttcccgaaaaaagagctagtgagaagagtggcattgtctcaacatcacattaatatttagcctaatagaagacaggtggattctcctatctgtttctgcattgtgttgtgatatattattagggttgaagtgtgccaagaaaatctagaaggaatattttaatagccttttcaaataactggattttttctctaatactgcatcaaaacttaacaaatggtagtttctttaaaagttacttgcagagtagaacccgaaaccacatcaagaaatttttagtgctctgttatgtgaaaaatccatggtctgtgtagcattttgaatggatcctttccccatgtgaaattttgtaacagtgcacattgctctggacaaaaatagtggttcattggattatgcagatcttccaaatgttgacacctttcattgcatgatataaaaaagaattatatttgcaatatcatcattgaccttttattagaaaaagtctttaagtattgggaagctgtcaagctcatggtggcatatccaagtttcccaaaatttgaatttttgcttagaagcttgaattttatcactatcaacaaatactggccaacggtttacttaaagcaacagactcactttgtgcattttaaagaaaatatgttaaatacttgagtttgcataattatagtttgtctttcaatgcttctttcatgcagaaaaatagtgttccatataaaaggtagctggttcatttcactacccagtctcacaagtgcttttccttgagacaaccatgatatgtcagtacacagcagcagttctttctgcatacttcccatttcagcacacagaatgctaaaaaaaaaaaaaaaaaaaaactcaacaatcaaaatgcaattaaattaataatttttacttttcaacaaggatattcttagaaaaagttgactttttattttttttaaccatagtgcatggcagtgaaaaatgaaaggccaaaagtacagttcagtgccactgtcttgattcatgctatggtgccagtagttttaaaaaacattacatttggaggagccaagatgtccgaagaggaacagctccggtctacagctcccagagtgagcgacacagaagatgggtgatttctgcatttccatctgaggtacccggttcatctcactagggagtgccagacagtgggcgcaggagagtgggtgcagtgcaccgtgcaccagctgaagcagggcaaggcattgcctcactcgggaagcgcaagggatcagggagttccctttcctgctcaaggaaaggggtgacagacggcacctggaaaatcgggcccctcccacctgaataccacgcttttccgatgggcttaggaaatggcgcaccaggagattatatcccacacctggctcggagggtcctacacccacggagtctcactgattgctagcacagcaatctgagatcaaactgcaaggcggcagcgaggctggggaaggggcgaccgccattgcccaggctcacttaggtaaacaaagcagcctggaagctccaactgggtggagcccatcacagatcaaggaggcctgcctgcctctgtaggctccacctctgggggcagggcacagacaaacaaaaagacagcagtaacctctgcagacttaaatgtccctgactgacagctttgaggagagcagtggttctcccagcatgcagctggagatctgagaatgggcagactgcctcctcaagtgggtccctgacccctgacccccgagcagcctaacagggaggcaccccccagtaggggcagactgacacctcacacggctgggtacttctctgagacaatacttccagaggaactatcagacagcagcattcacagatcacgaaaatccatggttctgcagacaccactgctgatacccacacaaacagggtctggagtggacctctagcaactccaacagacctgcagctgagggtcctgtctgttagaaggaaaactaaaaaacagaaaggacatccacaccaaaaacccatctgtacatcaccatcatcaaagaccaaaagtagataaaaccacaaagatggggaaaaaacaagagcaaaaaaactggaaactctaaaaagcagagcgcctctcctcctccaaaggaacgcagctcctcaccagcaatggaacaaagctggacagagaatgactttgacaagttgagagaagaagtcttcatatgatccaaccactccgagctacaggaggaaattcaaaccaaaggcaaagaagttgaaaactttgaaaaaaatttagacaaatgtataactagaataaccaatacagagaagtgcttaaaggagctgatggagttcaaagccaaggctcgagaactacgtgaagaatgcagaggcctcaggagccaatgtgatcaactggaagaaagggtgtcagtgatggaagatgaaatgaatgaaatgaagtgagaagggaagtttagagaaagaagaataaaaagaaatgaacaaagcctccaagaaatatgggactatgtgaaaagaccaaatctgcatgtttggtgtacctgaaggtgacggggagaatggaaccaagttggaaaacactctgcaggatattatccaggagaacttccacaatctagcaaggcaggccaacattcagattcaggaaatacagagaacgccacaaagatactcctcaagaagagcaactccaagacacataattgtcagattcaccaaagttgaaatgaaggaaaaaatgttaagggcagccagacagaaaggtcgggttacccacaaagggaagcccatcagactaacagctgatctctcggcagaaatactacaagccagaagagactgggggccaatattcaacattcttaaagaaaagaattttcaacccagaatttcatatccagccaaacaaactaagcttcataagtgaaggagaaataaaatcctttacagacaagcaaatgctgagagattttgtcaccaccaggctgccctaaaagagctcctgaaggaagcactgaacatggaaaggaacaaccggtaccagccgctgcaaaatcatgccaaaatgtaaagaccatcgaaactaggaagaaattgcatcaactaacaagcaaaataaccagctaacatcataatgacaggatcaaattcacacataacaatattaactataaatgtaaatggactaaattatccaattaaaagacacagactggcaaactggataaagagtcaagacccatcagtgtgctgtattcaggaaacccatctcacatacagagacacacataggctcaaaataaagggatggaggaagatctaccaagcaaatggaaaacaaaaaaaggcaagggttgcaatcctactctctgataaaacagactttaaaccaacaaagatcaaaagagacaaagaagcccattacataatggtaaagggatcaattcaacaagaagagctaactatcctaaatatatatgcacccaatacaggagcacccagattcataaagcaagtcctgagcgacctacaaagagacttagactcccacacaataataatgggagactttaacaccccactgtcaacattagacagatcaacgagacagaaagttaacaaggatacccaggaattgaactcagctctgcagcaagcggacctaatagacatctacagaactctccaactcaaatcaacagaatatacattcttttcagcaccacaccacacctgttctaaaattgaccacatagttggaagtaaagctctcctcaacaaacgtaaaagaagagaaattataacaaactgtctctcagaccacagtgcaatcaaagtagaactcaggattaagaaactcactcaaaaccgctcaactacatggaaactgaacaacctgttcctgaatgactactgggtacataatgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacacaataaaaaatgataaaggggatatcatcactgatcccacagaaatacaaactaccatcagagaatactataaacacctctatgcaaataaactagaaaatctagaagaaatggataaattcctcgacacatacactctcccaagactaaacgaaacgaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcctcaataaaatactggcaaactgaatccagcagcacaacaaaaagcttatccaccatgagcaggtgggcttcatccctgggatgcaaggctggttcaatatacgcaaatcaataaatgtaatccagcatataaacagaaccaaagacaaaaaccatacgattatctcaatagatgcagaaaaggcctttgacaaaattcaacaacccttcatgctaaaaactctcaataaatcaggtattgatgggacatatctcaaaataataagagctatctatgacaaacccacagcaaatatcatactgaatgggcaaaaaccggaagcattccctttgaaaactggcacaagacagggatgccctctctcaccactcctattcaacatagtgttggaagttctggccagggcaattaggcaggaggaggaaataaagggtattcaattaggaaaagaggaagtcaaattgttcctgtttgcagatgacatgattgtatatctagaaaaccccattgcctcagcccaaaatctccttaagctgataagcaacttcagcaaagtctcaggatacaaaatcaatgtacaaaaatcacaagcattcttatacaccaatgacagacaaacagagagccaaatcatgagtgaactcccattcacaactgcttcaaagagaagaaaatacctaggaatccaacttacaagggacgtgaaggacctcttcaaggagaactacaaaccactgctcaatgaaataaaagaggatacaaacaaatggaagaacattccatgctcatgagtaggaagaatcaatagcatgaaaatggccatactgcccaaggtaatttatagattcaatgtcatccccatcaagctaccaatgtctttcttcacggaattggaaaaaactactttaaagttcatatggaaccaaaaaagagcccgcatcgccaagtcaatcctaagccaaaagaacaaagttggaggcatcatgctacctgacttcaaactatactacaaggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatttaataaatggtgctgggaaaactggctagccataggtagaaagctgaaactggatccctttcttacaccttatacaaaaatcaattcaagatggattaaagacttaaacattagacctaaaaccataccatatgaggcactattcgcaatagcaaagacttggaaccaaccaaaatgtccaacaatgatagactggattaagaaattgtggcacatatacaccatggaataccatgcagccgtaaaaaaatgatgagttcatgtcctttgtagggacatggatgaaattggaaatcatcattctcagtaaactatcacaaggacaaaaaaccaaacaccacgtgttctcactcatagatgggaattgaacaatgagaacacatggacgcaggaaggggaacatcacactctggggactgttgtggggtggggggaggggggaggggtagccttaggagatatacctaatgctaaatgatgagttaatgggtgcagcacaccagcatggcacatgtatacatatgtaactaacctgcacattgtgctcatgtaccctaaaacttaaagtataataataataaaaaacaaaacaaaacattacatttgcatcattaatgaaaatattaacatagtgaaaaagaaaaagagcaacttagtattacagtaatatagtttcgaccttgcagactccctggaaggatctcagggatcaccaggagtctgtgaagcaccctttgagcattgtggttctagattcaaaatgtggccttggctgagcacggtggctcatgcctgtaatcccagcacttcgggaggccaaggcaggcggatcacctgaggtcaggagttcgagaccaacattgcaaaaccctgtctttactaaaaatacaaacaaattagccaggtgtggtggtgcatgcctgtaatcccagctactcgggaggctgaggcaggagaatcacttgaacccaggaggcagagtttgcagtttagctgagatcacaccgctacactccagcctgggcaacagagtaagactgtctcaataaaacttacacacacacactcacacacacacacatgcaaaaaacccttagtttaaaacacaaacacatcgtacagctgcacaaaaatattttctttctttatatcctttttctataagcttttttatatttttaaatatttgtattatttttttaaacttttttttgttaaaaactaagaaaaacacaaacattaggttaagcctacacccggatggtatcatcaatatcactgcctcccacctccacatctcatccaactggcaggtcttcaggggcagtaacaggcatgaagttcttacctccaatgaaaacaatgccttcttctgaatacctcctggagttcttgcctgagactgttttatagttaactgttctttaataagtagaagtacatgctaaaataatgataaaaagcacagtagatagttcataaaccagtaacagtcatttgttatcattatcaagtattatgtactgtatgtaattgtatgtgctatacagctggcagcacagtagatttgtttacaccagcatcaccacaagcacgtgagtaattcgtgacgctatgatattagcacactacaatgtcactaggcaataggaactttttagctccattataatcttaagggaccaccctcatatctgcagtctgtcattgaccagaccattgttaagtggcacatgactgtatatacaatggaatactattcagcatttagaaagaaggaaatcttgccatctgcaacacgaatgaacctggggaatgttatgctaagttaaataagccaaacatagaaagacaaatactgcatgatctcacttatatgtagaatctaaaaaagttaaattcatagaagcaggtagtagaaggttggttgccaggggctgtggtgtgggagaggaaaaaaatggggaggtgttggtcaaagggtacaaagtttgagttaagcaagataagtaagttttggagatctattatacagcataataactatagttaataataatttatacttgaaaattggtaagaggttagatcttaaattgctaagagagtagcatttaagatctactctcaccacaaaaatttatgagatgatggatatgttaattagcttgatttcatcatttagcaatgtatacatatatcaaaacatcactttttaccctgtaaatatacacaagttttatttgtcaactataccttaataaaggtggggtgaaaatgcatattcctgaaacccatcatgggcctactcaaacagagtatctgaggaggaggcagggctacccgagcagcagcgcaggttgtacactgcacaccttgcacaaaggtatacagttagcgaagatttgagcttgaagtttgccttttaaagaaattgcatatgtgaatcttggttatagtagaactttaagtgttctagagcagttgttcttcaactttatgtgcatcagaattacctgtcttggggttgaaaacacaaatttctttgtgccatgcttgaactacctaattagaaacctgagcatctgtattttcaaggaactacttagccaactctgccacctaccaaaatgtgacagccatttttctagactaaaaatggtatagctgtctacaagaaatcaactcaacaaaagctgaagacaacacacacacggcttaggatactcaggcatcatttggacagagtctattcaacagctataaatttgttgtttaaaatagccaatgttttttaaaatgcaactttccatagttttctgttgttatatttgttttcattctgtcagtatggtattggatctcaaccttgtatgttatttcaccaacatcttgaaatttatttagccatattttcatggttttatatgaatgcttactaaacatagtctgattttttaaaaggttttatcttatgcaagattcttcaagagaaaagacaaacttagtttactgtcaaattaccaaactgactcagatttttaaaaaccattcgaagtttcatgttatgcacttaacataaaaaaatgactcaatgtaaatgtcatgtctcgtaatgatcctattcctgggatctttcacatgaaacagagtgggcaggaacattctatggctgccaaaatggaattaaacacatggaaacaaagaaacaaaagcacaactcaccccttccagacaacaggaaaacatgtagataaatcagtgattttccttccagctaaccaatgaagtagagacatgtattttaacaattgtaagggcactgggcttaaggaaaggcaaagtaaaaactaggttataatgttcttctagatgcgaaaatgccaaatctgccagtcactcatgaaaagaacacagccccaggcaactgatattgatacattcaaagattatagttatgtatgattacagaatagcatttcataaactctatcagacagaacaactctttaatggaatgttaagagttgggagagagagaaaagttggtcattctaaggtccaattaatttgaaaactcatgagttatatagaattaaacaaatttttttgactgtggaacttctcagagcccttctgtactaatgtgcattacacctctccaagaagaaaaaagcatgcagcatttttcaaacttttgatactttgatgcttttttatttagcttctgactgggctagagttctctgggacacacccagggaaatattgatacagacaggtcaaacaattaaggcaaatgctcaggcatatacctgaactgtggtagaacaatctagatgccacagaaatggtgaaggcatgcccaacagccagccccactatatcaagtcccttagcctctctccattggccttagctctgaaagaaagatgatgcttattagtaaagtgccttgggatggttgggcaagaaacactaaataagaacaaattattaccctcattacagggtagatgatctaataaaccatctctattacttacaaagtttggaggcctgctatttttttccttttaactacactccaatttgaccttaaaaatctatgctaaaaataacttataggaaatatcccaaaaccataccataaactttcttatcggacctctgtctgtttgcacattctcaatgactgccaatcacctacaggtaaatgcaaatttcttagcctgctgtataactctccatctttcaggagctgtagagtttatgattaagatcatggtctttgtagggagacagacaaggttcacatgcaggctccactctactacatctgaagttatttctcttctctaagccctagattatcaaagtatggtccatgaactggcagcgtcagcagcatttggggcttcctagaagggcagaaattcaggctccattgaaaacctactgaatcagaatctacatttcaacaagagcctcacactgtagtttgagaagaactacacaaattctcatacgctttgaccagctcctctgcaaattggaggtaataatagtaaacttggagatggcattcatcgtctactcctttgaatccatcctcaagtcctaaggtccacgcaaatatccttacctgtctctttcccttcattaccttagtccaagctgttctcatttctctccagatctcctgcaatggccactcaactcattacaatgcatctcctcttgcttccttctattctgtttcacttactgcaaccagagagatctcccaggaaaagcaaatgtgatcagagcttccatgagctctcaaaataaaggccaaaagcctttcacagaactacaacctctgttgagggggtcgcttcccacctctatatcttatcttgcatgatgctccacctggtttcctctgctccagaagcactggtaaattcttttttccactccttgaactagccatcctccttcccgatacagaatatttgcaaaaccatcctcctggtcatcagtgccttcccctcaactctttacctggttaactccttctcaatctttagatgtcagctcaaatgtcatctcccctgaaagctttccctgaacctcctacccagcagccaaacacactgcctgacctgttgcctgtgccccataaatatttgttgaataaatgaaggaattaatgaatgttcattcatatggttattgtgacaatcaaatggattgaaacctgtaaatcatttagcacagtgcctggtagagagcaagagcttacttaatgcagtaccaatggtaatatattttgaatattagtcttgctaaaaactagaccccaagcagtacttaacaggggctaacaattagaatcacctgggaaatgttacacttctcaatgtccaggctctgctgcagaccaattaagtcagaatctctaggtggtgggacccatgcacctgaggattttaaaactctacaggagattctaacgtacagccaaagtgtgactgctttactcgttgtctcactgtggtctcccagccttccagagaatagcatactgggcgtcaagaagagtcctcattaatcatggcatgagtctgtggcccacagaaaggggcagtaatatgaatacatgtagtaaaaatctagcaattcatttcccctggctccttgacagcagccagatggtggaaactctccatctattacccaagccagaagaaaacctttctgggaaaatccaagttgcctgaactactgttgggaggaagtatggtaacacgtgaagatgactctggtcctttgggttaagtgatgacttaacaaaattcatcaggattccattataaatctgtcataattgttttgttgaagcaattgctttgtgggagcaattaattcctactgctaaaaaaaaaggtgagaactcctgagtgttccatcaggcaccaagaaataggtgagccgggaagcatttgcccttaccttctgtcttcttcactactcaagtatttggagtgtcaagagaccacactgtacttcaaaggcctcctcttccaaataaccaaccttctgctatgtaaaaacatgattaagaacacacatatttgtactgtatgtctcactcattttgaacttttcaaaatgtgatattgccaaagaagctttatctcttttaagggtttcacacacacacacatacactgccttggtttgaaaaacaacatagaatgcaggcctcatacaatttgagaaccatttacaattataacctaccaagtcagagctgataccaagccaacacaaaggcctcagaattgttataaaaggaacagaattgctctctggaaataatatcccagtgggctaaattccccctccccctgttcctccaaggtggtaaattgcaacaacaacaaaaaagcatgattcatgaatataaatttttcttggcttttaaaatcatacactggcatagtcctccccgaacttcagccaaatgagaatacacagataatgacaattttacaataagtggttccaggacacaggcttttcaagatccacaaatgaaaggcactataaaaaagagtattattattattattatttcaagcacccagaaaaaccacaatcaatgattagccataacaattaaactaacaatagtacatctggaatcagctccatggtaatatgtacttcatgcttaatagttcaaattaattcaatctgatggtgttagacataccagttaggagctggagagcaccaaaattcacattagcttccacttcaaaagatattatgaaaagagaaggaaggaaatgaggctataaacagcagtggtaaatacgaaaggctcagagatgatatggtcaggaataactctcagctattaggaattcagtgatgaaaatatgaaggctgatatttctatccttgcacattcctccagagtcaatgactgagccacccatctgagcgacagaactgaaaccctaaaatcagggcaattatattcaaagaagagggggccttcttcattctgcttacagcatcctttactagtagcccatttatattgcagaatgcatggagaatttctcattttcaggttatagacttcaagtaataagaaaagagagcaggagttggggcaggcataaaaggtgaggtagttattgcctgattaccttatttgtctcactcctccttgaagattcactagataactgtcttaagctgcactataaatattctctaaggcaggatttctcaaccttggcactgtagacactttggcctaggtcattctttgctgtgaagtgctatcctgtgcactgtaggatgtttagaaacatccctagtctccaccttgtagatgctagtagcatcccccacccccagttgtgacaacaaaatgtcttcagacatggccgtatgtcctcttgggggaaaaatcatactggttgaaaactgttaccttaaatcttttttttttttttttttttttttagatggagtcttgctctgttgaccaggctggaatgcagtggaatgcagtggcgcgatctcggctcattgccacctctgcttccaggattcaaatgattctcctgcctcagcctcccaagtaactgagattacaggcaggagccgccacatccagcgaattttttgtagttttagtagagactgggtttcaccacattggcgctggtctcgaactcctgacctcaagtgatttgcccgcctcggcctcccaaagtgctgggattacaggcatgaaccaccgttcctggcctactttaagtcttaattcacttgtttctgggcatcgggaggaaaatccagagggcagactcccctctagactcttcttcctcagagatgagcatggattgtattgccagctgtgtgcaaggcagcactcttcccacggcatgctgaatcctcctcctaacaccttttgcacatataggcttgttgcatataatacagaaatttggaacctggcagtcttctattcattgtgcagaaaagagttaacacagagcaggctcgagaaggcctatccttagaaggcctgtttgcaatgttggcctttggttagcagctgggaattggagctggtaaacagttccctacactaatatgacatttttcctaaattatagagtggccactatgcctcacctgtttgtacaaacagtgtggtttatgctgaacacctgctttccttctgggagtctggaatttgggtatgtgctaggcagatcagctcccagcagtagccttgggcactgagtctctaatgagtgccctagtaggcaacacttcaaacttgttgtcgcagcttgttgcttaaggaactaagagcatcctgtgtgactgcattggaagaggactcttggacgcttactcctgatttctccagactgcacaccatgcaccttttccctatgttgattttactttgtgttctttcactgtagcaaatcagaaccagaagataacaatgctgagtcctaggagtcctcctagagatttacagaaccttgcaagtggtcttggggaccaccaatgcagggactcattcagcattctatttgtgtgcctctatttctagatacagcaaagacttaaactccaagtcctcacagaatttatgtggtagcagcgagcaaagcattaattctagcatatttcaagcttctttcatagaaaacaagccctgtggcatctcttttttgtttttataacagctttttagagatataattcacatatcatactgttaatcaatctaatgtgtacaattcaagatttatattcatagagtcgtgcaaccacgaccacaatcaattttaggacattttcatcaccccacaaagaaaccctatatccatttacagtcactacccattttctcccaaccacccagctaggcaaccactagagtttctgccgctatggatttacctatttttgacacttcacaattggtcatatgatatgtggtcttttgtgagtggcttctttcacttaccaaaatgttttcaaggttcctccatgatgtaacatgtatcagcactacatttatttttattgctgaataatatttcattgcatggatataccacatttcatttatccattcatcagtaaatggaactttgtattgtttctactttttggctactatgaatagtgctactatgaacatttgcatacaatttttttatgcacatatgatttcattccccttgaatagctacctaagtgtggaatttctgggtcatacatatgtttaacttttaggacattttcaaactgttttccaaagtagctgcaccatttacttaccaatggcagtgtaacagagttctaatttctccacatccttgctaatagttactattaactgtctgttttttttttttgttttttttttttttgagacagcctgtcacccaggctggagtgcagtgatgcaatcttgactcactgcaaccaccacctcccaggttcaagcagttctgctgccttagcctcatgagtagctgggattacaggcacgccccaccatgcctggctaatttttgtcattttagttgagatggggtttcaccatgttggccaggctggtctcaaactcctggcctcaagtgatcttcccgcctcagcctcccaaagtgctgggattacaggcatgagccaacgcgcccaaacttatctgtctttttgctaataaccgtcttagtgggtgtgatgtggtatctcgtaatggttttgatttgcacttccctgatggctaatgatgttgagcatcttttcatgggcttattagccatttgcatatcttctttggagaaatgtctattcagacctatttgccccattttaactgggctatttgtctttttattattgatttgtaagaattctttttatattcatattctatctccaagtttcttatcagatatatgatttgcaaaacacttcttccattttgtgggttagttttattatttcaatcatgtcctttaaagcataaaagttttaatttttaggatgtccaatttatccatttttttcttgcattactgtgcttttggcaccgtagctaagaaaccattgcctaacacaaggtcatgaagatttatccctatggttttgtctaataatgttatagttttagcttttccatttaggactttgatactttaaggtaatttttgtatacagtgtgaggtagggggtccaactttattcttttgtgtgtggatatccagttgtctatggcatcttttgcatcactccaagacatagtttcaggtaatttttgtctatacaaattaaggtaacaggtaccaaaacacagaacctatgtatgtgacaaactgcctgaaagcctttataaaaacttttgcaattggtgttctttttttctattttcagaatatgctcagtattttgctatatcaggaagcagtaccaccattattaccactggtgctactgctgctaataataatagtaactagcagatattttgtacttagtatgtgccagacactacacttgcatttaacattcattaacttttaagcactacacatgctttaacttacatgatcttcctgccaacaccacgagataggtagaatcattatcttcattttacagatgatgatattaaggctcactgatgtaaaaaaattttccttaggtcatagaacaagcaggaaaaccgatttaaaaaaattgagggaaggaatggcactggaaagtggaggtcaagtaatgtcggatagcaaattctaacaaacagtagctaagcacgtatgcgaaatatacaaaaataaacaagccaaaatctagcactggtagatgacattcccagttctgatcaagttgctgacaacaaaggattggtctccccttctaactcaacaaagggtaggaaatcttatcactcaagatatcaatcaagatttatttgatcgctgaaagggttttgtcaacactccaaaaattgtattagtgactagatgattgatggaataagtcaattagaaccagattagaaatcgagatatgaagtcaattacttccaatctgaaaattaggaatcattaaacaataatataatagatggcatcaattttcaaaactacccttcgtgtgtttgtctatagggcaaaattcaagtaaaaaataactttgaaaagactaaaactatagagcaacttgatcttgggagtgttttcccagatgggtagtgggctgagtctggtcagttttcagtggagaaaatgtagacgagataagcagttgatgttcccaaattcaaataactttatggcagaaaagtcagtcaagtttaattctctttccctatactagctgtgtccttaatgataaatacaataataatagctgacatgtattgagtcttacattatatagctctctaggtacctaaaagatgacaactaatttatttaaaccaaggcatatgaagtaagtactattattattcccattttatataagaggaaaaggatgtgtaaagtgctaattgacctgcttaagaggtagagtgagaccttgaaccctgtagtctatgtttgtcctcctaatagtgtctctatatggtttcagaatagaagcaaatagacacataagggttaagcatggctaacctaactccaagttgagtctttttacactaggcaatgctgtcttcaatatatttataataactttatacaccaaataacattttgaagtttatttcctcccaatacagaaacatcactgcatttccactgggattttcagtactgtctgttgtggaactgatctgggcttagtgagtattgctttatcattcttaaataaaaaccattatagagaatgcagaaaacaatttccctttcagtttgcccacttctacccataccgagaaagacggatccttaaagctcagaatgtaataaaagctcacaatataataaaagctcagtatcagaaatgttccaagtccctccactctttctctatagttaggaaactaaaatttaatatagggcacaacgctccagagaattcagtgtatcgaaatgttaatacacttttatatattttaactgagataaacaagaaagagatagggaagccagagcagctatggcaaagacataattatgataagactaatccagctaacagcaatagaagcagatagtgactccactgtgatgctgtggtagagtttgtatggtcagaaaactatatcagtatacaatgttaatgacgcaggagccccattataggaaagcaaagataacttactatgtgactctataaagtaaagttcatccaaaagatcaaagagcatttgtcctattactaaaatattatccaaatgtattttatcaattaaaacttggataaaatcatttgcttcattgaacagtaatttaaaaggagcataggctgggcactgtggctcacgcctgtgatcccagcactttcggaggccgaggcgggcggatcacaaggtcaggagatagagaccatcctggctaacatggtgaaaccccatctctactaaaaaatacaaaaaattagctgggcatggtggcgggtgcctgcggtcccagctaatcgggaggctgaggcaggagaatggcgtgaacccgggaggcagagcttgcagtgagccgagatcacgccaccgcactccagcctgggcgacagggcgagactccgtctcaaaaataaataaataaaataaaaggagcatagtatgtccataaccaaataggaaggaaaatgcctattttgattttcataacagagcttaaacattgtggcaaaactttaaaatgcaggacataatgtaaaaattcttctaccagctctaaattcgtggttgtgctatcaactatgtcacatttctcagtgttgaccacaaaaataccatgagatacatacacattgctgaaatacactatttctcaaactcaactttatcttctactccaataaccctgtcaaaaggaaaactagtctggttacttcatttctggcagatccacattaactcctttcttttaatgctcattaatctttctgttaacaatacttctgaccctcaatacccaccctttcagacaggtcaaaactaaattcttcagtttaccatttaagcctttccttcaagtttttgcaggtaaaatgagataaaaacagacgtttgtattccagccagattgaaattttctactaccctctttgctcttcccattaaattctacctcgcagtttgtttgtttttgttttattttgttttgcgtcgtttttttaaaaaaaattgtttattgtttatttactaaatctggggcatattagatacttgaccaatttaaaatttacatcttttaaatcaattttgaagtgttttcacacacacatacacacacacacacacacacacacacaattggcatgcaacagttgtcctaaggtgaaacaatcacctcatcaacaaagtgtcataggtgttctcacccaaggttgcttatcctaaacctgaaaacctgtaacaaatttaaattacttatataaaactcattacttgtagttttccccttgcaaagatctccagaaatgtacaaataactaatatacatcagtcacaacataatcctggatcatccccacatcaaaaccagatgctcctttaattttaaactcattatcagagagcaagagaaagtcatttcgttttacacaaaacaaaattcacatatgccaaaaaagaaagacccaagagaaacaaaaacaaaaaccctagtgctgacactgatgttcagtgccctggttaaacagtggcccgaaggccacggatcaaaaataaaatagcggctgtatatcactgcaatgaagtttaacaggctttaaccttctggcttcagaaatccagatttttccaattacatgaatgcatacttcctacattccaagagtggagaaagtggatgcgccagtgtggaaatgaaaagagccaccattcactgggacaaccacagaactggctttaacagagactccttagaaagttacgcaaaaaataaagacaaaaaatggttgtatgcggcttgtgtcatcaattttaagtggaggtgactgagtcctaaggtacaatgtaaaatgtatgggggaaaataggtgctggggcaagtcttacctttaaaagcaaaacttgaaaacaaagtataaaagtgcccagcctggcagcatacacccaagccagagagctctgccatgagcatgcatagaaaatgtcaggattcatactattgtttctcataaggactcaacaaaatgaatccttaatagcttaaaccacagaatgagggaatacacagaatgcagtcatttcagtaaagtactatcaggctttgtgctgatttcctgaactaactgcattttattatcaaaacaaaaggaaaagaagattttaaaaatatatatatatatatattcctatatttcaattccagtgtttaatttctggaaggacctatataatggaggcagcatttaattaggaaattatgccaatcaattgtcaaattttcactatgactttcctaaaaaggtgttttcttccaatttctattaatcacaaagaaacataagctgtgactgtatagttcagaaaattaaaacatagaaattaatggcctatgacgttatcaccaaggtgtttggtaaacagtaaactatgagtttggaatcatcaggaagaggcttttgaaacaaccctctggacttcaaaaaatctcttcaggtagtagatgtgtcccaatgtcatggcaattagaacaagagcttcaaagaagcaccgaaggaccactgggctgtttgtgttgtcactaatggctctgtgtatcctctcccagattttcgtgtattcctctttgtgctgtacagctgtcatggccacagccagctcactgatcatttcttctagtttgttctggtgagcttctgtttccatgtcttctctttttgtagcctccccaatatcaatggtgaatatcactatctttggagtcatggtggacactcggtcactaaaacaaaatgtatttgttccatccatgtgagcagaaaatgtgtatttcccactggattctttgtctcctttataaatccttttattcttaggtcctgtaatctccatgttgatgcccaggaagccaccttcgaagatgaggcccatcttggtgcctgaggtgactcacttaagcattcttcagcatgtgcgtggatgctgatgaaatagcccaagaccatggtcaggagagtgttctggagcaacagcagctcagcgagcgtcaccacagtggggctggagcagaggccaggactcgcactgcggcctccagagccactgccgccatcaccaccctactgccttcgcctacctggcactttttgctaatcctaggaaaaacgcaaactcaaatgccttttgtgctgggaggtactgtaaataaatgaacagagaagtctagtgttaagaaaaataagacaggccaagtgcagtggctcacgcctgtaatcctagcactttgggaggctgaggcaggtggatcacgaggtcaggagatagagaccatccaggctaacacagtgaaacccagtctctaataaaaatacaaaaaaaaaaaaaaaaaaaaattagcccagcgtggtggcacgcgcccgtaatcccagctacttgcgaggctgaggcaggagaattgcttgaacttggcaggcgaaggttgcagtgagccagggtctcgccactacactccagcctgggtgatagagcgagactctgtctcaaaaataaataaataaataaaaataaaaaataaaaataagacagcagtacgttactggccgaacatatctgagtcatgcgtcatcaaagaatgttaccagcagtgaatctgtatgggtctgcagcaacctcagttcttacctcttcagaagaaagagttcaaccaaggggcataaggcagaaggagacaccaaagcaagttttagagcaggagtgaaagtttattagaaagctttagagctggaatgaaaggaagtaaagtacacttggaggagggccaagtgagtgacttgagagatcgagtgcatggtttgaccttttgacttggggtttcatatattggcatacttccagggtcttgcctcccttctcccctgagtcttcccatggagtgggctgttcacgtgctgggtggcctgcatgcacagtgtgtttactgcagtggtatgcatacccacttgaggcatgcttcccttacctatcaagcgtccctataaggtcatacaccagttaaactccaccattttgcctcttagtgcacatacttgatcccacgcacccacctcctgagatcttattaggaagctgctgatcaccggttttaggtttcttctgtctgttgggagactattgttccctggtgccagctgcaaccaattattatttgagagaaccatcttaacaactgcctgaccatcacctgatggtcgcctgacattcctggtgggatgtggggtgtccctttactgccccaactcatatctgactagctgactagctacctactgtaacaattacacttgattgcatttttttgttgttatttaatttttatttcataatcataaacttaactctgcaatccagctagggaacaaggaaaacatggaacccaaagggaattgcagcgacaatacaaagattctaggatactgcgagcaaatggggtggaggggtagtctcctgagctacagaaggaatggtctggtggttaagagaaaacacaagtcaaacttagtagagctgtccacagtcagcaatggtgatcttcttgctggccttatcattcctggacccaaagtgttccatggcctccatgatattcatgccttcaccatgccaaagaccacatgcttgccatccaaccactgagtcttggcagggcacatgaaaaactgggaaccatttgtgttgggtccagcatttgccatgggcaagatgccagtacctctatgcttcaggatgaagttctcctcatcaaatttctacctgtagatggacttgccaccagtgccatatggcatgtgaagtcaccaccctgacatataaaccctgtaataattctgtgaaagcaggaaccctcacacccaaatcctttctttccagcgctcagagcacgaaagttttctgctgtctttggaacctcgtctgcaaacagctcgaaggagacgcggcccaagggctccgtgtcaatggcaatgtggaagtacacggtggggttgaccatggctgatagtagggtgctcccggcagtggcagcgtctgcaaagactgcttttttttttttttttttttttgacaaagtctcgctctgtcacccaggctggagtgcagcggcacaatctcggctcactgcaatctccaccttccgggttcaagtgattctcctgcctcagtctccggagtagctgggactacagatgcgagctaccacacctggctaatttcttttgtatttttagtagaggcggggttttgccatgttggccaggtctcaaactcctgacctcaggtgatcggcccacctcggcatcccaaagtgctgggattacaggcgtgagccaccacgcctggcctgattgcatatgaaatgcactatttccccatcctatctcacccccatctttttttaacaaagacttctgaaaatgtatttttcatctttcaaactttgctggacaagtttttatgaatagtctcaacagtgcaagcatgatgctagagagcaattaacctttgacttcagtgttgggagactgcagggagaggtgaagactgcgacaaaccactcgtgtatcatggcaatcgctactccctctcagccatttcttgccaactaggaattcaggcagaatgttgtcagatctttcagttattacagaaaagtaagaaaacctgcattttatgtgaaacttccagattttctagtattttctaatttttgcttgaaatcttttattgttccaatatattttatttctatattcctgtgtagcacacatctggttttttatttgtgtggtttttgttttgttttgttttgttttgtttttaggccagtgagctgacagatcgagacctctgggttatgtcattccttggtcagtagctttcagtctttttcaccactacacccacctcaaccaaccatcctttccaccaaccgatgcccatcacttcctttcagatgttgctgaagaaactatttctccatataattttccctagatcactctatccttcattcctcattaccaaactgttttactcttttagcctttagtatgtatgctctgtggtccattggtgagccctttatctttctctaattacacctggactatagatttctaatgccgaggacccttggtctcctgccacattcacattcccttagcagaatgttgcacacccagcagacagtacatgtatactgtgagtaaatattttgtattcctagtcttgctaggatagaagtttttattctatacttgatgcatttctggatcaaaatattaagtctaagtcaagtctccatagttaaggtaatcttgaggattaaaacacttaggtggacaggcaacataaaacactttatctgaataatgaaagaagaatccgtctgttggtctgaagtatcaaagcaactgtcccaatcctacaaactttcagcattgggacttcctttcaagatgtaagcagggatggaaaatatacaatgcaagcgccattgtttcactctcctgggcctgtgacagacatcattaagtgatcacaacgttcttttcttctaaggctgaatgcagtcttagaaaccattttaacatggtatcctagatgtatcgtgtccatcttgtttatttctattaagaaatagagttggcatgagagctgaagatcctatcatatgaaggtacacatacaatttattattcaaaagccagagaacaacatacaactgctgctgcatctcagtctctctatattttaatttatttattgttttgagacagggtcttgctttgtgcaggagtgcaggctggagtgcagtgataccaacacagcttactgcaacctttgccacccaggctcagaaggtcctcccacctcagcccccaagaagctgggaccacaggcatggcaccaccggcatcccgccatgttaccaaggtctcaaacttctgagctcaagcaatccactcatcttggcctcccaaagtcctgggattacaggggtgagccatcccacctggcctcaatctctgtatattttagaggatagataacttcgaatgggaaaagttgtctctaaagttgaccagtcaagaagaaacaatgcttccactttaatgcctatgccagacttaccttacccattaacttttaatcctgtaagaaagatttgctatgtgatgaggctgcttttgttgcaccttgtaaaacatactgaaataaacaaactgtaaatgactttgcagggattgctgatttaaataaataaattgttataattgtagttacagttatagtcaaggggctatttcatttctcagactctgaaccaaagcaattaggaacaactcagacacaaaatgaccagcatcaagaattacaatgaaaagccaattacctttaactataagaaaccttatttgcatttattaaaacaaatgatctctcagtactggagaaaattatgtggattggttgattaacccttcacttgtaagagaccagaaattacttttcagagagcctgtatcttttctaaatttacagacaggaaaccagtaaatgataaatgatcaaggcccaaggaaaaaactgcatagcacaatggacatctatgagtttcacttgtgctagcatgcattcctcattgtgctggtaccatcatcctcactttcctctggggaatccccttctccagttctgactccagatggtgtagatggagctaacttcactccccactgagaatgagcaaatgaccaatcaatgtatttcaccgatgaatgattcagggagccaatcattaattcgagtcagtccagtactactcaatgctaagatttgagaactactgaaggaactattgtgaaagggaagaatttaaaaaaaatcttgctggcattctgagctggtaagataaaaactttgagcgtctagcggccatctaaccactacaaagtgagaccatgcctatgcgtgagaccaacccaatggaaagaaaactaagagatgatagagacatatttctgatgccatctttgagaagctgcatccaatcattctggaggcaaaaagctcttaactttatagataggcaagccaaaatcttcttactttcattaagccacagttagagctaggtttctgtcatttgtaaataaagaagttaagactaaatgcaaatcacttatagcttattttattactaggtactcaatgtctatgcttttgcatagctaagtgagagaacttaaattccaatactgatgggctattacctcatgcaggtaccctaataaatcttgtttcctctcagtgccattgtttcctcatttctaaaatggagattaaaatggtagctcacaaagaagaaatacaaatggcctataatcacatgaaaaaactgttgaacatcattagtcaagaaggaaatgcaaatcagctctacaatgataccacttcacactcactagaatggctatgatcaaaaagatagacaataacaagtgttttctaggctgtggagaaatttgaagtctcatattggcaagtgggattataaaatggtgcttcaaaaagcatctggcagttccttaaaaagttaaacatagagttaccgtgtgacccagcaagtctactcctaggtatatacctctgaggaaataaatatacaagtacacacacacatacaaattaaaaagtccataaccacattattcttaacagccaaaatgtgggaaaaaaaaccttaaatttccatttactaatgaatggataaacaaaatgtgtcatatccacacaatgggcattatttggcaataaaaagaaatgaagttctgttacatctcacaacatggatgagccttgaaaacattatgctatgtgagaaaagctagtcacaaagaccacatatcatatgattccatttatgtgaaatgtccagaataggtaaattcacagagatagcaagtagattggcagtcaccaggacataggaggagaggaaggacagtgactgttaatggctaggggtttcttttcagagtgatgaaaatgttctagaattagatagtggtaatggctactcaactttgtatttatactaaaaccaccaagtttcacattataaacggataaacattgtgctatgtgaattatttcaataagaaaaatatcttatagaaaaaaaatggtagcctattctgattctcacaaatgaccattataagaaatccatgatgataacaatattaaagtgacgttcttgttggagcctaaggaaaaacaatccatacaaatgcaaaggcctattgtttttaaggcctcagcaagtgctaagagaatgggaaaagaaaattaccaaatagattttcccagatcacttagcttcctttgtatccagcaatggtcaacaaatatatagcaggcatacataaaagctattcggagatctcttgaggttaacagcatgcaacatattgccactgcccccagcctggccaggaatattatttatgccaccctttcacagctgtatcaatctcccatgaaacattcagagcctccttgttaataaactacattatgagccggatgcattgtctggataaactgcattgtccaaaacactgccccattattacagaaaatgcagaatgtaattagtattcttctttgcataaactgcagcttccaaaaatggtgccatattataaagccttaattaataaacaagagttgggccatgaccagttacacttatctgaattttatattgtgaagaaaggccactgttcaaattccgtttacaaatatctaaattctggctagcctacatgaagatagtctaaacagaaagcctgagaattctgtgttgctaatagcattgtgttggtacaccaacaatagcaagccattaactgctgggacataaaccatcctgagaaatgttcagagtggaaggatgataacattgtatttcagctgcatcgtatggtgcaattcttctatttgttcatatgcatttcccatttaatagatggaggaaccagggtggcttttcatatctctgtgaaaccttaaatgtgggggagaaaagtgagctggcaaaaaaacaaaaaggataagtacgaggtattgtggggtgggagcagggttacatcacaatggaatgtaagtacacagttgctttctccatttccagctggtttttattgattttcccctaacctaaccccaaagcaaggccatttacataagtcatgagcattgaactaatatttgggaccataatattaagcagcccattttatgaacctcggctaaaggagcatttgcattaaactgcactcacctgattaaaatccatcaactctagcaccttgagaattgtagagtacctgttaagctcggctgtgggactctgcatactgaggcagaccataatcagaaggcagcaaggaatccgaccgggagaggaaagggaggaggagaacatgtgatgtgtgttgaaaagcagatcgcatgaaagaccgccagtgctcaaatctgaaaagagtcctaagcctactgcaaacacagagctgtgcgaacatgataattctttcagcaaagtccataatatggcttatagggccctgtgaaaacaaggtggatgagatagtattacagttcagtgaagagtaactggcccagcaatggaatgtagcatacacaggaggccccaaaatggtccctgcctcagcagaatgagcaagagctcagagagtccaagccgagggactttctgcagcctaaacaagccgtcttagatcactgccctttccatcagctccaggtaccaagcacaggctcagagtcctatctgtctcagaaggacctgctttaccgtgaccgcaaggatggcatttgaatcagtaataggctgtcagaggccaccttgatgcatttgaagaagagctatccctgagacattggttcaagttctcgatctgtaccacctagctgtgtggtcacggacaagcagtcttgctcatctgaccaagtggatgcagataataaacacatgtgaaatgaatgaatgagagaataagacctctgaagcagaatttctctccccagtgatacagacagaagacaaggaaatactgggtagaagagggaggttccctggcaaaggccccaacctcaagcctggagacctgcggcccctaagtggggcatttctgtttttgtacccaaacggttgccttttggcatgccacactcccttatcctgtacccatataaatcccggaccccaggctccaggagcagacaaggagaagaggagaaaagcagacaaatgacacaacagagaaagagagaggagaaggaatgtctgaacgccgagaggaactcagctgggggcagtcggagaagagtttggccgctgaacagccaaaactccaggggaagatcatcttcccattccatcccccagccagctccccatccatcccattgagagccacctccaccactgaataaaacccctgcatgcatccttcaagcctgtgtgtgacccaattcttctaggatgctggacaagagcttgggatacagaaagctgtcacactggccctctgcccttgcagaaaggcagagggagcactgagctggttaacacttaagctatctgtgaatggcagagctaaaagagcattgtaacactggggccacaggcacccacccctagacactaccatgggactggagcccaaagcactcactcttgctcctgcacctggccatctgtgtgctccctctcccacaaggggtttgagttcatggtggttgaacagagagccgcacccctgtcgcatgccccatgagtggggccagggaactcttctgtttcatcaacactattgacatttgaggtgggatgattctttactggggaggctgtcctgtgcattgcaggatgttcatccctggcctctacctacaagatggtagtagcacacatactccctcaattataacaaccaaaaagtctccagacattgccatatgtctctcaagagccaaaattattcccagttgagaatctctaatttatccttcagaatgtacattccaggatctaaattaatgagccatacacccagatagtgccccctaattattaggaaaacttacatagataccttcattatcactggaaattcatcaagacaaaaattttactgagcacctattatctgccatgtagaaagatactgttcctgctcctgagaagctcacaagtttaagtggaaagtggcattttacaacttcacatcaaagaaaagagaaatgttcaggtaaccatctttccaataaataatagaatatccttctatctgattagagaggtgaactgtaaagacaggcaagaatcagagcatatctctttgctattaaaagaatactacatgtatcaaagttgctgacatttgataaggtgaatttttggtaattttgactcattttagatgtttgctgcagttgtttattgctgggtgcagggagtctcagactcaaaggacaatcttatgaggtggtttagcctaagagcataagccaaaagagagagctctggaatgaaactgcctggttttaaatctagattctgccatttgcttgttacgtgacccctggcaattcattaaccccttcaatcctcaaatccttctctatgaaaaggagataatcaatgtacctacctcacggatttgttaaaagggttaaataacttatgtaaagtgctgaacacaatgcctcccacaaagcaaaaattgtaagaacaatagctgttagcattgttatattgatattgctgcctctccattttattatgatcttttttattgtagtaaaatacatgtaatataaaatgtgccatttcaatcatctttaagtctacagttcagtggcattaggtacattcatattattttgcaaccattaccatcatccatctctagaacatcttttattttccccagttgaaatttcccattcctccctccaccagggttgttctcttaaaccagtccttacccagcaaaataccttctaaggaaatgaggacaaagcttttgtaaatgagactaaaggcaattcaaactcaggtaccctggaaactgaatagaggtagtgcttaaaatggccatttgggccacttggggttatgttgatgagtttagtcaccatgaaccaactcctaggagtaacattctaagtgggtttttgttttgttttgttttttgttttgaggcaaatggttcctggctctgtggccttcccatcttaccatcacagaagcattcactctactcctctaatcaatattaacccagaaaaaaagtccagggacatatatattttggtagcctagaattaatgggaaaagacaagttgctgggtctaaactatcaaagtcacgtactttttaacagagaatgaacaaacctcctcccttcaagaatccacctgtttttgcaagagcattctggggtgggaggaaaaccttctgatttctagccagctcctcaaaatagctaaagagttcctaatttcacctcaaacctctgtttcagcacctactgtgttgtgccaagttatttctcatccactatcatttttgacagtggatctgaccctattgcaatcgagtttaaggagtttgtagacaggaaccctatctgagctgtcagcacgttgcctgatcatcttcagcaagtggtctggcagaagcatgcaggtaaggatgccctgaagcaggctgtcaagaaaactgaccaatgagaaaggtgttttgtgctccacagctgaagccaattctgctgggacatcccaagacagactccactcggactcaactgataatacacactttacatctgtcactatctgcccaggcatattgactttgtaacattccccccaggcacttcaagtccagtttcgactctgtgacttttgcctgtggtcactttgcctgaaatgccctttctccttctccttcttatccattcattaggatctagcaaaatgtacctcctttgaaaagcactttctgtagccctcaggcacaagtggggatggctgtgttggaccagaaaaagcaaccattgaaatttccaaactgaatctgtactttgatttatttcagtgtggtataatgtatggtataatatatggcaatgttttccaagtctgactgtacatcacagtgacctgggggacttttgaaaaatagattcccaggctcccctccaattaagacagcaggtcagaaggttgcaactcaggaagctttacttaatgtctagaagtttcccaggatattctgatgcatgaaccgtacttgaaacaatagtcagacattgctacttatcagctgtgtgatttggggcactctgagcttgtttcctcatctgtaaaatagcggggaagtaggggagtgtcacaaggtcttagaaaggaccacatgagggaatgagtgcaaaattcttaaatgatgcctcagtaagtgaaattatgatgctaattacaacgaatgtccttaaaaagctacttttcacttccaatagtccagcttgcaaaaccttcctctatcagagaaaaatttagtgaaagagtaaatgggcttcacaccaggatgatagcctggaaaaatcaaaagagacattgagacattgcccacatagaaagcaggggaagagcatgttcagtttttctgaaggtctatattcttcattcctactgtccatttctcctgattaaaagtctctcccaatagctgagaccattaacaaatataagcccatcaaatggtagctaccccactttgtaaaattaggcttttgtgtctctcatagaataatgttctaacacttcactacctgtaataaagtatttgcaccacaagaaaaaaatgtatttcatgaccagcaggctacaaccagcattctgcttttaggaacccatgcgtttgattgtatcctaagttggtaatgagtcaccacttttgcatttagttaaggacaccaaacaatgactctgtgaacctcagctcagactgcccctgagtcctcagaagatgcctaaatatggactgttctgtagcgcttaaggatatcaaatgacagtataccatgacaatcacaactaatcgaagtcccctgcagagtagttcctcataaagagatggagatggaaaagtaggaacgtttttcaatgctatgcagaaggaaaataatacctactgaccatattcatcctttcaaaggtctgccctgaaggcaagttgacaacacccaggcttggttctcccttttggaagagctaacgctaggagagttcacccttgctccctctggcgggaatcagcagaacagagcgggaggcactgtggcattaggattgcaaaccctggcttcggacacagtgctgcttgaatcagaatctacactgcagctgggcaactggctgaggtcacatttttaggctctgagctgctttctctatttgcaaagtgagaatacacagcttctaaggtcataatgcagatcaaattatatataaagcacttaacatgtgctcagtaaaaagtcattgatctaattattgttgtactttattgtcattaatatcaagggaatgacagcatagtgagtctcctagggatgcaggtcaatagatgttgaactgctattatgcagcaggtactgtgctaggtcctgggtaataccagagcaaacaagatcaacacaatctgcacctccaggaagcttatggtctagttcagaggtaggaaaaatgtgttttgtttggcctgcaccttgtgtataaacacaaaacatagagcaaacattttaaacttggatgacttcacaccacagtccagatttctggcttctctttgaaaacatcagaaattctgagagtaagggagatttctgtccacatgccaagccttctaagtcccaaagcaccaaccttccactggagagtggcctgctggctcttctcattaagaaaaatctccctctggctacacatgatgaggggcctggaggaattaagagagatgaggtagctgaggacacaggtccaggggaccagaactgaagcaaggaaggagaaaggagactcagcgctggttctctttcacggggtttttttgtctctcagctcagctcgctctgtttggctggacacagaaaaccctggaggagaattctgattccaacttgctctttgcacagttaattatttggagctcccagaaggttggagagaacaatgacttcccctgcagtggcagctggactagcttagttcccttttctgcccccaggggtcagaacccaaggaaggggggctatttgttttggccttaaaccaaatctgcctagagacacagagcgatgctctgacctgagaccacaaaagctactatttcaatgcctggtaaagctcctctctcttgccgtccacagcagtctactgacgaaaaacgcgttttccctatgcaaactgtttacttctctcctttgcaaattggaagtaatgtaaaaaaaaaaacaaaacaaaacaaaaaaaaaaaaaaacagaaagaaaagaaaagaaaaaaacctatatgcacaagaattccatctctccttgcaaataagatatttcacatttccttaggcagatagcatgcagacaagtaggggaactaattgggatggatcagtgaaaacaacgaaagctcatttatacacaacttgctaagtgtccacaactttgttctaataggggatccatgacaagtccctcaaaaacagagaaacaggagagaataatttacactttatagttgtgagccctgtaacagtagaacaaccttcctgcagtcccagagagattgtccccacatctaaccaaaaccattaccatcaatggtgtcctgcattttgaacagttgttaatgaagtcttgcctgacccaatacagagtgaaatgggtgtagttgctgctacaggctgccttctagccttcctgcatctgaatacattttctctgttggctgttctgatagagattcatctggaattcttaactagataaatccctcaatgacaaggtaaggcccatcttctgattaaacttgtattgaatttatttatttggccaatcatgtaatccatatttattaggtaccttttaagcaccaagcattgtgctgagtgacggggatatcaaggtgagtcaaaacaaccatagtccctgtccttagaagtccagaggggctgggtgcagtggctcacacctgtaatcccagcttttagggaggcagaggcgggaggatagcatgagcccaggagtttgagacctgccagggcaatataggaagaccccattctccacaaaaagggggaaaaaagcaagtccagagaaaaggaagctactaatcaaaagatctcacaaatataaaactgaccctctgaaaggtgtataagaagtattttggtactaggaggctctattacaaagagttcgtctagatatggggtggcagataatttgtctcagaagaaacagtacttgagctgacatttaaagccaggggaaaagcatcataggcagcgggaatcaaacactcaaaggccttgccgtgaggctgagcagtaaacataaggactgaataaagaccagtgagattggtgtggagaatgcaaggaatagagtgatgaagatggagagttggtagggaccgtgcaaggccttgtggagcacttcaaagatttccagcaacataaagctatttaaagatgtttaagcagggtataatggtggtagttgatgtgatcagatttacgctttgaaaaaatatagattagagttggcattttggggggacacagagtagatccaggtagatccaggtagaccaagtagtctagacctcctaggtcacaggtgtctaggaggggatggtaatttggacttggatggtatggcgctagaggtgatgtagccacattgacatattctaacaatagttactctggtaccaacccaatataccagagtcatccaatggcccaagagtggtactaactgtaattcctgattctgtgaagctgagtaaaaacatttagaaagaccaaactaaaaaggatctgaacgcatctgtactccctcatccccagcagcaaggtaccaccacgtactctgagtgatcatagctttatacttgaattgacaaattctgcataagactccacaggaaacccattaaataggcagggaagaaaatgctcaccattcagcattgacaagaaagatgataacaagcaagttttcagtcaaagtgggtaaaatgttgaatttctactctagtgtcattagcactgcacctgattttttaaaacaatattttggttaatcaaaactctgggtcaatcaactgttccacagtgacagctcctgtggtcatcaatctttgttatcgcttgaagctgacatggtctcggtccacaggagagtaagcagcaaaagacaaaggtttctcttcatttcccccaaagggagttaagcaatgagtcataaaagcatctaaattattcacatggctttccagaagtttatgattcaagatttgggagagataattgaaggaggtggggtgggaaacgtaacactggatgaacacatttattttgaaaatgaaaggatgagtttctgaggtagacccaattaccacacacagggcttcaggagcgacagcagcggcctatggttccgccacacaatgcttcattcattccttacatgggttcggacgatcattattaacctacagtcacctgagaaaagctcagtgtctgccaatcagtcacactggacttttgtggaaatggaaaaaggaagagagagtaagaagggagggatggagcaagggtatggagggaatgtgaggaaagcacaaggaggggccagaaggtgtcagctggtggaggagataaaatgttttctgtttctgttttacttgtagggtataagaaagagacatcagtgtgaagatatgccactgggtaggggctgagggttgtttgtatgtttgtttgttaataaacgtggcttgaattagatatatggctctccgttttagtatataagaaatacaagtaaaagagttcagctattgtgaaacttcattctcttgccaaatggagtttccttgactgtaatgctccaagactgaaccatgtacattcactatttataaaagctagacatgcatttattgaacctaccagatgtaggtactgtaaccaggcatgattaacagtagaaagaactgaaaaacccttcatgattcagccttagtttaccttactggttttatctcctgtgaattctcctttaaaactaagatcacagttctgtggttcttggaattcacaaaaaaaaaaaaaaatgctctacttcccctctgtgtatgtgagtattctctctgcactgaatgcccttcctccttcatctagcagcactgctcctctctgcctggaattgtctaattcctgccattcctcggatctgtttagacataacttcctcaggatgccatcctgaattctgagctgagtcaggtatcccttctcagggctctcactgagcttatctcaacagtagtctaggtagcattcaatcataattagatagtgtgcaagctttctgatggcagaggctaagacgttatcatgtttgtatccccagcccctagcacaccatgaaacacaaaatgcccaataaatttttgctgaataaataaaaaaatacaatacttgatacccaactccaaggcactttcagtgtagttagtaaagatagaacattttgaaacataacacagcacagggcaatatgaaagaaaataaaaaattaaataaatctgttataagcaacaaagcaggtatttagagaaggcaaagattacttttagctggggtgacaggagcaacagaatcaacgacaattcaatgtgtgttcatgacacaagtcctgtgttagttgttttcaacaacaaccctgtaacttgataatattatccccattaacaaatgtggaacccaaggttcagagaggtaagtgatttttcaaggttatataatcagcaatgccaggatttgaatgatgaatctaagatttcaaaacactgagaatggaaaggtgggtatcccaggtagagtaaaaacagaaacagaaaaaaatgtgcaagtgcatctcagtgtaatgtatgtcctggggattaaaaacaaatcaacttgatataatctattataggaatgctaaggatgctgatcctagcaagtaagctgtgactagactgctgggggccttgagtgtcatgctgaggaacttgggtgctgaggagccattagaagctttggagtagagaaaatgtgatcagagctgaaactctgaaagccttattagagagtgggagataggatgaactggaaagataagaaggaagtttgcaggcaaggtaattctgttggggacaaaaaaacttttcctttatcttcttatgttaggtatttgggggcctgcaaattaaactgacaaaccacagattaacaggagaaaagtttatttatgtgcatatggaagcttacaaaagaagtaactcaataaatggttaaagttagaggcttatacagtcttgcctgggtatccatggggaattggttccaggaccctctctcgccctccatcggataccagaatccaggttcacattccttatataaaatagcaaatataacctgtacacatcctcccgtataatttaaatcatatctaggccaagtgcggtggctcacacctgtaatcccagcactttgggaggccgaggtgggcggatcacttgaggtcaggagttcaagaccagcctggccaacacagggaaagcacatctctactaaaaacacaaaaattagccaggtgtggtggcacacgcctgtaatcctagctacttgggaggctgaggcaggagaaatgcttgaacccgagaggcagaggttgcagtgagcctagattgagccactggactccagcctgggcaacagagtgaactccatctcaaaacaacaacaacaaaaatcatatctagattacttataacacctaatacaatctaagtgctacataattattacattgtattgtttaagcaataatgacaagagaaaaaagtctatacatgttcagcacagatgcaattttctttttttcaaatagttttgatccactgttaattgaacctcagatatggaggggcaaatgtataactaccttagtagggaaaaaggagtgggagaaaagacctctttggaaagaataagcaggtttctacaggaaaaacaatgagagataagaaagtttgtaataatgtttgttcatccaggtacgagtggtctctctgtcttcttcaaggctataaaactcccccagagaggatatttatgatatattgagtctccttcctaggagtaaaagccaccctgaagaaggaatttatgaaagcctcatttcccagaagtttctgctattagtcaaataagagaagctctgagacggttttttttccgcatctgttgaatcccaaatgtcttcagcttaaaataatcttcagaccaactctgggcttctgagtgggtacccgacattaccacctaggagcctagcacaactctccagctccaaaggcactgatgtctgggatggagggaaagggtggattcaagccctactgtgagagaagacaccaacagcccctaacagctgagttattgtgcgtctgaaagagaaggaactaatggtgacttaaaagcattaagccaagatgacagagagatcattgtcaccactaacacaaataaggaagccagtcaggagaaagtactagtttgaagggggaaattttaaacatgctgaataagacacagcaggaaaaatctctaggagacaattggaaacgtggaaccagaaaaccagaaagtgatcagtgcaggaaatgcaacttgggagtcatttgcctaaagccataacttgaagccatagtaaatgtgggtatatctccaaggattaaggaatagagaaagaagactagaaggtaagcaacaaatcttagttaatactcaaatttagatggtctgcatgtgacattaacaagtgaaagatacaaagaattaagattaaagtgcccagtataagtctgacactaaactgggaactttttctatgtcattttatgacgtaggcactacctctatttcattaaaaccaaggctgagagtaatgtatcttgtcaaagccatataactagtagacaacagagatgggatcaaaggcatgttgcctcactcagggaccatctgactcatgccttcatggacaggactgtgggatggagggcaatggaggaagagttttcaggagtgcataggatgaacgtagtcaaaggcaatggggaccgagaagaggccactgaattctgagtcctctgagaggactcacctctcagaaatagttgcagtataaggtctaaaatcaaggcccccatattttgtgctgctttgacatatggagaaattcaggagggcctcaaatgacctaatgacaagttcccctcctgacatggtttggctgtgcctccacccaaatcttatcttgaattgtaactcccacaattcccacatgttgtgggaggaacccagcaggaggtgattgaattatgggagcaagtctttcctgcactgttcacatgatcatgaatcagtctcacaagatctgatggtttttaaaatgggagtttccctgcacaaggtctctctttgcctgctgccctccatgtaagatgtgacttgctcctccttgcctttagccatgatcatgaggtctctccagccatgtggaacagtaagtccaataaacctctttcttttgtaaatcacccagtctccgatatatctttatcagcagtgtgaaaacagactaatacacctcccagctctgctcctgcaaataaagtcccccagccaaacaaccctccctgtcatgtgaaccaggcatggttcctgcttattcctcttattccggagtagtggatttcagtttcctgccagcctgcagaattattcagacaagccgacttcatcctcccatagaaacagggataatcccacccctcttaatactaaagccttcttcccacatcccctgattgctcactgtgttcccaagtgcaactcccacgtggacctgtgtggcactcagggtccttcctccctgggctgtgagtatatgtgactaacaaactgctgtctcactggtccagtgttgttcagtcatctttctaaccctagggtgggaccctttctcaccaaccaggtaagtcgagagtggttagaacaacagaagacaccagagtgtttactgtggaagtaacatgggtgaaatgcttcactttaataactactggctttattacaactgaagaaatctgagaaatggatgattactcttttctaattttatataggaggaaactgaggaacagagaggtgttcaatggatacttagagtgagacagcaccaaattatttttctcactttaatgttgcattgttctcaaatattttttttacaagatcctttccagatgcttctatgagaatcacatatatccagtatttacagaaagccattgcaagcaataaggaaaatccaaaaagcaaaatatgggcaaaggataggaacagataatttccaaaagaagaaataggaatgccaatgatggcataatgtccaacctcactatgaatcaaagaaattcaaacaaaaattacaacaaatatttttgtccctttttggttgagaaagctttatactacccactgttggtgagattttaaggaattggagatgctcatacacagatgggataagtagaaatcagtatctctctgaaaggcagggtagcaactttctcaaaatctttaatggtagtattttatgaaaaaaaaattcattcgtaggattatatccaaaggaaacaacttgtgaaattcataaatgtatatggatgagaatgcttattcattgtttttttataatataaaaaaaccagaaacaatctaaatgcccatcaaaaggggataggctaagtaagttgtggtacacctataaaatagaatactatgcagtcttttaagtggaagatgtagatgtatatttatcaacataggaagatgatatttggttttaaaaactaggttataaagctgcaggtggaagagtacacatattatgtaaaatgtttataaaattttgtgtttttctacgtacacgcataatgagacatttgttgggaaatttgcaaagttttagtattccatagtcttcaaatttcaggtgagtcttactctcttctttagtttatcccaaaggcacatatcagtaatcaggaaataaaaggttgttttcactgggggtgggggaacacatggagaggaatgaataggtcacctcaaaaagaaagcatacttcaggaagaacttacacaaattacacaacatactttgcttttgcacttattttttatttcccaacagataacacgtgaaattccagaaaggggagaatcaattgtgcattcgatttttcacagggagctcatgaaactaaggcttctgtgcagcagcagggccatggagtggaaactggaaggcgactggggtcagtaggtgctggccagtccctctctgattgaaaaggacatgtgaagggtgccaagtgagacctcctctccaagttctcaacaatggctacttttttgcgttttattttgtgaacaattcgaacccacaaccctggatacattccacttgtgtaggtttccccttcagacagcaaatgctgctgtttccaaatccaatcatgagtgtttgctgttggagcgcttggtgtaaggcatgtgtgtcctataaaatatgtttctcaaaacttaactttttaagaaatcagtcactggtttatctcccaattctatcacccagaagaagagaaagatgccaaaacagatcccacagagagtttcattctgaaaaacagacatttaatgtagttattctgaaaaaaatacaaactgtattatgtcactttagaaatttcaaaatagagatctctaggtatcccgttaggcatctgtcgtgctcccaattacattactttcgacagccctaagagaagcaatatttattggcctactaagtctttaagaatgcaaaacttaacccatctggaactagttgtgttgttggctccagggttccttacatcagaacaaattcagacataaactctgggacagttcttgaatattgcatgaaggtgagttgcaggcattcacacaacacagcattgtcttttaaagcatttttataaagcagatccaaaggctggcaaacctttccttcaccataaaggaaatctaggctaaaggggaaaataagaagtttatgaactattaaaaaaataaagctgtggagttagggagttatggattaggttccaatccattaattcttttattctctggcagagctggctgaagatgtgcagccctctggcgggtaacagaaacattcatgtccagaacaatcacaaaaagggagagaaatggctggcagagcagagggcggatccactcatttggatgttaatttatacagaaatctggaattcaataatctcacatcccccaggtaagggagcgatccactctccaatttcatttgggagttctattacattaagcaatattctgtttggccagacatgccattcttctcttgaaggaaattaatttcttgattcttccatctaataatctaatataatcccaagtcagtgctttaagttttctcatgacactactagacaaaataaactctgaagtacctcttgtgggaactcacaagatacagatgaaaacaaaagaagaaagtaaaattgaagagggtgaggccagggacaattaggtattgaactgcctgccctgcctctgacacatgatacatgtgatttgttaagacgattttctatccttaactcttcactaagtagggctgctttacaatttccataggaaatttatttttaagtatgtaaggcctgtgaacaggataaataaaagattacaaggaaaaaaaaaagcagtgatttctggttgtttaaaaggcaactcaacaagcctttcccagcaaaaggaaaaggtcaggatcaataaaagggcctttcctttgggaggagatctgttttcaatttaacaaaaataaatccttatggtgtagtcttctgaagaccaaggaaacatcaagctatacaagggatctggccttaccaggataagaaaacttcttcatttgatattctccaataatatcaaaacaaagtaaactgtacccactttgcactctttctcggccccctgcctgttagtgaaaggccagttaacctgaaaaatgaaaaccagctcttaaatgtaaagatgatactactcattgatgcaatgttatcctgatagtggcttttcagagatatcatcttaagcgtgatatcaacagggggaatctcacatacgagtagaggctggtttagaaaaatcctgcaggatatggagtgtctttggtgacagaagtcatactcttaaaggtatcttggtcaaactcatcatctcttactctttttatattagccgggcgtggtggcacatgcctgtaatcccagctatttgggaggctgaagcaggagaatggcttgaacacaggaggcagaggttgcggtgagctaagatcgcgccactgcactccagcctgggtgagaagagtgaaactctgtctcaaaaaaaaaaaagtactggctcaactactatgatgagaagcttttgggagatactcagtggtaatgtcagccttattttctgtggcaaatctgaatctttgctgccgtaacacagttgttttcaacatttaccctttctacactcataggcacacacacaattttaactgatgaattcatagaattcataaacctgacagtgtcccattgctggaaccttagtcatacccattcctagctcttgctaactataacttctccatttttccttcctctcaagaaagtatattagattgcaaggttgcaagagagtaagagtcttaaccttaaatatgctttcatttattagaaaaaaggaaatcatctgcatccttcagcaatttaaatattattagagaaaaacctggtgggattcagcatcaaagttattctcctttctggcatgacctcctctcagcacttcttcaagtatataaatcctaccaatacctcaaggtccatctactctgtattctgaaaatactccaatctcctctccctggaatctaccaggactctcaaactcaagtgttttccagcagtcaggaaagttagttgcatgctgcaggccaattttcaggcatgtgtgtttactggatgagtgatgaggacatgacaacagaagagaacacgtcctccctgaagggggcagcagccagtcagtcccatcccattgctgtcaggtgggaatgcaggcccatagctacccgatcttccaatgttttaagataagtcgaaaatctgcattctatggataatatctcaacttcaaatgttggctcacttaggatgacaatgactctgtgatctgcattggacccatggaaccactaatttgcaacctctggtttctacaaaacatgaagctgactgataaatgacaagcttgtgccatttatcagcaagtgtttgctatttcacatcatcagtcacatcagtatttcagagagccataaataaatgtataagttataggtaacaaaaataaagcagggctttaacttaattatctttaatttagcttatttaaagtttcaaataacatgtaaagagggcctgagatatttatatttagaaatttagagacattggttaaataagttaaggaacaatgagccagactctgaagtcccagcaaggagggactgtatctttgttttattcagtacctatcaagagtgctaagtacacaggtttgaatggaactgatttgaatcatttaaggaaaaaggttccagacaaacattgcatgcattagaaactgagtatttcccgattaaacatacaccacccttacatttccaaagtgtcagcaaagcattctgttctttggtcaaatcttgtaaaagccacttactcctaaatatttttactttgtaaccttcaccgttccaagttcatctaaaagaataaagaaaatacctggcacagagaatgcattcaaagtgtattagttaaatttcactaaaaagaagtaaacaaaagacaaaaaacttcaatgcatcttgattctctgtagagagagcaccttgtggcttgggcttcttctatcaaacacatacccacacctttttgtcagataaactcatttggtttttcttgtgtaatggggtgagtattgtacaaggtttcaatgccttttttttccaactcacattgtcccttagaagctcgaagtactaacaaagtgcttcaccacacaaaagtgctgtctacatttgtctggcaaatacgatgccaaacgaaaagcctgatgagtctgcaattcgtcatgggcatgatcaagctccaggctgcttccaccagagagcaaattcaacattataaaggaagtgtggacaggaaagccttccagcaagattctcagaatatggacatgagattcaaagactaataaaatgggttggggagacggtattgatgaagaagcagccggagaggaaaaaaggaggatttgagcagatgtctgtcactaaagaaagtgaaagacacagaggaaagagaagatctatgttatcacctgtgatcctaaaacaactctaggaattaggccgcattatccttgcttttatagaggaagaaaatgtggaacagaaaagctgaataacttgtcacagtcttacccagccaattagtggcttaactggagtttggccaggtctttttgtctgtatagcacaaaccttgtgaccacacagcactaacttccaataagtcacccaaaaagtcagctgcatgtaattagctctgctgtgaaactatggactggggaaagggcattgttcatttgttagcttaatttttgttaaaggcatacaagaccaaccacaaaaaaagaaaaacaaaaacaaaacaaacaaacaacagcaaaaaaaaatcagccagagctgtagaaaatcaactctgtcattagtaagtatattttattcaagtatgtgttattaatatatttgagatctcccaaatactaaagagatagaaatttagatacattggagataaacttcaagtaagctattttttcactattgcataaatgggaagatattttcattgaaaataatgttcctttactcaatcacccaatatttattgagaaaccacctgggccagacattgttctgaattctgaagatcagagagtgaacaagaagcaactgactttgttttgtttacagttcagattgaacaaagcaatggcaacagagaaagaaagagaagccatttatggtttgtgataaatgctgtgaaggaaatattttctgatagagaatgaatggaaaacttcctttaggcaaagaggacaggaagggcctccttaggtgattgtgtctaaatgagtcaagcatgtcgagggttgaagaaagggtgctgcaggcagagagataagagtatgctaagagccggtgaggacactgaacttagctcttcctgggaagtggcagccccttgagttggtgcagtgaccagggtggacatgtgtagtataagcttcagggaagaggtgagtagaaaccagccagcccctcatgggtctggtataccactagagtgcgtttggaattaattgtaagcacaagagaaagctgttgaatgattcagtcttcaacaagggaacaacatgaacagattggtggttttattttggctgccatgtgaagaatggatgacacgacactcgcatagaagtggaagactagtctagagtttggaagatagcacttggacgtcctgctggatgcctgccattaccctctggatctgccctccaccctttcctcgcctgttgcctgcctcagaggctggcttacatggactacggcccagggctctctagcttccagttagtttggtcaatgggaaaccccagccagagatcagaagggaggagaaagaacttaggatattagtccctcagcaccctgtcacctccaagcagagtttctcacaggttggttgtatcccaccacccagggctgctggtccttcaggtggcctctgccaaggggcctgtcacacagctctccctcaggtcccaataaccttccctctcctatgcctctttcctcccctttacccttcaggagttgagtagcatcagaaaacgctgcagctagccccaaggtactgcactctgtcttgtagtttgaaaatgctacctttgttaaactctagtcaaattacccaatgtatggatgccatctgtttcctgtggggctgactgatacaggaagagagaagcaagatactattttgacacgttcagttactgtgatccttgagtaacattctgtttagcttgagttcatataactcaaaaggttatcaaggaaatcttacacccttttacctttttaggagaagcaacaaattcaccaaagaggtaaaatgccaaaatcatgggcgtgcggattcagaaaataaaataagcattagtggtcatcagtatttgatttcaggccaattgttagagctgtcgcttaaaaatttagatgtacatttctcattccatgtttcatttattcaatcaatgtttattgagtgcctactacttgcaaggcactattttatgaactagacatagagcagagaccaaaacaaaatgcctactctcttggagcttacattctgggggagaatcagaaaataaacaactcaatgatatcttatgtgcttataagaaatggttaacaggaatagagagtgggagatcagcaagaggactgctgatttataaaagacagagtaggcctttcttaaaaggtgataatctgagcagagatctaaaggaaaagatgaagcaagctacggcgatgtccagggcaagtgtgttctgggggcggaaatcatgagatgacgaggtgtgggtggcacttttgagtaccagtagaaggccagtgccactgtagcagaggaagtaaggaggacattggcagcctatgcaatcagggagacggcagggacaagatgaatagcctcaagaactttggcttctattttgagacaataagtttttatggttttgagtagaacagtgataggaattgatttaggttcaaggggctcattctggctactgtgttgcaaataaggtggcaaggatagaaatagagaacacttacgcaaaagtctagagcaaagatggtgacttagaccagggttgtagcatttatatttgatatgccatttaaatatccaagggaacatgagtaggcatgggatgtgtaaccgaagtctagagttgaaagaagaggtctaagctagagatagagatttcgaaaacatcagtatttaaccttgacagtggatgagattttctaggaagtgaggagagcattaagagacaagtttttaaggatggagccctgagtcattacagattgacagatcagaaagaggatgatgaccagcaaggagaccaaaaaggccagtgtggttaagtgggaaaccaagagggtgtggtgtccccaaagccaactgaaaaaaaagtatgtcacgaaggaggaagtgatcaactgtatcatgtactgctgatagatcaagtaagaatagaactgagtagaaaaatggatttggcaaccaaggggccatggatgacccagacaagtgcattctgagaagcggtggggatgaaagtgggatggagagaacatgtgcaggcaactcctctgatgttctttgctgtaaatgggaagcagagaaacgtgggagctggaatgaattatgcaggcttctttctttttttcttttcccttccttccttcctgctttccttttttccttccttcctgcttgcctttctcccttcttttctttcttccttcctttatctttctttcttttctccctctcttactctctttatttcttttctttatctctttctctttctttccatttctctctttccttcctttgttctttttctctctcctttcgttctttcatctctttagtttagagacactacagcatcttcatatcctctcagaattgtctagtagggagaggaacccaaatgatgcaggagagaacagataattgcggaagccaagtgtttttgtaggcatgtgttgaggttcacggcaccatgaaggccgagggtggaagcagaacagttcagagagcacatggtctaggagcaggtaggctagtgagagcatgtggaggtttcctcctgactgagctttgctcagtaaaacaggaagtaagggcatacacatagcaggaccagcagagagaagctattggagatctgagaaaagggtgggaaatagtcatccagggcaagtgggtggagtagggtcctgcagtaggattgctgagcagtgtgttgggctttaaactgcctttcatatgaatccacaaatcctactaatattaatgaaagatattaattttcatttttcctgctcccgtcagcttaaaacgaaaagtttctctacttagcccatgaggagtcagaaaagaaaaagtaatgcccagcaaatttctccttcctaagctagaaaggaaaaaataagatattcatgtaaggaaaataaagaagacatggcaacttgaaattatgaagaaattccaaatgttgcatttggtagtgttcttaagctaccataagagatcttcattctattctgggtagggagaatgtacgtggcagttgctaggaatgatcctttgcccgtgatccttcccatgtggtaccccactgtccccaatagacctgagtggcacaaccaacaaaacaacattcaaatatatggaaatgatctttattttagactctttctcatttagcctgttgggctccgagaatgtgaaaaataaatctgaagccttacttttaatagctttcttataaattatccccagtatgtaaaagcccagctcctagatataaccagaagaagggggaggggggaaagactaatgacctttgacattaaaatttaaaatgtcctgcatgcaaatacactttcctgccactcttttgtaatgcaataaccagcaagaattagaattgcaaaaattccaaaagagctacatggaaattatacaacaaagtggtttcacagtgatattgagaaaggaatatgaaatgaatacaagataacatagagacagaatggggtgttacagatgtatgagtgaacgtgcgtatgagcacatgcatgtctcagagagagcaacagataaaaaattatttctttttttatgttgctcttcatgagcaaaattttaagacagacactgttctggtcacatttcaataatgtgacacatggtttctatttacattccaaatgagttttcactaaatgactttcgaaatatttacttgcaagtataaaggagaccctttgaatgtctgatttgaaaaaagaacaaaatcaagcaattatcaacatagatgttctaatacaaactgacactattttcttccatgtcttttttttttttttttttcattcctagacaccacaaaagaccaatgctacagatgtctctctttcggctttaaatacttcaactgtgacaatgatagtgagacagactgcttcaggccctgtagctaggacataataaataattcaaacaagttttgaaaaatcatttggcccatataatataccagctatccgaacatttaccaatgcccgccccctcccctcacacctcatccttattttcattttttgctgcttccatcagcttaaaatgaaaagtttctctacttagcccatcaggagtcagaaaagaaaaagtaatgcccagcaaatttatccttcctttgctaccggcttccattaaattgaaggtgacttcacattgatcctgggttcaattcacatatccaaagagacctcagtgattaacataaagggcagtccaatcaaggatagacacctccatgtgtgtatggtgagcaatttggtgggatgtaaaacataaatgatgtagcatcagaacacctggtgtggatgatgccaccacttgcctacccagttattctccacttcttgccctgagtttttctttctctctctctcttttttaacttagataaaaaataatcagcttcttaacctcccttgcatctaggagtcatcaaaaagatatcggttgatcaataagatcaataagaatttgataggcagggcttccaaaaaagtctgttgaaaagggaagactcagataacacagtttgttagtgtttgccttttgcccaagatccttccctctttcttctgcctgtgatgcccagggatggagtagtcagtttgtagcctatgaggacaaaagtcccatggcaaggcataaccatgcagaaagatagaaggaactgtgtcccgctggcactttgaacttcttgaggcatcttggggaaaataagcccctccttggtctagcagtatgtgacagttaatttcaggtgtcaatttggctaggccatggtatccagatacttgttcaaacatatctggatgtcactgtgaaggtaatttttagatgagattcatcattaaatcagtagactttgagtaaaacagattaccctccataatgtgagtgggcctcattcaattagttgacaattagttgacagtcttagaaaaagagtagcatcccccagggaagagggaattttgccagcagtctgcttttggacttgagtggcaatatcaactgttccttgggtatttattgtgttggcctaacctgcagattttggactgagatctcagccttcataatcatgtgagtgaacggcttaaaatcgatcatctctgtctctctctggagaaccctgactgctacaccattacaccattctaactgggtttctgttcactgaaactgaatgcaattctctctgacacatctgagatcaccacttcatacactgtgtaactgtgtaggtgtctgtgaccctcagcttccagatctacaaaatgggaatatgagtactcctgactccacaggcttgttggcttacacacgagacagaatgtgtaaaagtgctgtgctgtgttaagttacaaagcccaatcgaaatgatagggatcattatcatggtgggctcactgtcaattcacgactgtaagtctgttatgattgtattcacttaaaataataatattcttcaaatctgaccataaaaagtcattatagaacatttgaaagttcaaaaacgcatgaggaagaaaacactcaaccacctccatcattccatagctactgtcatctaccaatacctagcatttattgagttattatatagcaggcaatgtgtgaagcaattcaatgcattatctctaccctgtgaaggtaggtactattttggtgcccatttggcatatgggtgaaaacttgtcaccggacatatagctagtaagtggcaaatccaggattcaaacccaggtctgaattattctaaagcccatgtatgtatccagcaacacatggcgatgagctgtgttctttaataatgtattggctactacaaaattggagtgtgatcaggtaacccttacatcaggaaaaatggggtatgcacattgctcagcatatacacaaatcaagactcatattacaaggctgctagctctcttgtcagggataacattttaatttgaaatgaagtggaagaatgtttcatatcagctactccggttaacactgctttttacttcagataaagatatcccttctgtcaggcaccctgaagtttttctgtaaaaagttgtgttcatttgtttcaaactgcccatacatccatggtctcatttcattttccctatagcccgctgagttaagaggggcaggtattattaactccatttcacaggtgaaagaactgagccctagagaggttaactaagttgcttaaggtcacacagcaaattagtggtacgacggggattggaaagcctaacgcctgacatccagcgtggtatgttttccatcatgtagtgctccatcacctgtcactcccaccattcctgaggggcttggagttgatggggcatgctatcaatttctcagggtaaaactgtcctatctgggtaggaaaatgcacacacacacacacacacatatactagacacactgtaattgcatctgccaaaatggttttataacaatccagtcaaggatacagaaaactcccaggctgcctttcagaaacaaagcccaaaggatcaatttcatcatgaaataggatttcctcagctgtaggtggatgggtaggtggggaggtggatgaactgcattaacaatggaacagtggactgcagggtaaaagctcatttgacattcactgctattaagcagtggcaatgtaaacctggggtagcaaagagcaatacccaggaaaaaatacgaagaaaagtttcaacttaacccttctgtaactttctatttataagtctcagggtattaagtctcattctttagaaataacaaatgcatattttgactcactctgtaagatatttataagaaataaagagcaagggggtattgattaagaaaaaactaggatgagattatagatatattaatatgtgttaatatacaacatataattacatataattaatatataataaatgtacaaatatataatgttatataaatgacatgtcaatatatgaatatatatatttcaagatcatattcttaacctgaaaccaaaaaaagtacaaatagaggtaacatattgcattgtctatttagcattgaaaccaggattttcagatagaaacatttgcctttcctaagctacgcaagccatcagatatttacctcagtggcactggtctcagtgaaacatcttaatgtctcttctctcagttggttagatgaatggatgtcataaggtaaaaagaggaactgcaagatttgaagctcatagaaaaaagactggcactgggaatggcagttaccgggagattgaaacaagaaggcttctaaatatgctgtcaaaaccagcaccagtgacctctcatcaagtgaggggcagcactaaaagctataccttctagaatgatgttaccttgaaaatcatgaggaaatctcaagtgtctttctactacattagcaaaaggaagtttagggagtttagacaccaagagactggaccttctcaaaagggaatttgccacagaatcatagatgttcaaaatgtgaaccaagctttctttcaaataaaagtgaatatcagggcttaaaacagaaagacacatttcatcaaaaatgattaggggcccacgagtgttgactggggaatgagaatagtgggtaaggttagggggaaagccagaaaaaaaggtgaatcaaatatacttacactaaaaatcctggggctccatgtgatccagtcacggtaccttgtcacagagagaaatgtaatcagggatccaggaagttctttacaggtttacttggtgtgatgcttaatattaggtgtcgactagattggattgaaggatgcctagatggctggtggagtattgtttctgggtgtgtctgtgagggtgttgccagaagagactgacatttgagtcagtggactggagagaaagatccaccttcagtgtgggtgggtaccatccgatcggctgccagtgcagctagaccaaatgcaggtggaagaaggtgcgataagctggcttgctgtgtcttctggctgccttctttctcccatgctggatgcctcctcccatccctcctgcccttggacatcagattccaggttcttcagcctttggaactcaggaacttgcaacagtggctcagactttggccacagtctgaagcctgcactgtcagcttttctggtttgagcctttcagactgagccactaccagcttctctctctctcaatttgcagacagcctatcctgggactttgccttgtaatggtgtgagccaactcttcctaatatattcccttatatatatacatacatatatcctacttgttctgtccctctggagaaccctgactaatatacttggacacatgaaaaattattaagaagagatgtctattcttaatgcattaagaatactgtaaaattattctctcctcattgctgcctttctgaaaattcttcatgtggttggcagctgactcaggagcactctctttcctggcacttatccaatggctctaacacccaatctgggcagcctgtccggcttactgtctccatctctccactcttgcttatgtacttcaacacagactctttatttctttacttttatttctgttttctttactttagggaggacctgggagtttaccaggaagctcaaattcttcctgtatagaagctaggaaaatagtgaagattgtgactatccatactcgaataattttatcctataacatctcaacagattttgtctctaagaattctattgtctcaaataaacccagaagttagcactttaacatgggagccttttcaaatggtagagtctcaaggccacatctgactccagagatcatggtgttcctacaacactgagatgatgataggaactacagttgaaaacagatctttctccccacatcaccttgatcaagtcaataaatgttagtatatgccaggtactgggctaggtagtaggaacacagagataagcaagacaagatccttatccctgaagaagtcacagttcagtgtagtatttctaaaattgcattccttagaatgaaagtgacccttgtaaaaataatccatggaccaaataccttttggaatgtggcatgctcaatctccttttggacatttttcatgctcatcctaatgcgaaatgattatataaacttcagttctttactccagcatttcccacatttaactcatcgctgacccatttggcttgcaaaacttacgtcttgaattgagcctacaaatgttaacagaaattctaccattagcttaaaaaacagacaaataacaggcattttaaagataaaataagaaataatgatagcattttaatataaagtaaatagtatttcaaccaaaaggcaagtgaatctgtatgttgtcttaatggagattatatttgtttgctcactacagtttataagaacagagaggatgataaagacaccacaatgatgaccatgcacagagtgtttctatcagcaagcctatattgtgggtctttactcacaatattttatttaattcttacatcccttctatgaagtaggaacttatatttcccattttcctccataaagaaatcaaggttcagagaatttgttaatttgtctgctacgatcatgtgcctggtaagtgatggaagtgagattctaatccagactatttactctgaaaacctagtggctcccaattctagttatatatcccagagaatctactgttaactgatttaaaatgtccattagcagagaaacagattaacaaaattcggtgtcttcacatgatagatgatcagatggctatcagactatctgtggcttctgaacagaaataagaaagaggctttggcaagctctagattagaatcaaagaaaggctttccctcttgttaagcaactcttgttctattgcgccccaacaagagacagaatgtttcaagataggacaccaggtgactgtgtggcctgagctgcccaacctgaattgggtgttgttttatccactgtctattacattgggtgcactcagcagcagctgtctgtatcaaatgaaagtagattacacgggattgtactattaggcttactctggctatccctgttttaacccaaacctaagacttcatggggcattttttatgtagttacctgaagaaggaaaaaaataaagcctactttacagacaacattgcacgataagctagctccagcctgaagtggaccctgaatattataaccccactcaaggtgagtagccctaaaggacattgaagaagaaaaatcccatcagtgggcaaaacttcaaataattacctcttgtggtcaacactgcctggaaaaatagttggcctgaggtattgttccacgttaattcatgggctcatgaatgaggcattaggaagaaaaagaggggaagactgaaagggaagggaacaaatacacagtaaggcttctcaaacttttaccagagtgtgaaaatatctgtctatgtgaatgtagactagaaggtccccactgtggagaaggcactcagtagctaggtaggcaaggcctctttccctgccaactcagagcttaatcagcatattcataaaagctatttagtatctacggtggccaaatacagaggtttgcatgggctgaccaataaggacttcaccagttctggccactgccactcccaaatgtaccacttgctagaaacatcaataaggaaatctgttggagagttagttttttgattcagtgaataccaatgtgctctcccacatttcctctaccttttgtggtaaggtggggccatgtgactagtgcaggccaacgggctacgaggaaacagaaacctgtcatgcctgtgaggggccctggcaaggcataccgcctgacctgcacaccaagtgatgaggtcagagaatgccagattgctctgcattctctgtatagaggaaaattgccccgcaaactgcctgattaatataccaatcctgaatcaaagatacagaaaaataccctgactggaccctccagccacctgggggcatgctgtttgtatggaccccatctatcatagaggagatgaaaatgtatacttcttggaaaagacatatactcaataagaattatttccctgtttgccaggcttctgtgaacaacctcaaatgttttattcaccttgatggtctcccacagaaccttcttgactaagaaactcattttatatgtacatatatttatatgtacatatattaaaaagtaaagcaatttagttggtgctcatgggattccatagtctcacctagtaccccatcctcaacagtggaatggccagttaataacttggctgtggttccagttaaaagacaacaccctgaaaagctaaaggactatcctacaggctgcagaatgttctcttaactagtgattaattatagtgctattttcccataccaagaatatatatgtccaggggtcaaaggggagaggggagagcagtgcctttcaccattacacagaacaaatcactcattttgctttccttaccaggaaatttgaggtctgctgttgtagaggtcttacaactcaagtgaaaaatgcttccaacaatagatatgataaaagaaaaacttcagccgagttaaatttaaaggactttaattgagcaatgaatgattcacgaatcgggcagcccccagaatcacagcagattcacagactccaggggtgcctcatggtcagaacaaatttatagacaaaaaaggtaaagtgacgtacaggaatcagaagtcgggtatagaaacagtgagattggttacagctcagtgtttgccttgtgtgaacgcagtttgaacattcagcagtctatgtgtggttgaagtatggccgctgggattggccaacactcagctattgttacaggtgcatactattaacttaggttttcaattttgtctgttaagctaggttacagttcatccacaaagactcaaatatagaagtatggccttttcaggccatatttagtttgctttagcagatgcaagagtgtttctatgaaattggaagctgaaactgtccagtggacattttggacacctcacaccccactcaaactgagtaaaaagggagttattgtgttgggaggggtcattagtcttgattatcagttgggaaatgaagttcctgctcagcaatggaggccatgaagagaatacctaccatgcaggtaaatcctctggagtattcctgctactgccgtgtgccatggtaaagggttagactccagcaaccccaaatgagcagaagcattgagggtttcctggatagaattactgatggactgtttgttcaagggtaagttagagtatgttaagtcagagcaaggtattataacttgaaagttgaaacatggagaaaaaaaaaaaggagtattattgatatttggtaccaagaaagggatcagagcgaaatttgtctcgcgtggctgcccaatatcctctggatattcttgctcataataatgtttgctccacatcatgaattcttccttttcaaagggaatttcagaaaactcatatcctttgcagctaaggagcaggcatgcggtctgccctcctcttctcaggccacacaagacttcactgtggaagtgagcaatgaggaaaaacaggctatgtgtggacattcatttttccagtataggcagtgagaaaggtatccagatttggggatgttaggataaattgcaataaaattaaatccttcgtatcctagatgttacagtcaggaaaacattgtggtatccagtaagtagatggtgacaattgcctcataagcccagttctaagaaaatgttctgcagtcaacagcatgtcaatggctgttttctgaccagaccagttctgcaacatagttttggacattgttcccaaaagcttagcctcaagcttatttctctgggtctacaatgattcttccaaatgccccatatcctttaataaattccttctctatttaaattagagcccattctattgtttgcaactaatgctcctgaccatattttccttctcccactttcaatacccaggcaaagattgttttaatcattcacaacctaacagttctctctcaggaaagtctaatctagcaatatttttttctgtggaatctgcaacctactcctttacctttaagccataagcagtgaatgaaactgactcctatttccagaatcccacctgcattccttttccaactcaatcttctttcttagcctaaggctagcctatttattgtatgaaatattcttttctgtcagtgaacatggcaacatctttggctaagtcaaaagcctaactcttcatctagctttcaacttggaagcacatccctggacacacctatgctttgaaagtaatatttatctctctctctctctatcccactgttcaacaatcattttgtctgctttttttgagttacactttgcatatcaatactctttctgaaaactcctccaaagtgttaaatatctggcatagtcatttcaaaacaggaacggagtggtctgcatgttaaagaaggcaagaatgccagaaattgtcccatttcccatgttgatcagtgactgtgtaactcagacacgttgcagaggcctacatggcctacttcctgagaggggggtctcactgccttgtcaggattccagtttaagagcacagggcaagtgagaccactgaatacagtcatttaaaaagtgctacaggaaagtatttaaatagtcatcttatagaagggggtgaaaaagcacatttattgatgcagtaattaaaaaaagatttagatccagtgtgtcaattcccatagaatcccacttagcccccttatctatgtcaaagcaaacttagtttcacatcagcagtgcttctcatttatcttaatgctaaggatttatttcttatgcaaaattgttcattttcaccagcctggaactttaaaaaaattcacattctcttcttcaagaatttttattaagccaagatgtcatcaagctgaaaatctcagacacaattttggctctcttctgcaggaaactcagaggagtgcccaatccaggcaacagcagattagcactggcactgctgacaggttcttaaaagtgttggaaagagaagaacaaaggtggtgtacaatgattgacaaagatttctgctataaactaaagttgaaccaataaatatgtctagactctgccatgactatctgtggcctggaagctgcattcttcagaagaaaaaaaaaaagttgcagttggaatttggaatggttttgcccccatgatgtgcacacaggactttgatgagtagtctgatatgcagaagcatccagattatcactgagatagaaatgaaacatccagatgatagattaagtagattgttcacttctcatctatatatatatatatatatatatatatatatatatatatatttgacatcatagaggcataatcaaaatctgagtaggtaaagtcactaaccagaatacgaataccaagttacctgtgtggtttcatggaaaaataataggggaattgacatcatctttataaatgttgtatcaatgagaaaattatgacagtcggggagatctgatctagcccatctgcctcctgtctttagcattcaagctgccaagctagctttgggagacatttactttacagtttaaatgataataacccttccccccaactcaactgcctttgtaaagctaatgagggaccaactgagggaaggagagatgcctggatgctgctaaggtacagacatgaacaattgccagccattattccagagatcacaagatttgcaacttccctaattactcctgcaggcaacatcactattgtagattggccttttgagatactgtttcaggttttttgcatgtctggcacccatggctctacttggacccaccaactgatggttcctctggccagaagcaactcagtgtaagaggacagcttcaactccctatgattaaatctccaacccagccaatcggcagcaaacacccattgcatagccatccctacgccttcgcccaaactacctttgaaaagcccctaacctacaagccttctatgagattgatttgaataataactccatctccggcatggtgtggctagccttctgtcaactaaactctttctttactgcaattccatggtctctgtttgtgtagcaggcaggaagaacccactgggtggtcacagaatttcaaggctgcaaagagtcagactttactcaaatattctaggcaaaaaaaatagaatttaagggttacgatctgcacaatcatggtcaaaatcaaagacacatcgaaacagttaaaacgcaacagttatcccaaggtcaaaaccaagaatatttatttattagtgtaccctgtagctctgtacccaattaagcccaaacatctccctagacttcatctccataatcatatgggtatctgatacccgtcaatgcaattttcttgatcactaatgaaacattccttgttcattgcattagtctttataatcacaatattaaatcattttccctggtgttttcccctagcaacaatttatgagccattacagaatttctgttttttttctatgtcttctctcttctcataagttaaaccattccagtatcttgcaaatgaccagacaactactttaagactttggttgtaactagagcttcctaccaagctatgtaattaagccacagtatctttgctcttctagcttacaagataatcatctgattcccttttgttaaactatttgccctttggccttatagtttattcacttgggaactagattacagtttcccagactatatagctacagagaaattattgtgacttattataagtttaattcatgccaaacaataccagtctgatttctggcttaataccaccttctttcataaagctggaccatcattttgcctttaatcatcttcttgattagtatttttccaagtgtttctcaactcatttcttctatagaattaaaacattcctactggatgggctactcattttaaggatttaaaattttcagtctggatttggggttacacctttgatggatgagcttaaggaagatacgaaaatggcaaaattatcttcatgatgacatcataatggatagaacaaagtaaattttataaaatggtttcacatgccttattccatttgatacttaacagacttgagaactggacagagtagatatagtagttccctcttgtgcacagggaatatgttccaagaatcccagtggatgcctgaaatcctgtatagtcctaaaccctatacatactgttttttccctatatatacatatttatgataaaatttaattaatttattctttttgagatggagttccattcttgttgcccaggctggggtgcaatggtgtgatctcagctcactgcaacctctgcctctcgcgttcatgcaattgtcctgcctcagcctcccgagtagttgggattacaggcacctgccaccacgcctggctaatttttgtatttttagtagagatggggtttcaccatgttgaccaggctggtctcgaactcctgacctcaagtgatctgcccaccttgacctcccaaagagtgggattacaggcatgagccactgtgcttggccaaaatttaatttataaattaggcacagttagagatgaacaacaataactaataataaagtagatgccagcatcactacttttgtgctttggaatcattagtaagtaaaataagggttccttgaatataagcactgtgatactgcaacagtggatctgatcacagagctagctataatgtcactaacgggcaagcagcacagacatcacagatacatgggatgattcatacactgggaagggcagagcagggcagctcagatttcactgtgctgctcaaaatggcatgcattttaaaacttacaaattgcttatttctggaattttccatttaacatttttagatcgagttgaccacaggtaactaaaactttgaaacagcagataatggggaactactgtattactatgcccatctttataaagcagtggtttccaaactgtgttaatgcagaccaaattcatgacattgtttcaaccagtgcagctcctttcatattagttttttaaaaaaacacatctaagtaagatcaccatttgaaatgaatagagtgtatgttggcttttaaataaggaatgtttaaatgcccctgatagaggaagaaaccaaagctcagtacaaatggtaaactcacatctccacctgtaaacaccaggtaaaaattgaaggagcagggacaaccacccaagtctccagcctgtgagacagccaggtgaggaggggtccccagaagacctccaactggcctgtgcaccggggtggagcctcgggaatttcatcatgtttgcagcggggaggagcctggcccttccttttcctgtgtggaacctgggattcaagctgtgggcgggaagtgctctatcagggactcaagccttgggagactccctctttcccctttacttctttttcacccaataaaaccctgctcaccctctccatcggtctgtgaacctaaattttcgtggctgtgggacggacaagtaccctgtctttaactgaactatggaaaagtcctgcaatatttttggcgcccaacgtggggactcgagaaggggtaagtgagatgcaaaccaataattctttttccctctcccttctgagtcttctcatccccgtggccttttccttccttttttgggatggaccggcgagcagcagctgcccactgctcctcactccatgccggggctgggacacatggcctaagtgtcctgcacagcctgctggctggttccccgtcactcctggctgtcccagccttccccttccctggccaagggatgtaactctatcagacagtaattaagcttaaatttgtctccctggtggaggaaccacttgcaaagaaatatgaggttcttcctcaggcacttttaaactgtttcttttctttccccttctctaccccatcagcaagttaacttaaatttttttttcttttagaagatgttgtactaggctagcctccacccacccccaacaactgtcagtgtattctctgcaaagtttcggttgtgaaatcaagcctccatcttgttttatatcctgagggcatggctggtaattgtggcaaggatttgtttagcaaagccttgagaggatgaaccctgtaagattcaatgtctgcatgttttcctagccctttctcttaaagggccccacccagcaactgggttttcttctgcctgcctgtgtgtgtactgtacgtaatgtttgtcaagagaactctaattaatacagcctaaagaaagacaagtgcttgaatctaatattttttaaagggaagataaagtctggtacctttcagttcacatgactttaatctttaagaaatagaaacagtcttaaaaactattggtcaaatgcaggtattatcaaaatgtaaataggtaggctaaataatgcaggtcagatgcaaggtttgctaagtgttttgaggttacaaactgctttttgggttttcagaactatattgacttgccagcttcacaactggtaaggcctggggacacacggaactaaccgcacccttaactaagaaggcaaaccttggctgcagttagcacacaattaaagcaacttaacaagttttagtttacagttaaaaattgctaggagttaattgaatccactagaaatagatttacatgcaaggtgtatgagaacagtaaaatgtgtttttcagtaaaaggttataagaagtcatggaaatgtaaacttttgcctagggttaaggattgttttgagttacattaggaaaaagctgaaggttccaagaagtggtggaagaattgtggaaattaatcttgcagaagaggttctctgtgtgaacatactgactacattcaaccaagggtattatatggtttttctgtaaattgagcgttgaagtaaaagcataacgaggttttcctaaggtgctaatcttaatctgctctttggcaaaatttgtaaagggttataaaaggttttcgcttcttcaaaatttctgagtcatcattttgacaaaataaataacttttggtaatgttgacaaaaggagtcaaattctgtaaaatatttttacagacttattgtgagccacatatgagtgaccatggcccgtgacacagccctcagaaggtcctgagaacatgtgcccaaggtggtcagggtatagcttggtttgatatattttaggaaagcatgagacttcaaatatatttaagaaatgcattggtttggttcagaaaggcaggacaactcaaagcggagccttccaggctataggtaaatttaaacatttttctggatgacggttgagtttatctgaagacctgggatcaatagaaaggaaatgttcaggttaagataaaggattgtggagaccaaattttattgtgcagaggaagctctcagatagcagacttaagagagagcaggttataaaatgcttcttatcagacctaaaagggtgcctggctcttagttgattatctcctggatctggagagaaaggaatgaaaacaaagggggaaggggattctctataaaatgtggatttttcccacaagagacgttgcagggcaacttcaaggtatggcaaggaaatatattttgaggtaaaacattttgatttttttccttgttatgccacagtcagattggaaagtaagtcacgatatacagggttaaataaaacccatctgatgaaaatttatggtttgtaagccatgactccccaggctccttagataggaatttgggcaatattaaaaaaaaatcagagcttagtcctcagtaatctggaattccgtttcataacatcaagtgttttaaaccttgaacatttaacagccttcccaaagtcaaacttcagtttcaaaatcgtcttccctggtacatggcttttcaaatacttcagagggcccccgatgtgtccagaactaagagaggtaaacagaattatttgacatgtttaggtacatgggattgccaaaatgatgctcaatcttctttaggttatagctgggtgaataatgccaatatatgttccaaaattgtatgggatttctaaaattctaatgtctgagtatatgctatcaaccataattaaggtttttatgttaagttatagtaaaccacggagataactaaacttctttgtcagtcgtgtttctaattgtaactaccctggaaattttgctattcacagacaattgttgctttaattctttttcagaagatggtttataataagctataggactttgacaggtgctttcaaatacaggcttctgataactttggatattgtgacactgaaatacaggaaaatgtacaggactcaaaagctgaaatgctcatgattatcaagcaaaacaagagttagccaaatggactgaactcaggaagctgaagcaacctttttgacttttgcttggaatattgctaatccatgtttcatttttcagagtcaaggaaacttattttgaactatttacagcctttaacaattgagtaaggtatactcctatgaacaaagtttgaagcgtgtttgtttctctctgcctggttcctctagaatttggaaactatctgtgaatattgttatggcaatatagttgtttgcatcagtgccaataagaatccatttttcttttgcagcaggacacatttggagaaagtagttattttaccaaggttttgactggaatggtatgcttccctttaaggagtcaagctcaacttgcagagccaataaaagccccatggggaaactggcctcatactgttgtctatgcagtccctgtacagggttcctgacctgtggtcagtaaagaatgtcactttctagcaggtccaagagctccaagtttattgtgggaccttaagaggagaggatcacccaactcacaggtatttgaggatgcaaacccatggctaggctcagctttaaaaggtcttatctgtgattccttgtggaaaacatttccatcagtgccaatccaaaaagcctatgtagaaatagttattcttgctgcactttatgcaaataatcaggccaagtgtaagactaaagtctattttgcaaagcactcagtcctaccataatttttttaacaaaaatgaggactggagagacagaaattatgttccaaaatttgccatacatttgtcattaaatgctaaactcattagttgtttttaagttttcatctaccttttagaccaaccctgcttgctcctgtgaaccaagcagcaatctccagctgcagctcagaaagaacaggagggatgggtaatgtagaaatatggatcaatattctagctctgaacaattatcctgcaaaccctgccaggtgatggaataaatagggtgcccattaccaggaggtttcctttttgggaaagtaagaccaagtgaactaaccaaagccaagcatcacgtatccaaatcctggcaagcataactatagctaccagttatctgggtgtgtcacaagacatccttttctctctcttgttggaggagaactgggttccacagcttcactttagcatttgtcttatgataaggaggccatgcaatgccccatccgagatacatttttgtcccagactgaattccaagcttcacatcaaagccttaggaaggaaaatcggatcttagggatccagaggcaaatgacaacagaagttaaaaggcacagcacaggtgagcgtgactgattcctgctgattaagccaaccccaaacttcctgtttcatggataaaggccacgttaatatccatggcataaatgaggtctacggaactccaaggctactgacagcaggggagatagggcatacgtgggtaagagcggatgattcccacccctaggcccccctgcttcatgggtgcaagttgctttaacacccatggtggcacctaccaaggtcactggaacttggggatgcaaggatagaagatggaaagaggatgctcttccctctctacctcacatacctaaggtatctgctggaagaaaagggaaccaggtatgcctgctcccctctttctagatgggtagccattcatcttcagtctgtatccctttcaaatgcatcctgaacctctgggactcctttaaaaggcaccttctttttgcctttcttctcctctgttctctcttcactaataggtaattgtgtctccatactacaaggcactctcctcagatgcatcctccaaactagaaagagttggtttcccaaaccttaaactggttagcttaggattgggctcaggggaaggggacccagaagcccaacgtgccagcaaaagggtaaagttttttttgccagtcaggcttttggcctccctctacgtgtgcaaactggcaaaaggcctcaggatctttgagctgtccttaccctcccttcatttcgttttgatacatagtttctaataacctggtttgtctgttcttgccttcaggccattaaactctaaacaatcatgcaagcagagcctctgacaatggccctttctgctgtgaacccttagatgggcctctgccgtttccccaaaacagcgccccctctcagcaggaagcagttaaggtcagtcttcatccttatccttaatctaaacggcagctggatgtacctctttagagggaggaatgagacagctaggtgggagggggtccccgaaaaacctccagtcagcctgtgcactagagtagagcctcagaaagttcaccatgtttgcactggggaggagcctggtccctccttttcctgtgtggaacctggaattcaagctgtgggcaggaagtgctctatcagggactctagccttgcagaggctcccggttccccctttgtcttctttttcacccaataaaaccttgctcaccctctccaacagtctgcgagcctaaattttcttggccatgggacagacaaggaccctctctttagctgaactaaggaaaagtcctgcaacacctccaacaactaacaattgtttccagtgcacctccattctccaggagggagaaggccaaagcacataagtggagaatgcacacgttagcccattttcaatagtttaatactttaaaaaatagtagtgttgctgactttcaagctttagcatctacacgtgctagattcacttattgactcattaaactattcttttaccaatgagcttaccatatgccaaaaactatgctatactgggaacccaaaggcacacagaaaaactagaagactatttctgcaccagtcaagaagcacacaaatggacactcatgaagaaactatagacccaaagaaaaccattgacaatataggacaaatggcatatcaagtcctgaggaaagagattagtaaggaggttaatattttaaaaaaaatagaaaagggagaaataatgaatcactggaaatggtcccatcaacctgcagttcttcactatttttcaacttaaaattggatacatttatagtcacttgacctctctaggtcccaatctccccatgttcaaagtacatatcctattgctagctctctctactttgctaagtctattgtgaaaatatcacaatataaaatactttgaagccttttagggaagcttaaggtcttctacaaataaaataacaagaagtaccacttggctgaaaaatgaaagaggtaggacaccaatggtagtaaatcacttgtatcactttgttcagaaattatttcatttttttcattttattgaatatagacaaattatagttgtatatctttatgaagtacaaagtgatactatgatatatgtatacagtctggaatgattaaatcaagctaattaacatagccatcacctcaaatacctaccatcgattctcctaactgaatcattgtaccctttgaccaatatctccccatttcccctactcccagcctctgggaaccaccattctactctctgcttctatgagtttgattgttttagattccacttgtaagtgagaacatatggtatttgtttttctttgctagcttagctgacttagcataatgtctgcttggtccacccatgtggtcaaaaatggcaaaatttcctcatttttaaggctgaagaatatttcattgtgtgtgtgtgtgtgtgtatatatatatatatatcacattttctttatccatttcatctcacacctattaaaatggcaataataaaaagatgaaagacaagtcttggcaaggatatggagaaaggggaacccttgttcactactgatgggaatgtaaatttgtacagagctggttcaagggaaatccaagaacatggctgtgaggcaaggaccagatgagggtattaagggactatcattacagtggaaaaattaaccctatcttttttgagagaagccagttacaatgcttgatgctatccctgacacactctctctagcaacaagttccttttctttcggcccttaagtaaggctataagaagaacagaacaaaacagcaaggagatgaataccaaagcactggccacacttttcccctgtgggcctgtcttattccattcatgctgctataaaaaataccacaaactgtgtattttataaataatagaaatttaattctcacagctctggaggctgggaagtccaaggtcaaggtgccagtagattaagtgtctggtgaagtcttgctctctgcttccaagacagtacattgtttctgtatcctcacgtggacgaaggcagaagggtaaacaggcataaagggcctagctagttcccccaagcccttttaaaagggcaccaatcccattcatgacggctctgtcctcatgacctaatcacctcaaaggctccacctcctaatattatcacactgggttgttttttgttgttgttgttttgacaaggtctccccctgttgcccaggctgatgtgtagtggcacaatgtcagctcactgcagcctcaacttccccagactcaagtgattttcctgtctcagcctcctaagtagctggaactacaggagtgcgccaccagctaatttttgcatttttttttttgtagaaacagtttcgccatgttgcccaggctctcactgggtcttatgttccaacatacgaatttgtctgggggatgggtgacacatacattcaaaccatagcagggccttcaataggtcattagagagagagccaaggaacaccagtgtggctttttgcattgaacaacgataagttaatggaagtttaacatagcccacagtctgtagtcagaggtcagaggagtaaggccttacatgctacagatgcccacaaaggagataagaggaagccagaagaaatagaaatttgtttgtcagtggataaagaacaaggccaaggttttcttaaatagtgattgatgaggccctggtttactgtaacagtgtacttgtgattttttaattttgtaaaaattgtcccagtgtgtaattctctgtttatacctgagtgtggggaaatgaattttaaggaaaaagccctatatttcctgataaatcacttctataactaattggttatttaatgattcatctgtgtaaaaagggggactaatggttttaaaataaaatttcatcaacagttgtctctttcataaggtttgaaaacaaagaaaatggagatgatgatgcaggtgtggctctttaacagaacccacaggggagcacacaggctctggggagagcaaacaaggcaagggctcagaagactaggttctaatcccaatgcccctttctcccggatatttaatcatagtcaaattacttaatgaccccaaagtacagtgatttccttaatattttacaaaagaataaaagcactatggacttttcttcaaacagacatatcacccctggcctcaggagtttaatattcagtgactctttggcaggtcgtgaactgcccatcagtcccagtggttgttatgaatgtcctctgctcatccatccagatcccctccccatctttcttcatcctgactcttcctgggagggtgatcaatatagacctgccaataggctcctgcaccctctagcttctaattgcattctgtccacgggaagccctggtgagagttacatcattccaggattgggagcaacctgtaagaggccccggacagctgtgtccatcctctgaaaatgaaggctgttctcaggtgacctgctctacccagatctttttccttccaggttctttttttttttttttgagatggagtctcactctgtcacccaggctggggtgcagtggcacaatctcagctgactgcagcctctgcctcccaagctcaagtgatcccctgcctcagcctgctgagtagctgggactacaggcgtgccccaccacactcagctaatttttgtccttttagtagagatggggttttgccatgttggccaggctgatcttgaatgcctggcctcaaatgatctgtctgcttcggcctcccaaaattctgggattacaggcatgagccacagtacttggcctccttccaggctctgataaatgtttcttcccctcatctcttaaagcctaggggaggttatggactgaatgtttgtgtccctcacaaaatttatatgttgaaatctaatcccaatgtgatggcatgaggaagtagggcctttgagaggtgattaggacatgagggtggaacccttgtgaatgggattagtgcccttataaggggctgaaaagaccagaattctaccccttcaccatgtgaggacacagcaagaaggcatcctctattaaccagaaaatgggcactcattagacaccggatctggacttcacagcctccagcattgtgagacagacatttctgttgtttatgagccacctggtttaaggtgtcttgttttagcagcccaaatggacaaacacagggaggtaagagcccctaccagcccctgtccaccagaaagatggggatctgaacagaagccagaggtgtaactggaatggactcaggtgttttcctcacagagcagataactaaagctagaattcttgataagaaaaatgggataaagaaataacagttgcaaaggtaagaagcagagacagagttatagtccagaggccaaaaggataattttaagaagaaggagtaggtctgaaagtgatgactgagactagcccttggctgtggtgattaagatctttggtgacaatagaaaatgtaacaataggagtggtctgttgtggtgatagaatctgcagaccggtggaagtccatgggcccatttaccatgccacaggcaaagagtatattaaactcccacgaagagaagtgcctctggattcattttgccaacattcactgtactgatattagccatggacttgcagagggtttatttactattgcagcctggctctctgctgtgtctgaaagttgaccttggtgtcctctaagttttatcccagagaaaaagacagcaattgagctattccccaggcacagggggcaaaatttgaaattgacataaaaccaagattccctgtctgacttgggcctctgggattgtattgctgcatcctgtggtggcaaaaagagtatcctgggcagtaagtgatttcaattccacttaaagcaacaagtatttgctgaaaaccaaccatattcttagtaagaagatgggtgctgtaggagacagagaattaaatgaaatcattccttccctccaggagcaaacagcttcatgctagaaataaagctaactcaaatgcaacaaacagaagacacacacacacacacacacacacacacacacacacacagagagagtacttttcaagattagtaacaaagagattatctacagagataaagacagaagaatccaatgtctgcatgttttgttattcatgtgtataagttttctaactttcctacattcagtgtgaattagtattgaaatcagaataaaaaagcaatatttttttaaaagcctaatttttagaaattgatagtaaaaaatgagacagccctgggctgaagtcccaggcgtccttcttcctaacaacttgaacttagccaagttgcttaactacttggtgcctaaatgttctcatttataaaactgggaagatggcatggagaggcaatgggcattttctggcaagaaactaagaaaaaaggccataaccaataagtaacttatggaaatgaaaaaatcttttaagttttataatcttgctttagttgatatcttaaaacaaaattttgaaagttattaagtcactcataaggatttcaggaagcactgcagtgtaatatgcttaagaatggagatggttcaaatgctagctcggctacttagcaatacctgtcctcaaataagttatttcaccctacctgagtctgttacttcatctctaaaatggagataatcctaaaacgtacctcacaggaaccttgtgaagataatgcatgtaaaatgctatcacagtccttggcatggaataagtgtctaattaacttttatatataattataattatcatctaaaaagtttagtggtgtttcagacaaatctaagagaagataagcatgaataggtatatgtctttttcatctttgtatttcaccagtgctttgcacagggcctgtcacaaagtagggatctgagaaatacttgtgaatgaagaatgaatgaatgaatgggctgattttcctatttgatcaaaagccacatccatatatgactaaatctgagtatataaaagaagataaaacttgtgtttcaattcaatctagtgagttaaattaaaagaagaaagggaggaaggcaaattaaaagaagaaagggaggaaaagaagcaggaaagagggaaataagacaaaaagaaaaaaaaaaaaacaaaacagaagttggccaggagaaagggtgtctccatccttaaatattttactccttattgtgtgatatattattttgtcagcttcttctagctacaattcccaaggaagggatagagagcagcagcttccaagtaatgacccatgtgggtataaagagaaatttttatcatattagaaaaaatatatttatatacatgctaccaactttacctagaagagaagagcaagggattggaaaacaaattagcataaaatccctgctccagctttttacacatacagatgttttcctgcatatttatccatccttctgagcactgctcaaatgttacatcctcagagaagctctcctggacccctcatcctgggctggatactctgtcacatgctctaatagtgtctgatacccttccactagaacagggatcactgttgtaattaggtaattatttgggtaattaattgtttaacatctgtgtccagtgtcagtatgcaagcaagctccatgaaggcagtgttcctgtctgcctgttcaccccaaaatcaccaacacttgcatatgccttgcatgaaacaggtaagtgaacataaatgtgtataaggttggcatccattctttgtgcattctgtgtttgtgaatttgcccactcaataaaatgcatttgtaacctcaacatcgatacttgccacatttctgtggtcatttttgggcatcacagagaagtgaaaaatttgtcacccaacatgtacattccccaagtgaagcagaacaaagcaaagctccaccttcttgctccatctctcatactgtaaacaagggtctttttctgatctattaaatgccaggttgttggggtgggttttcttttgcatttttgtacataatggccccaaaagaacagtgctgaagtgctgtctcttgttcctgagtacaagaagaatatgatgtgccttacagaggaaacatgagtgatagaagcttcattcaggctcaggttaaacagctcaggctgtgtcccatgacttcagtgttaatgaattagctatatgttaaataaggcatctttaaataaaagtaaacatttaaaaagtttacatattaatcaattaacaaaaatgttgtgaagaaacagccagtagcacgtgcctgtagttctggtttctcgggaagctaaggtgggaggattacttgagcccaggagttcgaactgcagtgcactatgattgcaccactgcactccagcctgggcaacagagtgagaccctatctcttaaaaacaaaaaaaatattgtaatcagaggctctcaggaactcaaccctggatttcccctaggggcaatggttcattatttgctaattcagcgtttgtggagactttatacaacaatttcctatgaaaaatcaggatcaactatatatatacatagaatgtatatgtgtatatatattttacatatttgtgtgtatacatgcacatgtgtatatatgtatgtttagtagtttttaaccattttggtgttatacacctgttgtaaaaatttaaggaagacgtggatactaggggctgagggttgccacaaagggaggtatgtacatatatacagccctgtgctatgcatctccagggcaggagacagggtgttgacattcacagtatagcctaagtgaatattcctactccatagaattgttcagtgtggtgacacttcatgcaaataaatacatgtatacacatacacatttgcataagattctgggcatttgtggcctcctatcgtgtacctcaggtaaaaatcctgacagagaaataatagatacacaaatataaatatatattatatatggcacattcaattttacttcaaatgttttacataggctaaaattgaaactaaaatgctttgcatttcagccaccaccaacagggactagacaattccaaaatatatgtatccccagaagaaagataatttgttgtgaaacactggctaaagacattccctaaggtaaactaaacacaggcagaaaactgagagttgaaaaaaaatatatacatatatagagagagagatgagagttgaatatctatatgtatatatagatatgtatatatagagagagatgtgtgtgtgtgtgtatatatatatatatatatagagagagagagagagagagagagacagaggagagagagagcacaacaagaatacgaaggttggccaggtgctgtggctcaagcctgaatcccagcattttgggaggccaaggcgggtagatcacgaggtcaagagatcgataccatcctgggcaacatgatgaaaccctatctctactgaaaatacaaaaaattagctgcgcatggtggtgcacacctgtactcccagctactcaggaggctgaggcaggaggatcacttgaacccaggagacagaggttgcagtgagccaagattgtgccactgcactccagcctggcgacagagtgagactccatctcaaacaaacaaacaaacaaaataccaaggttaacctgccccgtttgctttcctaagagtctaagattctctggattctcaggtctgtatggtgggcagcaatgtaaatttaagcttctctgacatctaagttctttggagacagtaactattaaacacctgactctgtcccttgaataacagacatttcttagtaaagcttttaattagatctgttggttgaggatgaaaatagaaagacaccagaaggaaaaaaaaaattcatccctgtaaatggtcctgtggaaatagtaactaaaacaattatactgttaataattcaatgttggtttaaaactatacaattgtgagttatttatacagaccagagttggcatgtgttgtaccacaggtggatgtgaggtcaccaagaaaccacttcacagttttcccagaagtgtagcgtcaaaaaggtcacttgtggtaaaagatcttttggattagtcttttaaatcaatgcatgaattaaagacaatttacatataaataggctaatactctggctttgaaattaaatggatttttaaaagatttaagtaactgcagaaaaggtcagttaggcagtaagtgtacataatgtgattcttgaaaactgctgtcttgttggtttattaatattttgtattcattgtcagtgttgttctaaaattgtgtgcataattagcaatgcaccaaagtcaacggcaggtcccaaaagtaaggaaagcggaatttacaaatcagtgaaggaaggacaagtctagatttggacatgaaaatagtcaaaattaacctttgcctatatattaatacacattagattcaaatatgtcacaacatattctaaataagcatggcatcactcgctccagttaaatttaccttggcatttagcctcactgataaattttcaactcttccaaaatacaaaagctgcagtagtctcctgagttatcacaacaggatcatgattgtaatttgaaatcctgattccccttttagggaacagaaacctgcagtttttccaactgtaatgaaaggatagagcgaaacttccataggatcaaaccacattccattaccaccactcctctgaacattaatgtaccttaaaacatattgaaccataggatgaatatatggagcaggggcatttttaggagagtgaaactattctgtatgatactacgagagatacatgatgttacatacttgtccaaacacacaggactatgacaaaagattgagtcctaatgtaaacgagggatgacttcagttaacaatagtgtagcaatattggttaatcaattataacaaatgtgtcaatccaatgcaagatgttaaccataatgaatactgtgggcaaagggaggggatttgtgggaaacctctgtactgtactttctgctcagtttttcagtaaaactaaatttgctgtagaaaatcgtctgttttttaaaatagtgaaccaaatgtaataatgcactcaaagactctttttagacaaatggtttataaactatattcagaggagccctagtggtcctttgctggccatttggtttaggagtgtttgggaaaatagagtaggagagaagagggaacaatgaagaaaagactgctcaagctggccccttatctttcacccctgtttcaaacaaagcaacaaccttttcacctgtacatattgtttctccacattggagcccagtaaagaagggtttctcagctaaagagaaaaaaaaaacatgaaaatcaccaatgtatgctcaataaagtatcttgctacataaatcagcaactcaaagaagaaaaagttaaattataaaaaccttgctaataatgtacactaattccctcagctacttaataaacatttaactaaaactttctgcctgaccattattacttcctatgattgggctaagcataagctaaatgactaccttggaagaactccaactaagaagtatttatttcacatcaacaatgaaccagtactctgttagaacatgcaacatgctttggaaagacaggtgaaatacaaagcatcattccagctgtccagaagcttatcatcttacaggacagagaacatgaacacaacaaaatgcagaaacaatataatacacctgaggcacccagcacccaacttgatgagctaaaaaatagatttcaggtcttctgtcaggtgttaacaaattgtcaactctgaataatgtgagggccagtatgaatgagaacagtccaatccccagttaagccccacttttctaaatcttcttctctctttaaaaaagcaaagtgaatgctaacgtagtctatcagtaatggacagtgtcctcataaaaagacatatgtaaaaaggaggggaagtggaaggtaagcagtgcttactattttatcatattcaattgtatacacacctcctctcaaaattggtgtccccctatcagtagttactaacaagttagttcccaggatcttgcagatggtgggctggtttcagacaaaggcacagtggtccagaggatctggcaacctctttcaggggctgttgggagatgccctgacggcagcagaagcagcctccaatgaggatggcttcctgctcaagacctcctcacactcctcttgcataaataaatgatttagacaccgttttctcctctaatagccagcactacaccaaagagaaaacactccgctattgatgacaggagagggctttttttgtaagtgtgtatgtgtgttatgctataaattaccctgttggtgggtgtaaaaataaatatccatgtatatagttgtgtatacacacacacacacacttacacagagagaatatgttacagttaaaatcatgctgtcgacagccactcaaatctagagcaatttatggctctcaatgcagtcacacattcaggataaagacaggatgataataaatactttgaatattaccagcataaataaactgcctgaggagcttaaacatttgcaacatagccttgctggctcacactgacaaccagcagacctgttgccagtgagcgactgaaagatcaaacatgattaaaaatgcaaagatgctgcacccaaatgacatgctttatttgacaatgaactctggactcagaggcaccactgcaatctatgagcaaagtgctttttggtaattcatttgcccactgaggccagctactgaggaatcacaatacaagtcccttttaaagtaggcacagttctttacagccattagtaattccatcttgagactgcccttcgagaaaacaatttctttttttttttttttactgagaattgatggtttgtgttttgtcaaaatgagccccagaagttgttaagaacttgtgtaatacattagctatgagtagccgaataatggtcttcaagtaagtacaggaaaatgaatggctgtgatgaagatggtgggcaggtatccttttactgaaactactaaagcaggggctgaagtcaggttttaaaaaagattcttgtgaccataagacacaggaatgtccagtggaagaaagccagttctagcttggagttttaggaacaagccagtttccttggtgtctcagtatcatttgattctatagtatgttatttcttttatttacatacatatgacattcatgatttctttttaaatatccataaattcaaagtggaatacaatgtcacaatgtcttaagtctcagaataagatgctgagaagaccatgaacaagtgatttctttttctttttctttttttttttgagacagagtgttgctctgtcgcccaggctggagtgcagtgggcaagatctcagctcactacaatctccaacccctgggttcaagcaattctcctacctcagccaccctagtggttgggattacaggtgcctgctaccacgcccagctaatttttctatttttagtacagacagcattttgccatgctggccaggctggtctagaactcctgacctcaggtgatctgcctgcctcagcctcccaaagtgctgggattataggcatgagccatagcgcccagacaaacaagcgggggtttcttaaggaagggcttccaagaaaaactgcttacagcgtggcaagaagtagaacagggaaaggcaagaagccaagcgagggtgtgattcagggtagaatcctctgagggacgttttcccaccagaggcaaggaaactgggctttcactctcactcaccaatcactctgcagctaagagccatcctgggggttcctaaactccaagcacttccagctctcagcagacctagtgaagccagcagctccaattggtcctgcaaagaccattgccgaagcagccattggaaggtaaatacacagaagctggggcagggctcacagatatgttgaaaggtaccagggcagtgctccgacaccttctgctacagcaaagaagcaaatggtccaaaaatcaaaatgagggtagaataaggttggagaattcaaaaagtgcagaaaaaaaataaaagtcccccttctctcacccccaccttccactcacccttcacctagtccttctttccaaaggtaacctttgtttacagttttctataaatccttctaaggaaaaatatacacatatactatgtatctatttaaacattctttttaaaaatatgcagattggacaactgttccactgttctactccttgctttttctcactaaagaatatatcttgtattctagatattatattagatctatatacatattctaaatagagagatgatagattagacagataaatgcaaagaggaaggaagggaaggaaaaatggatggatggatggatggatggatggatggatggatggatggatactacacttcattgatttaaagataaaacagttttccacattttaacatttctgaaataggctgtcttatacttgacagcattttagatttgctaaaatgcagtagatagatatatagctatttatggatggattgacagttcacacatagctctgccacttgagaagtagtgcaggatagtagttaagagtatattaacacattgcttattaatgagatactttcgtacttgaggaataaggacctcttttgatggggctaatattttaataatctgataaattgtttattaactttaaattttcataatgagtccgtaaatgagtttgatttatagttttctattctgtgctgtctctctcagactttggaatccatattacattggcttcataaaaacacactggcagtttttttctttatttgtgctatgggcaattttgtttacttttataattctttgactatgtaatacatgtactgtgtatcaaattcaaaaagtacaaaagggcatgagtaaaaaagtatctctacctgtcttccagctgcctagtcccttcccccagatgcaatcattgtaatccgttgcttttgcgttcctttagttatgtatgacacatacacatatgcacaaggacacacacttttactcaaatgtcggtataatagacacaatgctctgcatcttgcttttttttcacttcatgtgttttgtagattgttccataactatacacagaacctccacatcctatctgatgacttcacagtattccattatgcagatataaaattaattttaccagttttcatttttaaatagaattaacattatcagttccttgaaatgcaaaattatttgcttctgaaagcataaagacctgtggctttttaagatctttgataactgcttcagatttttccgatgttattaaagttctctttcctgttgaatatgtttgggtaacttatttacctgtttaaaaaatacattccttgaagattttcagttacttttgcaaaagttctcctttgaatattttaatttctttagccatggttctttttcctttttcctttgttttttgtttttttttttttaagacagggtcttactctgtcctctgtctgtcacccaggctggagtgcagtggcacgatcagggctcactgcagcctaaacttcctgggctcaagtgatcctcccaccttagcctcttgagtagttgggactactggcatgcgccactacccctgtctaatttttgtattttttgtagagatggggtttcaccatgttacccagcctggtcttgaactcctgggctcaagccatccagctgcctcggcctcccaaagtgttaagattataggcttgagccactgggactgtctgctttccattttttgtttttgtactccctaactttttgagtaagtgaatttcattgcttggcattgttttcaaggtgtgttagtctgttttcatgctgctgatgaagacatacccaagactgggaagaaaaagaggtttaattagacttacagttccacatgacaggggaggcctcagaatcatggcgggaggtgaaaggcacttcttacatggtggcagcaagagaaaatgagtaggaagcaaaagcagaaacccctgataaacccatcagatcacgtaagacttattcactatcatgagaatagcatgggaaagaccagcccccatgattcaattacctccccctaggtacctcccacaacacgtgggaattcggggagatacaactcaagctgagattttaatggggacacagcgaaaccatatcacaaggagacagtatttgagcttatttatgattcttatggatttatttttaaattagaaaacctaatttcttatttttatctttattatttagttctttctgcattttttccagttttttggctgtccctttcttaagtcagatgcataattcctttatttttattcttttttaaatattcaggtgttaaaggctgtatacattttcttctaagcgaggctttagctgtagcccatagctcagatgtgttatattttcattatcaatggtgtctagatatttttcaagttgggtttaaaatgtttctttgaattaagagttgtttatcaaagagggttgttgtttgtttgtttgttttgagatggagtcttggtctgtcccccaggctggagtgcagtggcacaatcttggctcactgcaacctctgcttcctgggtcaagcaattcccctgcctcagcctccttcatagctgagattacaggtgtgtgccaccacactcaactaatgtttgtatttttagtagaaacaacgtttcaccatgttggccaggctggtctcgaactcctgacctctggtgatctgctcacctcggcctcccagagtatcaaagagttttaaaatatccagattgtaaggttttgataaaactgatttctaatttattgcattgtaatcaggtaatggggactttatttgtacttcagcttcttgaaatttcctgcaatttcttcataacttataaaggccatgtgtttgtattacattgttttattatttgatatattttgaaccacatattttagaggggctttcctatcacaaacatatttcaaagttgtttgcaaaatattttgcattttctaatcaccataagtgaagtgattagaaaacacatcagggcttctgtggctcaggatttggtgcttgcctcacatagacacaaccagtaactcttactcttgtgccaaatgatgtaattgccctaggaaaatgtttctacacctctcttgcccactttcattgaagaaatggtgactgaatctgaatgtcaggaagggttgtgggttgtggatatggcaactgcaaaactgcagacaatagagatgtacactgcttttgtggtagggacaggatttgagcagtggaaaggcataaataagaaaaagagaaattaattcatgattaagacagattctggcataaagaaattgcagtagtagtagtagtagtagtagtagtagttagtgctgaataccgtatctattttctttcatcagaatctgctggttccatttcatagttcagaggtctcacaaattcaggcaatattcacagctgtggacatagtaacttaggcatattttgcattattaaacgattgatgctatctttaaatttaggttgcaacataacatacatgaaatctgataccaagtcttcacattggcaactagatgggcattgaacacaaaactagaaattgttttatttttataaaatatttaataagatttaattaaagtgtcataaaaatccagctacattgaaatgtttgatttaaatgttttttattagctaacccattcttcattttgctttttaaattctaatgtataattttgaatattgtgcaagaaatatgactttcttaaaaacattaaaaattaattttaattttttcaatgtataattaatttatatgcttgaggaaaatatattcaaattgtatacattttaaatacaaatgcagtttaatttctaattctttagatcagggatcagcaaactttttctgtaaagaaccagacagtaaacattttgggctgttacaacgactcttctctgtcactgccctagcacaaaaggaatcacagacaatgcataagtgaatgggagtggctagagttggccctggggccttagtttgcagatccctgtattagatcataactgccaatagacaaaaagtatcttaaaaaaaaaccccttgattataacaacatgacaattttactgaaatgaagatgagaaaaaataacttaattggaataaatatataataatttaagaaatatttcagtcttttaaaaaactcactaaaatgtcatcagcccaataacagaacatgtacaataataatcaagagctgttgtctttgatatttggtcaattttcaatcacgtaaaaactagggcttcacctatacatttagattttgtccttaaaaaagttatctcatggcagaggataaaaaacacttctttaatggcttactagctggatttgttaatttttaaatatttagacagatggtatatggcctcctttttgccctgggccccataaaccttagatgtaggcctgaatacaacagtgatcaagagacaaaggccctactgtcttgaattacagtctagtaaattctagtgcacatccattgactctaatttagaccagtcaatcatctattctcacatgcactactgcaatagctttttttttttttttttttgagactgagtcttgttctgttgcccaggctggagtgcagtggcatgttcttggctcactgcaacctcctcctcccaggttcaagtgattcttgtgcatcagcctctcaagtagctgggatcacaggtgtgcaccaccacgccctgctagtttttgtatttttagtatagatgggatttcacccggcctcccaaaatgttgggattacaggtgtactgtacccactgtacccagcctgcaataggttttttattgctctctctatatctattcttgccctcaccaacctattttccacataacaaattaatatgttaaaaacataaactatcacctctttcctaaaagctcttcaattgttttccattacattccagattaaatccaaagtcttttatgattagtattattatttttgagacagagtttcgctcttgttgcccaggctagagtgcaatggcgcaatctcggctcactgcaacctctacctcccaggttcaagcgattctcctgcctcagcctcccacgtagctgggatcacaggcatgtgccaccgtgcccagctaattttgtatttttagtagagacagggtttctccatgttggtcaggctggtctccaactctcgccctcaggtgatccacctgcctcagcctcccaaagtgctgggattacaggcatgagccactgcgcctggcccaaagtctttttttataacatatgaaatcttgttcttccctatcttccaactttatcttgtgcacttccttccttgcccagtattatctggccttttattgtacttctaacatattgaggcatttcttgcctcgggacctttgcacatgcaatcatctggctacagtgtttctcctttccctactcctttttcggggctacttttttcatttttacatctctgcttaaacattttcacctccaagaagacttgtaagtccattcagtctaacatatatgattcttgctatattctgtcactgcatcctgttcaatttccttcacagccataggaagaaaacctgtaattctatatatttatctgtttacttgtatatttcctattctgtaaactctttgagagccaggataatttttattttgtttatcacttccagtgcccacaatgcctggaaatcatacatactcaaaagatagttgttaaaaaagtaaatgaatatcaattcatttgttgaacaaataaatatgaaatggataggcacattctggacctatcgaaccattctagcatgaagcctttattcccagagtgatagcaatatcagggtccccccaactaatgattttcaagcccactcagatcctttattcatgctgtatttccaagctgaatttccttcccccacttctctctgccttctcaaatatttatttctttcactaattcaaacacacttctctcaacaagtctttggtacccttttcagccccaaataataggtcttgatttctacatttattatctgaatcattcactttagtatcatcttacggtgcctaattctttctaaatctaagttccttccatagtgtatgtagtagagaccatgtgcacttaatccagccagcagcatggagtggaaccccaaaacatattgatatcattggcagccttagcctgtgttccccatctgactcttacatcccactcaggaaagcagaccctaaacaaaggcttacaactaggtagtttattttgggaaaagaaccctagataatcaaattgaggaacgagggagagtaaaacaggggaaaagggtatcttaaatcagattccctagaagtacactctgaaatgggtacgcttgtacaagaaattgattgaaatagtgccctcaggagaaacctatggggaaatgagggagtaggatgggccagggaagaagccacggaaagatatggcttcagctggagtccagccatggcccaaacccagagtatggacaagagtatggagtatgaacagcaccacagagttattccccttgacagcttctgttagtccttggctgtggactgcccttgaccaggcataggggatcctctaaggtatttctggggaagttcatttccctcaatagagggttaattctcctgagatgagttcagctgtgagaccttagtatccaacactctaagcagctggggcatgggtgtgttgacccactaatggtggtcttggtaggggaccaacagcatcctctacagagggaaatacaatataagtatacattctcaagtcgataacaactacaggcacctagggctcaacctgctggaatcttccgagaaaacttacatgcttcagatgtatatgtataatgtgcttcagacatgtctaaacaaggcatggaagagattatttatccaccaactcccagtccccaccagtcaggggttattccgtgggttaataactctcttatacttccaggttgccagtctcactcccaaggtggtagaaaatagggatgaaaatagggatgcccaatgccacttaggcaagaggcttcaggtcacacttgccctaacctggtttccacagcgacagccctaatacagaaagggagacaagaggatgtgagatgtgtcacaggaagtgtccaatccactaactacttgccctagatctttggagaattaaataacctgtcctactgctatgcatgacagaagccctaccagtgggggctagttggccttcacattggctcctggccttctcattggctcatcttaggtgtcttgggctatctgcctgatacacattttcagttaggcacgtcatgtgaccttacagaccaaggttatgcaaaagagaaatgaaaattaacttattaatcttatgacagtattgggctctctgtatttttctcagggtccctgacactgatggtattatctcattctttggtgatgattatgtgtggaatgtttcatttaaaaattccagtgttgtctctcatgaaagcctgatacggtaggctctatatacatactggtgatgatcgtaatatgtgtgtagcacaaagtagtccctgaacaacatttttaatggcaaacagtgattccttcccccaacaaattaagtaaaaatgataaattcctacattgaaagaaatcggcaaaacagaacatttccttcaattcacataatcattaagaagtatcattcataaggggttagaaacatataatatccaaccttcctgtttaacagagcccagcaaggactcaaatgcacagttcattactgtcattatgagagaatttctgccaacaagttacagtcaggttactatcattcaatcatgttgctaataggactaatttcatggtaattggcatattctagaccagagaagaactcaaatggttgtggaatcattaatgatttatgctttcatggtaaaaatgacaatctattagtttaccagatgctggatcaagccatgggccattaacaggagggtgttctcagaacgttttcagaacaaataccagctactttattttcagcttgcagacataatcacatgcatcccctatcagatccaccactatactgtcagatacatcataaattaaaggctccatgggctcattattggctcttattcgtaaaagcaacacgttgccctggcaagacccaaaatattaaatgggcatttaaagaaactgcaaaatgtgtagttttggaaaaatgaaatcttccttaaaactatttacagtactcaagttttcaaaatgtccttcatcctcgattttgcctcaatatttgtttttttgttttttgttttttaataaaagcaaagaaaaaagaaacaaattcctgccctgtcaggaaagcttttaggccgagtctcttaggaactgggtgtcatttattagtaaacctaatatgctgccttcagaagaacagaggtgccagcatcaaataaacaggcttaaaaaaaaaaattccaggaaacttaatgtacactacgttagtaaccaggacaactcttgtttcccagcaatctatggcatagatacgttggtatgagataaagcctccatctttcctgaatcttcaaaacaaatgtaaagctgattaaaattcctcttctgtcttgcctatgtacaaggctgctctcccaataccaagcaatcctatttggagacaatgggatgtttgccaaaccaaaccgaaataaataaataaataaataaataggagagtttctgttttcaactgttgatggcatcacccttgccatttgtggtgatcagattatccacctagaaagtgtaagaaaacaagtcttccggttagcacttactgggcaaagggctgagtttcaagaatcacaactgaaatcggtggggttgctctttgttaatgggaaaaagcaccatgttaaagtgaccagggcctggtgtgtgcaccgcatgatctgtgagcatgagttgtgtgtgcaacatgcttcctcgtgattaccgcctatacggacagtcactgtgcattagtgcattggtagccagccgccgccaaaaacaggatggcattcttccatcgtgattagaggttttgtgagcattttgggatgggggacactttctcagtaaagactcttccgccccattcacgttcattcagctctttctaggggaaattaaaagctgcagtgataatcccttaaggacaacttggaagagtataaaaggtgcagtgtataagcaattggatgagaaagccttttatgtggaaagttactgaatgggtggctgagggtggtgtgagtggggagaaagaggggcagcttttcttttctaaggtggggagcagcggggatatcatggcacttcagttccctttaatcatccagattcctacgctgtccctgcccctggtgtcaccttgttttgcagtgccagctagctcctccctgccattttcccctcaaagagggagaggggagcaatgcgatttttggtaaggacccagtttctcgctgaatgccaactcagccagctggcaccgaacaggccaagccttcttcagaagaggttagcaaaatccaaattagcatggtccattttaaaaacttgcttttatttaaagactgattcatgacaaacagtggctcccgtactgaggtctggcaccccaggggctggcatccaaccaaacacatgcaactaattgccaccctcggatgacacgcaactaacaagctccattttgaggcagtagattcactaagaatgtaaccccggaaggcagcggaggcagaaaagctcctttcataaccctgtcctaggctaaccatggcagcagagagcctgaaaaacacttttgtttcattgcaccaacaatttagctccacggagggctacaaacacggctaacttgctgaaaagtgatcaagggcactgcgatccccctcatggttataggaggcaggggctctgcttttctctttgctcaaggaaacacacaaaattgcctactatcttgaaactccgcatcttgcaccatttgcaaatctatcgacccccagtacttccccttatactttagttcagatgctctcaggcttcctttgtacaagcaagggctctggagccaggatgcctaggttcaaatcccagctccaccattcattagtaattggcaagtattttaacccatctatgcctcagtttcttcatctataaagtggagagaatattagcacctacattactacgagtaggaacgagtcaatgtaataatgtacataggacaatgcctgacatatcatcactctgttatgaaagctctttgagtctgagatagctcggccttatgaagaaaaaatttccctttgcataagctgcattttagtcaaagttcttgcttccctgtaaacttctagagattcaacctctaagcctttgtttaccattctttctcctctcaactgtccttcctccattgcacagccctgtatgactaaatctcatcatcctccaaaaccattcttcaatgccacctcctccgaggagacttctctgccatcccagctgccatgaatccctgcactcttggcatggccatggcaatttctgcaaacaaatgactgtgttttacttgcctgttatatttccttttctagactgacagatccttttgagcataatccacgagtaactagcacatagtagatactcaatgaatatttggtaaagaagtagatggtcagatgaaagaattgctctgcataaatgagtagctttatactatggttatgctgggcattactcaataggcaggatgggggaatcgtttcttaaggactttcatagttgctttggcccaaattaagagttgtatttaacttgtcatcaactgaggctcataaataaaatctatcaaagaaatatgtcaattaccaccttagtcagcttgggctgccataacaaaacaccaaggattgtgtggcttaaacaacagaaatttatttctcacagttctagaggctgaaagtccaagatcatggtgtcagcagattctgtttctcctgaggcctctctccctggcttgcgtatggctgccttttcgttcaccatgtcacatggtctttcctctgtgtgcttcctcccctagtatctcctcttcttcttcttataagggcaccagttgcattggattaggtcccacccttatgacctcatttaacattaattacctttatttttatttttattttatttatttatttatttttgagatggagtctcgctctgtcacccaggctggagtgcagtggcgcaatctcggctcactgcaagctccgcctcctgggttcgtgccattctcctgccttagcctcccgaggagctgggactacaggcacccaccaccacacctggctaattttgtttttgtatttttggtagagatggggtttcaccgtgttagccaggatggtctcaatctcctcacctcgtgatctgcccacctcggcctcccaaagtgctgggattacaggtgtgagccaccgtgccctgcctacctttaaaggggtaattaaggttacctttaaaagttgtctccaaatacagtcacattagggattcaggcttcagtgtatcaattcaggggaatacaattcaggccatcacaatgacatatacatatagaagcatgaatattctgtatattacttaagtgcataggaggaacttaaccataggaagtccacaagcctttgctccttaagtcctggcatccagatcttcattatgttagcaaaagttcagacaatggaaacaaatgtggcactcaaatacacaactattttatctagatgaaaaattaagctttctttggaatttgtgggattcagttggggggctcagttgcttctctcttagaggcaggaaaacatcagcaccccaggcagcagccacaaccctgtctcctgttaaagccattgcctctcccaagaacaaatgcaaattcccagctaaactcctgtgcactttctaggaggaggctcactttggtccttctaggatcaatttatctgaatcttttcttttgaaggcggacctgcagctttatgtagccctgaaactctgaaccagcttctcatgccagcaccccttctttagtcacttcataattcaaattgctgttatcagcatacactatttgtactgatttgactttttcacattgttttaaatcactaatttcctattaggcagattcctcacatcaataccataagctaatggctcccatggtatttgttcatatctttctcttaagatacttaacactttttacctggtaggaggatgatttatagtcatatgtgtctttcttgccagaccttttaactacttaaggttagaattgcatcaaacccattgttttatcccaaccagtgcttaacatgatatggcacacgtagcagagtcacagtaaaagtttgctgtaattcacatagactttgccaggagtgcatagaaggattaagcatcagaagcaatgcaatcgcaaaggtatctcgtaccatcaaggggtgaggccaacatcttagaaaattaagatcaaatatcatccttcatttttaatttaaagcttctagccagttgacccagaaacatcccacacctccaccatgacttaccaatttgtctgaaataataaagaggaaaatgagaggctattagcgccacttccattctccagtcaatcattgttctaaattattaatcagttgaagtattgccaagaaattttcaggcctctctccaaaagtgtaaagtagtcattttcaagtgaacaattaactattttattcatctagaagttgtagaatttatagacaagctgatttctgtggattttcttccccccttttggatgctggtggaggtaagagaggtctacatgaactacaaatagtttcctttccatcactcacttattaataactagaatcctgtttaaaaggaatgtactaaaatattttctaggctgaagcaggaggattgcttgaacccaggagtttgagactagcctgggcaacatagggacaccctgtctctacaaaaaaaaagaaaaaaaaaaagaaattaaattagctgggtatggtggcatgtgcctgtggccttaactacttatgaagctgaggtgggaggacgccagagcccgggaggtagaggctacagtgagccatgattgtgccactgcaccccagcctgggcagcaaagagatactctgtctcaaaaataaagtaaaataaaatatttcctgaccagttcagcatttataatattgttcctaatagcatgccactcctgactgatcattgctggcaaaagcaaagtgatcgattgtcaccaccctgtttgtccccaggattaacttggtaaagaagtacagccatggtttctgctttcgtggagcttacattctagaggagacagtgaaaaagaaaggtaaatagacaaatgaaacaactacagcaaattttactaaaaaaaaaataaaataaaaaaaggaaaaaagaggctaagataaagaaaggggaggtgtaccttaaataagatgtcgataaagacctcactagcaggaatcatcctccgtggatcaggagaatcctgaaactggggacctcataggcagtccaatccaaagtgtgaataggccatgaacatttttaaaactatatattcagttctggtcatctattgacctcagagacactagatttccagtggcatccactactatgactgcaattgctgaggggtaattttctgagccagagttgtagcatgcaatttgccttgtcattctcatctgatgctcattaatagtcccaacttttatgtaaggtatgtgctttcaaaggtagtgtgatatgtggctaaaaatattgatttttttcttttacacttttgtttcttttaaaaggaggaaaagtgagcactaatttttttatttcaactgtatcttttgaaggttcattatgcatatattttgataatcttgtctatgagaatgaaccctaggacaattaaatatcctttaattttgagatgtgtagtctggaaatacctacatggccgtcctaggctttaggttcattttctttgagaggctcaaccccatattatatcagatatatttacaggtcaaaaggcaagattgaaacaaatttagtttaaagatcttaactggcttttatttgtgattctagaatcagacaaaacctcactgtataaaaaagaatgagtgttccaatgagctgagcagaggaggtttcctttacagctggaaaagggatgaagaaagcagaaacaaagaaccaaaagcaaattggttgtttccaagttactttccttgtaaaggttaaagcagagggacatccttatcatattggctacaactggtctagttgaggatttggctactagttctcccccctgatttcttagaaggtcagatgaaaaacttggttttggcttggtggccaaaacttcagcatgagtaattctattttggtttggactgttgagcttggttcagtagttcagtccaaaccaatggacttctataaattttattcaacatacacgaaacagtttttgtatgtgagatctgtgaaaaatatttttatacttttgcatttaaaattatttgcttatgtataatttggttaatttaattttttaaattgcctaaaatttcccagtaatcaacatgcagtttcaggaattcttaagaactgagaaaagctaactcataaaatgtctctaagagtagacattttaataactattacatttagtaattaatcacaatagcataaaatttcatttattgacatatcattaaatatgacattgttcagattgtgcaatttctgcatacactgaaatcaaagtagtttttctctctctgttagttctgaatattttcataggcccttgaaaaatacattggccctagtcattagttcctggtacctaaagattaaagaggcaatagaatatgtgtgtattcccaggtcttacatggcactagatagtgggggtcttttccccctaaataaagtggatgctattataaccatgcatgactccagttagacccagatgaatgtaccaaaatcactaccatttaaaaagcataaaaaaccttgccctcaatttactgtgatttgcaaactctcctctgaagtttcactgaaccccacttataaatatcatcttgcttctttagcaaattctcaaaccttagtacataagaatcacccagagctcttattaaaaacagattcctgggccctgaccccaaagaatcttatttaatagatctaagtggagcccagaaatcagagtttttaaccttctgaaaccttaaaggttgtataagcctttagaaaacattagttgatgtgagcagggttgatgataacagctggtaagattagtcttgacttgagctactgaacaactcaagtccatttaggctagtctctctcaaccctggctcatactagaatcccctggggcttttaaagcactttacccccaaggattctgatttcttctgtatgggcattggtattttttaaagctaccatataaacaaattgagaaaccctaccagcctaagggcatttctgtcagaaaggattaacccacacactgcggtgatgataaggcctaacactcctacaaaatgcaaacactgaagcagagatttcgcaagactaaaatccatctggagctcttgattcccagtttgtgtcagcctcaacacacccaagttggccttaacagttatggcacaagaaaatgagcccttccctttagttttcatcagctggcagaatgatttagtagctctattataaaagcaactccattataattacagtgtttgaattataaacaaaacaagaaaaatacagaaggaatagtcctttagtcaaaactgtaaaacagaacaatttctggctgcagttaaaagcaaactgaaatattaagagtaagctctccagccctttgattcttgcctctttcccataggagcgacactacacattttttcaattaagcagtttgacaacctgaagaaacccacagtgcatgatttaatgagcatatactgtgtgcatggtaatcggcaagctgacagtttgctcatttcaaactgacaagagagcactacacattagtagaaaggtttcttgggtctcttttcattaaataagctttacagttgaggaacattccaactgtattggcaaagctgtcactaatggtccccaggcaaccttaactctctgtcactctccaagtcctcaagtcttgatgaagaaattgcttcttaaaaaacaaagcacaaaaacaaaatatagatatttaaagttctctggatgttgtcaggggcaaggtggagctttctgagccatgaatccactggtgatttcacagtacatgaattctaacccagtatgtgctggttcttcatgcagatcactttataaactggaattgtttttagaaataatgcccaaactgttaaattattcaatagtttagaaatgattcagtgtactggaaaaaacataggccttggtgacagagagataggggttcgaattctgactaaaatacttctctgtggccttggtcaaattacatcatttctcaggggctcagtttcctaatttatgaaacatggacaataacatctgctttgtatgaacaagatcgtaaaagtctttcgcacagttactgacaacacaggcatacttaaatagagactagtttacccacagaaattcagagtatggggttttaacaaagctaactatagtctgactgtcctgagatttctaccatgagcctttattggagttctataagaagaaaaacagtaagctaacattcactcacaaatgggattttatttaatcctactaagattctgaattttgggtgttattacacctgtttttataaaatctcgaaataagaagggttcttagaggtcatatgaggaatttctgacattttaacttttctgattacaagaatatgaaactactgtttccctctttgctctgcttgtcagaaaactcgagtgaattctcatgctaaatgtatgtttgcaactctgttagcagtagcggttagcagatttgtttcctgattttctatacatatgttagtaaccttacttaaaatagtttataagctaccctgaaggaagttgagatttcttagctaactagtaagatccataacaagaatccatgtcacctgactccaggctaggacacctcacatataacatggaaatgacatagaaaaccccagaagcaagtacagtgaagccatagcttattgcttgggtcctatgccatgaagatgatcaaacatattagccttctagttacgaggaaaaaatatggaagcttcagggtccttatttctaaaatagggataatatatatttctaagatcattgtaaagatttagagagaatattttcaaaatcagccagtgtggcattcgatacatagtaacattttaaaagtctgaaatgttgactctaagaaataattgtagttctactaattacaagtaaaacacaaatgcatagacccttaaacatgatttagaaatcatttatccctccaaacttcacgcactgatgtaaaattctgccccaggctaggtgaagatccatacttgctgtctttctctcatgtcacagagtacatggagatctggaaaagttgtccataaattccaaattcttaatataaacatgtctattggaaatacagactcttttttttttttttttgagacagagtctggctgttgttgctcagtggagtcatcttggctcactgcaacctctgcttcctggagtccagtgattcttttgcctcagcctcccaagcagctcagattcccaagcagcatcatgcctggctaatttttgtatttttagtagagatggagtttcatcgtgttgcccaagctggtctcgaactcctggcctcaagaaatccacccactttggcctcccaaagtgggattacaggcatgagccactgtgcccaaccagaagtacagaactttatcaagaatacacacatgtgacattttcaggtttaataatttatacttcagggtactcacaaaactgggccaaaatcatggtctacctctatgtgaaataccaagtttccctatgtctcacagccatgactccactggtgacttcacagtacacgaattctaacccataaattgactatatccagaatgtagccagacataccataaagatgttcatttatcttcaagggagtccacaaaaatagcactgtagttcctcatatgcataccctaacaaaaatgagtcagtggtgtttccccagagaaaaacgatgctgtgcagtggaagcagctttggaaacagacagattcagatttgaaggctggctctgctatccattagttgtatgacattggacaacatagtatgaacctcttagagccatagattcttccactggcaaatggaggaaacactttgaacttatataactattgtaagcaggggttatgttatgatttaaatgtcccctccaaaaattatgttaaaatttaactgccattgtcatggtatggagaagagggaccatcaagaggtgggaccactgagagatgattaggtcttgagagctctaccttcataaatggattaacatcattatgaagaaagtaggtttgttatcatgagtgagttattataaaaatgagtttggccctctcattggctcattttcattttctcctgcccttctgcttgcctccatgggatgacaagcacaaaggccctcaccagatgccagcaccttgctgttgtacttcccaacttccagaaccatgaaccaaataaatttattttcttttaataaattgcccaatctcgggtattctgttatagcagaaacaaaatggactaagacaaatgatatttaaaatatttaaccattagtatggtaaaggcaccaaccagcataggcttaatgcctgttctggtgcatactaattaaatatgaactccatttgaagaattttgaaggcatccaacttgatcctagatcatgggaggtgcttaaacatatacaacgcattaaatgaagcaaacacgtgttgtaaaacattacaataaaaaacttagcagcagttatactgagatctctatactctccaattacattttttcacctgtgttgtttttattccatgattttattaaatgattgttagcttaaagtgatgagccacttgcgtcttttgactcatgattgagacagtcgtcaaaaaattctagatttgaaaagacataaagtgatctcacttggaattttatcaagtctatattcatgtataatccttatgtcttcttaatttaatgactcctttattatgacacactcttcttctttatctctgataatattttttgtcttaaagttgagtttgtctgatattattatagccactctagacttcctatgctgtttccatggtgtatttatttccatcaatttattttaaacctatctgtgtttttttatttaaaggctatctcttaacagaacatagctgttcttgcttttttatacattctaatcatctcagcatttttttgaatatttatttatttttgtttgtttggtttctttgcccacaaaacttattcattttgtcaatcatttgaaagtagcttgcattcataaagcccttgggcttaggtctttttaaaaaaaattcattcatctgtttttatgtgtttattttttcaagtttcattttagattcagggggtatatttgcatgtttcttacctgggtatattgcatcatgctgaggtttgggatatgaatggtagcattacccaggtactgagcatagtactcaccatttggtttttcaaccttttcccctctcccttcttccctgctctagtagtccccagtgtctattgttaccatcttcacgtccacacgtacccaaagtttagttcctacttacaagtgagaacatgtggcatttagttttctgttcctgcattaaattgctaggataatggtgtctggctgcatccacgtggctgcaaaggacatgattcgattcttttttattactgcataatatcccatgatatacatgtaccaaattttctttatctgatccaccattgatgggcacctaggttgagtccatatctttgctattgtgaatagtgctgtgacaatgaacatgcaagtacatgtgtctttggtagaatgatttgttttcttttggatctatacacagtaatggaatcgctggatcgaatggtagttctgttttaagttctttgggaaatcaccaaactgctttccacagtggccgaactaatttacattcccaccaacagtgtataagcattcctgtttctcagcagcctcaccaacatgtggtttttttttgtttgtttagttttgttttgtttttgttgttttttttttttttactttagccattctgactggtgtgagatggtatctcatggtggttttgatttgtatttctctgatgattagggacaatgagcattttttcatgtttgttggccacttgtatgtctgtctccctttgagaagtttctgttcatgtcttttgcccactttttaatggggttggtttttgcttgttcaatcatttaagttccttatagactccagatattagacctttagtggttgtgtaatttgtgaatattttctgtcatcctgtaggttgtttactctgttgacagtttcttttgctgtgcagaagctctctggtttgattagtctcacttgtcaatttttggttttgttgcaattgcttttgaggacttagtcataaattctttcccaaggctgatgtccagaatggtgtttcctaggttttcctctaggattctcatactttgagttcttacatttaaatctttactccatatggagttagctttgtatatggtgaaatgtaggggtccagtttcattcttctgtatatggctagccagttatcccagcgccatttattaaataaggaaacctttctccattgcttttgttaactttgttgaagatcagatggttgtaagtgtgcagctttatttctgggttctctagtctgttccattggtttctgtgtctgtcttgtaccagtactatactggtttggttactgtagccttgtagtatagcttggagttggaaaatgtgtgcctccagctttgttctttttgtttaagtttgctttggctattcagtctcttttttgattccacatgtactttataatagttttttccagttctgtgaaatatggtagagtagttttataaactacctgtataaaacctgtagattattttgggcagtatggccacattaatgaaattgattcttccaatccatgagcatggaatgtttttccatctgtttgtgtcttctatgatttcttttagcagtgttttgtggttccccttgtagatatatttcatctccttggttagatgtattcctaagtattttatatacttctattttttcaggctattgtaaatgagatttccttcttgatttggctcgcaagttgaacattattggtgtacagaaatgctactgatttctatacattgatttaatgacctgaaactttactgaagttgtttctgagttctaggaggcttttggtggcgtctttgagttttttaggaatagaatcatattgtctgcaaagagagatagtttgatttcttcttttcctattaagatgcattttatttctttctcttgcctgattgctgtggctagcacttccagtactatgttgaataggagtagtaagagtgggcatctttgtcttgttccagttcgcaagggtaatgctttcagtttttgcccattcagtatgatattggctgtggttttatcatagatggctcttattatttagaggtatgttcttcagtgcctactttcttgaagttttttatcatgaagggatgttggattatagcaaaagctttttctacatctagtgagatgattctaaggctttttaaaaatcctatttatgtggtgaatcacatttgtatttgctcatgttggaccaaatttgcatgccagaatgaagcctacttgatcatagtaaattaaccttttgatgtgctgttgaatttggtttgctggtattatgttcaggatttttgcctctatgttcatcagggatattggcctgttgatttctttttttttattgtgtgtttgtcaggtttggtatcagggtgatgcacagaatgagtttgggaggagttgctcctcttcaattttttggaatagttcagtagaattgtaccagctcttctttgtacatcaggtagaattttgctatgacactgctacattttaattagtgattagtccactgacatttagtctgattactgatatgattgcatttagagctgcaagtttattatatgttttctgtttgctcctccacttcttgtttttctttttcttccctctgcaacttttggatcatttttttcttaatttaggattctattttatctttggattttcggtggtttttctaggaattaaaacgtatattcttgatctttcacagtctacttagatttaattttatactatctcatataaaattggaaaaccttgcaactgtataaatccatttgccactgcctccattctttatgctataaagtcatatggattacatctgtacatattacattataaacaccacaagacaatgttataatttttgctttaacaggtcctgtgtagttaaagatcttatcatgaaaaactagtcttttatatttacaatttccaaaattttttcattccttcttgaagacttaagattccatctggtgttatctcactttatagcctgaacaatctttcctttagcatttctgtggggcaggtctgctgataataaatgctcttagtttccttttatctgaaaatgtactaatttgcctttactcacaaaggatatttttgctacacatagaattccggattaacagtgttttgcttttttttttacccctcgtttgtactttaaaaacatcatttcactttttctggcctttataaattctgatgagaagtcatcgttcatttaaagcattgttccaccaaagataccgtgccatttttctctggctactatcaagattctctctttattgctggtcctcaccagttggaatatgatgtacctatgcacagttttcttcaaatgtatcccatttggggttcactgcatttcttgatctatgcatttatgtatttcaccaaatttgaaaatttgggcccattatttcttcaaatattttgttctgtttcattctctttctcttctccttctgagactccaattacatgtaagctagacattttaatttctgttacacaggtccctgagtctctgtttattttttttattcagtcattttaagtctttttttctgtctgttcttccaaaagaaaatttctatggatctatctttaagttcactaacactttcctttgtttcctccagttgctgtaagtatactcaatgagtttttatttcaaatactgtatttttcagtttcaggatttctatttggttctttttgcagtttctgtttactaccttcttattcattatgagtttattttcctattatttgtggagcatggttaaaatagccactttaaaatctttgttaattcccacatttggctcatcttggaattggtctcagataattgctttttgtcttcagaatgagtcacattttattgggtttccatatagcgtgtaatttggggttgtatgatatgcaagtattgatgttattgtatgaagagcttcaatcctgttatagttttctgaagggtattgatttatttgttttagcaggcaattagttatactcaaatttaaaactatcccctgggtagcagctcgaatctcagttcagttcttttatctttgtgataatttgtgtctgctccatcaagaatatacacatgacatatacctcagaattacatgacgtgatctcacttggaattttatcaagtgcatattcatctacaattcttacttcttcttaatataatgatttactatcatgaaatgttctccttcatctctggtaactctttttgtctgaaagtttagtttgtctcatattaataaattcaagggtcaaccagaaatttgggtagtgtttatatacagatttgggagcttcccctctctgcctctcttctttccaagattctgaattcattttcctgtggctatgattgccctgaaccctgttctttgggtcttcaaaccaaaaacactgtgagttttctattggaggatggccacccgaagtgacattaattttagcctgttctcactctaaaagttgtaaaatgggaaactcactctggaccgacctgtgcttccaagttttgaatttcagctcccctccagaatctgtctgcttaattttattctctaatgcttccaggtaatttcttttttcttttcttttttttttttttgtttttggtcttttggtactttatagttgatatctgtgagaatttcggatccagtagaacttacttagccatattggaaatggaaacaagtaaaaacatttaggaaacattcctttgcatttcctaacacctctcctcaaaatacttaacctccgtccattccctcatttagtgacatttgagtttggttttaagtagaaatagaagccaggctcagggcttccttgatcatcttgccaagtacatgagaagacttggaatgaaaacacagcataaagttaaatgatagaatgatagaacatcaatcaattctagctcttagactggtggcatttaatctcaaagcaatgaggcttatacagaatcatgactaccagtgattatctacatggtactttgccacgttattttaccttatttctttggtctcagatatctctaaatcctgcctcattgaaaactgcaatagataatatgccacgagaaacagaatactgaaaatcctaaaatgccaacccagagttggtaattgcacaattccttctaatcataatcattatggcttccacttcttgaaagcttctgtataccagccaccttgctaaccactttacattaattgtcagttaatccttcacaactattctttgagcagttcccataactagcttcattttacggaggaagtaaccagagttccgagaggttgagttcactaagagcacacagcaaacagtagaactctgagtcagtctttgtaaagagaagaaatagcaaaggggttttggagacatcaggcacatactctttactattaggagagaagatagaagtctttctaggagtaagtagggtttctaaaacttaaatagtctacagtcctttttgtcagtaattattgatattaaaatgccacccttccagaaacaatatattttatattgacagcttttatgtttaaaaagaaccttctagccgggagtgatggctcacacctgtaatccctgcactttgggtggctgaggtgggtggatcacttgaggtcaggggttcaagaccagcctggccaacacggtaaaaccccatctctactaaaaatacaaaaattaggtgggcctggtggcgggcacttgtaatcccagctacttgggaggctgaggcacaaaaattgcttaaacccaggaggtagaggttgcggttagctgagatcacaccattgtactccagcctgggcgacagcgagactccatttcaaaaaagaaagccctccttcagggcttaaaacactaacccaaacaataacaaaaggatcaaataattatatgtaaaggctcatatgaaaaggcacataacaccagtgctccattttacctcatttcatttactgcctttaaactttgttttccaggtaaaccatctaaacaggcaggtgacctgccagagaaaaatctggcacattaggaagtaaagatgcctgcctcatcccacaacaagatgcagcaatgtctcacagttctacaactctaggggcaatcctgcccaactttgcaaattttgcataaaccatgggtttcaagtgactttggaatgagagggaaagggaaggcagcacgaaggataagctggctgacattgtaaagtggatacaggaaactgggacttaaccggaagcaggaaaaggaatatagtatctttgtgttctggtacataggattattcaatatacatatttattatacatgttaaattgtctgagacccggaaatgagagatactgttaaaggagtaaagatgagatgaggtaacagaaaaggagaggagtaaatatgagtcctaaggaggggttacatgagcacagtcccctgacgacatgctagagattaccagattagtgcattgctcctactttcttgctattattattattattattatgggttttttttggcagggtctcactctgtcgcctaggctggagtgcaatggcatgatcttagctcactgcaacctccacctcccgggttcaagtgattctcctgcctcagcctcctgagtagctgggattacagacacctgctaccacatccggctaatttttgtatttttggtagagatgaggtttcaccatgttggccaggctggtctcaaactcctgacctcaagtgatccacctacctcggcctcccaaagtactgggattacaggccctttcctgctgtttttaaaaatacatattcaacatatccggtgaaatcattcaaagatgcatacagataagtgattattttactctaacgtaaagcctctttgtaagacctacccttcactgtctgtcccagcatatgccctaggacttcctctgaccatgaacagtaccatgccactgaaggagatctgtttcaacagagcctcctcctgctgctcctaactttatttccattccactagcttctcaaagtcatgcaaaacataacaacctgactttgtaactgtttaaccttactttttacacgtaaaaattattaaatatgtgtaactgctggggggaggataatataatggcatgtcagtcaggtaacaggtaagctacatttcatggaaaagaaggggaatgctttcttcagaaagtgaagtcatcattcttttatttaactgacataatatttataccccaatttttaaaatggcagctacaaatagaagtcgaaagagggtaaattctccaagggaatctagccctgaaattttaccattttaaaagttctattttacaagtacataggaacattactactattataaggatactcacagcaggtcaattatttcaaactctttgaaaaaaaaatcaaaattaagtaaacctacctttcagaagactgctacctcttcggagtcctcagtggcaggatgcacagagcttttatagagggtctaagcaggcaggtattcctaggatacctacaccaaggacaagaaattcagatgattatttcagcagtgatccagatggctctaggtacaatttcattaggaacgttcaccatgaatactgagcattgccacacaggtactgttaaaagcgcagaatgaaggtacatatgtgatttttgcaggcattgtcattaatctgtacattggagactgtggctcaaaagggtgtaagtggttcatacatgatcacacaagaaaaggggcagaaccatgccttaattattcatttctgattcctagtccagggttgtttcagccacatcatctgatcctcctcaagaactggaaagtcctggcactggggctttccattttgcaaaaagatgaggctgacccgtgagtctggtgggaagagtctttctctggttttctggtggtctatgccaagtcacctgtctgaagtgtcctgtgtggccagtttactcactttcccttgaaactctggtgtccacagaatctgaaggaatctgacaagcaaagaaacatgggtttttttggtcccactggcctgagtttgaatcctagtaatgtgtttactacttctgtgtcctatgtagctgctcaacatcactgaggctcactttctatctctatcaaacgggtataataatatttgaagggtacatttatgaagaggattttttttttctaaatgagaataaagtatcaagtacagtttctggcacatgttagatgctagggcaaagtgaaagccccatgacccaccttacttgcagggataaccccaaagtggacaagtgacagggaggctattgagaccttgctgctcataaatcactcaatgacaatgcactaatcccctaactggctggttcctcactgctctgacctctacctctgggtttccttcatgtacacttctttgaaataaaaatatcataaacaccaattcattccctaggatctcatttagaggtaatcgtttccttttttaatctaataatcttggtctacatcatgttacatggtcagctcaatgtagtaattgaaagcagatgatcattcatttaacaagtatttattgagactctactaaggtgtcaggcactattctctatagcagtggacataatagtccaagatcaggccatcatgctgcctaccttctggtagaggagacaaacaaacaaaatacatatgtaaaatacatgagtggttaaatagttctaaggactctggagaaacacaaagtaggaagggagatggtgagtactatgggttgaattctgttcccccaacccctccccatcaggaaaaaagatatgttgaagtcctaaccctcagtacttagaatgtgaccttatttggtaataggattgatacagatataattatttaagttaagatgaagtcatactggagatcggtgggcaggcctctcatccaatatgattggatataagaggatgaccacgtgaagacacagagacacaggggagaaggaacgccatgtgagaataaaggcagagattggagttacatagctgcaagccaaggattgccagcaaatcactagaagttaggaaaaggcaaagaaagattcccctgcagatttcagagggagcatggccctggtgacactttgatttcagacttgtagcctccagaactatgagacaataaatttcggttgttttaagccactcagtatatggtacttagttactgccaccctaggaaatcaatacagtgtgtttggggagattgttgcatttttgagcaaggagatcaggaaagatctcactgaaaaggtaatgtctcagggaagatttgaggtgcaggggacaaccatgatgatggctctggatgaagaaattctaggcagagggaacagaaagtacaaacctcccaggcaggtgcatgtttgtatgttagaacagcagggaggccagtatggctggaatagccaggggagagtggcaggaaaccaggtcagagtgatgacaaggagctggagggtgctagaccttatgggccactctaagaacttaggcttttacttggagcaaggtgggaagccattgcctacttctgagcagaggtgaaccaagatctgacttacattttaataagctctctctggctattcggtaagaataaactgaagaacaaggccacttaggaggctcctgcagttatcctggtgaataaaggtgctagccaggtagcacacaggagagtgaaaactggtcagtcctatgcgaaatattttgaaagcagatccaaaaggatttgcaatagattgcaggtagagatacgcctgacttcttgatagtacatagaattaaattagaaaccgtaacaacttaactgtactgatcatctgaataaattatcttctcaaatgccagaccagccaaagatattagcaacaggtttaacagacagggaataagtaaccagaatatataaggaactcctaaaatcaacaaaaagaaaaaggtaaacaaataaatattttttaaaatcatgattcaaagaaggaacaatggaccatggacataagaaaagcagctcaacctcactgatatggtttggctgtgtccccacccaagtctcaccttgaattgtaactcccacaattcccatgtgtcatgggaggaacctggtgggaggtaattgaatcatgggggtgggtctctcccatgctgttctcatgagagtgaataagtctcgagagatctgatggtttaaaacatgggagtctctctgcacaagctctctatttgtctgctgccatccctgtaagatgtgacttgctcctccttgccttccaccatgattgtgaggccaccccagctacacggaactgtaagtccattaaacttctttctgttgtaaattgcccaatctccagtatgtctttatcagcagcatgaaaactgactaatactctcactaaacatgaggaaaatgcaaatgaaaataatgggattctactttatttctatcagactagttaacatgaaaaagactgacacaattcagtgttgtccaagatatgagaaaaaatagcatattattctagtttacttccagcggaatcatgaattggtatattattctattgagcaattttactgtattatcaaaagtgacagtacacatatgccacggcatagtaactcttcttggggggtataccagggctaagaaacatacacataaggggacatatattaaatcagtataacaaaacttggaaatgacctaaaagtcacccttaaaggcaaatcagtaaataaaatatgctatatttatatgattaaaggacatatggctgttaaaaagaatagattggttttataggcatcagtgtggatgtttcataaatgtcatgggcagaaaagcaacacaaaggaaaatgttaacatacaaacacaatagtatgtattcattgtaggtcggggtccccaaccgccaggcggcagaccagtaccagtctgtggcctgttagggaccaggccacacagcaggaggtgagtggtgggcaagcgagcattaccgcctgagctccacctcctgtcagatcagcggggacattaggttctcataggagcaggaaccctagtgtgaactgtgcatgcgagggatctaggctgcctgctccttatgatgagaccctaacgcctgatgatctgaggtggaacagtttcatcccaaaaccataccccccacctccccatccatggaaaaattatcttccacaaaaccagtccctggtgccaaaaagttggggactgctgctgtggatacacatatatgtatgtaaaagtataaacaacggactagtcaaatacatcccaaatttatggtagggaattttaggcaggggtacaggcagcaaagaaagtggagggtggagggaaggacaggacattattggtgaaaatgatttggttttatcaataacttctttaaaaaggaaaaaaacaacactggaagcaaatctgaccaaacaaaaacagatactcgttttgggatagtgagagtacagatgatcattacactagtttttgtgctcatctgtgcttttttgttttctgcgagtaaagaaaggaggaaagggagggagggatgaatggatggaaggaaggaaggaaggaaggaaggaaggaaggaaggaaggaaggaaggaaagaaggaaggaagggagttaccagttctggactgcacttaagctaatcgctaatcatagatggggatagatgaggttagtttttttgttttgttttgttttgttttgttttgttttgagatggactttcacacttgttgcccaggctgaagtgcaatggcacaatctcggctcactgcaatctctgcctcccaggttcaagcgattctcctgcctcagcctcccaagtagctgggattataggcacgcgccactacgcctggctaattttgtatttttagtagagacggggtttctccatgttggtcaggctggtcgaggttagttttttaaggatgaaactcaaaactatgttttaataatcagcgtgaccattggtgattcctagcagactgtctcagcgtggagggctgaatttcagttcagcccgcagagggaaccatctgtcatttggaatgacaaggagctctctgccaggggaacaccagaacaccggaagcagccatggtcttcactgcatccccactggccctggaaccaccaacactacaggacacaggaacacacaaagtaaaccaagggtacaccatggacatcttttcaacctttttaaaagcacattgcaattttctagaatcaagggaacaatatgcttgattagttcttcagcagatttggcaattttgcttgtcatatttctctctttaaagcaagttggtcattaaccttccatgttctaggacttgagattaggttttccccccacaaaatgaaaactttgcttaaaaaaaaaagagtttgctttaggataattcatttttgctgctaataactgcaagatcctctttgagccaaggaggtcattcttgaaaggggctagaattgtgaagaatgttccttctcttcctggagagagagtctgtgaaggcaaaaaagtttgcaggaaagttcagtaatcatgaagtgaaagcccaaagtgacctgaatacttcctcctgggtcaatattgtatgtttaaaaagaaacaaccaaaccttcaaagaaaaatctggccatccccaaatcccaatacatgaaactagaaggcaggaggcaccagtagaatgctggctttgctctcattgcttggcctccatcacagttacaatagttgcatatcatccttttgtacgtgtcatcctaaaaatgggatttggattggtttctaacaataaaacgagcaaggtagaaaaggaatattatgaataagttaccaatgtaaatatgctattttgcgcctttgaatttgagtgttgataaacatgattccacacatggaaattagacttttcagagctactacactgaatcatttaatttgtctgagtaagtacttataataatgtggctgctctgcactgcaataaacatcgggttttcaaatgaacaaatgaagtatgtgatactccttataaatggaactgcagcaaagggcgttcagctagggagctgtgcactaaaatgggatgggtgataagaacatctctctccagctccactgatagtgaaaggaaagaatcatatggcctctgctgctacattttctgttcctggacagaagcaaggctgaagcctcactgtgaaatgatgggggactgttgctattttgggttgtcacagggtaacttgtcacactactcaggacacatgaggacagataattctgttcctccagattgtggacttgagaatgctttagtaaaatagcacagggatatattttggatagtggttaaggacatgggtttgaatcctgggctctaccaaccaaataggtgcatgattgtacccaagtaatcatcagtcttctccatgctcattttcctatttggtaaaataaggataataactttggcttcctcattaagttattagggggattcagtgagataatttatgtaaagaacctggcacatgattagaattcaccttttttaacattatcattttaacattatcatcacatttttaacattatcattcaccttttttaacattaacataaccattttaacattatcattatatatgtcatcattattattatatttaaccttactttcattttaatccattattcaattttccttcaacgctcattaaaagcacaactcactacattgtttagtaattaattacttttgttcatttaacaaagtatttatactttgttatatgtgccaggcacatatgctaggggctagggtacataggtgatctaatcctcctggaagctattagaggagatgggcatgagtcaaaggctcccataggaagtgaaacctttgaaactcagggaacaggtctaaaagaaaggagcaggctaggcatggtggctcatgcctgtaatcccagcacgttgggaggtgaggtgagttgatcacctgaggtcaggagtttgagaccagcctgaccaacatggcaaaaacccatctctactaaaaatacaaaaattagccaggcatggtggcgggtgcctgtaatcccagccacttgggagactgaggcaggagattcagttcaacccgggaggcagaggttgcagtgagccgagatggtgccactgaactccagcctgggcaacaaaagtgaaatgctgtctcaaaacaaacaaataaacaaacaaaaacaaaggagcagatcactctaagagatactaaaacaaaggaacttaaattaaacctgagacctgaaggatgagaaggagaacaagggatggaatgatggctttcttgagagaaacacaacaatattcaaaggcatggagtatacagcactttatcattgttatcaaaagtcattgcaaaatgatctactgaatagctcaattaaatctaacaactatgtgacaagcacctactatgagccaagcgcagtgccaaactctagaaacaccatagtaaagacagatatgatccatgcctgcatccttacctcccaacacctactactatgtttgaaaaccacaccaaagtcaatatttactttgtaaccaataaattacccctctgggtttgatcacagagagatttcacctgcatggaaaaactggaatgctttctctggtcagacaaggaatgttacatatgccaaataattccctttcttcttagttgctggatatctacaaccaaatttagtttattccatgggcctaccaacttatactactaaagatggccatgtttctctttcatgattaattgttctattatttgtagactacctttaatttagtaaacagcctcagcctcaaattatttggaaagttattagaagaggagaaaaaagtaaaagaaaacaaggaaaagagatctcaagtttcttgagatctgggaattgtccaatgtgctttctgtagtattcgtggtacctaacatggtgctggatggaaagcatttaataacttctgattgtcagatggatgaagaatataaagctttcctggttcaacttgggctccattagaaggagggaagaactgaaactcggtagatcagaatatgcctccccacaacatccttctttagcataaggattattttgagctgattattttgagagactgcagctacaggagaagatctgaaaacagaagagaagttacctttttgtaaaaggattttacatctataaaggaaatttctactcataagggtgtctccctttctataccaggaagagaaggatgaccaaatcactagagactcttaccaatggagaagacaccaacttaaatctgcataacaaaccttactcatgtttaccatacttttcctgggcatccctccacaactgactatcccccatacccttcttttttttctttcagtggacaatggtatttgagcctgatctcaaagccacctctttgagatttattcatatctctgggtatcttccacgtgtacatgagatacacatatttttaacttctgtttgtttttctcttgtttctgggtctatcccaacctaaggaccataaagggtaaagagaaaattatttttccttccctacacttacttttctctagtctccaggttcagaggaaagaactcaaaaaagtggctgaaaagtttagcatgattttcattgtaaagcagcccaataaccaaacagaagcaccacataaaccaaaagaagagagtggtaagtgaaatataaggtaccattagagatttctctcagggaataagattcttgtaacaaaatatttacctttcttattctggtgctagtaaaaataagagaaatgtcacaattttaattaatgtctaagcaacagggaaaaatattaagctactttatgacaaaatggaaatatatttgtaattctatatcctaatgttctctcagttattttggaaaaactattagtcctttggtctcttctacattaggagagcaaaaagctataatatggcctatctggctaactatcgggaatcggagaaatcaatttaaaagaaatttggaagacacctacattatcgatattagagcaaagtagagatctgccttgttcacagcaaagcaatccaattcacacacacacacacaaaacaaatgttgcatttatggaagtattaaaacatctcatccttgtccttagcttaacatattaatgagaatttctgaattaatctccaatcgtgaactgtgtctaggtgtgatataagggcagtaaatactgtgcagcttgcttcaggcatgttttatgacagattctctgacagatagaaaatctttaagattaaattatttctgtattttcctaagaaactcatcagtactaacaagcataccacttccccaactagttgataaacagaaaagaaaatattattaagtgatggcacttgaggaaatagttaaaaggagaaactcagaacataagattgtgattatatataatgaggagattctcaaaatggcacagaaaggaaaggaacgagttgaagctgaaaaacgtatgtttttaggaggtaagttattccataaagcaattactaaaatgtgagagttcttctcatggttctcaaccttatactctgaaagagaacttcttataatgcaagactaagagagccaattacttcagcaccaaggtacatcctaaatctctggacttggcagttcaaaaaaactcttggaaaatgttcttctaaaatcttcactaacagccctgactttagaaatgtagactctaaaaggatgaataaaaactaaccaattagatagcaaaatggagaagagagagcactgaataaaaagacctgccagagttcgggttgtacctctgccaccagcctcagacttagttcatatttacaataaaaccataatcataaaaattaataattatggaacacttagtatgccaagaacttttcatatattatctaatttaatcatcctaacaacctatgagggagacaccacataagagaaaagcagttgaagagtttgtccaagaccacccagctgctctgagtgatgggttaggattcaaacacgatttttttggaccccagagcccaacccttaaccactcactctgcagaatagttcagaaacctcctaggatgatctaaaaggcttctttcaacaatagggcgctaagatttatgagacatgattgtataatggaaaaaaatctcaggtttttgaagtgactttgtagcccagttgagcagcttcttctctaagcctcagaatcttagataacaacactacttaccttacaagctggcctaaggatcagagataatactagagcccttagccccaagtaataataataataataggcagcatttatataatgctcattatgtgctgggcaccatctaaacatttttttccccacattaaagtatgcaatcttcacaatgaccttaaaagtactattattttgtactttttatctaattgtataagaatacaattagataaaaagaaaaaaaaagagttctattgttttgattcctgttttaccaatgaggaaacagaggcaaagagagttaaattacttgacctaaatcacagttactaagttgcagatcttggattctgatccagacagaatgactcactggacaacccaaaacatattggaggcactcctactgatacataaagaacctccttgccatgcccaatgtctgtgtcactctcacccaaagtaacaaatttaacataaacttgggaggatgaaatacatagggatgcccagataacctgcctactgtcattccgcagattgtgcctttaaaaaaaccaatttcaatagaaaccagcaagaaagagatacatcaggtatgtcagacatacgtggtcacaactattttttctccttcctggctaatcactccctttgtgttgataatgtgctgctttaaatcaattcataaaaaaaaaaaaaagcacagaggcaccataaaagtcgtttttcctgttttcaatctggaagaaattcagtctcttattcattttaaaaactattttaataatagcttttacttaacccaatatatcaaaaatattatttcaacatgttaataaaagttaataagagattttacgctaagcattcaaaattcagagtttactttacatttaaggcccatctcaaatcagactaacctgattagtctgaatgctcagtagccatatatgttgctagtggctaccatattagacaacacagttctagaaagattggcttagaaaagccctggttgttgatatttataggtctctttccttgggctggtcaaattccccagaaagatatctttcaatctcctgccttaggggtataagcctgggtgccattgttctgagatttaagtatgggaaagagcagaagccccatcatattgtctttcacttaagccccgattttcatcattatacccatcctcagctatgcatggtgactccaatcacgagccctgtagttggtccaacccctccagtcttcctcctggggaagtagggagggaggcagttgggagaggcagttcccaggctatgcgggttgggcaagaactctggggactggttagcagttatttgtcattctttcaatgttcttttaatattccttcattcccactttcatacatttacagtgccatgaattcctgacacgttctagaatctcagtttagattttaccgtttctctccccttttaaatcagtccctggccttttaaggcagcttctacaattgtattctgtgaccttctcctctatgatttttgttcatattcccctccccttttttaactaacattttttatttgaaataattgtagactcacatgaaggttgtaagaaaaaatacagagaaggtccatatgccctttatccaattcccttcaatggtaacatcttggaaagctattacacagtaacacaaccaagatattgacaatgacacattcaaaacacagaatgtgtccatcccagggatcctcttgttgctctttaatagccacacccacttccctcccactccaccccttcttaacttttaaccacaaatctgtactccatttatataattttttcatttgaaaaatgttatacaagtggagtcgtacagtgtgtaatcttttggttttgtgtttttttcccctttaatctattccctgaagattcagtcaagtagtttcatgtattaataattcattgctgagtagtattcgatggtatggatggaccacagtttgcttaaccattcacccaataaaggacatctgagttgtgtccagtttggggctattacagataaagctctatgaaaattcatgtatgggctttggtgtgaacataagcttttgtttacttgggataaatgcccaggagtatgataagtgcatgtttaattttgtaagaaactgccaaaccattttctagagtggctataacattttacattctcaccagtaacacaatttctctgcatcctcaccagaatttgttgttatcattatcttttattttagttatttcaatatgttcatagtgataactcattgtggttttgatttgcatttccctgatggttaataatgttgaacatcttttcatgtgcttatttgccatctgcataacctcttcagtaaaatgtctggccatgtattttctaattgagttgcttggatttttttactgttgagtttgaaaattctttatatattctaaatactagtcctttgtcagatatgtagtttgcaaatattttcttccagcctgtagttattcttttcattctcttaaaagggtcttaggccgggcgtggtggctcacacctgtaataccagcatttgggaggccgaggagggtggatcttttgaggtcaggagtttgagacctggccaacacggcaaaagccagtctcaactaaaaagaaaaaaaaaatacaaaacttagccagccacagtggcatgcacctgtagtcccagctattccagagcctcaggcaggagaattgcttgaacctgggaggcagaagttgcagtgagccgagatcgtgccactgccctccagcttggggaactgagtgagacactgtctcaaaaaagaaaagaaaagaaaaaaaaaaaaaaaaaaactctttcacggtgcaaaagcaaaagttttaattctgatatagtccaatatatcaccaatatatcatttgtttcctgttatggattgtgtttatgtgaaatctaagaactctttccctagccagagattccaaagatttttctctaatgccttctccttctaaaagaagggttctttattctgttccgttgatctatgtttctgtcactccatggatagccacatagtaactatgcaatacttcttgaaactgggtagactgattgctcccactttattatttctttttcaaaattgttttagctactctagttcctttgtttctgtataaattttagaataatgtcatctatatatgaaaaaaatcatactgagatttttgataggaactgctttaaacctgtatatcaatttgggaagtatcggtatctttactacgctgtgactttcaaatcatgaacacaacatttttctccatttatttacatttttaaaatttatttcatcaacattatatagttttcaacaaacaagttttataaatgttttattggattcacataagtatttcatatttttgagctaaggcaaattgtactatatttttaaaatttgtgtccacagattcattgctagtataaagaaatacaattgataatttaaatgtctatctcatatcctgccaccttaatgaactcaattattagtttttcatttgtttgcttgagatagggtctcactctgccacccaggttggagtgcagtggcacacaggtattggcacaaacacaaccttctatagcctcaacctcctgagctccagccatcctcctgcctcagcctcctaagtagctgggatgacaggcatacaccaccaggcctggttcatttgttgttgttgaggagagatgaggtctctccatatttcccaggctggtcttgaactaggctccagcaatccacctgcctcggcctcccatcgtgttgggatgacagtcatcagtcactacacccagccacttactagttttaagagttggttttgtgttttttcgtctttgtagatcacttagtgttttctgtgtagaaaatcatgacatcagcaaatattaacagttttctttctttccatctgtatgcctttcatttccctttcttgccttattgcactgattagaacttcctgcactatgttgaataggagtggtggaaccagccttgcactgctggactagactccatttcgtcgtggtatattattcttttagcctgaatcctgtttgttaatattttgttcaggattgttgtgtctctatttatgacagttattggtatatatttctcttttttgcactgttttttctgtttttcatatctgagtaataccagcttcctaaaatgaattgcgaagtgttctctcctattttctggaagagactgtataaaactcctattaattattctttaaatgtttggtaaaattctccagtgaggccatctgggcctaaatatttattttcagggagtttttaaatgattaattcaatttttaatagttatgggcttttaaatattatctatttcatgataggtgaatggtaggaatttgtgtttttgaggaagtggcccatttcatctaagttatcaaatttatgtgtgtagagttgttcatggcatttctttattatccttttgatgtctacagggtcaatagtgatatctcctctttcattcctgatattgtaaccaaatgcaggtccagatgcccactgtttacagagtccagttaacaagagtgaggtctagtagaaagaaagtcattttactaaaaccagtaaaggggaaatggtcagattcccgcccaaagcaatcactttgattttgggggaaggcaggggtttaaaaagggaaaacttgataaggaaggcatgcaagaattgtactaagtataatatctgtgtgtcttgttctggtagctatcttgggtctcagtctacctggatggtgagtcaagacatctgggaatatctttacttcccctttattcctgaggatattttcacgggctgtaggacactgctttgattgttgattattatttcattcaggactttgaatgctttaagttcctgagcagccatggccaggtttttaactagccactttgaagtaatctctggaattttgcagctgggtctccaagcttattccgcctgtctcaagattagcccctggaacttctaagaaggcacagtaattagatactagtatatacttagacaaatgtgaagggagtatatatggtgaaaaagggagggacgtggagcctatttctaggctgaggaaaaggcttctgcagtttttcaaggttgtatcttgaaaaccaagagaagagaaaaaaatgttttaaaatgcatttggaagttaagttgcctagttacaatattggtaattggtgtcttttctcttttctttgtcagtcttgctagactgtcagttttattaaccttttcaaagaaccagctactcttgttttcctttgattaaagtttgcatgatacatcttttcccattattttactttcgtctattgttatattgaaagtgagcttctcatagacagaatatagttgggtcatattttttaaacaattctgctaatctcttccctgtattataagtggtatatttagaccatttaactttaatgtaattattgatattttagaatttacactgccattttattttttgtttattttctgtttgttctctttgtggttttctgttttctttgcccagacttcttataagctatttgaacactttttggaattctgttttgatttatctaaagtgtctttcagtgcatttctgtatataattttttaaaggtttctctaggtattactttatatatttataactaaacagtttactggtgtcatcattttaccagtttgagtaacatatagaaaccctatctccgcactttgcatccctttatcttccccatttataatataattattttaaatacttcctttacatgcatttacatccacatcagaatattgcaatttttgcttcaaacttcaaacacaattagagctctcaagagtacaaatgtttttgctatgtttttttcttcctttctgatgttgaagagatccatttttaattgtcttctttccaattagataactcttttcttttctttcgaggcagagtctcaccgtgtcatccaggctggagagtgcagtgatgcaattatgcaaattcttttagttttccggctgggcgtggtggctcacgcctgtaatcccagcactttgggaagccgaggcaggcggattgcctgagctcaggagttcgcgacgaacctgggcaacacggtgaaacccgtctctactaaaatacaaaaaattagccgggcgtggtggtgggcgcctgtagtcccagcgactcaggaggctgaggcaggagaatcgcttgaacccgggaggcagagcttgcagtgagtcgagatcgcgccaccgcactccagcctgggcgacagagcaagactccgtctcaaaaacaaaaacaaaaacaaacaaacaaacaaacaaaaaacacaaattctcttagttttccttcatctgataatatttttacttcccctttattcctgaggatattttcacaggcaataggatactggcttgactgttgattgttatctgcattcaggactttgaaagctttaagttcctgagtctcagcagaaactcaaaaataatacatgtaggaagagctaaaaaaatatacaataaaccggatcctatcgaatttaaatgtcaccaggctacaagaaactgattctggcagaaaaaataaacatgtgaaaaataattacaataatgtgtgataagtgcaaaaatgcaggtatgtacttgtcacgatgctgacacacagagagaatcagcactgcttgagagaatcagtgaaaacttctcagagatgtgtgaaccaggttctgaaagttaggtagtaaaaggacttcctgggtgaaggggaacccagcacgaaagccctgagaaaagcggaaaagatggtacatttgagaatctgtgagactgaatgcctggctgaggtatagaacacccattggaacaagcaagagatgcagtagaaaagacagctaagggaaggatgctgggctagagggcctcatcctctactaaggagtaaactttatcctgtgtaccacgaggagctaccgaacagacgaaaatggtgagtgtaatatttaaagcaatgattgctactataacactctttttaaagtagcttttccatgaattattaacattatctttagtctaatacgtatcaaaatttagtttatggactggtaggatgtgttaatggccaataaaagtaaaagactcagccgattccctgccttctacactccattttacacacactccatcctgcctgccgaatgacttcagtgtctctgtgaccagtgagtgaagcagcatgcaatgagatcatggctagatggcagcacattcagtgaagtgcttcagctttcctgttgcttctgattccctggcatttgtcagtgtctgtcaaaacattaacatttcttaatgtatattttgcattatttactaaatgaaaattttccaatgacagtggctgagaaaaaaaaatcagatttacatacagtatgtcaagttcacattcgatgccccagaaatgcccagtccccaaagacctctagggactgcagctcatttgttgtccctctccctctcccgtttattatgctgaccctctgcccagccacatagctcaccccacccccttagaagcatctagagttggctctagacatgaaatggaatagatttctgcatttacataactgctatcgcacttctggtgaaaagtagtttcagaaaaacacagaaaaaaataaacagaagaataaaaagtgtctatgtgataacataagggcttatttaactacgtctttatttcctttacagtccaactattttttttttaaaactgcatgccaccttcatgctgcctctcggaggggacttgatcttatttagacccggtggcgagggtccttcagctccgtgaggagctctctagcactcagtcctctttagaggaaagatatcttcagagcctaaaggccttgaaagaaatgacacatttttaaaaacagaaaaacaagcatgaaagtggcccatcagaaatgaaggtgtgaactagaatacaatagacagcgaggaaggagccaaaaatcctcacccaggcaggccaggatatatgcagatagggaggaaattgggaggcattcctttgctaataaagatgatttttcttctaattttcacatctttcatgatgtatcttttgttttttgttttctctctatgactgctgttctaaaataagtgggctttaagaatatgaactacagtccgcatgtttgccagccccatattctgcgatgaacttgacatgtgaatgaatcaattctgcagaggtgaaaagttattcctacaaagtccccagttttccttgtgagaaagatccctacttacctgtaaacttgttaattaaatgtcaaaggtttttatatcaaggacaataacacaagccaacctgggaatctgcttgtctgaaataggtaaagagtgtctgtgtttatttagaattgattgtacactttccttcattctctacatagattttattttctccccacattcttctttttctgtattgccttgagggctttctcttataattatgtgacaaattatatctgaattatgttcaaataagcaaggagactgaggttttctgttaaaaacatatggcctatcagtaatgaatgaagttttgcccatatcatgacatgactttattgaaggcaccatctcatatatgcagttttcaatgtggtgtctaacagatttgtgtaaaatgtctaaaattaagcaaatgcaattatatgagttagtatcatcttatcatgtacattttgcttgataatagaaaagcaaatgaaaagtttattagcttattacaacagtctgtttttgatttttactttagactctattcctctttattttctcctcttctgtttcgggtcattattttatctggagaacccaaaatccaattcttcatctgtatttaccacatagatctttagattctcttaccaatccaacagatttctgaatatttaactaccctattgtaagttgtcttgtttagaagaaatggaatctaagattgtggcagtaaaggacaagctgtcaatgtgttaaataaattcctgttgaaaagtaacggcatgcactgtgtgttaacataatttattagaacaattagaacccatccttgttgtcttttaattagattattccctgttctggtaattacactagacaagggagaataatagtcttgggattctaaaatcatctgtagactatgtggaaagagaataaataatcaataatgctaatgtaccggaaaacttaaattcccagaaagagatcttttatcatgagcaatcctttgtataaacagcattatttctcaatgtctatgcttatcttgcccaaagttgaaaagtgaagacactggacaaataacagatatttattttactgtcagaaacctggttgggctgggccacctctggcctctagtggctcagacattgcttcagtcccttgcaaaatgccaacaagaaaccgcaaatgaaggatttaaaattccatgcagagcagcatatctagcagtctgaatgcctaagggaaaggatgcagggcttttaagttctggtcctaggtgaggaatcataaagttcctcaatttaaaaaaatatatacaaatggacaaaaatgtcttagaactgagaaggctactaaatattaaaaaaaaatttctgatatttccatacatgaagatgttatttgcagaaattaataggcaggctgtatgtcaggaaagtttctggctctcagggatgggctgaggcctttagatgtgaatcgaactacatctctggttttatgtttggaagaccacagggaattccagtgctccaaggacgctccgagggcctacacaactgtcatcaagcatgttaggacatcctagagagtagttcccaaaacttctaggcttcagaatcttgacaaagtcatgggtgggcatatcctgccctcacggataaccctacagttgagtagaaggatgctggaatgcacagaattgacaccagtgaatctggagttctctgtagtaatgagcaacacaaatatctcaccaacagtcccactgttatccgagtctgccttagtcaatgtaaactcctaatgagaccatgtctagacagtattgatctcccaccagaaaaaaaaaaagaactcagagtgtgacttcttttctagcttagcccaaatgacaccctaaaacatgctctttcattcactcattgctaacacttttcataacctgagatattttatcaactaggcagccaaggacccataggcttcttcgcaaggtatatgtgatattttttatatttaaaacatctttgatattcaaatagcagataagaaagttacttaagcttattaaagaacctagagaaattaaatgagtgtatatatatatatatatatatatatatatatatattttttttttttttttttttttttttttcccttgctaggcaaaggagacaggcctttaaaaaatgaaagtccacataagattaaggtgtgatcattcaagttaatgtgggcaagatatctaaaggagaaatcattagcttaagctatccaaaggattttacacacagtcctgtggtttaggagcagaggatcacccgtactactgtgctatccatcccagctgggaagacatggttctttatagaagtaccccttaaaattgtcaggggtgctattaagtacttagggttccccactattcttatctccagactggtcaaatctaccaggcatctttctgatatatcagatagatacaatctatcatagatataccaaagatttatttgcatctgagtgtcctgtggtgaggcattccacagcaggctgtgcatcaggtctgtctgcagaaagtaagaaagaaaggaatacagtttaaaattcacgtaggaatggagtttaaaaactccccaggcaatgtgaaggtgagttaggactgggaaccacaagctaaaaaggagaaccacagagaattctttctgactttggggctgaaatgaagctgaccgaggcattcaggtggttccagaggctggaaagtctcatacgacaggtttttttctcacaaaagagaagtgaaataagtaccttattatgttccaacaatatcaagatacaaatctatcttttagaaaaatgctaaataaaaacacagtcagagagagacttccaccactataaatagtttcttataaatgccacctagagacaaaattatcatttctatgatcctaaccaaaagagccttgcatgtcttggaaatactttgccctctaaagcaaccagaagaacattccttcagtctatgtgttcttgtgctggattttgaaacttttgagcatttgctcccaaagtgaaatttaaaaggctaacagcagggacacctggataactagaaaacttacctattgatatcacaggctgcttctccaaatggactgtatataatttcttgcaagcatagtaaaaatcctatacttgcttgaaatgaaatgaaggaaagcctatcatgaatttctttttctctgtgttaatgaaagacacgagcacaccatgataagcaggagagaatgacctagtgttcatccttctcttcttgtccaacgcaggtaactataggtgggctctgggtagagtatatgattgctgcatatttctaagaaataaagttaatttacaggctacctcaatcctgacactctaggggtaaggcaagcatgcatgtatgtatttctggtaatcaagagggagaaatagcagtgaaaaatagagcttggatatatatcttaaagacatgccactgatttcaaaatagggcaagagcacttatgatttaatataattttgttggaaaaagttaactctctccaaggaaatacagagcttagcaaataccttataaataatacaaaggcatactatagtgtttagtagaatcttattcacccattctgatttggacaaatgttaaatgagacaaacaggagaaaagtttattgattaggtaaccgattaaaattttggtgaaaagcagaagtagtaagttccagaaacaagaaataaatcatgtatatcaacaagaggaatgaaggcattttgtgcaatcctggggaatagattttcttaggtatttcataaaatcattgactctagggcaggaaaaaaccctacacacataaacccacagcattctttttcctgcctccacagttgtaaaggcccgatgataaaacctgtttcctaagacttccccagaatgtgattcaacacattttctatttttttaaaaaaaaatttctgccacttaatttcatgtgataattttccccaatgactaaccaaatatgcttcactattatataaatcaattctttcttaatgccacaagtgaaagtgcaaaggtagctaatggttttcttctcataaaaatcacactttggctttttcctttcatatgtaattaatcatatttgtgacaatcttccaaacttacttgaaatttttctgaatccctttcaaatcaggacaagaactagaaatgtctatacaggtttaatatgaagtaaagaaaatgtttttcattttcttgatttatttctgaattcagcttgctcttcattagcgctacatagctgmcttattattcgtggtcccctatgaccccctgatcattttccctgagggtgcatatttattcactaactatgttacaatcatgtgatctgctggattttttctgatagtctactctagatttgttctaaattaataaatcccattatttttggcttctactacttctatttattaaattcattctgaatatgaagtttattttcaaaggaattcataattctttactccrrgcttggttctaacaatgaatttaataagaattgtatttaatcaatgtttaaatatattaagggcaaattttgtaaaaatgttagtgttccaagctttccatttccccacaaattaatttttttagcctttccccttaatccactttcttaaaaaataaaattttttttgtgatgcagaattatgtgaacaataagaaaaaaataattagaaaggtaggagtaaactaaaaacaaacaaacaaacaaaaaaaaaaaccaaaaaactaaggctgcagacttaatagaactaccatagctacttaagggtaaatgattaagagagagacaacgtctggcttctgagcagagcacagagagaaagatcaccaggaagaaaaaagataacagggaattttaaggacagttgccatgtgtaatgcataaaatagttttcaaaattcttggagaggtaaaaataaaatttagatttattttttaattatttcacttgcgatgctatcttaagattgaaccacatggggccccagaatttatttaggttatacaaatatcctccaattctgatgctgattatttcatatgcagacttcagttacctttacatgtcataaacacacataccccagaaataaacttgatcatcccataaattttcaagagctctcagcctgctgtaaatgaaatttcaccattaactcacaggtcgatgtctgggacaacctcaaagactgcttgagtaattaataaatttatatgaaaacattggagtgaaaatgtctgtcagtgtcaaatacataagaggtaatggctgatacatagtaatgcagttttaaaccattggcaacatatctaaacaaaggtatcagagaaaaataaaagaaaaccttgtaacttgtatgataagcctcttgcataagattattaagaaagtcataagcacttacggctttattccttttctatatagatagattgcccagaaaaacgtggactgaacctcagctggaatctgagggctctgcttgtctttaacagcttagctacattgttagagagcaacactacataatacagcatgccctattcttaaggcaatacataaaattttaaaacctgaagctaaattaaaaggttatcacccttctgcctaatgtattatatatttgtaaatgatatctgtctctaaaaaagatgtaccacaaagcaagagcatatgtgaaacaataagagagaatgtaggagttagaaacacatttaggtatgtaggaaacacaaacttcaagacattcccaaggatctaaataacctatacacaaatatagcaaagtcatatcctaagggagaggatttgagttctaaagccggagcctaaggtaaatgttgcatatagtcaaacttaccattgaagatcactttaatcacctgtagggtgcaagttacattgctttgtgtattcaagactgacagtgaatatttgagaaaatcagttgagttagaataaagaaggaagcaaagaaaagtccacctacagatattagggtattcaaacaacctcttctttaagaaactagcaaatctccacctctgagtttttatcaggtaggtgatgaagtgcaaagctgtaaaccctccaacagggcttattccactgttttaatattcacatttcataacttggacatatgcattaatggatgtatttgtcattgttaagattaagtaacataatctttctttttttttttctttgagatggagtcttgctctgtcgcccagcctggagtgcagtggcatgatctcagctcactgcaacctccgcctcccaggttcaagcaattctcctgcctcaggctcccgagtagctgggattacaggtatgcaccacaaagcccagctaatttttgtatttttagtagaaacaaggtttcaccatattggccaggctggtcttgaactcctgacctcaggtgatccacccaccttggcctcccaaagtgccaggattaaaggcatgagccaatgagcctggctgataaccttatttcataagcaaaagcatcatccacagggtctggtccagagcagatactcaatagggtgctacattttaatctaactcttgtttcatcagacccacaaacacattgctctttaaaatcctgtagagaagaatatgacaacctgcaccttttctttccaagatggcatttccagttagggtacctctgaacagctgttgcttgcacattttaggcatggtgaagatctacacctgatgctgggttcctaagtgggcatatggtgaatccactgcacacagaagcacttctttatgcttggatcacattgcagaagattggacccctgactggggctacctttcccaagccttaacagcacatcaggctcaaatcacagggctatcaaatgaggagatccccttttccaaaaaaagcatccctatcaactctcccaggaaagcacatgaactcatgttatccattcattcttatcttggaaaatacacccacaagccccttttactgccacttacagtaggatgccacaaaaattcagaaactggaatccttttccgtcccttctcctttccttcctccctttcttcttttcttcttccttaccttgaaatttctgcctgtggtaaaaccacaggaagaaggaaagtcaaatgaattttcctattagtcgacatttctgtgatacactcattttttttggtccccgtatgaactccctccagggtatttctttatgggaataaagtatgccaaatgaaataaagaacttgaagcacaattttatccttgacatatgtagagagaatatgttactcctgaatttatggtgcaatgcaactcagtcacttccttttcctctttcccctagtttgcacttcctacttattgctgcataccatcacaaatttatggagtgccaatggctgtggcctctaggcagctcccaaatgactgaatccagacatcattgtcttcagttcccctttggcattagtctattttccatccctcttcctttattgaaatctgcttccaattatttttcataagatggtttagctttcttttatttcctttaagttgaaactcttttatttctacctttcatttctatgccctcctgggccttaagcacagttcttctacatttacaggggttttcatttagaaactattgagaactttactatcaaattgtactttttaagataatttttttgcaattttaactaaaaggagatttttagacttttggaaagtcatggctccaggtctcagatctcagctgtaggttttatcactttgcaagatgatgactagagttacagcacattctttcaacccatgcccaaaacttcaaagatggccacccttcaacccctgaagatttcaactcagtgttttcagaaaattggaggtccaggctttggagtcagacagatatgggttcaaatccagcctctggcacttaatttgaatacaacctagagtaagtcatttaactttcctgagctttgatttccttatctgaaaaataagaatatagatacttacctcaccatattgttataaagatgaaatgaggtaatctttgtaaaatatacacaatgtctagcaggtggtaagcattcaaactggtagctattttttattgttatgagttaaaattttgtatataatggattttttttccaagaaagctcatcaagctgaccttaagtagatgttactcccaaataccacccaattccatgtctacatacttgagaagttactaaacactttaaaattgaaattgaaaactagggacaaacatagatttgaaaccaaaggaataggtaatcagttataaatttggatataacattatgagcctctatttcagaaaatacattccttttaaagtatatttactatagttatccatgcagactgaatatttttatcaatagttgcaaaaccatttcctgaaagggaaaaccatgtaattataactagattttcacatgttaaccttttatataagggaagaacaagaagtagatatttgctaagagactgggaagaaagggaagagaagggagagagggagagacagagagaatgagaatgaaagcaaagaaatttgacaaggaatactatttggcttttggcccttccgtgtaccaacgtagatgtgtgattataccatttaggattgttgtcaattctttccataggaacagactgaacaatgagacatctacctctcaacccaaagagaataaaattgtcatttccctacaggacttttgttaatacaaaaatgaaatatatatatatatatatatataaaattattatgatttcaaaaataaagccaaatatctaaatgaaaccatgaaaataattagctccgatccaacagagtaagtgaggtttttactttggaagataagtaaattctttcagagcatgagaatgaaaaattgattgattccgatctgatctctaaaaagagcagtctgatttactttggtatcaaacagacctgcttctaaatgccatttctgccatttacctgttgggcaaatttcttacctatgcacttggagtcttcacccttaaaataggtatgaaaataggtagaaaataggcttgccatgctttctctctctctccctatatcccatgtctctccaaggagcaattcctaatgtaattgatcaaattcaagcatatggagtcttatttactaagtggcatggtcactatacaataaacgtgacttcccccacttctacttcttctcttctaagttgaaaaaactctaatctctcaggtcaggctaactatttccttccctctttcctgccttctttctaatttgaggcaatagcatccatgagcccaggcgatgtcagggattcttgtttttatctcaacactttcattcttccccatcccctcacaggcccccattcagaattcttaagcatgctatttgcttgagggggcatttaggaagtcccatttaagacctctgccagctctaatcttatctcttcagagaggccttcgctgactatccaatctaaagtacctacctttatcagtgttctacactggaaggtattgggcacaggtgcaactaataataaagtgggtggtactttgttgccatttccatgttagggcctttgtgtctgcacttctctctctctctctctctctctctctctctctctctctctctcatgctctgcatctttaaatcactaaggtctcagctctaatgttatctcttcagagaggccttccctgactatccagtctaaagcagactcctcattcccaccaactcactccattacattaatcttttattttgttaatagctctcattgcatcccattactttcttctttatttgcttgttgcccatccctacctccttcccaaacacacttattaaaacaccatgaagacaaaaaggtattgtgctcaccacttgtttatccagagccaggtgcctgtccaaagtagatgcacacctgccatgtcctatggccaaccaggtccaatgaattcctttataaagctcctctcctcagctgacccagaacaccagctgctatactgaaggctttcacactttcagatgaggtgtctttatcttataaatttcttttctctaagcagaatttatataacctactcattactttgaatagcatcttattcagtataccttattggtatttttcagtaaaccctggtataaggcacacagctaagtgaatgtccccacatacctataagagagtggctagatgcctttcttacccacagggatggtttcaaagaaaccttttacactcactcccatatacacacatacacaaaggaaagctcacatttgcattccagatcatctccaggaggagggaggagaaatactcttttaaaagagcaaacctaaaattataatgctcttgaaaacattagtagttaacatttactgttaagaaagccacaatcccagaccaaagatagctgagtggcatcttaaattgaagatagtttttaagtcagagcttagaaagtctcttggaaatctctttaattcccccacagaataaaatatggtacagattctcaggaggtccaatagaggctttcctctagcattagaacagatccttctttgatcaaggatcagatgaagtcattggtgtgaatttactaggcatatattttttcatatataacagaaaatgtcaacactggaatctcactcagcactaagatgctcacactaagaggttcaggaaaatgagaatgactcccagaacccatctcacattttctaagaggcatatattcattgaggggaacgtctaacagaatgacctatattatttacatcagtacttcctactctcacttttttggccaattctgtgtgattaaattggcaaaagttcaatgcacacaaggtgcaactcaattatatttaagatcactcatttatgtcataaagtctttctcaaaaaacaaaagatgccagccccacagaactttatcatgtcacatagaccccattaatgcagtctatcaacaatatagacagattattatattcagggaagttccctcaagaattgccttacaagttcaatttaaaaaatcaaaataaaacaagccagtactgagtctttctatggtatagttaaacttgtaatattttatacatattttttgaaagtagccttgatataaatcctgaaaaaagaaaaaaagcaaagtccacatttctataagtgtcacgatgataaattttatgtatcaacttgactgggccatgaggtgcccagatatttggtcgaactttattccgagtatggctgtgagggtgctttggacacacttttaatatttaaatcaacagatgcagtaaagcaattgccctccctaatgtgtgtggacttcatccaatcagctgaaggcttgattaggacaaaaaaaagctgaccctcatgcaagaaagaggaaactcctcttacctgatagtcttcagctgggacactgattgtgtcctgcctttggactctaactgaaacactggctcttcctgggtctcaagcctgttgatcattggacagaaactacaccattgggtctcctgggtccctagcttgccaatgccagatctggggacttgccagcctccatagtcacaagagccaacttctcataataaatctctttctatacatatggatacacacatcctactgattctgtttctctggagaaccctgactaatacaaatattaaacccaaataaaaacccaaatgcaagtattaaacccaaacccaaatccaaagatgaacaactttcttcatcagtctggcacctaactgcatgtctctttatgaagtatgtaatattttttcatgagctgccatatgtcattccatcactcgctctagaactcttttaggcacttaaaactttgtatattatattaaaatttaatgtatcaagaaaggatatagtgagaataaactgaaaagagtagttactaatgccaaatataaggcagtcttgaaaaaaagaaatattcctctgtaatctcagtactttgggaggccaaagtgggaaggctgcttgaaaccaggagtttgagacaagcctaagcagcatagtgagaccctatcccctaaaaatcaagattttttcaaaaaaagaaatattccattttttcagtaaaaatattaaacaaatttcaaaaggcagaatggacagcttatacatataaacatatagggatatgaaacacatagttaaatatctacctatactttttatttcattaatttaattggatacttaaaaacatgtactttactcaaattcttatgtgagcatctcaacacatggtttattcaaattctgatgtgagcatctccaccatataagagcctcctttttagccctccaactgagttttccagagttttccacaaaactccaactgagttttcttcccttggttcaaaacaggacactccttgaatcatgtatgatggtgtttctgaaagttgtctctgaaggcacaagtacctatttatataatattagcagctttttcttctaaataaaaatatttctttgaacaggtatatattttgatgtctatgatgtatttgtctcttgtattgctttttaaatagacttttcaaaatcgctgtttggaacaacatccaacagttggaattgtgaagtcatagcccctggaatcatgactaactgtgttcaatttccctgctcctcttttatggatcctagcagatgaccttcacgagcacccaaaacaaaccttgggtgaagccacttcagcccactgtgacttcctaaagcagtatttgaaaggacccaaatataaagcaaggtcgtctcttctgagggataataaattcagggggaagcaaacctcacctttgtatttgaggatatctggtgtattttagtgcaattctgcctttaagataaagtgccagctgacttaatggcagttgtgatctctgcttcatttcatcttttatctaatgatccgctagttagtaaacctgcaaatcctgaaagaaacataagtactctttttctttgcagtgtaatcaccaacaataaagctttatttttttgcattaacattcaactgcaatgtatttaaatgttccacatacacaaaaacacctgatttttcccaagatttgttaaacatagtccctttggtgtccttagtaacactgcaaagatgtcttcatgtaaaacttaatttgagtcctgattaccttactgtgaaaaaccgtaaacaccaaacaaaagtaagcataatatccaaatgcctaaaacataatacccaggttgaaggaagtgtaaatgttcagattcaccagtgggactagaatgtaaacttcttgggttgtggttcctccaaatcatctggccacctgggtatcatatcccacaagcatatggtaacactgatagagtaagctcaaagtgttccaacaccaggacatttcatggccacatcagaccaattgtatttttcacttcctctctttccctaacttttctcatacaaagcttcctacatttcctttggcacttagtaatacttaaatgcatcttcactgtcttattcagtgtttttagctttggaaggtgtatcacttgggattgctttcagatgcattaattgcaatctagctaaccaacagcccaacagtgatttaaacacagaaagctttcttttccggatatgcatgtgtgcatattttgttttgtttttcatgcaacaagatgtctgaaggtataatctgacactgagctggtatctcatggtgtcatgaatgccccagcctacttctattttttttttttttttcctctgctgtccttcagtgaggctttcactttcattgtcatagacggctgctggatctccaagtttgacacattctccctaggcaagaagagggggaaaggcaaaggggaaagaggatgccagccaagtcagtctctttctaaaagctttccagaaagttccatccagtgacttccacatacatctgcccagccacaaatgggtcatacagtctttcctaactgtaagagagtgtgggaagctggatatgagctgagcattgctgctccaaacaaaatcagatttctgttaggaaagaatggatgtaaagtggatcttaggaagggaacaaccaatgcctaccatacacaagtatttgtggtgagcagacatggctaagtgcctcttcctatctagggaggttcagggaattactcaagatctcttttgtgccagggaactagggagtcagtcatctcatttgctttcatttcctcatctctgaaatttcctactatggtattcctcttagaacaccatttagaagtgttatggttttctgttcttaatccaaatgtgacaaaatgtattctccttcttctctgataacaaaacccaaattctgacgggcagcatgtgcttagccttagataatgaataatgactggtctaacccaatcatggcgatactatgttcttttgccattgattggtattcagtagtaggcatgtgacctagatctaaccaatgagtggacatacactggggggactcatgaaagatttttcacctttggtaaaaagtcatagttgcaagaggagaaagccttttcttcatatgcctcttctttcctgttttagatgctgtcatgttaacgctttgtgcttagagctgtagaagccgtcttgtgaccatgaggcaatagccaaaagaggaaagagcctgagtatgaaagacactgggtcctttatgatattactgagttgccaaactaaccctgggatcctctacctcctgttttctcatagtaataaatatccctgtgatttcagcactatcactttaattttctgttacaggcagctgaaagcattcagaactcacatactatcttaacatcatcttccatgtgttatgggccaagagtatattcaagagtgactacaaaactacattcattgtcgtatccctgtgggactcccttaaagttctagtgttctgtagtgtactttccacagcctagaaggatatatgtttccctctctccagccctaaggaactcttaatttaagactgacaagatgaatgagttacaatgagggtgaatccaattcaaaagacgtaacaacaagcaagaaaagcaaagaaccttgtaaacacccatgttatggagtgtgagagtgtaagcttaaggaggcttttattttggggagaagatgcatcacctctgtttgaatgagagaaattaagttgtaattatgatggtgtttcagttaaattatttgatgtggaagacaaggagaccattcccaacatgttatttagcaaagaatatggaggagaggcagaagactgtgatggaaaacgttcagaggccatcaaccaaaatggtaatgcattcgaggcagataaagttgcttcttgctagacagaggtggggtgagccctgacatacgtcttcaaaattgcaaaaggcacagatctgggggggaaagggggttgattcaccaaatctcagaatagcagaatggcaataaccctactccaaggcttccagttttcctcagtttaactccttttgcatactgcagccaaagagattttttttaaaatgaagatcactcagactgtgtcctcttcctcttaatctccccaaaggaagaaaaaaacaatgatcaatggcaaatggcagttgcaatgaagcaacaccaagaacgagcttcgtgctcgggagagaacattgcatatcttcctgtggtttccagtgctctacacacttggggaaactcctttaagtaatgaaccacagaaatgacccctggaaatataatcttcaaagtgatcttttaaagatccaaatatttcctgttcccactctgcccagagatcttcagtggctcactactgcttccatgataagatcctaaaaccttgtcacaatccacaaggccttcattgtccatccctgcctgcctcactgtctttatctcccaccacactctgccttctctatgctcccacctgacaacttcttcagtgcgtggaccctattgtactctctcaggcctcaaaaccatgtaacatcctggacttcctcttcactggtctaatgcctactcatacttggcttctgagattgtacttcactccacatggagattatccacaaccatgccccactccaaaaccaggttaccttcccaatgtgatatacttgccatagcactcagcttccttttttataatactcatcacacttgtgattgattgactctcttctcctttacattgtaagatccataaaggcaaggatcatgtctgtctctttctgatgtgtaacaagcctgaacatacatacaataaatggccaggtgtaatttaccattgtgtggatgccatcttgggaggggggattctaatagttcaagggcatgtatgaaaaacagactcatggtaaaataataagaatagaaaaaagttactcagagtggtttaatggctggggtataccttttactattttacttagacatcaaaggaaaatcagtgtcctccctatcatgttccatgattttgtacaactgagtttagagcacaagctaaggtatcagacagcatttgacagcccagcttcactacttatcagctgtgtgaggtgatataatccctctaatccctataaaccttagtttcctcatctttaaaatggggataatgacaaaagcttttcaataagggtttgtgaggattaaattagataatacatggaaagctttcatcccagtgcttgccacagagttagcatgcaataaatgttataaagagttctttattgttctgcccatcaacatctgagacagaatataaacacaactgctcctgggcctggtggctcatgcctgtaatcccaactttgggatgccaaagtgggaggatcacttcaggccaggagttcaagaccagcctgggcaacaaagcaagactccatctctacaaaaaatgaaaaaataggtggatatggtgatgtatgcctgtagttctagttacttgggaggctgaggcaggaggatcaactgagcccaggagttcaaggctgcagtgagccataatcatgcctctacactccagcctgggctttttaagattccatctcttaaaaggaaaaataaatcaactggatcactagcctataagagcttaacaattgttaggtagtattactatgggtgttattgttttgttatttgtggcaaaaagtactagtgctcacctgagcacatgacttccttatgatcaggtaggtccatgtttgtcttggtcactactccagcccagtgcctagcacagtgcttgacacatggtgtgtatgcaatgaacacttaatgagtacttaaagatctaaccagtatgatagtgcagattctcttgtaagcaaatgaatagagaaaggcagtattccacagagaaggagacaggaaaaaagaacaggcttgattttactaaaaagaaaaacacacttttaagcagtaaaattagaagttcccatttcaatggcacaaaatagagaactcactgagaattgtgtgctataacatggtcaaagcagaggccgataatgaagggagcagcattcagaaccatcacatgtatggtcagctttcagaccctgaaaactcgattaaaacattccaggaaaccgctgcactttcattctaaaggaagattgtgaactctgttcacatattacaccccttcatattgctttgtctaccagtgtggccttttatgaagtgagggcttctttcttctaccttgctccatgacaatcaaacccaaaatgccttccacccttaaaaggaagttttggtaagtgccttattataactatcacatatgacacaaggctcaccactaatcggagacagatgagaatgaattacttaaataggacagaaatagccattcacttcaagaaggtcccagtttcttgaaagtctgtggcattgagaccatttacagtttgctgtcaagattcctagcagtgctcattaccttggctagcaatccctctggactacagaaaacttatctgaaatatatataatcacaggctgcaatgcctaagtgcaacaggatgatttaaaaagcaccatgatagtgttcccccaggacattcatctctccctgtctattcatctttgatccagacaaaaacttggaatgcaatctgtatattgatattccctaaaaaggatttcaccagctctttaggaagaattgttttagcggctctggaagtctagaacattctgcatttgtggtatttacagcttttgtttctatttcataaaaataaagccccactaagagcagtattcaattcctatcccaataggagtatcgaatagtggttaagcacatgttttttggaacgaagcagacctgtgttcatctctgggctcctcatagacctcttcataaacttaggcaaggtattcaacctttttgagtctcagctatatcaggtaaattactatgcgtgcacagaagagcttaataaatgttagatgttaatggtattaatattgttttgctgctgttttcagtttttctagcagagattattagtattcacccatgtgcacaggtagaccgcatttccacccatgcacacaggtagaccgcatttccaagcttcagtggagttacgtgggtccaaatgactgagttccgatcaatggaatgtggcagaagtgatgtacaccctttcctggatgggcctacagaaatcctctagactctactcctcactctccttttcccttctcaggcaccctgaaggctacttgttaaagaatttagagctacaggatggaaagaacctggatcctacctaagaacctcctaggagagccacccttcagaaacatttgcagtggattctgaatacgatttttttttttttttttttttttttttttttttttttttgccgagcacggtggctcatgcctgtaatcccagccctttgggaagctgaggtgggtggatcacttgaggtcaggagctcaagaccagcctggccaacatggtgaaaccctgtctctactaaaactacaaaaattagccaggtgtggtggcacgtgcctgtaatcccagctactggggagactgaggtaggagaattgcttgaacctgggaggcggaggttccagtgagccgagattgtgccattgcactccagcctggtgaagaagtgggactacatctcaaaaaaacaaaaagatacatatatatgatatatctgatatatgatatatatatgatatatctgatatatgatatataaatgatatatctgatatatatacatatggtatatatgatatacatcatatgtatatatggtatacatgagatacatcatatgtatatatggtatacatgagatacatcatatgtatatatggtatacatgagatacatcatatgtatacatgagatacatcatatgtatacatgagatacatcatatgtatacatgagatacatcatatgtatacatgagatacatcatatgtatacatgacatacatcatatgtatacatgacatacatcatatgtatatatgacatacatcatatgtatatatgatacatatatatcatgtatatatgatacatatgtacatatatatgtatatatgatacatatgtatcatatatatcaggtatatatgatacatatgtatcatatatatcaggtatatatgatacatatgtatcatatatcaggtatatatgatacatatgtatcatatatcaggtatatatgatacatatgtacatatatatcaggtatatatgatacatatgtacatatatcaggtatatatgtacatatgtacatatatatcaggtatatatgtacatatgtacatatatatcaggtatatatgtacatatgttcatatatatcaggtatatatgatacatatgtatcatatatcaggtatatatgatacatatgtacatatatatcaggtatatatgatacatatgtacatatatcaggtatatatgaacatatgtacatatatatcatgtatatatgaacatatatacgtatatatcatgtatatatgatacatatatacgtatatatcatgtatatatgatacatatatacgtatatatcatgtatatatgatacatatatacgtatatatccatatatatgatacatatatacgtatatcatgtatatatgacgtacgtcatatatatcatgtgtatatatgatgtacgtcatatatatcagatatcatatatacacatatatcctatatgtgtatatatgatatatgtatatatgatctatatacatatatatcatatgttctatgatatatatgatatatatcatatatgatatatatgatatatatgatatatatgatatatcatatcatatatgatacatatgatatatcatatcatatatctttcttttttttttcagttaagctactgggttttgacgaagctcattacagcagttagcctacttcagggtttctcagcctgggcactactgatattttggactacagaattctttgttatggagggctgtcctatgcattgtagggtgttgagcagcatccctggcctctatcctgctagatgccagtagtaacctctccagtagccatgacaaccaaaaatgtctcctgacattgccaaatgtcacctgcaaaatcgcctccgattgagaaccagcagcccacactggccaaaacatcaccatcattgctatcatcatcatcataggatattgatagtctagtctctcatgttccccttgaaatcactgcaaaaggactcaaagttccaaaagaggtccagcccagtttttttaggagaaaaaagtgaaatgacactaaaatttaagaaaaggtaagggatcaagcagtaaactcaaagttataggagaccaaaaaacaaagtaagaaccaaaataaatataatccttttttaaaaaagctagtttgtgtagtcccagctactagggaggctgaggcaggagaatggcgtgaacccgtgaggtggagcttgcagtgagctgagatcgcgccactgcactgggcaacagaccaagactcggtctcaaaaaaaaaaaaaaaaaggccggtttgatcactttggtaacctagaataaaatgattaaaacaaaaacaaacccaaatatctgggtctaggaatttcaatgtgtctaacaaatgcttatagaatatctaccatgagataagcattgggctgaatataacttggtaaataaaacagatataatccctgccctcatagagatgaaaggtaaataaaaatatggagttttttgtttttgtttttgtttttgttttttaagacagtgtcttgttctattgcccaggctggagtgcggcagtgagatcatagttcactgcagccttgaactcctgggctcaagtgatcatccgtactagctaggactataggtttgcaccaccatgcccagctaatttttgtattttttttatagagacgcggtctcactttgttgcccaggctggtctcaaactcctggcctcaaggaattctcttgcctaggcctcccaaagtgcttgggattacagtcatgggccattgcacccagccaaaatatgatggatttttcaaacagcttaaacacagtcatgaattgaccactgcaataggcagacttctaaagatgtccctgcaggattcccatccctgggccgggcatggtggctcacgcctgtaataccagcactttgggaggctgaggcaggtgggtcacttgaggtcagaagttgaagaccagcctggccaatatggtgaaaccccctgtctctactaaaaatacaaaacttagccaggcatggtggtgagtgcctgtaatcccagctacttgggaggctaaggcagcagaattgcttgaacccgggaggcagaggttgcagtgagccaagactgcaccattgcactccagcttgggcgacagagtgaaactccctctcaaaaaaaaaaaaaaaaagattcctgtccctggttatccaattaaacactagattaggtgctgccatgaagagacttagcagatgtatcaaggttactagtcaaccgactttaacataggaaggttatcttgaattatctgggtatgcctaccctagtcacatgaggttgtaaaaacataagtggaaggtggaagaatcagtcagagtgagaaagcagaagaggatgcaggagctatgctgcagagggaaagtcagattccaaacacaagaaagaaaaagataagatgaatcattgatggttctaaaatgtaggaggctctgtgtgaggaccagaaagaggcctgagggagctaagggtggagccctgcctaacagacataaagaaaatagggacttcagtcctacaaccacaaagaaccaaattctgtcaataacctgaacgagtttggaagttggtttttctgcagtctccagtaagaaacacagcgctgctgatacctcgattttagcccagtgagacatgtattgggcttctgactgccagataataaatgtgtgttgttttaagtcactaaattcatcatagtttgttatgacagtaatagaagactaataaaccattatgcattaaatatcacagaaaagaaagggtttaagaaaataggtattaaagtatgccttatcaccttatcattcatcaatctgaggtttactaaacacttgatgggtgctcattagtggaataaattaatgcactcatattttcattcatttgttaaaaatatgcatacagtgcctcctctttgatggtccctgggtgaggtattgaggttacagtagtgaaataggtattatcctctgtttataacagctcataatggaagtggaggacagaaacatgtacattcaacaataatgcaaagaacataataaagatattaacatcatcattataaaactatcagtaaaagtgtgaataagggagtacagaataataattacagctgacatctattgagtacttgtctcatttcccttcacaacaagcctatgagactgtattagtccattttcatactgctatgaagaaatacccgagatgggataatttataaagaaaaagaagtttaatggactcacagttccacatggctgagaagacctcataatcatggcagaaggtgaaggaggagcaaaggtacatctcatatggtggcaggcaagagagcatgtgaagaagaattgccctttataaaaccatcagatctcatgagacttaatcacgagaacagcatgggaaaaacctgcccccatgattcaattacctcctacccactgggtccctcccatgacatgtggggattatggtaggtacaattcaagatgagatttgggtggggacacagccaaaccatagcagagacagacccatgattcataccatcttgcagattaagaagctgaggtacaggcaggtgaagaaaccagcctaaagttactatcggtaagtggtggagctggaattttaacacaggaggtccaactttagagcccatggttttaaacacttcattgtgctgtctctcattgcagaagggtgaggaggcctcacagaagggctgagatttgggatgaataccttcatcaagaaaaggaggagccagtagaagaaactgcattggtaaagccagagattcaggaagaaggtggatggtgtggcatattctggaacagggctctgtattggcaaggaggggtggcagatgaggttggagcctaagttgtcctgacttgaaagacttgaacctctcagcagtttgaatttcgttctaaagctatcaaaagaacctattcaagagcatgatacggtaaatcatcttcagcaactcacatatcatttttaacattgtttcaggggatattagtggacactcttaggaacgcagtgtatagcccacaagtataatgacacttattaatacaacttagaaaacaccctttgaaaatgcatcaaaaccctaaaagattcgattaactctatggaaatgaggataaagggtagatgcatgtaagaatccagctgtcttctatctacaaagctcttcatatccacaaccacagagacactgctcagcttctgaatcgccttagttcacaataaaatagaaataaatcataataaaataaaatagggaataaatctatctgttggctttgagaaaatttctcagtagcaacaaaccaactgctcaaatcagaatcccccaaaataaataaataaggtacctaagagggaatgcatgtgttgaccaaaaaactaaaaaattctcccatttctgtctgacgttgaaaaaaatcataggtatttggcattttagcctatgctgttgaatgtggtagccactaattatatgtggctatttaaatttaaataaggtaaaattaaataaaatttattttctcagtcccattagccccatttcaagtcctcaacagccatatgaggccactggccactgtactggtcagcacatgtatcagacatgtccattgttgcaggaatatctgttgggaaaaaaatgaactacttatttagataaaagtagtgatttgttagacatgcctaataaaattcagtttattttaagattatgtaattaaattcagacttacttataagagtctgaattttcattttaatcgtttgtatgtatttcattcctcttagtatgaagagagtctatatcaagagactctctatggagacaggagccagtttgtattaggccccagctctgtcttgggctctgtgctaggcatttcatatctgttatgctacttaaggctcatgactccctgtgagataggcatgcttattctcatttttccctaaatggggggctgtgacaaggctgaagcaaagagagggcacaacatcttttcagggttaacacttgagaaacatctatttcttcttaagtagctctactgctgcttagagaagtagagtatgtagacaagacagttaaattttccacagatggggtttacttagagggagataagatttcttttgcacacaattgtagatttttttttaaatggtcaaaatcctcctgttctagcagtagctaagaagtgactcggggaagcattcaacaagtaggaaagaagtctgctcagatggaggccctgaatcagagatgcctgtcatctgttcccaaaggctccaaactcctgccacaaatacactgagggttcctctctctataacttcttctctttattttctctggaaggaatgtacttgatacttatttttaatctgagtctccttccacaaaaagtgtagaggatgtgctacccagcccctaaagttttgcctcttggtattcacacttgtgaagtcattttccatgtggaagagggctgacctgtgtaagcaataagatgctgcagaaatgtatgacttctgtggctaggttagaagagccatgagtccttaaagctttcccccttttctctctcttgagtggctgtctctggaggaagccagtcaccattctatgaagttactcaagcagccagtggagaggcccacatggggaggaactgaggcctcccaccaatactctccatcaagctgccaggcatgtggtaccttagaagtggatcttacagccccagtcaagccttcagatgactatagagccagaaccactctactaagcctgtcccaaattcctaactcaccaaaataacatgagatagtaaatgtttactgcagttttaagcagttgagttttggcataatttgttatgcagcaataggtacctaacccagagggtttttccagctttgcctatgggcaagtctacagatgaaacaagctgcttttcatatttagtgctctctctcacaattatcaggagatataattatcttaccatccaggctgtgattcttgcacacaagcaccaagtcatccattattgcagtctcccttcccatgcttgatgaataactgggttcctgtgatttttcctcttttctttccccattgactgttgaaattgtttgcctcaactattgagtcccttctcttcagtttgcctccttttcttttcctcctacatgagcagaagccaggaaattgaatgtattcgatcacaaagtatgcatgaccctcagcaacatgagcctacaatagtctttttaatgaccagaggaaggttgtgaggactcttagttaatttgttatgaacacccactcccataaggaagctgctatgtatttgtggaataaattaaataaaatcagcaaatttgcttattatctatttcctgccctttgaacacaggtttacccataaactacatttgttacacactaactgaatatggaaagcactatgggtaatgcaaaaaatatagcttgtctgttttcagtgtactcataagcaaatataggagacatcacaaagatgcaaatatgtattcatattcacatacatgcttaagtagacatttacatatcaaagacagtgaaggctaagggccaaatgaatggtacacacaagtgttaacagatcttcaaaagaagatgttatggctgtgagctgaattgatcagggcagcctttatgcaggaacaaagtcttcagaaggtttaactatggcagatactattacagatactacttgtttcatccagttctcctttagccccaagcatagagactcctgcacatctcagcctcttatgagtgggcaggatcatgtgactagctctacttagtggggcacgagaaaaagtaacatgtttcatttcttaagtcaaagaaaaaactatgtttaattctccaatctttctcccccaaaagttcacatgctctggggtaactagaggatgttagtggctccctcagcctgggtctatctgaatgactacaataagcagagccccctgacaactttttttgggcatgtaccattagcaagaactaaacctttctttgtgataggccactgtgatctggggactcatttgttactgcagcataacttagtctctcctaactaaaacagagattcccaaagatggagaaaagcagagcacagtagaggtagcttataagtcatgtcttatatgacctttctcaatgacaaacctgtgtgctcaccaagacatagcttgttatgacatatctgaatagaattgaaggtttttaaataaaaacataagaaggttggaaaggcagcagaatgagctactgcctgtgggtgatctttacacatctcagaataacaggattattgatgccttggccagaagcattcctttccctctgttttctttttctttgagattgcaagccatatatttccatttggaaaacagtatttcataacctctaaacctaacatgagtcctgtgaaaccctagtctacagttgaatggccaaaaataaagacttgaaattccttcaaagctatcccattttacaaggcaatgctttctctctctaccaagaaagtgttcctgcttgatagattcccctctcttgctgtatattacacttactgctctcctgtcactccctattctcttcctagttgtttgtgccttattaaattccacattttgaaacaaccaataagaatcagaaagcctgaagaagccctttctcatacaatcagagctccctttttatctaggaataaattatattttccaatcaattcatgagtgggattcattgacaatatactctctttgtaacatatttctgaatgagtagtaaatggtcttcaataaggatatggcgatacattttagctaaactgtttcataccgacattaactcccctgttaacttacttaggagtctaaagacacaatcaaatagctgtttctgactattattctcaaagcgaagctccaggccgtaatctcaggacatgcatgaaaatatcaagtaacaactcaaaggcccatttcagcttcaaatacctttgaaaattcgtgagtttgaggagcagagtgggatagcaggcgagtggaagaggaggcttctgagaaacttaattatctacattttagaatgtttcagtctttggccttttaatactgtagtatagcctggcttctgtcattctgaagggatttcccagcttaacaaaatcccaaggaaccaacctcagattggtctcttacctaaggaaagattctggcaacacaacaggaaggatttggaaaatttaatgaagattttgaaatacccctaacacacttaaattaaagataatacctatttcacccaaatctcctaaccccctgtggaagatcaattctaatttttgaggacaattattcatgtgttattggcttgaagtacagaatgtattagtaagtctcttcagttctaagtaacagaaaccaaatcaggctaggttaaaattgaaggggcatcattagaaggacccaagagtgtctcaaggactcagaggcaaagatgcagccagttccccccagtgccgggaaccagaaggtgggcaggaactcagggaatacagcccccttctatctctgcttctcaattctcatagggaaatatggttgtccacagatctcaggtttacctgtcatagttctagccacatgcaaggaatgactgcatatctctgaattccaaatttcagaaagtgagaccttggggtgggagatggggcacgcttggattcggtgtctaactctaattcaaacaacttttgccacggagccatgtagtagccaaatatgtttctaaggcccaagggaccactcttacaaagatggaagatagttcactaaaaagaagacatgctttctagactccacagccaccccagaagtgccaagataaataatagggagccagagtttaagcaagggccaccatcactgcaagttgtctcatccaacttctccctttataggaattgacatgacttcaaatattcatgtctgacaccaacgaagaggaatgtctgttcttgagctctttttctcggttcccaaggggccctcagtaccctgctttaccatttagtgtggattctgacaaaagaacaaattaagtactttgatttgattcttaatttttccttataaagacttgcaataaatattgtgggtacctagaaataatccaccatagtgcacaacacaatctgttgacttaccttagcttccattttccttcttggtctgacatataaattcaccttgctgctcaattctgtcacctactattttcagcatgtatgagcaacagtaaagtgcatgcccacagaactcagaaatgagaaaactaatattgctctgttatatgcataatggatcaatacagaggtatttaaacacacaaagaaaaaaaaaaacaggtcagcaagacttgactttcaactgatagagaatattaacatgtttatgggtagaaaaagtggtcagttgtagaaaaatatacaaagaaaagctacaaagagatgttggcagtggccatttaagctctgtctagggaaaggaagcctttagttaatggccttcaagtattctaatgtagggacacggcacccctactgtggaaagagatgcaggaggtggaaggtagctaaggccttggagtttcagttccacaggcaaggctatccttatcatgagaactgagcagcatgaagctatctgtagtctgacagtcatattgtatgttgtgtcaaatgaaaacatagcatcactcaattccttttgttctcttctcttgctaaacacacaactatctgatgctctggcttcccatggacctcaggcctgcttagaggatggaatgcaatagtcccactagtctgtgcagtgggccaactgctggttgtaaaatcacaaaggggccttctaggttaccgcgtctcacaaacttgggtaatgtaattccgtcttgaagagagagtcccccatgggtaagaccatggaccatggtaaatgagtgtaccccaggagaactgcttgggaaatagtcacttagcctattctcctggtgatgccccagacattgtcaacatggaccccttggagcatttcctcgttgatgtctacatttgttaccttactcttaattaaattttctaaaaagatggcacaataggagcactgagaacatgatttttaggaagaaaaggaatcccatgtaaacccgtttccatctgtggttcttgcctttctgtccttatccatagggcagctcattcttgcatatctgcagctcttgcatgcctgccattttgtatcttcctttttctcgttatatcagaagcattataataagttacattagaacccgttttgcatattttaacattgccttcacagtgaaactatagagagctttatggtggcactctagtgaatattctgttctgcttctgttacatgactaccttaggaaaagtctccgagaactcctgtctcccatgattatctctcctaatcaggctttctactatcaaactactcagcaaaaggaactcaccaacctatagtgctaccagaagtctaataacataacactgtcaccacaactttttcagcactaaacatgatcatttttaaaaatagtaagtttattaggtatataatgatactttccaagttccagcctgtttataaaggactctgtataaataaggaaggggcccaggaatggtgacatatttaacgtgtaagtcaggatgctaaatgtctgactgtatttgtttatttttttctgaaatggagtcttgctctgtcacttaagctagagtgcaatggcacaatcatggctcaatgtagccttgacctcccatgctcaagtgatcctcccacctcagcctcctgagtagctagaactataggcacacaccaccatacccagattttttattttttgaatgtatttatttatttatttatttattttttgtagagacgaggtcttgctttgttgcccaggttggtcttgaacttctggactcaaatgatcctcctgcctcagtctcccaaaggattgaaattacaagtgtgagccactgtgcccagctcctattatatttttaaaaggaatatactgaggaaaatacaaatggagttcaactgataaaaagaaacctctgtaatatgagcaggtgaatacaatttacaagatcatacttcagtatgaattcagtaggaattgcatgttttgcctgctgtgtgtccctaagggtgacacactcctgaatgggactttagtttgccataagcctgctttgttttgtttgtggtagaaattccatgctatgaggaaatgctttcatttcttttgatatctcatgagcgcttgttgcaaaaaacatttgtaggcaaacagcttcacacatattaaaaacttgtagcagaaagttaattccctaacataagttgtccagctcagggctctataatcctgtaattcattttggttccaataaatacgtactttctgtgagaccctttggggaaagggtaattagatatttcacatcagtgggatatctttccttcttttgctccccctccttctttccttctccttttcttctctttaattcttctacccagaaaaattctcaaggagcaaaaatacattactctctgcatttttataagctggccagttttgcttcctggcttttgaacagaaaattatgcctcaaaaataatcccacattattctctaaattcattttcctcagtcattagcccataacggcaattttccttttgaaaataaagaataatgatcatttattgagacaaatcctcaatcagaatgattcaaagagaatacaaatttaatgatcaccctgagaacccaagtaatacatctcaggaaataataataaaatttatgatggccttaaaattgcttaactcctttcaggaaaccctgaattatagggtagtaacataaccaaggactggcaacaactcacaaaagtctagaagagttttgcctttgagttcatagacaaagatgcttaaattgttccccgttcaaaaaataaagattatttattatttactttcctgtgcaccggacactcctgcaacatgactataactcttgcgttcttagatttgatcttcaaggtctctgaatgatgaaaaaacttgtagggtagcatgccaaccaacttgggttttttgtctgtttttgtttttggaggaggggaacaaggcagggagagagggagagggagagagagagagagagagagagtgagagatcacactaccaggagcttcataaagaaacctgcaatgcagaaccaaagtggatgaaagcaaaaggatacaacttttccctccagatgattttactgggaggaagaaagatttgaaactattgagtgctttttctgataaccacctatggctctctccaaagacacacatgtaaagttgggcaagttgttttctgtcatgtcaggaaaatatttagtagcagtcttacaaaagtaagcactcagcgccgtcccagggagctgtggatttgctgtgcagccttgtttccttcaacaggttcctttgttgctttgtgtgttctcccgacaaagggcctgcccttcttctacagatgggtttaccattctctctgaatgaagactattcagaagtacacaaaccaacaaaccatccaagctgcctctatctgatggtcctggtatatccagagtactaaatagtggcctacaggatgggaaattcacactgactgactccacaggagactgagaaagcttaactggctgatagctgtaaagtcctttgaaggaacaagcactgtttaaaattctaagtagtaatcttataatttgctaatggaaagaaatataacccagctaatgtgtgcctcccatttcagagagtatgtttcaacagcaaagccctttacaatatttagataaacttcgatgtatagaaagtgcaacagcaaggtaaacagcagggcttcccgctatggcattttaaaatgtggtgggtgaaatttgtcactcctaagcaagtgcctatagtaaaaataaaatatcactatttatatggtatgtgttaaaaattgtccactctccccaactacaccagatcaaaacctcttgttttttaaattatgaaattattgaactgtattgagcacacccctacttatgagttgtgtaacctggggcatgatattgaacccctctgagtcatttcctcatctatctagacaaggctaatggtaatacctacattgtagggctgtcgttagaattttaaaataatttaataaaataaaggctagtatttattaaactctaaatacatgtttgctgctatcagcagcagcagcatcggtcggcaatcacgccaacactcctcaaagaaaacagttctgaaaaggctgtgtgcatcctaggtctgaagattttcttggtctaaagagtctcttgggctagtgaccaaatccttcattaatttcaagagctctgggaactctctgaaactgaatgtggaatggtataactactggtctgtgcacatttttctagaaaacctcacatctttcatcacattaagaggttaagaatcattgccatatgtagtcattagcttacctttatctactttctacttctaacggagaactagagtcctgtttagaacaagtaaccaggacagggacagaagaaggagactatgcatctgtcactcttgctgattagtctccaccctctcccagcttctgcgggcctcctctcccaagagttgcgatcctagacccacctcccatctgcagtctcaacctatcctcttctaaggactaatcatggcatatggcaggagagatttaagactagctaggtcaatgctctaagctcaacatcaagtcacctctgaggcagggtgttgtcatggaatgatcatgacctctgaaataggaaggtctgtgtttgatttggcttgaccacttactggacgtgtgaccttggaaacgtttacttaatcatgtcttttgtcacctataaaataaatacaataagatttacattgtgagtctatgagagagaaatgagataatatagagaatatttttaaaatgggagcatatgtcaggcaacagtagatgctcagcaatgttcttttcttacctgggcttcaacctggcacccttggtcaccttcccaggacccaaatccctctaggaataaactctggcccttgctggcttctttattcttcctcccacctacatacttgaacccatccaaagaaataggtctgactaccttggaaaccttttctgatgcttactacttgtccaacattcatttttctgtaccatgtgtgtagatactggattccccatcctagaattctacccacctcttgggctaccctgttacaatgtgtgactgactatcctactcccactttccaagttaaccacttaattgaatggctgcccatcaacatactccttaaatgccaagttagttctgtcaaacccaatccacagacaagccttatcctcaaaccttttctgccctctgccacagtgctaactggttcattgtgcttgttcagcatgcagggacctttaatttaatgggcctctcccatttttcacatatcatgaaagttatcaaatttaggttaattaagtttaagacatccatagttattcgagtgaaaacttgaaggcagcataatggataataatggtaaaatgataatttttgagctcttagtagatgccaggcatagtcctaagcagtttaaatatatttttttcatatgattttcataacaatcctacatagtagattatgatcattatctctactttataggtgaggaaactgagacttagagaagttaagcaaatggccaaaagttatgcaggtagtaagtagcagacatagaattgagaagacagcccccattctaaataagtatgaaaaatttcagggtgtcaatttttagctaaggaaaacttattcatgtgtgtgtgtgtgtgtgtgtgtgtgtgtgtgtgtgtgtgtaaatgaatagatattcatttacttatatatctatttcccaggcctcaatgcaatcagagatctctgaagaagtgaccatattatgaacataaatttttgacttcataactttacagtgataaataacctcaggttatcaggatcctaaccttaaaccacctgagattttatcactgttcctttagtaagcaagggatttttcaaccctgagacagataaaaaatagattgtatggtcaatgaaatccattatattcatactttttggttgagtttaggtaatggaacaatctgagaattttgtatcaagtatttgtgatgtttaagaggatttatcatatttaagaatctgacagattgcccctgcaattagaagtacaattgattactgacttctaattttaggttaaaaagtttaacagaatttgatgtttttaagtagtactgagatgtttaaataactgaatttattctttatgagtctagtatatttgattcaaaacatggcttcaaagcttagaaaggttttgcttgttaaggttgtgagcttgtactgccaagtattcgaagtgtttacaaagaaagtaaaattgttaaatgtgtaaagttattttaaaatattgatgaatacatttaacaagtaaatacaaaagtgtatttaagtagacattattcttttatggcattcataaattcataaattgcacaagataacctgagttgctctaaatgcttttcaaacttaagtttaggggagcaacatcagcaagatggctcactagaaactccagcactcatcccttccacagtgacagccaaaacaatgaataaacaactacactttaatgtacataactgaaggagagtgctagaatacatcaaaggagtaacagaaaccctggtgagcacagaaactcaggacagccacaaagagaatggaaggaaacatcacaactccaccaccctatccccagctgagatgagccagaaacccagaggaaactttccctataggaaaaaggcaagcaagaggattccagtagcctccaccaacaccttggacacccacagtcctcactactggagtccttgtagtcttcactggcactaagtccagctgagggagctgcctacaggccacacagccacactcacctcagagaaggaactaatactgtgctctattccctgtagcccacatggcaactgtgctatatcatcttagaactggaactactgctgaagtgtgattttctctgagggtgagcaggcttgacacccctgcctccataaggctaagctgcctccaaaccaccccaaaccagtggccacagccaagctgccagcagctgttaatgcctttccccatggagccaaacagtgaaaactgctctacctgccctccctcaccttcacctgccctctcccttcacctgccctcttgtgctagagatgaagcaatacattccctcctggggaaacagtgctttggcagaacagctccatctgcttctctccgctgcaactgtacactgcttctaggggtctgagccaaaatggcacagtatctcccaaggaaatagtgctttggtaggaccctgtatcccaggtaaatggtgcctgggccacacagaacagtcatgcctgagttaaagtgtcacattgccccttggggaatcattgccttggtcaagttaaacaactgtgcatcccagggctgagctgatgtagtatcttgtgtcccaaggaaacagagtagaacatgacctaagacagtctaccctactggacaatctagtaccctgctttcctgaagctggactagcccactagagtctgaactgctaagacctgctgtttcctggggagtggactcatcactgtgctactccctgccctccaggacccaaacaatacccatgctcagtcattctagggtacttgctgccactgcgcctggccacatggagtctgggatacagatatgccccaccattccaaggtctaaatttaccactacatagttcttcattctcagggacctaagctgccactgaaccctattggcttaggctcctaaattatagctgtaccatgcatgctgtgctcaaacccctaaaactctgcttctttcccagagctgagccagggctgtatcctattccccaggggtagaatcacagctacaacctgacccactgaatcaaagctggtaggggctgcctaacagtcatagattctggctctgtgggaaacctatatttgacccagctacagagagtgaacctgtaccccaggacccaagagccacaataggcttgtgaaactctgatattagcaccctgactccatagccacttcaagtaccaatccctggaactcaaagcaatggaactgcttgtaggccatgtaagagggatcctcttgtttaattatccccattgtgaggaaaatcagaataggaggaccccaaaagccctgccactgaggacattaacaacctatgttgtcactgccactaccatacccctttttttttaattatactttaagttttagggtacatgtgcacaatgtgcaggtttattacatatgtatacatgtgccatgttactgtgcggcacccattaactcgtcatttacattaggtatatctcctaatgctatccctccccctgcccccaccccacaacaggccccggtgtgtgatgttccccttcctgtgtccatgtgttctcattgttcaattcccacctatgagtgagaacacgcggtgtttggttttttgtccttgcaataatttgctgagaatgatggtttccagcttcatccatgcccctacaaaggacatgaactcatccttttttatggctgcatagtattccatggtgtatatgtgtcacattttcttaatccagtctatcattgttggatatatgggttggttccaagtctttgatattgtgaatagtgccgcaataaacatacatgtgcatgtgtctttatagcagcatgatttataatcctttgagtatatacccagtaatgggatggctgggtcaaatggtatttctaactctagatccctgaggaattgccacactgacttccacaatggttgaactagtttacattcccaccaacagtgtaaaagtgttcctatttctccacatcctctccagcacctgttgtttcctgactttttaatgatcgccattctaactggtgtaagatggtatctcattgtggttttgatttgcatttctctgatggccagtgatgatgagcaccaccatacacttttacagcctaagtcattcaggcatccacagttactgttgacactgaatgcagctgaagaaactgcatagatactataccactgaacctacctggaaacaaagtcaccacacttttcctaattagcacactaagatccaactacaggtgaaagtctttctctgcaaaagccactctagaaagtctggaagaggcaatttttccaccaaatgcatagacattgatgtagaaacacaagaaatatgaaaaagcaaagaaatatgtcaatgccaaaggaacaaaataactccctagtaacaaaccctaatgacaagaaaatcaatgaattgccagaaaaggaatacaaactagtactcttaagaaactcaacaagatacaagaaaatacagatagacaattcaacaaaatcagaaaaagaatttattatataaattagaaattcaacagagatagatattataaaaaataattcaattaataaaataaaaaatacaataggcagcttcaagaacagacttaagtatagaaaacaatctctgaacctaaaaataggttatttaaaattacttagctagagagaaaaaaaaataagaaagaaaaagagtttttaaaaaagactacaagacttataggacaccattaagtgaacaaattttcatattatggcagttccagaaggaaaagatgtattaaaaaaaaaacctaatttaattatctaatagctgaaaatttcacaagtctggatagagatgtgtatatacagatccaggaaactcaaaggttcccgaatagattcaagccctgatgcacattatagttcaattgtcaaagtcaaagacaaagcaagaattctaaaaacaacaagagaaatgtgtcacagtacatttaagggaatccccattagactaacagaagactttcagcagaaccttatagaccaggaaagaacagaaagctacattcaaagtactgaaggaaaaaaactgtcagtcaaggatactatatccagcaaatatatcctttagaaatgaggaagaaataaaacgtttctcagagaagtaaaaacagggaattcatcaccactagaacagttttacaagaaattctaaagggactcctgcatctggaagcaaaaaatgattatcactactaagaaaacacacaaaagtataaaactcactggtagaggctgagcatggtggcttacgcctataatcccagaattttgggagtccaaggtgggcagatcacctgaggttgggagttcaagaccagcctgactaacatggagaaatcctgtctctactcaacacacaaaattagctgggtgtggtggcacatgcctgtaatcccagctacttgggaggctgaggcaggagaatcacttgtacccaggaggtggaggttgcagtgagctgagatcgtgccattgcattccagcctgggcaacaagagtgaaactcatctcaaaaacaaacaacaacaacaacaacaacaacaaactcactagtagagcagatacacagaaaaaaagagaaaagaagcaaaacttatcactacagaaaatcactaaaccacaatgataaataataagagaagaaagaacaaaggatatgcaaaataaccagaaaatagttaacaaaacgacagaagcaagtcatgacttatcaataataaccttgaatgttaacagaataaattccccacttaaagacatagactgacttaattgatttaaaacaaaagaaaacaaaaacatgatccaactatatgctttctataagaaattcacttcactactaaggatacatacagattaagagcaaaggaatagaaaaagatactccatgcaaataaaaataaaaagcgagcaggagtagctttacttgtatcagataaaacagactttaagtgaaaaaactgtaaaaagagacaaagaggatcatcatataatgataaaggaatcaattcagcaagaagctacaacagttatatatgcatccaacactggaacacattgatatataaattaaatagtattcaatccaaagggagagatagaccccaatgccataatagttggggaccccactctcatcactggataggccatctagaaagaaaatcaacaacgaaacattgagtttatactgcattttagctcaaatggacctagcagacatttacagaacatttcaactgacagtggcagaatacatattattttcatcagcacatggaacatcctcaaggacagatcacaaaggccacaaaataagtctcgacaaatttaaaagaagtgaaatcatatcaagtatcttttctgaacacaatggaataaaactagaaatcaataacaagagggacttttggaagctctatgaatacaacatgctcctgtataaccaaagactcaatacagaaattaagaagaaaatttaaaaatttatgaaaatggaagcacaacatatcaaaacttatgagatacagcaaaaacagtgctaagagaaaagtttataacaataaacacatcaaaagagtagaaagactttaaataaataatctaacagtgcaagaacaaaaatgaaaacaagaacaaaccaaacccaaaattagtacaaggaaagaaataacaaagatcagaggagaaataaatgaaattgagactaaaacttacaaaagatcaatttttaaaactttttttgaaaagataacaaaattaacaaaccacgagctaaactaaccaagaaaaatgtcccaaataaataaaattagaaacaaaaagagagaccttacaactgataacccacatatacaaaagatcattagagactagtacaaacaactgtacacccacaaattggaaaaccaaacagaaacaaattcctagacaacctaacaagattgaacctagaagaaatagaaaacctaaacacaccaattacaagcaacaagttgaatcaataattttaaaaatgttctatcaaagaaaagcccaggacctgatagcttcactactgaattctaccaaacatttaaagaagaactaatgcccatccttctcaaactcttctagaaaataaaagagaagggaattctttcaagctgattctacaagaccattattaccctgataccaagccagataaggacacaacaaaaaaaggccaaaatccctgatgaacatcgatgcaaacatcctcaacaaaatactagcaagttgaatccagcatcacattaaaaagaacattcaccatgatcaagtgggatttatcccagcgatgcaaggacggttcaacatatgctaatcaataaatgtgatacttcacattaacaaaatgaaagacaaacaccatatgatcatctcaatagatgcagaaaaagaaaagaaaattcaacatcccttcctgataaaaaccctgaacaaactaagtatagaataagtgcacctcaacatagtgaaggccatatatgacaaatccatacctaacattatactgaacagggaatagctaaaagcttttcttctaagaactagaacaagaccatgatgcccactcccaccactgttattcaacataacattggaagtcctagccagagcaattaggcaagagaaagaaataaagggcattcaaaatggaaaggaagaagtcaaattgtccctgtttacagatgacataatcttaaatacagaaacccatataagctgtaccaaaacattcttagaatgagacaacaaaatcagtaaagttgcaggatacaaattaacatacaaaaatcagtaccatttctatacaccaacaatgaactagtgaaaaaataaagcaagaaagcaaccttacttacaatagctacagaaagaaaatataaaatacctaggaataaatctaaccaaggaagcaaaagatctctacaattaaatgacaggacactgataaaagaaattgaagatctggttacaaaaaaaggaaaatatcccatattcatgaattggaagaacttatattgttaaaatgacaatgctaccaaaaacaatttacagatttgatgtaaaccttttcaaaataccaatatcattcttcacaggattagaaaaaatcctaaaatttatgtggaaccactgaagaccccaaatagccaaagcaatccccagcaaaaagaacaaagctggaggtagcacattatctgactttaaaatatacaagaaagtgataataactaaatcatcatgttactggagtaaaaacaaacacatagaccagtggaacagaacagataaatcagaagtaaatcctttaattatagcaaactgatttttgacaaaatgccaaaaacattgagtgtgcaaaggacagtctattcataaatgatgctgggaaaactggatatccatatgcagaaaaaatgaaactagacctctgtctctcacatatacaagaatcaaatcaaaatggactaaataattaaatgtaaggcctcgaactataaaactaagaggaaaacattggggaaaatgcttctgggcattggtctgggcaaagattttttggataagacctcaaatataaaggcaacaaaggttaaaatagacaaatgggattatatcaagctaaaaagcatctgtacagcaaaggagacaatcaacagaatgaagagacagcccacagaatgggagaaaatatttgcaaactatccatttgacaagggattaataaccaaaatatataaggaactcaaacaactcaatagcagaaatgctaataattcagttttaaactgggcaaaagacctgaatagacatttcttaaaaggagacatacaaatggacaagaggcatatgaaaaaatgctcagcatccgtaatcctcagggaaatgcaaatcacaaccacagtgagataccatctcaccacagttataatggctactatgaaaaagacaaacaataacagatgctggagaggatacagtaaaagaggaatgctagtgtactgatagtgggaatataaattagtacagccattatggaaaacggtatggaggttcttcaaaaaaactaaaaatatctacaatgtgacccagcaatcctgctgctgggtatatatctgaaagaaaggaaatcaggatattgaagagatatctgcatacccatgtttactgcagcactattcataatagccaagatatggaatcaacctaagtgtccatcagctatggatgaaaagataaagaaaatgtggtatatacacacaatgaaatactattccgcttattttatacaattaagcctaaaatatattttaaaaaataataaaatcctatttgcagcaacatggaactggaggtcattatttttatgtgaaataagcccaacacagacaaatattggctgggctaagtggctcatatctggaatcccagcaatttgggaggctgagggaggattatttgagcccaggagtttgagaccagcctgggtaatatggcaagattctatctctataaaaaaattaactggctgtcctagctacttggaagaccaaagtgggaagatcgcttgagcccagaaaattgaggctgcagagggccgtgtctgtgccattttaactttactccagcctaggtgacagactgagaccctttctcaaaaaaaaaaaaaagaagaagaagaaaaataataagaatgacagacaaatattacattctctcactcctatgtggaagcttaaaagtgtggatctcatggaggtagaaagttgatgggtgctactagagcctggaaagggtggcaagaggggtgaagagaggttggttaatagatataaaaagacagctagatagaaggaataagttctagtgtttgatagcacagcagggtgattatagttaacaataatttgttacatatttcaaaatagctgcaagagagaatttgaaatgttcctaacacaaagaaatgataaatgttcaaggtgctggatatcctaattaccttgatttgatcattgcacgttgtatgcatgtactaaagtatcacatgagcctataaatatgtataattattatgtatcaataataaaaaacattaagtttaaaatatatctttaataaattaaacttttgttaaaagcccaaattatagtaaataaacccttctgcatacaaaaagtgatctattagccactgaaaatcttataagagagtttttatgacagacttatgagcaataataagtattttaaaatataaatcagatcatgtcatgccttggcctaaaactcttcattgtttaacagttactcttatgagaaattccagtctcccagccaaggtctatgaaactcttcaaaattgactcttgtccacttctacctcctcaccaattatcaacctcactaccccagtcactttggccttttttcctctttctgatacatcatgagcttattatggcaacaagtcttttatatttgttaacttctctacctggagtacttttcccaaaatattttgcaaggtgggctcttgcttgacatttaactctcagctcaaatatcacctcctccagatgcctcctctaattgtcctttacaccaataacctctgacacattcatatgttttacagtcttaggaatatcctcaatgcctgacttaccatattcatttattggctcccatatttatttccccctctcccaaataaaataaaagctcaatgagagcaatatcttgtctttcctaaaccattgcttggcacatattaaatgctcaataaatatctgttgcacaaatgaataaacttaaataaataaaacacatctttgccttaataccaagttatttttaaatcatatccttatgtaatatcgaatccataagactcaattatctggggtttatttgacaaatttgattatcttatttgggggttaataccatgaatggctaaaaataggccaattgccaagcagagcacacaagcaaatatgatccctccccaggatgcttgccatccaaattacaagcattgaaaaatcttggcaaggcgcctatgctaataagaaagtgatccaatattcatgagaagaacttgaaaaactattatttttgcctgcaatcttcttggcttttccataattaatatgtcattatcatcagaaggctaagagatcaagagtggtaaaagcaacctttcatgtaatactcatagggacaatggtatttagcaaatatcacattgacttctggtaagagaaataatccagaatctgtggttgctagaaacctagtatatggaaaaaatagaggggcagttggcatcaagacagaaaggtagggttttaaagctgatctagaggtagaaaaaaacacattctagagattcctgaagaaacaaattccaagtactcattgtcatgaaaaacggtatgatggagtcctaccctctgtctgtattgttcttttttaaatagatcttcctggttaggtcaggaagaagctattcttgaatgccagttaatacattcctccatttactcaacattctatccctacaccaaattagctcagtagaaaggctatctagactatctactacctaggtcataatacattagcaacctgtacaaatgtcttttcagagtttcagtttatagcatgccgtggtttgttatccagggtgaatctaggaaacaattagatctataatctcacagcaaacttcatttgactatatttgcaaatgttatcaactatgttatttttttaccatcatatatataacgattgatataaaaagtttttcttacagttaggaaaaatttgtctctcctgacaaagtggtattcttccttttgcaactaatggcagttatgtaacttgcttctcttagatggccttggccatctaagaagctcagagcagaactaacttgtttaggtcgtctagaatgacttcttccgatccctatttttctctgcttaaacttgttgttcagttctgttaggacttttgttttgttttgttttttacatatatgccttttctcattagttggttaaaatacgcttttaaagtgtataagataaaaatagtagagccagacacggtgccttacgcctgtaatcccagcactttgggaggccaaggtgggcagatcatctgaggtcaggagttcgagaccagcctggccaagatggtgaaaccccatctctactaaaaaatacaaaaattagccaggcgtggtggcacacgcctgtaatcccggctactcaagaggctgaggcaggagagtcgcttgaacccaggaggcagaggttgcagtgagccgagactgtgccactgcactccagcctgggcaacaagagtgaaactccgtcccaaaacaaaaaacaaaaaaaaagagtaaataattttgaaattttaagctcccttttaccaaaaaagggttctgacttctggccagaatgtagtaaatgtcaagaaatcagtcacagctgaggtagtgccaggaatttggtgtgggggacaggaggagacaagcaaagactatttaaaaacaatgaattttagcctgtctataagtactcttttctatgaaaacataaaaggaaatttcccttacaaatgttgattgataaacatgaacgtctatatggaaaataatgcgatatctgagctaaaaggactcttagtgaactctgatccaatctccttgatttgaggatagggaaaagtgtaatccctaaaagattaaatgatatttccaaagaaacaacaagttggtaattaagtccggcctgaaatctggggcttctgcttcccaggttatgagctttctaacactccaagaactgtgaaccctggagggaaggttgtaatctgactttaactcctgaggacatgtggatatgcccttcagggtccagggacatttgggttgcacattaacagttaaaatatgctaaagcaccgcattttctccaactccattcaatgcctaaggtttattgtttgttcagttttagccaactatatttcctgagtgtttcaaaaggcagcaaggtggcgaggatacaagggaaagccgctacacattcaacataggaatacaaagattatagtagaattctacgcatcaaattccaattcaaatttcttctggggtcagtgtcagtatctcccacttcctcctgacacatcctgagctgaagatcccttttaaattttctttctaagaaaaaaaaaaatataggtttattgatctcctttaaatgatagctttagaataacatgtcaaattatttctgtttcttgacttattctaggaaaaaagacaaagaaataagatattcatataaatgaaaagtttcacagccggcaaccaactaattggtatatatttaaacacatttaagatattacttgattacattcaataggcataatgtccatataagaacaatggttttgtttggaacatataaaagtgatagttctgtaacatgtatttatttaactttttattttgagataattatagattcacttgcagtggtaagaaataatatagacagatcttttgtatccatcacccagtttctcccaatggtaaatcaagatattgacattgatacaatccacctcagatttcaccatgttagatataagttctaaatttctcatcaaagaataaatatgccagtatgttcaattctttgccttctacttttaaacttaacttcctcgtaaagtaacctttttcgattacctactccaccccgactcattccaattcctactccaccccaactcattccgatcacctactccaccctgactcattctgattacctgctacctgctctgccctgactcattctccacgctgcataaccattttttttccctccaaagcactcaccccctcactctctttaaattagccaattggaattagtttcgcctgcgtggtctaatcctagccaacaggggaacgacacggcagcaggggccatgtgcctcagggataagaacaccttcccctcccttgtccaagtgtgcgctcaccattgttccatctgtaagggcgtacccttctgtagaagtaacttgccttgctgagaattaaaagaaaattttatattcgatgccgtttcttttgcggcaccgaaactttatatataacaaccactttgacattcatttatataaagatcaatttttaatagctacaatctatagagcacttctatatgccagaccaactgctcactgatgaacaaacattcttctagttcattcctacaaaaaacaatttaccagtggaggcaatagtgaggactgtagcttagaagctttcatgctacaatgtagtatatgctacagtgtagtaccctatagctgtatgggtggttcattttaaaaattgtatatgcagccattcctcaataggctcaaaataaatattgacagaaataggtaagtaaatcaaaagagaaaatcaaagccaggaatcaaaagaagaggcaaattgggttaatatgattcaatttacgtctgggcttcttggtagacaggacaaaaaggtaaacagaatgagatatgcaatcctttttgtcaaaaggggaaactcatattgatcctttaagatatagatgtttaaaaatatgtctatgtctgtgcacatacccttatgctagctccagctcagttttttaaaataatcttttcagtcagagtttatgaacatccaaataaaactgtgtcaacacatgcttaatacatcagtaaaactatttttaataatgtactctcctattgaatatgggttggttttctgacttgctatggcccattgagtgcacagatgtcacagtgttctacttccaggtagtccttaacaaggctggcagcttctactttgaaactttccaaaaaattagcttccatgatgtaaaaaaaaaaaaaaaaaaaaaaaaaaaggccaatccagaatactacatgataaacacttgtgaagagactgaggtcatgtgcacagcaccaatgcacagatacgagtgaatccgttgatcttccagggcagcatagccgaaagctgaatgcagcctagtgattgacccagcctacaccaaatggagcggaacaactacccagccaagccacgccccaattcctgacctacagaaccttgaaaaataatgaatcactgttggtttaagcaacagaagttttgaggtagtctattacacagcaatcaataactgaaacaataacccaaactgataacctgaaaattcattttgtaaacctgcatctaaacttggtacaataattaaacattttctgtgcaagtagtccctcttatatgactagaatgtgtggaatgcctaggagcagcttttccaaatgaattcatcaataaacataaaacataaaatgaactgctctagttttcccagagattctgcctagaacagactgccctaggacagatgattaagttagtttgggtccaattcatgactacataacatggagttagttatgtcttaggctacgtcccttcaggcaacttggagcctcccagggttaaagaagctctgccaaaactcaaaatcaatagggccatttaaatgatgacatccccagtgggtaaagatatttgactccacacatcaatggcatgagctactgtcatgggcattcgtcaataggttgaagatctcattaaagctttttaatttctgcttagtggtattaggatttaattgatgccaaagacactgcctgtcactatacagtgatgttgtggcagtcagtagagaatgtcttacacacagtcctagaagaccttcctagaaaggccagggcagttctactggctgcatttcctggcttgacaggctactgctactttatagtagctctctctatgttgttctaccttcccatcatccgtgcacccatcttcttttaccagcaacccaattttctgaaaaactactccatctttattcttagtccatgttgctcagaagggtttgattctacccacagcttcaggcatgggcacaccacccagatcaggttgatcaccctggacatataactcaagacagtgtcaatgagatcaaaactttgaactctcaccaatactattggaaatgagaaactctattgtttcccactgggttgctaaactggtagaatggaatgggtatatataactgacagcctttttgccattccagggagataaaccctaagaacaaacaatgcatagatcacttgatcttctggatccagcagttctagaagtcatacgtgtctatattttttcagtatataagccaataaaatatcattttcatctaggctgttttgagttgtatttgctatctcttgcaatcattctcagaaactgccaaaagatgggctgctgcacaactatgggatgatggaatgccatttattttctgggacagtgcaatttattacaatttattacactccctttctgagccatagatcagaaagtacccgggcgttaagacaacagcacttcaaaaaacaatatcatacttgatcttcataaagttaagtgagcaaacaaggaaactaagacattaatgagacatgtggttcaaaagtcatccatcaaatcaaatatggcaccaagactggaaaccaagtcttcatgaaatgcgaggtttctgttgcttgaatcaatggaccttaaaggtgatttggtcttatggctccccaatgtcagtccatggattgggatctgttgccagagtatgttcaaatcatcaatagtccacagagtaatgagaaaaataaagaaactttgataggttttaatggagcaatttcatttcacttttaaagcctgaaatttcatccttccaggtttgtttggttttttcttttggtgttaacatatcctctttttgaaataatagcaatagtagatgtaaatcatcttttttggctaaatataaagtaagcaagcccatagcctcccctggaaggcactgccattgtttccaatactctcagctttaacactgacagctacccttgctctctttctcactgacacccaccaactcaaccagccctctcccaccacacaccctttctcaggtcacctctgtgctctccacccttggagctttacctctgggtaattcccttgtcttttgtaatgtatattagagtgtatattagagtgtaatgtatattagacgtctataactcctgctattactctgctcagcaccttcttaggacagaagcagctatcctttctcctgagaaggtgggaaaaaggcaaattatgcatacttataaataaatatttgttggtctcaaacaagtaaatttataaacattgatactaacattactggaagcataaaagcattagaaagacattaaatgccctacagtagagtgaaaattaaattctgccatctaggagaatagtatttagtcattaaagttatgattataaatactttgtaataatatgcgtaaatgcatatgatataaggttaagtgaaaagatacataactacaaaatacaactatgttaaaatatccatgcatggattaaaaaaatacagctttaactgcatagtggagttaccggtaatgtctacttttatatttatagaaatctctgttgtccagattttctgcaatgggtacatatgacttttgatggggttcagaacatgctaccacaaaacatggcaccttggcattttgaatattttaagctgaaggagtctgagaaacagcatgtgctggaaggactctctgaagcaggtcagaagccccttgtgtgagaggtccctccctaaacccagagaaaaggagcatccttatctctgaagatggagggacacacggagaagaaactccaggaaccagccttggtaagtttcccctagtttactacacttagttcatatgcttttccacaagtttccactcttcatcaaacctagtataaaagcactcaggtttaactgattcatcagattttccttccttatgaatgctctagtgacacataaaacttgtattaaatacatttgtatgcttttctcttattaatctgtcttttgttatagagccctagccaagaaactaaaatggttaaagggaagatttttcctacactttaaagtgtacaaatatatatttattaaagttagttccaattattatgtagccaatatttactgattactctactctgtagatgccaagaaagccatactctttcctgatagtttcctttgtgtgacaagatttgccacagatgtaggcaatgttggtattatacttttcttgacagctagaataacttctgctaagctaggcaaccacatctctccaagccatccttaatgcctaatgactgccactgcacctgacctagctccagggctgaccctttcatgtttaccccaaggccatgcccatctgggaaaccacctgggcaggtaccttccaaccaaattaaagtcaaggattccatccactatcactaaactagcacaaaccaagagagagaaatcaaggcaccacataggggttaggacaagtaatcaaagtcaggtagaaatcccagaagggtggtatacaatttatatttccctagtgaggcccattctagaataatgggaaaggttcactgttgtcagaatgccaagaatgaattctctgaatctggccttccctgaaatcaacacttaggttctgacaacctctaaattcatcctcactaactacatcaaacatttagcatgctttttattgtggggatgggggttgcttttgtttgatttggtttatctggcatctgaaacaaaagatgggaaaggatgacattcattcttaacctcgtgtatagttaaccacatcaaaaaaggctattgttagatacaaataaacgttaacatacattagttccaaaaggctaaagcctttcaggtgaacattattggacactttctcccctgtgccagacaaaactatgcatggcttattcccagagtcaccccgtcctttccaaggcattctatgctgcctcagggatgcaaacaattatggtacttccaggagagaaggagcacataaattctgtcaccccttgaccccaggatccaatttcacagcaatgggtgaaaggattttttagtcaagagatgatgtgagacgcacagataccccttggagtcatttgggtgacagcattaaagagaatgaaatgagctatcttgaaatggaggccaagtgcagtcactgcatctggaaagttaggctccttgatattcaaagctctggggctcggcaaaaaattcaaagagcttttagtattcaaaacaaaacaaaaaaaaacaaacaaaaaaacaaaaaacactctttaaaaaattaaaatattcaaaactgtggaaaacttgcaagaatcatatcatgaacatcccatactgtcttcccaagattcatccatttgctattattttgccatatttgctttatctcttcctcctcctctgctccccttccctcaaacaaacaaatgaaaagtggtttttgctaaaccatttcggtgtaggtgtgaacattaaaagcttctaggaattacagtagtctctcacacatacaatgatcaaaatcagggactttaacgttgatagaatactatcttacacgtagtccatatttacttttcttcaatcccgagtgtcctgtatggccactttcctccagtctaggatcgcactggcttttagctgtcatgtctctttagcctccttgaagctggaatactttctcagccttcctttgcccatcatgtcattaacattcttgaagaggacaggcctgtggcttttcagagaatctatgctggtctgactgttatatgaggattagattcatagtacatgtttttgaaaggcatactacctaagtgatagcatatccttctcattgcattacatcagttggcacctgatgaaacttggtcccattcttgatgtgttaaccttgattccttaaataaggtgttttctgccagattacctcactgtatgtgtgtgtatgtgcaggtattcctctttttcccttttataattaataatgtatgggaagacttttttctgactgtgtaaacaccctgctaatcaacaagctttcactcaatggtttaacacctattgacaattctactctgaatcaattattactataatagttgtaaaaaagtgatttttctaactctattatttctttcacagcaattagttggttttctagtgcaagaaacagctgccctttctcccttctttccttcctttccctccttccttccttcctttctttctttctttctttctttctttctttctttctttctttctttctttctttctttctttctttcttctttcttttggttatatcttactcatttgattcttaagtgtcccatttcaagctggttcctgtgtcattcagacaggtcctcattttttttttaatcagtttttattttctggcacaacaaaatgttccaggcttttcttgtcctttccctgctctgaaactgcaattagtcattgctctaagcaggggtccccatccccaacctccaggctgcagactggtaccagtctgtggcctgttaggaactggctgcacactaggaggtgagcagcgggcaggggaacctaactgcctgatctccgcctcctgtcaggtcagctgcattagattctcatggcaacattaaccctattgtgaactgcgcatactcattatgagaatctaactaatgcctgatgattttagatggaacagtttcatcctgaaactatccccgctcccctgccaccgatggaaaaattgtcttctatgaaaccggtccctggtgccaaaaaggttggggaccactgttctaagggcccttatttttagtggggaatgctatttagaaagcaagagctgggcactcagtgtgttcactgctgctaggagtgttattgcttgcaggccctttaagaggacaagtaagaattataaatatatattgagtcatgtcttcctattgatacttctaatctccatccaatagctcaggctcttccttgcctttccccaatccacagttgtactgccctccttccacagtgataagcctgactccccacaaaataatacatttacttaatcctacaatggatacaaagtaatttcagaattgtcccacaaataacacaaccaagaacaaatgtataaagttcaagatttctttccagtacttctgttgtttgattgaaggccatgcccatctgggaaaccacctgggcaggtaccttccaaccaaattgaagtcaaggtactgcattcaaaataacttgaatcagtatttttttcctatgtgtaatcatgtcatccatttgatatatagttaggttcatttactctgtactcaatttcccccatcttgttatttaatgttatttcggaatatacaaaccatgaacatggtttcaaactcaaaactatataaaaaggtattcagagaagtactacatcactgtcttccttccctaactcttctaatgctattcccaccctgtagatgaccaatttcatatcttctagtttatccttcctgtgtatccttttgcaaaaataatcagacacatagataaagacatttttatttccccttctttctacctgaaatgcagcatgctatatatagtcttccacattttgctttttgcactaccaatatcttctggtgatcactccaatcccgattcacagggatcttcctcatcctattttacagcacactactgcattaatgtattatggctcattcaaacaatctcctcattacaacataaccacgatgatgctgcacatattattatgagagaagttgaacatattttcatatacttaaggacccttttttatcaatttttgtgaactttctaggtctttgctgcttttctatcggatttatggtctctttagtctcctcaacgtgtagtaactttctatatattagcaatattagcattttatcagaaatacatcttgcaactatttcctcctggtttattacgtgtggtttatggttttttgccatgccaaagaggattttgtttaatttctaactttacacaatcagattttactacatctgaagtttgaattgtgaaaaacctttccttgtgcttttcctttttgttataaagcaatttcttatactggctaatttttaagtatccctcattacactatacatgggaatgtatgtaagaagaaaatcctatttgcctactgaccgctgggcaacttcaaaactgcatgacctttatttctgcaggcccttcatttcctagctgcatccctttcattttccctaaccccaggtttcctcagcaggccagcttcactagagagctgtaaactaaacctaaattactaaagaacacattactcactcatcataaccataggaatctttctctagagcaaataagaattagtagtacaaatctgttttataatcacatactttcacaaagcaagaatcaccaatagtatactttattgtctctcattgatgggtacattttctcttattatttttattatcaaataatccatgtttattttaggataaaattaaaactacagctaggcaaaaacaaatcaagatgttggaactgttaatattttagggcatatatgtaaacacacacctatttaaaaactctcttctttttatacctattaaaaaaaccctctgttctctactatacttgctattttgtaatctgtttccattttcatttaatataaacatctttccatgttactaagttgtctgcaaaggcattttaaaaggctacatggtattatactgtataaagacataaaatattgaaccaaatattgtgctcttaggatttaaaaaaaatatcgtaaacaactctgagaaaatttactcagacacacaccttcatgaatttgttcaaatgcttctttaagataaatacctaaatgtggaattgcaggattaaatagtacacaagattttcagggttttgatatacgtggtcaagttgccaccagcagtgtatggtgggttccctttacccacactgaacccacattagtgttatctttctctgtaatcctttttatctcctgatttagcaagactaaacaacagtgtaaagttctgcaaaagcaccagataagcaaatttagaacaaaacattactgatgtctgcccaaaactctgtaaacctgttcctaggctctaagctgtctattgaaatgtcctaagaaaccatttcactcagagaagaacatttttttcactcttcctgcacagctcagtctttacgatgttaaaatcctgtacaacttcctaacagcccttcacattcttcaggagcccgagtttggttctggttataaatgcataggatagatcccatacgggaagcatagacctaagaaatttatggaaaggaatttatgggaaagcttctctcatcagggctgtaccaattaaaaatccataaataattctcccttgtcagtttctgtataaacacattggccttagaaatttttacttcaggttctagtctaatggcctacacttctaaattatgcttttaattgaaaaacaataacatgcattttttttccagaaccatctgtgctttcccaagaacatgtaactactacagataaatccgctactttgaacaccctaattatccagtttagggttccaaaagcttaggaaaataatgccattcctgaaaaacagtacgtgatcagaaacacttgctttaaaattcgatatttggtgtgtgaagcttcttaacaagtgtttattaaactgcataatttcaaagcctggagtggtatattgcaatgttttcctcggagttgatcacatttgcatatctttttacacttcctgtgaaattaatattgccttttgtatctcgaacttagctaatataacttgccatttttacttttcactgctatgagtaatataaagtgaacccccaaagggacccctgcaacgcctacataagctttattctctcactgttgtattttttcatatgaatatattaaatcaagattaataaacctttgcagaatccactggtcctgcaaaaaggcaagattcataacggtaaaggctgctcagcaaataaaggaaacctgctcctaaaactggagccaaaggccggggttcatggagctcttgtcacatccaacagtgtgccagagactcttcacctcacaagaagtctttcaacagtcactcaataatatgtgcaaaagtggcttaaccaccaggataccaaaacccagccggtgattatcaggctgccttggctcagggatacatctttgtgagatgccaaaaactgaccataatcccaggattttaaaaatttcagctgggcttatggggatggaatgtgataataaagaaacaggatggtaggggctgaggaaaagtggaacatgatgagaggctcctaaaagcaaatcaaacacagaaaagggaaatctctctgaacactgcataccgcactgggcacaggagtcctcagttgagcatcccccactcattgggccccagcagctactttgcctagctaagaatctgctcaaagctcagggaaacctaaatggcaatacaaagaaagagttgggggcagcttcaagatagcaggctactggtacaaatactttgtgaggtcagaaaggctcactatcatgacttgtactgctgtcattgattctcctacttcaagatcatctccaacttggtcaagaggcagagtaatggggattcagggccacagttagggtgcagcaaatgaggtacaaaatttaagtagaactaaaaacaacctcagtagccaggtgtggtggccatgcctgaagtcctagctacatgggaggctgagataggaggatcacttgagcctaggagtttgaggctatagtgcactatgattatacctgtgaatagtcactgtactccagtctgagctacatagtgagatgcccatttcaaaagaaaagaaaaaaaaaagaaaaatcctcagtaatcaagataataatacttcagtgcaatctttttagaaaccaaaaaaatcatggtgaagaaaacacaattttaaataaatattaatgccctgccaaccatatttgagcctgcatggacacttctacctacatttttaatatattttaaaaattaatttttttggagaaccttaaagtcattgaagaaatactgaaaaattggaaagtaggtatattaaaacttacaatattaaatgtaaatattttatttatactaaaatcagaattcattataatttcactttcctgactctaatgggacaaagtaattttatttttatgttttgagatagagtctctctctgtcgcccaggctggagtgcagtcgtgcgatctcagctcaccacaacctccacctcctgggttcaagtgattcccttgcctcagccttccaagtagctgggactacaggtgcatgccaccacgctcggctaatatttgtatttttagtagagacgaagtttcactgtgttggccaggctaggggacaaagtaatttaaacatgttttcaaaacttacttctttgtttgtcttcttttcaatggaagaattaccatgtttgacattctcttatcacctagtgacaatcataaatgatttttaattaaacaatttactttctttaaattaattttattttgtttttccttagctttaggctccaaaatggcttggcactgtactaatccttatttaaaacttcaatgttttgttcatcatggatttttctggcatttatttgatttttgaaaaaaatggaattaaactatttgtcttgatcactaagtatgttgacattctcttaaactgtgcattaccttgttccatccaaatcaaagtcaaggatgtagccatctcagacaaataacataacaatgactttaagtgtggaaagaagcctaagatcttttattaagtgaaagaagtatgtggcagaataatatgtatagtatgggctcacttgcacttaagaaaggccagaaaaacattttaaagaataactctaagtcattacacatcaaataaacattgacggcaaaaggtaaaaagtgtagttactgaagcaagagtttctaaatcatggtgctgcaaaataatacactgggtgtccaagtagcagtaacaactaagtattaccctctgctaacatctgatatctttgaaagattgtctctacaataatgtcattctcattcacttgtagctaggtactttttttttctagagaaagagatgggatttcagcatgtgtactaggatgacaagcaaacactgtaggttcaaggaagttcatgggcatctcaacaatatgtgtggtggtgaaaaatacactgagaaccactcatctagctgctactgatcctattccataagctaggaatacgtcataagtactgttttgtcctcgcgttggggatttttgttttgttttgtttttttgtacctcctcagtatcctcctctgttaagtaatagcatttttgtttgctttttagccaggtttatggaggtataatttaaaaatagtaaaatttacacttttagtatatatttatatgaattctgacaaatgcatatagttatataacaaacaccacaatcaagatacagaacatttctatcatcccaaaaagttcccatgtactttgccatagtcaatctttaccctaattctccagcctctggcaactgctgatttgttttccctataattttgcctgttcaaaaacatcatataaatgcaatcataaaccatttatgtctgacttcttagtgtaaagcatttgagattcatccatttgatgcatatctcagtaatttatgcctttttattgctgaatggcatcctattttatggatataccacagtttatttatccatggtaataggatttggattatgatttcacaaatcacccatacttcctttcaggtcatgtggtttataaagggctgacccgaaagttccagagatgcccatagccaggcctgatcaaataacatattcagtcatcctgataatatggatggtttagagctgggcacatggtttgatgtaacaattttcgattcaagacaactgacagaactattggtaagaagttactgatggtataatggaaactgtttctggtagctattgcaccaccacaagggagccccaacttgaggataataaagccaacaggaagcaaagtgcaactaagtggatgagataccttcctaacctagtttgagcacctggatccagacatgcctaaagatctacctgtagacctgtcagttacatgaacctataaaattccttctagcctaggccaattttgattatatccctcattcctgaaactaaaatctcttgactctacagcatagaaagaaatctttcatcaaggaggttacaagagagtcttggaaacaagacacaaaaaatggttttgacatcagacaccccaactttaccacttactacttcctaagtatacaatgtcaagaattctctttactcctataaacctgtatttcctcatttccaaaatgcagagaataattccttacccattctaaaatattatcttgagaatcaaaaaaactaagttggttcaaatacaaaagaaaaataaaatgtatgattattatacacacaaaataatttgtatatgaaaaggagatattaagtgatgacggtgagagagaatcaagaggcattataaggatcaatgcagaactccagtgcttatataaggatcaatgaacaataattgtaactagaggtatttcttgagtatattcttgtgttaggcattgtgtcaggtattttacctacattatatcatttaacattctaaatatcactaaagtaactttttaaacccatttttgattaggcttagagaacataaaatactttttaagttaaagtactaactggcagaggccaaataaagacctaaatctggaccactgaaactagtgcacacttctaagttagatggaaggcatgaagcaaacactttggaaattaaaattcagttataaaaaccatcacaacacaattaatttagcaactacattcctttatacataattgtgccgagtgcatctaactcattaagatgtagaatgtttatgctgtcatataatattatcacatggtaataaatgaagttgcactatatctctaaacatctggatttcagagccaattttacacatttaattcagctatttggtgtcttaaacacatagcaaaaatacacaaggaaaaaatgattgtacatctggcatcaagatggctccaagaattggactgccaatgaggaagtcaggtttttctagcctatatcctctggaggataaatacccaaaatagtactgtttccaaagtaaccaaaatcaagaaaggagactccacaaaggaaacaagaatgaaaaagacaggcctagcccttttcaaaagctgagccttccctcccaggatccaaggtacttagggtttctcatacctgacaacctataaacgagaaagagtatcacttgtttgtccttccatttctcattttccagctttggtgcttatcaggttctccagaggtagcaaatttgtaagacatttcatctatttagattttcatttattcatccatcctttcagttactcagtgatgacttctatctgctgagccctgcactaatgatccaaaattcccaatcttcctgcctaggagagatagggagaggtagggaatatggcttctccattttctccttttcctttagtaaccaacctctactggaattaatcctttgagttcagctgggccttgagatccaacatgatttgttttaaaaatcaaggcaactattaatgtaaaaacaaaacaatacaagtattaggagaaaacatgagagaatttctgtacaactagatgtggggaaagcctttctaactataactcaaatccaaatgcaaaaaaaaaaagaaaaaaaaaagattgagaatttcaattacctgaaattttttaaaatttgcatagcaaaaaataccataagcaaaaataaaaaattaagtgcatgataggagaaaatatttataaaatatatcacagattaagctccaatcaccctaatatatattttaaaattcttggccaggcgcagtggctcacgcctgtacttcctagcactttgggaggctgaggtgggtggatcacaaggtcaggagttcaagaccagcctggccaagatggtgaaaccccatctctactaaaaatacaaaaatcagccaggcacggtggcaggcgcctgtaatcccagctactcaggaggctgaggcagagaattgcttgaacccgggaggcggaggttgcagtgagctgagatcacaccactgcactccagcctgagcaacagaacgagacttggtctaaaaaaaaaaaaaaaaaaattcttaaaacccatttttagaataagaaaaatagaaaaacaagtagttcacagatgatataggaattgcccttaaacatatgaaaatatgcttaattttacttataataagagaaaagcaaattaaaactacactaagaattataaccatattactctaacataagaggttatcaataggagaacctgggtgtggtgtacacaggaaccctttactatcttcacagcttttctgcaaaccgaaaactcttcttaacaaaaaagttgatccaaaaaaagtacattgagatactatttcttgcctatgagattgtcaaaagttgaaaaacttgacaatatactctattagcaaacagagtgtagagcaacagttcctctcaggcattgctagttagagtgcaaaagggtataacctgtgtaaagggaaatttggcattagttaacaaactatgtgtctatttccttttctatctttctacatacctatctatatatttacttaccagcaatgtcagttacagcattcaccctgaacatacaccttcaactgtatgaaaaaacgtggacataaaattattcactgtagtgttatttccagtaaaaaatactggaaagaatctaaatgccatccatagatacaatcaatagtagtcctttgtgtgaacaaccaatatacacatagaactactattcaactgtaataaggaatgaggaggatctttataaaattatatgaaataattgccaggataaaaaagcaaggtgaaagagtatacatagcatgctaacttctgtataaaaaggaagcgtatgtatatttgcttctttttataatgaagacatgaaggataaaccagaaactaatgaaaatattttcaaagagcgtgagtaaaaatggagctggaagggtagggatggagtgggactttcttgaacaatttttttttctagttttgacttgaaccaggtaagttttgacttgaaccaggtaagttttgacttgaaccatgtaaagttttacatattcgaaataaaaaatttaaaaaggatttataaagcaaaacctaaacttgcatacaggcaggacataaatggatctaatgatatatcacatcaacgtaaataatcacagaggaaaaaaataaattcaaataatttctgaagacagtattctgaatgtatatccttagtggaatattaggaaaaaaagaagtccaaataaatcttgaactttacttaatagattgattgtcaggaggggtattgatatagtaattctgaaactattttccgtgtactataggatagagcaaatgaatcgatacattaggatctcactgtggaataaaggagatacaaatatgaaatgagggaaagtgcggaagaatcctgtgatgttgaatttgaatggttgagttgtacatggtaacatacatgcatctacctatctgtctacttatctacctatctaatctatctaatctacctatcgcctagcggcaatggcaccccagtagcaatgaacccacctagcggccaaaactttctttctaaattccattctccagtaaagggagacagggcttgactgattcttgattggggtagggaaaatgtaaggtaaggttgatacatctttttttactccaggacatactcaaagactgatggagatatgtcaaaacgacataggaactagcatcaggggatcccactggctaaatgacagacaatttgagcctcacaaaagaataaggagctaagtatagttatatcattttgtggaacttcattgagctgtgtgcttataatttgtgtatttttttgtaggtatgctgtatttcaatatgaaatgtagtgtctttttttaagaaagctgtgatacaagcagcaaataagacatataatttactttagcagaaaggaagaccgtgctctatgaataaattgttctgattacactgatggtcatccatcctactatggaaacagaggtggagacctcttttggtaagaaacaacgtcagcccagaaatgtataataatacaaagagaaaaacatcattaggcacaaatcatcgatggacaatagaacccatgagtgaaaggttcttgggacacaaaatagttacccagtctcaaagtatcaccccacagatactaatttcaaggcaaaacaaaacacaaaacaaaaaaaaaccttaaaaatggagtgacctgaagaatatccaagatgaaacagcatcaccaaaactggcacaaacaaattatatgactctgctgtgatccactgtgaagcaggcaacattacctagatagtactttggcctacaatgaggaacaattggacagatccacattgtgtggtattccacaatcactgggtcggaatcttcaaaaatacagactcatgaaagagaaataaaaggcaggagaatattctagattaagagggtccaaagagacaaaataactaagtgaaatgtgtaatccttgattgtattctaaaaagaaaatggaaataaggaaaaagagacattacaaggtatgagggacattaatggaaacatttgaatatattagattacatatcaatgttaaatttcatgtggagagtgataacagtattatgattacatattcatcttaggaggtataaggtgaaatgtcagggggtaatatgatatctatgactgaaatgcaaatgattttttaaagtataataaatgagagaaaaaaagccaatgaacaattacaacaaaatgttaataactggatcctcaagggggaagagtaattgggatagactgtacaaaaattaatcaaagataactagcatattttgaatgctcactgttgtcaggccctatttagagaggtttgcaatactaactcatttaatccttgcaataactctatgtgattgataccacatatatccattttacagacaaaatggaaacctatagaagtaaaataacttgcccaggctagtaagtggagtagctggaatttgaagttaataaatttagagtcaaagtttattatcatatccacaatactactctgcccttcaaataaataagtctgtttagaggagcaaacacattaatcacaccaatcttatgattacatgcaactgatatctcctgtgtgcctaatgcagaattctggagggttcaattggttccaattagttctttttcctgtaccagaaaagaagatcagcaataactggaattctggggtggcatggagtgggggtgttaaattttacaaacacagcatccaaaaatagtatgttcagtcatgagtattatctttaaaatagagaatataaagaaagtctgaagatcaacatttaaatcaaagaaaaaagaacaaaagtacaggtgctttgaggtttagactatgctgaaaatgccattatagagcagtccatttcctcagtaggtagccccaaaagacccctgacacagtagaaattatatcattatacaattaatcagttttctttcacaatggcacaatggggtgccctctttaactcaacagagtaaccagctcaccaacagtatctagaaaagaggaaagtcacagaatggaaaaatagacacaaaaagctatggagaagagagactgaaacagacaaaggcggttgtactataaaagaaagcgagaaatggaaagggaaatgtcagcaatctaaggttaaaagagaaaagatcaggatataaaaagatgtagaagtctcttatgaaaaaaaaaaaaaaaaagggaggggaccagtgaagagatagaaatcatgaccagagtcgaagcttgaaaacgcagggcaacacacaaagagaagctgtaatagcagagccattcactcaatcattcatttcactcattcatttaatgcctaacatatgaagggtactttgtggagctttgagagacacaaaaatgactaagacaggacccctgccctcaaagagcccagctgttccaaatattctcattttggtatgctccaatttttaatgtaattttaattattgttgtcacaccttagctaatattttcatactcaacatgtacttccagaaattgcagcaactataccatctataaaagagggtaatcttggcagggagcggcggctcacacctgtaatcccagcactttgggaggctgagatgggtggatcacgaggtcaggagatcgagaccatcctgcccaacatggtgaaactccgtctctactaaaaatgcaaaaattagccaggcatggtggtgtgcacctgtattcccagttactcaggaggctgaggcaggagaatcgcttgaacccggaaggtggaggttgcagtgagccgagatcatgccactgcactccagtctgggcagcagagcgagactctgtctcgaaaaaaaaaaaaaaaaatgagggtaatcttaaatggatggcagctgccatacagaatgagttcattcgttgtggaacggaaacatgtttacatttctgatatgctgatagtatataatgcagtattgtgatgtggttctctgtatatatagatgctgtctatactttttttggatacagcacactccacatcattctattttatttttatcatcccattccagagaggaggcaaaggacaaggaagtctaaaggatgtggaaagacaaataaggaagttaaaaaacaggttttcattttctttacaatttcccagagggcttctatgacaaaaagctgtactgaacaacggaatgcgtatttgtcatagagtagctgagagtgaattctaggtaaacatacaagggagaggctcctagacagataccattgcctagtacctttcatttaaaagatacctagtgatatatgacttgggaaaaccagaaattgacctcccagcctgcctcagtatatggtctttgctcttaccaaggttggcttgctccctgaaaagacctgaaaattcaagtttgaaaaggtgtttcatatacctaatttagaacacacccctcctagatctataagagtaggtgagaagcatagaaatgaacacctattattttgaatgctcatcttctgattcctttaatgcactgtcccgccctttaccctctccccaaatctttgtggttcttttgggatttcaattgaggtgccccatctctccgccagagataggaatgtgactcaatctaaccaatcaaaatcttctgggggaagtgtatgaatctgcagttagagagaaggctttccgagatcttgggcacttaaattcacataagtctgaagctgcttagagatatttcttcccccaccacaaagactgtgactgaagaaaagatgaagaccacatggagaagaggaggactgtgaggggggtgagagcagaggcgaatttatcctgaagctactacatcttaagcttacaggtctttctctctttttttttttttttttcccagacggagtctcgctttgtcgcctaggctggagtgcagtggcgcaatcttggctcactgcaagctccgcctcccaggttcatgccattcttctgcctcagcctcccgagtagctgggactacaggcgcccaccaccacgcccggctaattttttgtattttttagcagagacggggtttcaccgtgttagccaggatggactccatctcctgacctcatgatccgccggccttggcctcccaaagtgctgggattacaggcatgagccaccatgcccggcccaggtctttctctagcgatgtgttcatatggtcatttataatcttcttatagagaaggctctccaaactgtatgagctttgggccacaaaatcctagattcacccctgggagagacagttgtgaagatacaataaggcacacatagccacccataacagaagccagtgtcaccccactggacctgcaattatgtgagccaatattcaccctttctttttatcttgggataatccaaatttggttttacccacttacaaagggaagaaaccggagattttaaagatagaaataaagtcatggctcgtaacttgctggcaggaaaaaatgagaaccaatgctgtttttgactttcagagtatctatcataagctatcattttgtttttgtccgcatttcagtatgtggtttaaaaggaagttccaacatcatatttgtaactagttataaggaaccggcagggaacagcctccagacatttttcaaatatatttttcctttaactggctataaaggacaataaggattaagttggcaccacaaaaagtcgcatttaatgatacccttttgtgtgttacccatttaccaaacatggatttttatttctgcattctatagaatacttattcgccactgagagttccatttaaattctttgcatgcacacacacacacacacacacacacacccttccaccaccactaccaccaccatcattttcatcatcatgtgatttcagaagagcagtcatgtctacagtaaaggtatttgagagctaaacaaagcctcctggctagagatcctggtatcttcctttaaacccagatcattcatggtatgggttccctgcagagcactggttgtggccccaccaagcactgccatttccagcactgtcagtttctttaaccttcaagagaacacagaagagtcattcaaagccagcaagtgaagagatgtcctggcagtctaatttcaaacaggcctcataccagagtcttttttatggtttttaaaagaagtattttatgctgctctgatgaaaacctctaacagtagtagcttctgtctgacaaataccatagagaatgaaacaataagtctgaagcaaagggagggggtaaaattatttttgtttcaatagccaacacacaatgaaaacaagaaactatagaggtttaaagaataaccgatatttattctggtaaagacttttctcatatcagcactttaccactgtaagatgctgacaataattatgtgaatgttgctataaaaaaattaaatctcccatctcatgggtttaaaggtgtttccgcctctgccttacacacacacacacatacacacacacacacacacgtacacacacatatttcaggtacctctgtcaggatctcccaactcaattatactgcatggaggaaaaatatgtatactactactactagaataagaataaactagtaaacaaacaaatagaatacaatgtaagctgcagtacatgtaatctgaaggcctgaagctcatgtgtgctaggtttttgattgagcagtggtgggggtaaacgtggcacagcagttatcagcctggactgtggaatccgatcataccgggaaatgaatcctggcttactcattgagtaacctggtaactgaacctccctgaggcccaggttattcatcaacaaactgatgacagttatcccatggggttattatagggattaagtgagaaaatgttatataaaggtgaggagtggcagaatatgccaccccaaaatatgccactttggcatgaggattattttgagctgaaggcagttgagaagaagcagatatgagagaagctctctgtcttccccctatttgccacaaaacaggatatagatttataaaggtgccctccccacctatcaggaaagaaaaagttaatcatcagagataactctagatattcactagccagaagagacaccagaggaatctatgtaacaagctttactaactagcccttccattagttcccccatatatttaccttctcacaatttgcagaaactcaaagtcctttcctttgtcttaccatttctctaaaaatttattgctcttttttaaaaagctatataaggtcacattttaatcacccctttgagtcactcatcactgggtacttccatgtgtatgtgcaagtacatgttaataaacttctgttttttcttatgttaatctgtcatttttcactctactttagagggccacagctggagaacctaggagggtagagggaaatagatttagtacaaagagcttagtgcagagcctgtttcacaatgaagcactctgtaggtgaaagcattgccatgattaatgattgccacaaagcatccatgttggttaaacagacaccatgcctaagggcatataatgactctgaggaaagctagacttgaagaaaacacgacttgcccagccaagtaccttggtcaaaacacatatttgtttgactctatagtgttgagacttgagtatctaatatacagatgaatgagccagtacagaatttgaaatttcaacaaaaaggcaagtataatctgcctgataataataagcaacttgtaaatctttgaatggatgggcttgcctgttttcacccatgctactcaaactgtgaaccacagaacagaacatcagtttcacctggggacttcatagaaatgctgagtcttaggtctcaccctagaccttctgtattccagaattataataagatctccagatgatttgtaggcatattaaagtctgaaaagcactgctgtggaccacaaaatttaatgtactgcttatcccactttgggtgtgtttctgtgatctttacaacttaataaaccacccccaaaagttagtgactttaaacaacaatttatttgtcctgcttcttcaatattggcagggctcagtgagacggctcatctctgctccatatggtgttgactggggtagttcaacacagactgcaagatgcaagctggcttcccttcattcacatgcccttggctgacctggctgggacagttgggggctggctgggcctctctccatgtctttgttgttcttcaggacctctttccaaatggagtggtctctctcctgcagcatgatcagacttctttaagtgatggcaccaggctccaagacagtgaagtcagccatcttaaagtctaaatctggaactggcactgtgcatttctgccattttctgttgatcgaattgagtcaaaaggcaaacaaatgtcaaggggagaaaaaagactttatttcttgacgggagaagaggtctgcacagacagtgtggaaggatttgttagcaacagtttttgcagacaagctaccacagagtatctgttacttttcactttcttcatctctctgttctcctgattggtcaaacagccacttcatttcaattacacaactatatgcgaggtcccattgggagcataaggaattttaagacatgatatctcccatcaaggagcttgttataatacaattggtaaaataaggaatacatatcttgaaattttaataacaataaaatactgtaataataaaatatttaagtagcagtgccagataataacagaaatgatgtcctaaggccatgaaccatttatttaattaatcgtgcacacaataaccatcctgagtgttcagaagagagaatggaaggggaggagaatggccatggaaggacggttgtgcagtgagtaagacttgcataggaaaatgagtaaggttttcaaaaaaaaaaaaggtccaatgaaatacacacaaaggatacaacagaatcaaggagccaagggaatggggtcatagggacacaaggccatgaatgagtatctgcatgttcttcaatgatgattatcaattcaatgttcctgaaagaatttcctgcctcataacgtccacctttacttctccctttagatatgttcataagctatttgtggaatccccaccagcaatataaccttgtattaataatgaagggtttttatgaaccttataaattttattataccttgtagagagggtgggggaacaaacaaacagaaatgtaggcattgccaaatggcaacttgtaaacttcactattcattgtgtaggaactaacacttttggtattgttaagtagccttgtaaatttcactctcccttagaaaataaaaatggaatgaaaggtgctgcttagaagaaacgtataaatttcaatctccactgcaggaaaataagctctgattacactacatagttcatacacctcaatgttccgaacacttgtttttttacagattcatgtataatgacttggttttccaacaacagagagtgaaatttacaagttgttatttaacttttttaggagtgtatttttcttccatgtcttttttttcttctttgcccctactcacaccagaaacctaatatgagcaatgggatttctgaatagtaccatacattaattccttcaataacaatgattaaaacattttaaacattgttctcagggcctcctgataccacatataaaagtggggaatgacacagcttttggccacacagttcaaaaaattgctctttaccttgttggggaagaagagggcttattaaaagtttataataagcagtattactagtatttaacttctatttgttgttgaaaagaactgagcctataatttcagaggcttccgagcattttcataaatatacccattagatattcaatagccagtggatttgaatgattttgccatttattcgaacagatagctgtcctggacaggaaggatagaagcattggaagaaagtgttagaactacatttccataaagtcatgacaagaaataaagaaagaaggggagtcaccacctcaatactagaagtgtcagcacaatgatatcctcataaaaggtgttctaaaagaaacttttaggtgttctaaaataaagttataaatgccataccaagaaatactgtcaaaacaaaagtcaagtacaatacagcccagaaagaaccaaatacatctttacatcagggagtaaaaatatacatagatataatatccacaattgtcttaatttatagcttttaaatagataatatacatacaaagtgaaaaattgaaaccacaccaaagtacgttgaaaaatgtcttcccactcatgctgttaatgatctctgtaccctcttcaacatatgcatatgtgaacatatacacacattttaaatttccatgactacaaataatggcatattctaacccatttttcacttaaaaatgtcatagagatggttctgtatagacccatttttgtgatggtctaattttattacaaagattataaagtatagatattccataatttatttacagattctcctattgcttggacacttaagctgtttttaatcatttgttgttaaatgcaatgccatggcgaatatttttgtacatagaattttgtgcacctgcatgactatagttctaaaataaattactagaaatggaactgctaggtcaaaaggtatatatgcattctattttgatagttagagccaaatagctttccaaagacaatataacaattcatgcttctattcatgataccaatacatcttgcattgaaggaattccaaaacaaccaaaagttcatcatttttctgccaactgatcctttctctcttaaaaagagtcggggtaaaaatcacccatttttgcttataaccataggcagttataatcattattgcccaagattcaaggccatttcattacccactgcatcaccatcctcactgtggtataattctaactggtcagagagacctttaatttgcagaccttctcagaagacagattatctgcattctgcagacatctgcagaaagccatccacaagtgcatatttcatggctgaatatttttacataacatcagctggaacccatcgttccagcattctcgccaagtgtcacaacctgctctattatatcaataagcagtttcaattagtcattttcttcccatggtgacgacagctataatagcatgcagtagtctgatgaagtttgtaatataaagtggagatgggagtattaaaaggaagagaatacagaattagaatcgcataaaaaaatccatctcccaaatagtcatttggggaaatgacaacatttttgaaacagtgttcaagaatgaatacaaaaatgcaattacttttgaaaagtcagataaataaatttgccatgggaacacattcttgccccagatagaaccctagtttttactggctaattagtcattaagcaccatctcaaaaacaactgtatatgaaagaatattgggtaaatagaaataaaacttaaggcttaacagaattgtaaaatgaaaataaatgccaacagagaatactactttgaaagcattggatagtagtaaataaattagaaggaatgacacagttgctctgccctcaaaatttatccctaatctgttactacttcctactttgtgtgctaagattaccaggctccaaaccatgcttgccttccctggcacacagccagagccttctgactggccacctgcctctcttcttgtccccttcagcctcttctttacacagcagctgaaatgattttctaaaaaatataaatcagatcgcatcatttccttcttttcagccctctactggttttgctcataattaaaatctaaaatctttgccatggctggcaaggccacatatggaatccatctaccacttctttctcctccctacactggcctctatcaagcacattcccaactcagaccctcaggtcttgctgcttccagctaaaaggttagacccccaaatattcagatgtttttcctccttcactttattcaggtatgtcctcaaatgtcacctcatcacaaaggattatttgaccaccctatctaaaaaataacccaaaactctttatcaaatgcatgcagatttactttccttatatcatttaactccactcgacattatatgatgtagttagatgtatatctgttcattctgtatatcccctactagaatgtaacttcaatgaagatgagaagaagcaaagataaaaaagtgcatcccaaccagacagaaaaacatactatgactgtgaactacacccattgatatggtttggttgtgtgcccacctaaatctcatcttgaattgtaactcttataattcccacatgtcaaaggcagggctaggtggagataattgaatcatgggggcacttccacccatactgttctcgtggtagtaattaagtttcacaatatttgatggttttataaatgggagttcccctgcgcaagctctcttgcctgcagccatgtaaggcatgcctttctcctcctttgccttgcaccatgattgtgaggcttccccagccaggtgaaactgtgagtccattaaacctctttttctttataaattagccagtctttactagcagtgtgagaactgactaatacacccatagttgagaaaacagcatctacctgactttggttaaattcattcaactcagcaaacatttactaaactcttattagataagaaattccagaaacataggtcccagtgtctatctgttatatagtttagagacaaaaacttgcatataatttgggaggcaagacatgaaatataaactactgaaatgacaactaaaaagagttaatgatcaaaagccaacatgagtagggcaggcaataagtgtcagagagttctgaggaggagagatttgtgtaggctgagagggtgaaggaatggttcaaaaagaaggctggagaagatctgggaaaggaaaccaggaggaagaaggcatttggggtgagagcacagcaggggcagacacatagattataccagtgttccccaaacatcaaagcatggaaccttggtgttacatggtccactgacaggacaaaccaaagaataataaagttatatctctttccatttgattttaatctttctaatacatgcaatgaaaaagtattaattcagcattaattgttaaacaccttagtaacacttgccaatctgaatggcattattttactttttattttttgtacttctctttaaacttttactccctatttatgataagggcttttatttatggaataacatataattttattcatatgtaaacttctatgggtaaaaaaaagggagttgctttaatggcagtcaatcatggactaaatatctgggtcactacctacccagacacaaagcagagtcaacctttaaagtaagcaaagggggctcagtggaaaagagaagaaagttaagctcttgtcaagatgatgcagggggcctcatgtcaggctaaggattctggaaaatattctgtaggactgtggtttcccaatttgcaacaaggtcaaattccttgaaaacacacgcgttatatttgagtgtggcatgcttcttattttcaagacagcaagaaatatggcaatcttcaattccattataccatttcattatacaaacttaaacacaaagtggaaagaagtaaatacaactttatactatatgtgaattacaaaagcacaatcacaaccacagtttttttttttttttaaagctgtctatatctattatgatatgggcaagaaacagatgactcacaaaatactcaaatagggtaatctgcagaaatgcttagaaagtgtattcatggtgtggagaaaccaaggattaatgcaatacccagggacaaggcgggagcctacttatagagttcacagagaactgcccaagcaaagagcaaagcagagagtgggtaggaaaggataaattgaagataaccaatatacaaacaaggctattttcacatatttcaaatacttaccaggtcttcgaatactttacctgtctaatcacgagctgtatattttttatagggaataagagtgcataggccaggcgcagtggctcatgcttgtaatcccagcactttgggaggccgagataggtagatcacaaggtcaggagatcgagaccatcctggccaacatggtgaaaccccatctctactaaaaatacaaaacttagctaggtgtggtggcatgtgcctgtagtcccagctactcaggaggctgagggaggagagtcgcttgaaccagggagacagaggttgcagtgagccgagattgcaccactgcactccagcctgggcgacagagcgagactccgtctcaaaaaaaaaaaaaaagagtgcatatagcatggacttaaacctcagcttgccattcacttctatgtgagtttcttaagctcaatgaatttaattttttcaataaaatgggagataataacagtatccactataaggctggtgtgagaagcaaatgaataaatgtatgtaaagcacttagcacagcatttgcctataataaatatgcatgctttgggaaaatgggggagggtcatgtgagctgccaaaatagtgaagagaaatttatgagagaaaagcttaagattgcagaaattatcaatttaaattgcattagcttagtatttcatatgagttgtccaaaacatcccatattattcaactattccatttcattgataaaatacttcaaaggcatacaaagaaggaaaatagtctagatcggtagaggcaggtggggttatagtggtggtgatcagtggtagtggcagggaatagacagtaaaggcctccttcagaaggtaatatttaaaataagaccaactgaaacataaaaggagttaactaagtgaggtgaaaagtgccccaagcagaggaaacccaacatgccaaggacctggggaagaggaaacctcctggattcaacatattccacgatcaacatgtggaagagtaaacaaggcgtggggagaactgcagctggagcggtagaaccttttcagtcatgtttaaagaatttaaattacatttatcccaagggtaatgagaagcctttgaaagactttcaagcaggaaaaaggcatgatcccatgatcggattatcatcattagaaaaccactactaaagagaacagggaggcattagagagttttgagttaaggactgaacaagaaaaataatgtttcaaatttcatttttattattttattgtttacaaaaattgtaaactgccgcagacgatttctctgagggctaactgtataagtataggttcatttggtaactcactcattccgtaagatatttattaagcacctaatgcatacaccggaactgtgcatagataggggacggaggagaaaactcacaaataagcagtctaaaaagtgctaagacttgaaaggcaaacgacacttctgagtggtgggtaaaattccaaaggtggaccaggcagtgtctttgctaaaacatttttcggtatggctgaaccataaaatgcatgggccgtattgaaccactcctttcacaagaatttactgagcactgactatatgctggtattgtatagctttggtgacatggtggtgtatgagaaatcacttaaaatataatagcaataacttttttattgtaaataaggctgggttgattatcaagagtgcatgagaaagaaaaacagagaagtgaagaacagtgccttcacttaaggagggttcgaatggcaataaaatacttttaattaaaacttctctgctgagaatagacagcctttgaaagcttgtgtaaacataaatgaactacatgtaaatatattcatgatattatagctttttaaataacattataacttttaaaatgtcaaatcctttgaatatgaaatgccatcccctctccccaaaaacatgaccaccatgaattatccagttgatcttaaatcaaaagccacttacttaaaagtgaaatgttcattccttacacttactagaaaaactgcttcaaatatgatcagaccttccctttgtcttcagagaattccgctgctgaaacagacccaacaagccagccaaggtccatctggggcagcttagggaaggggcaagacatgttccctgcccaacactatcttttccaacttagcccctgatcatgccaagacatcacagtgtaataatagtaatttaataatgtagtcggccaggctctgcccacagtagaaagcatgagaaaataaatgaggcttgaaagctaaacagagagaaacttctccaggcactgcctgcagcagggagatacctggtaatgaaatacccactgatctccattcattacacaggaggcaaaccttaaaagagagtctagaaaggtggatctctcaaaatagaaataaataaataagctcacctgccatggtggggtctctgaaaatgacttggaaggactgcctatagaatttttgtggggatgcagcaaagttttgtcagatgtcaagggaggtaattattcccgacttgcttgggcacatttgctggataaattggcctctttaccttcatctccccatgcgggcaccagataaagaaaccgtgtttaaactctacagtgttctctctggcttttaccatgaaaaagaaataaaaatgcatcctgggtgcttggcaaatcagcccagtgtcagatggggacccattatctttgaccttcacatttgtgccccttgggactcacagaaaatcctcaaaaactcttttgggtaaagatatatgatgtctaggaggtacccaccttcaggagaaagaaattgcctttgcaatataaaagttgcaaaagttgaagttagtgatttctttattttttatttccatttttgtctatctgctcaaatttttaaaatttacctacaaatgctggaagccttgtttactcaaccatgttatcaacatgttaagctatcagccatttctctcccttccctgctttcctctccaatcaccaagacaacactaacatttctccatcttaccttctttaaagaaaaattcttacagttaactgtctgccatctactaccacttccagaaccagtaatgaaatgtcagaggaggaacagttaattaaaattgtggaatcctactttgcatcctctcacagtcaatacatgtacaattagagatgcctttcagcatgtggtataactagtataagttaaactttgaataacacttgatcattaaaaataaaaaatcattaatgttaagcaaatacgcagtaaacatcttgcttcattggccataaaactcctttagctcagctcaactagtgtggtagatttaatattgggattcacttagatggtgctttttagtaagaaaccaaggaacatgtctacaatctgcaagtggtttatgggaataaaaactgtgcctaattatcccacatgggtttacctaagttgtcatttttttacaaaatttctcaagtttctccacaaacgtttagggaagaaatgacatagaatggtggttaagggttcagactctggagtcaaatgttgtgtgtgtttcatccctgcctctgctacttgctaaacatgacactgccataaccatttttcttcatttctcagagcctccatttccctgtaggtaatatgaagaaaacactattcattcacagggctactgtgaggatgaaatgagataatgtacacaaagcattttaaatagtgaccagaaccttgtaaagattaagtaaatgcaagctggtcctcctaattgataccttattcattcaataattatacttcctaaaagagtctggtaattatgtatttaaaacatattcacgaggtggagccaagatggccgaataggaacagctccagtctacagctcccagagtaagcaatgcagaagacgggtgatttctgcatttccaactgaggtaccaggttcatctcactgaggagtgtcggacagtgggtgcaggatagtgggtgcagcacactgagcatgagccaaagcagggcaaggcatcatctcacccgagaagcacaaggggtcagagaattccctttcctagtcaaagaaaggggtgacagacggcacctggaaaatcgggtcactcccaccctaatactgtgcttttccaatggtcttagcaaacggcacatcaggagattatatcctgcacctggctaggagggtcctacgcccatggagcctccctcattgctaggaaagcagcctgagatcaaagtgtaaggcggcagcgaggcttggggaggggcccctgccattgccgaggcttgagtaggtaaacaaagcggcctggaagctcgaactcggtggagcccaccacagctcaaggaggcctgcctgcctctgtagactccacctctgggggcagggcatagacaaacaaaaggcagcaaaaacctctgcagacttaaatgtccctgtctgacagctttgaagagagtagtgattctcccagcatgcagcttgagatctaagaacggacaaaatgcctcctcaagtgggtccctgacccccgagtagcctaactggcaggcaccccccagtaggggcagactgacacctcacacggccgggtactcttctgagacaaaacttccagaggaacaatcagtcaggaacatttgctgttcaccaatatccgctgttctgcagcctctgctggtgaaacacaggcaaacagggtctagagtgggcctgcagcaaactctaacagacctgcagctgagagtcctgactgttagaaggaaaactaacaaacagaaaggacatccacaccaaaaccccatctgtacgtcaccatcatcaaagaccaaaggtagataaaaccacaaagatggggaaaaaacagagcagaaaaactggaaactctaaaaatcagagcgcctctcctcctcgaaaggaacgcagctcctcacaagcaacggaacaaagctggacggagaatgactttgacgagttgagagaagaaggcttcagacgatcaaactactccgacctaaaggaggaagtttgaacccatggcaaagaagtaaaaaaccttgaaaaaaaaattagacgaatggctaactagaataaccaatgcagagaagtccttaaaggacctgatggagctgaaaaccacggcaccagaactacgtgacgaatacacaagtctcagtagccgattcgatcaactggaagaaagggtatcagtgatggaagatcaaatgaatgaaatgaagcaagaagggaagtttagagaaaaaagaataaaaagaaatgaacaaagcctacaagaaatatgggactatgtgaaaagaccaaatctacatctgactgatgtacctgaaagtgacagggagaatggaaccaacttgcaaaacactctgcaagatattatccaggagaacttccccaatctagcaaggacggccaacattcaaattcaggaaatacagagaacaccacaaagatactcctcgagaagagcaactccaagacacataattgtcagattcaacaaagttgaaatgaaggaaaaaatgttaatggcagccagagagaaaggtcgggttacccacaaagggaagcccattcagactaacagcagatctctcagcagaaaccctagaagccagaagagagtggaggccaatattcaacattcttaaagaaaagaattttcaacccagaatttcatatctagccaaactaagcttcataagtgaaggagaaataaaatacttaacagacaagcaaatgctgagagattttgtcaccaccaggcctgccttacaagagctcctgaaggaagcactaaacatggaaaggaacaactggtaccagccactgcagaaatataccaaattgtaaagcccatcgaggctaggaagaaactgcatcaactaatgagcaaaataaccagctaacatcataatgacaggatcaaattcacacataacaatattaaccttaaatgtaaatgggctaaatgctccagttaaaagacacagactggcaaattggataaagagtcaagacccatcagtgtgctgtattcagacccatctcacatgcagagacacacataggctcaaaataaatggatggaagaagatctaccaagcaaatggaaaacaaaaaaagcaggggttgcaatcctagtctctgataaacagactttaaaccaacaaagatcaaaagagacaaagaaggccattacataatggtaaagggatcaattcaacaagaaaagctaactaccctaaatatatatgcacccaatacaggagcacccagattcataaagcaagtccttagagacctacaaagagacttagactcccacacaataataatgggagactttaacaatccactgtcaacattagacagatcaacgagacagaaagttaacaaggatatccaggaattgaactcagctctgcaccaagtggacctaacagacatctacagaactctccaccccaaatcaacagaatatacattcttttcagcaccacaccacacctattccaaaattgactacatagttggaagtaaagcactcctcagcaaatgtaaaataacagaaattataacaaactatctctcagatcacagtgcaatcaaactagaactcaggattaagaaactcactcgaaaccacacaactacatggaaactgaacaacctgctcctgaatgactactgggtacgtcgcgaaatgaagacagaaataaagacgttctttgaaaccaatgagaacaaagacacaacataccagaatctgtgggacacattcaaagcagtgtgtagagggaaatttatagcactaaatgcccacaagagaaatcaggaaagatctaaaattgacactctaacatcacaattaaaagaactagagaagcaagagcaaacattcaaaagctagcagaaggcaagcaataactaacatcagagcagaactgaaggagatagagacacaaaaaacccttcaaaaaatcaatgaatccaggagctggttttttgaaaagatcaacaaaattgatagactgctagcaagactaataaagaagaagagagagaagaatcaaatagacgcaataaaaaatgataaaggggatatcaccactgatcccacagaaatacaaactaccatcacagaatactaaaaacacctctatgcaaataaactacaaaatctagctccctctccctctccctttcatctccgtctcccgctttccacggtgcccccctccctcgtctccgtctcccactttccacggtctccctctgttgccgaggctggactgtactgccacgatctcggctcactgcaacctccctgcctgattctcctgcctcagcctgccgagtgcctgggattgcaggcgtgcgctgctaagcctgactggtttttgtattttttggtggagacggggtttcgccgtgttggccgggctggtctccagctcctgacctccagtgatctgcccgcctcggcctcccgaggtgccgggattgcagacagagtctcgctcactcagtgctcaatgttgcccaggctggagtgcagtggcgtgaacctccacctcccagccgcctgccttggcctcccaaagtgctgagattgcagcctctgccccgccgccaccctgtctaggaagtgaggagcatctctgcccagccgccaatcatctgggatgtgaggagcccctctgcctggccacccagtctgggaagtgaggagcacctcttcctggccttcaccccgtgtaggaagtgaggagcgtctctgcctggccgcccatcatctgggatgtggggagcgcctctgcccggccgccccgtctgggatgtgaggagcgcctctgcccggccgccctgtctgggaggtgaggagtgtctctgcctggccgccaccccgtctgggaggtggggagcacccccgcccggcagccgccccgtctgtgaggtgggcgtgcccccacccggcagccgccccgcctgggaggtgaggagcccctctgcccggccgccaatccatctgggaggtgtacccaccagctcattgagaacaggccatgacgatgatggcggttttgctgaatagaaaagggggaaatgtggggaaaagaaagagagatcagattgttactgtgtctgtgtagaaagaagtagacataggagactccatttcgttttgtactaagaaaaattcttctgccttgggatgctgttaatctataacattactcccaacccagtgctctctgaaacatgtgctgtgtcaactcagggttaaatggattaagggaagtgcaagatgtgctttattaaacagatgcttgaaggcagtatgctcgttaagagtcatcaccactccctaatctcaagtacccagggacacaaacactgcagaaggccacagggtcctctgcctaggaaaaccagagacctttgttcacatgtttatctgctgaccttctctccactattgtcctatgaccctgcgaaatccccctctctgagaaacacccaagaatgatcaacaaatactaaaaaaattaaaaaaaaaaaaaagaaaagttcaaataaagtgtatgaaagaactttaaaaaaaaaaaagaaaaaaaaagtgcgaaaattagccaggcatggtggagtatgccttggggtcccagctactcaggaggctgaggctagaagatcacttgagcctgggaggcagaggctgcagcaagccatgattgtgctactgcactccagcctaggtgacagatggagactctgtctctaaataaataaataaataaataaataaatcctatttttaaatgctaaaaaaaaaaaagaaaatctagaagaaatggataaattcctcgacacatacaccctcccaagactaaaccaggaagaagttgaatctctgaatagaccaataacaggctctgaaattgaggcaacaattaatagcttaccaaccaaaaaaatccaggaccagatggattcacagccgaattctaccagaagtgcaaggaggagctggtaccattccttctgaaactattccaatcaatagaaaaagagggaatcctccctaactcattttatgaggccagcatcatcctgataccaaagcctggcagagacacaacaaaaaaagacaattttagaccaatatccctgatgaacatcgatgcagaaatcctcaataaaatactggcaaaccgaatccagcagcacatcaaaaagcttatccaccatgatcaagttggcttcattcctgggatgcaaggctggttcaacatacgcaaatcaataaacgtaatccaacatataaacagaaccaacgacaaaaccacatgattatctcaatagatgcagaaaagacctttgacaaaattcaacccttcatgctaaaaactctcaataaatgaggtattgatgggacatatctcaaaataataagagctatctatgacaaacccacagccaatatcatactgaatgggcaaaaactggaagcactccctttgaaaactggcacaagacagggatgccctctctcaccactcctattcaacatagtgttggaagttatggccagggcaattaggcaggagaaggaagtaaagggcattcaattaggaaaagaggaaatccaattgtccctgttcgcagatgacatgattgtgtatctagaaaaccccatcatctcagcccaaaatctccttaagctgataggcaacttcagcaaagtctcaggatacaaaatcaatgtgcaaaaatcacaagcattcttatataccaataaaagacaaacagagcgccaaatcatgagtgaactcccattcacaattgcttcaaagagaataaaatacctaggaatccaacttacaagggatgtgaaggacctcttcaaggagaactacaaaccactacttaatgaaataaaagacgatacaaacaaatggaagaacattccatgctcatgggtaggaagaatcaatattgtgaaaatggccatactgcccaaggcaatttatagattcaacgccatccccatcaagctaccaatgacttccttcacagaattggaaaaaactaccttaaagttcacatggaaccaaaaaagagcctgcattgccaagtcaatcctaagccaaaagaacaaagctggaggcatcatgctacctgacttcaaactatactacacaaggctacagtaatcaaaacagcatggtactggtaccaaaacagagatattgaccaatggaacagaacagagccctcagaaataatgccgcatatctacaactatctgatctttgacaaacctgagaaaaacaagcagtggggaaaggattccctatttaataaatggtgctggggaaacctggctagccatatgtagaaagctgaaactggatcccttccttataccttatacaaaaattaattcaagatggattaaagacttaaatgttagacctaaaaccataaaaaccctagaagaaaacctaggcaataccatttaggacataggcatgggcaaggacttcatgtctaaaacaccaaaagcaatggtaacaaaagacaaaattgacaaatgggatctaattaaaataaagagcttttgcacagcaaaagaaactaccatcagagtgaacaggcaacctacagaatgggagaaaatttttgcaatctactcatctgacaaaggactaatatccagaatctacaaagaatcaaacagatttacaagaaaaaacaaacaaccccatcaaaaagtgggtgaaggatatgaacagacacttctcaaaggaagacatttatgaagccaaaagacacatgaaaaaatgctgatcatcactggccatcagagacatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactgggtatatacccaaagattatgaatcatgctgctataaagacacatgcacacgtgtgtttattgcggcactatttacaatagcaaagacttggaaccgacccaaatgtccaacaatgatagactggattaagaaaatgtggcacatatacaccatggaatactatgcagccataaaaattgatgagttcatgtcctttgtagggacatggatgaagctggaaaccatcattctcagcaaactatcgcaaggagaaaaaaccaaacactgcatgttgtcactcatagctgggaattgaacaatgagaacacatggacacaggaaggggaacatcaaacaccggggcctgttgtggggtggggggagtggggagggatagcgttaggagatatacctaatgctaaatgatgagttaatgggtgcagcacaccaacatggcacatgtatacatatgtaacaaacctgcacgttgtgcacatgtaccctaaaacttacagtataatttaaaaaaataataaaaataaaacatattcacatatttacgtattcatgtatttaaaatatattcatttattttacactatgtgcaactcatttttctacttaagaattagagagatgacatttcggaggcccctaattccaaatgctgccgcctgtttttagtacagatctgtgttaagcaaaggaaaatgaagcggtcaaatcgcctcagaagcttccggcttccacccctgtttgtaaacgaaactccatattagtcaaactacactccccagggagcacctgtaaaagtccctgatttacagaagtatttactttagggtatggagtttgttttttcaggtttatctctgggagagcttggtgaagctgacagtccagcaattttattaaactgttcaatttcagcattttttaaagagcatatataaagaacaccggcagtagctatttaaatttcccagtggatgctagaaataataaaaggacacttaaatgaccatttttgagcagagccaacagcatgtgtcctaattatccaactatgtgaaaaattctgtggatttttaccagagcacaagggtgtgatatgcacaattcagaacactaacggctacctcactagggtgtagagaacttttcaagtctaaatataaggtcccagtctgccagggtaagtttttctgctactttccctcttgatgaacttgttagacatgataaatggacaacatggtaagaagttgatatggtccactgataagcctctgatgaagaacaagtaaataaaaaaccattgtgctaagtgctctccttcatttattctcacgatcacattctgaggtaggtattactatgcacattttacaggtcaggaaagcaaagctcacacaggataagtgccttatcctacagtttaagtatccaagctggtgttctgattttcctccactcacctcttcctatctcttctccacccacctcttcctatctcttctccacccttctctgccctgctggtggtctcttccttactgatctctacagactcatctcccgtgccctttggtttctatagggctaagacaatggcaggcagcattaagggatcagagaattggaggaaagagtctgggggtatctattccccatttcctctctcctcccctcacactgcacaactgagacttttgacaagtgcccacatttttctagctttgactataatttctgtcagtggccctttttccctaattcctagctagggctctcattggattcttgtaattctgttctctgtctttgctccttcagactttccatagttgcttcaccatcttttttggttcccttaaatctacccacacctctgtcaatcttctgttcattaaactctcttccaacctctcagttttggtgtcatccactttctgctggagaaaggagggtagcccctagcagttggtacctcctcctctctagcttccctttcatctacccacaaccaaccactcacccttcccttgtagccagtcacaccacaagcaagtctgtgactcagcaaactggctcccagaaacaaaccctaggagcataattgaagatgaacccaaagatacagttataagtatgctcgtggagaatttgtaattttttaaaaaatggtagttatctaagaggacttgattaatcaatgaagggacattcataaaatgaaaaattataaatgattaaaaataataccataacttatatttcatgacatgaacatattctcaatatattaacttcaaaagggaagatacaaagttgtgtgtagaataactcagtttttctttgtaaaaattttgtatacatggggagaaaatggtccaaaagagaccatccaatagaaatacagtacaaggcacataagtaattttagtgtcagtagttacgttttaaaaagttaaaagaaaccagtgaaattcatttagtgatatattttagtccaacatatgcaaaataatatttaatcatgtaagcaacagaaattaataatgtgatatattgaattcttcttttgcatatgaagtcttagaactccggtgtgtagttgacactcagagcacatgtcaactcagtcttgctacattttaaaagctcaagagccacatgaggatagtgactaccagattggacagctcaggtaagcctcaaaagcgggtgtgtagagtaggaagttgaatgttcttcactttcttattatttttctccttttttaccattaccatttactactgatgcatgtcacctctgcaattagaaaaacaaattatttttaaacactaagagcaaggcttttttcttctgtctctggaacactttttggctcatgtcctttgcaattcacagactacacacttactagtatagaaaggtgccctcctttcttcccctccctttacattttctttggatagctacctatcttcagccctcaggcataagagtaagaatcaaatgttgattttcttcagagtggctgctgagccagctcccactctccagtggtgtgacccggaatctatcaggcctcacaccactgttttagcagctctgaatggcttgtggaagggcatggaatggggccagaaactgcttaatttgaggttaattaaatagtgatgacaagccttaatctccaacttgtcatcagattgtaaacactgattgcagctgcagcaatctgcaataaacctattgagaggaatcttgaccagaatgaaataagtacgttggttacccagatgaggctgggagaggtgagatcagagaaatctaggcttttgcagtaccaggagaaatggagacctgaaaagagggaaattcatgggcgaatgtgtcaattctgattcctgtacagccctatcaaaaaaaagaaaaaaagaaaagaaaaaataactggatcccatgcacctggaaattggaaagaacaagggcagaaatataaaaccactaaactaaggacctggaaaaagctgaaatagctttacatctattagccattgatgaggtttccatgaaaaaatatgtctgagccactgcatgccctgaggccgctggacagatggttataccaccagagtgagctacagcagtggctttctagagtgcaggcaaggatgacagttacagtgtgttaggtctctactgtgtctcaagcacatcacatgtaacgtatatgataattctcaaaagtactttatgaggtagctattattttctccattttaaagaggagaatgctaaatctcaaaggagtatcctaccttgcttaagtacatgtaacaaatgggttgaacccagactgtctaatgccctaatgcaaattctaaatcacaagaatctctgcctccagctttgaggcaatgttgaagtgggaaaggggaaagaatagtcaagttcctgaagaagatgggaaaaaatgagtcaaaaatctccaaagaatagggaagcacaaagggctgaggtaacaaatgccagatgagtaaacatgttcataacactgcaccccggaaagtgcccctcctggctccattttcatggagaatgctttctcattcttcaagatccagcacaaggccaattttcacctcttctgtgaagccttccccaaacctcctagtgagagaggcactttaaaaaaatatgtgagatgcattgagagacagatggacaccataaaagctgaactcaatattacatgtgaagaaaatttacaaaaaaatcttaatctgagtgtcagaaaaattggagtagtgaaagaaccattacagttattgtcaaatagttaattaactattatgtaggtttaaatccatgtattcttccttaaaaccttttggaacaagataaatcattctcatccattcatttattcattccctagcactgtgataacactagagaaataacaatgaccaaaaacagacacaattccactctcgaggtacacatgtttaaaagggaaaacagagtaatgatacaaaaatcacacaaataaatggacaattatgacatgtgttccaaataagaggtaaatgagatgttattattttatccaggatacaggactggaatcattaaagagaatacacagggaaataagctgcagttcattatttggaaaaagtttcaaacaatccacacagaaatggccccacacatgagcctgctctcttctgggcattggatgtgtcccggctgaggcagggaagacaagggtgcatccgtcgataacttctcaagtctcttctgactctaagaaactgtgaccctatcattccaaacaaaatattttctcagataagaattagaattggctaggttgaatttccaggagacttaggaaatatgtacagagaataatcacttcctaaatagagaggggagtcaagcaaaactgagtcttctaaactgctcggtagcattctccttctcttcgcacatggacacacttctgctttatgcactgccctgacagcttcctgaggacagaggctgatggtcttgctcatcactgaatcatcaatgcgtggcacatattaaatatttgttaagtgagtaaatgaatatggtactaaaatgtgcatactgacagaaacttttttctgttgtggcccttgtaggtgaacttccttgaataattaatgaacatgaaagtcagtcaatcactcacctcctgattaatagtcagggtcccttgtccaaacagccacttagtccattaaaaattaataattttctacagaataaatatatgctgtacatggtacatcaagggttccacttttaatacgcaattaagtaatgcagaaagactaggaatctattaactaagaaagagctccatgaacttgccctccaagtcatcattcatttactatccatttctcttccaattttaaaaaattatttagccagaaaaaaagtagttctgaaaacagagtaaataacaacatgttgtcatattttggctaacatttgcaggccgacacaatgtgtgtttgttaaagatttgagatatgctattccttctgtgaaatgacgaatacattagggcagatcaatacaaaactgaagctctatatgtaaaatgttaagggtctattcattgaaaaattatgagccatgttatagaacttaggtcagagttaaattattgatctacattcatttttcccctttccatgtgactatcttttgattttttataacatacattattgcctatgtagaaaatgaatcctcttcttctagagctagtgtgtctggtgactgacaattttctaaaattaactgttgtgttggtagcatttagatttgtaaattgaactccccttgcataaacatttaaacattgaaaataaaatctgtaaactttggtagcatgaactcaaagggaaaagaggataattttcattttttaatacaaagaaagcaaagaaaaaaaggaaaggttatttttcttaacatcattctactactttatggttcttgatacatttcattgatgaggccaaattgtattcagttgactttttacaaatgactaaactgtattgctaagcaaagggatgtaatcaacactttgtgagctgaagtctcaattttcagacctaaagcttactcaagatgtataacctcaaattctgtaagcaggttagatgtcttgaaatacaaagactctcatcccctatcagcccccaaagtgacaaaggaatgtgtcttcaatgaagattttctctcatctgctgaaaagggaaaatgtgcaaatatttcaaagaaatgtagattccacagacccacattaattcatgaaaaaggaagctaatgtaagagttcttagtaggaatgatctttgatttggggctgtatttggtcagtaacttttgcctactaggagaatattttctctttaacgaagtagtatcagacacagagggctcttcattttctctaatggagatacaatcatttagattcgtgctccaaatgaggcagaaattacccctaatgtgtagtttgaacatttgtatcaaaatacagtgaaatgctgtttcagagtctgatgagaaaaatatgtgagctcacagaatgtctgcctctctcaggtgcagaagtggtctactgctttttttttcttttttcttttcttttcttttttttttttttgagatggagtctcactctgtcacccaggctggagtgcaatggtgaggtctccgctcactgcaacctccacctcctaggttcaagcaattctcctgcctcagcctcctgagtagctgggattacaggtgcacgccatcatgcccagctaatttttgtatttttagtagagatggggtttcaccacattgttcaggctggtcttcaactcctgaccttgtgatccgcctgccttagcctcccaaagtgctgggattacaggggtgagccaccacgcccggccctctgctacttttcttcacattgtcactgcaggaatcacctggctctagggggatatcccacagtctcacataaataccaatccctgtcgctggaacaagggggtcccagcctcacagaaggcctgagggactctgtttctctacaggtcagctccaaagcagagggccctttgcaccataaatcaatgtcatccacagaaaactccaggagaaagttaaataccagcagcaaacaatgtctcttgtgtagcagtctctcaccactgtttctgctaggtgacaaaagcagtgagaaaagcagaggaagcaagggctgaagacagaaaagtcaaagaattgcagaacttgagagttggaaaggggcagagtccaaataggaaaagacttaagcttcctactgtgttgtgctatgtagaatgctgtatgaggaagggcagcaggctttctccccagaagcccagctgaaagtcatccacactttacatggtcccctataccaggcttcagcccccttggccttggttttctcaacacacagtatggaatccatttctcatgagatggacttcattaaacacactcatgagaccaacatataaaaccagaatgtcaaagtagtagtctacgatttgcagtatagctgttgcacagatgtcagaaagaccaatacattcattcccttcctgtaaatgtcttccctgcaaaaccaaatcctaatcaggcagcaatctgacatgtaaggaatctgaacaagaggagttcatctgatgaactgaatgttaaacagcgtcaggggagatggagtcaccaatgggaaagaatacccaatgtcccttggctgcagctctctacatccattgccgtaacagaaatggccttgccaatagaaaaacaattctccaagtttctcacaggaggtcccgtcccctccaaagagagctacatgtgtattctttgtgtatttttatcattgagaaacataatttgaatgggaaagcctttctttcgttctaaaaaccctgcatcatttttctcattgcaggttaaaatatgttcattgtaaataatgaacatacggaaaagggtaaaagttattctatttcttccgcccagaaaactataggtggataatctttcagtctgtttctatgtatacatcttaggttgtccatataaaattatcattttgcagataaaaagcagtcaattaggtgcaattctacatggtccaatctcatatacatacgcacattacattaaagtcaaatgacaccttaacttctactttgttgcttttctttgaattaactagggctcatatacagttttccatgttactcggtaataccataattgattctcttgcacgcacttgtttaccaaaacttctcattatttccttagggaatattcacagacatagaagtgcttggttaaaggatttgcacacacacccattcatgcatatactgtctaaggttgctctcatcattaacagcagagttgagtagttgtgaccatactaccaaaaaacctgcaatatttaccctttagtcctttacagaaaaaggttgccaaccctgacctagaatccataattaactagatacagaatccagacatccattcaacaataggacacagacttcctatttttaaaaaattcaccgtgactacaagcagatctgcatttaaaatattttattcccattagtatttttaattggtccaaatgctctatgtgatataacttcactatcattagaatagtattaaagaatactattagaaaaatgtagctccattatttttactacagaaattattataaccgaagacataaatgcgaaccaaataaaacaaaataagttgtaaaaattcctttcttcaacaattgcataataatctataatacacatagatatacatgttcttaaatatttcatgtaaaaattggttactatttaataattaattttagaaacattaaaagaaatttaacttctgggtctttgatttgaaacagctaagaattttagactggtttccatttttaatcatgatcaagactcagaaacgtagctaagaaaaatcatattgtactttttattgaaaaggaatcacacagaccatgtctgaattattataaaggcttcattaattagattttaatctacatgactataccatatgctaaaaaaccatccaaacaaactctatgaaacggttttactgctattacttaaagagccatttaaaagaatttctacgggataaagactgggtgatttatcatagttttatgctcctttaatctgctccatcttcccattgtaaaataaatattggttttaaaataaatggttctgcccaggttttgatgagaaaaattgccctgtaaatcacaagctcacgtgtgccaaactctaagtccaatgttaactagcctattctgaagaaaaataagtcaattttatagaacaaaatctaaagaagacaattacttaagtgtattttcaaagctgcaatgtaattaatctgagatatgagcttctgtaccccaagttttttaattctcaaaataagaactagtggatatcaaactggtcctccaactggattttttaaaaatgggttctgtactatagtttttattatattctttccgaatccaatatacaagttatgtaactgaaaataaatacaatgagggttatatgataatgtctgagggttatatgatgacatctttatcaatcacttttttcatacacagagagccaaatcaatttaatagtcaggttcttagaatatttcatagtgttctgaaaaattgaccttacagtatacatattttcctataataagcatagtggttaaaatgctctggaagttatgaatggtttaaagcagtgcttcacaaactatttaggatgtaaaactagttgactatatttttcactccaatatgttgtgggttggtgatacttttataaaatacaataaaaattgcacttggatttagtggtagtgtcaaactgctatgacagtctctaaaccagcactgtccaacagaaatatcataggagccacatgtctgattttaagctttctagtagccacattaaaaatgtaaaaagaaacagttgaaattaattttaataatattttatgtagtccaatagatccacaaccttatttcaatatgtaatcagtatacaaatataatggagatatttaactttttaaaaaaattaagtcatcaaaatccagcatgtatattccacttacagcatgtccccattcagactggccacatttcaagtactcaacagtcacatgtagctagtggctgttgtgtgggaaagtgccattttaaaccattactcccaaactctgcacctccctcttcatgaactggtccacatacaacactttgagtagtactgtctaaactactgctcccttaaaaatggcaccttcatttctcttctataattttctactctgtgttttaaattgagggctccattccagataagtccaacacttaaagaaattaacaaactcatgattgcagctaactttatacatcctttcaggaaaggaatttgcatttataagggatggatacggaggtcccctctgctctcccttctctagaagcaatcactattctgaatgatattggtttctttctttcctatccatgtttttatactttttctactgactatgttcttaggatttaaataaagcaaagagaaaatttgtttgcacattgctgagatatatgaatttaatgcgtttagctcatacaaatcctgaccatattccatggcaaccactgaaaccgaatcacacacctttctacgtttgcaccctctgatcccctattcgtccttcataccacactgctttgatatatcattttctttctgctctgtatttagactctgttccaccttctagcctggataatttctacccattgagatcaaagcttaaatatcacttcttcaagtaacctttgttgatctgccctttgccctggtaaaattaggttccctgtcaaacactctcacttttcctatactgcacttaccaaaattgtaaatagtttctgttgttgttgttgtttttgagatggagtcttgcactgtcgcccagggtggtacaatggcacaattggctcgctgcaacctccacctcctggattcaggcaattctcctgcctcagcctcccgagtagctggattataggtgcccacagccatgcctggctaatttttgtattttttagtagagacaaggtttcaccatgttggccaggctgaagtagttattttttttactgatttgtttaatgtctctctcattcataaaaatatgttagcaccagcataattaaaagtatacagtaggtatccacaaatattaattgagtgaatgaatgaattttcattctcagaagccagacttaacctggtcattatgtttctcaatctctagtcatgacactagcttacaatgtgtatatcatggatatatatacatagggtatccctgttaattagaaggtatattttcaagagtatggccataaagaagttattcatggtatattcttttgaccttctattttcaattgtctctatatttagctcccatttttcatttctaatactgtttgtatttctctctctctctctctctttgttcttctctctttgtagttgatcaagtttgacaagtgagaatgtgctgttttagtctttaaaataatcattttttgctcggttgatcttctctactgtttctttgtattctatttcatttttggtaatatttttgtattattccttccctctactgtatttgggtttactctgctattttatttatacctttttaattgaatccttaattccctaacaatgtctccttccgtttctaacgtatacatttatgagtctataaatttccctctatatacctctttgtgtcccacaagacttaaagtatgtactaatttctatcatcatttttctttgactcacaaattattgacaggtacagttttgagtttccaaatgtataaagttttgaaaagtatcagtttctaatctcctgcttttttcctctgaaataaagaattagtaaatataatttttattcatcagcattaagactttctatgtgtgtatattatctgttagtggagtttgaagttctatatatgtctatttgtccaagctaaccggttatgtggtttaaatattctttatcttttctaagcttcttagcttgtttgatttatcagtgtctgagagaaaaatggttaaaactctcagattatgattatatgggttttcaatacttcttggtgactgtgtcaatttttactttctatatttttaaaaggatgctactaggtaatgtaggctcaggattaactcttcctggtgaattgttcttttatcattaaataataactctttatctgtaataatatttttgcttttaaagtatattttgtccgatattaatagtgtcaccagctttcatttgaatgatatttatatgatgtattatgtcaatttcatctattttctcttaatcttcccatgctattatccttaattgggttgttccttgtaaacagttaaagagagtatagctgttctctctatccaacttaagaatctttgcctgcagacagataggtttaatcatttgtatattggctttgattactgattatttggcctcatttcaactaattaatctacagcttcctaaaagtcagtaattatggcctctcactgaaccaagtactgcataccatagcaagcattgctgtatctatcttacactcataatttagctgttctcaataaataatttagacacattggcaaataatattctcttaaagcttcaagctcataagtacttatatatataacacagaaaatccccaactaagatggctaatccactactactcttatttctttacctataacatgaaaataagtgaatccacttgtcatctacctccaatgttgctgtactttcctcttcaacctcctcatttttaaaaatttctatcgggaacagctctcattctgtctcttctacctttcttcttccctatcccagtctctcacctgttaccttgacaattgaattagtatcttttctctccctgccttcatcctaccacctaacaatccaatgtttcctccagttaaatgagggtcgcatagtataagttaagaaatttgaactttaccctacagctcagtgtttctcaaactgaacccaaaggcacagtatcatagctccaaacattctatgagaatatgctttaggtttttatggttttattccaattaatgtcctgaagaatctaaatgacaacctgataattgagctatgctttccaaaagcagtgcctgagtttgtcttttttttttcctccatcaactctgttctgttctcagtatcactggaaccaaacaatcactttaaatgacagcttttaactttcagtgtgtcagtgagcacatctggctgctaggttggcatgtcctaatgctaaaattgtcccatgtctgctattgtgctcttcttgaagataatttgcaatggaaagatagtgtcatggaataagactttaatttattaagttatttaattaatggagactttgatatgacatcataaaaactcatagtgtggcagagtaatggtctattttaattgttatgggctaatgagaaaagaacaaaggcagaattaacatgtaaatgatgcgtttatatcaaatgaaagccaaatgatattatgggacagtgcaaaaggaagtttcccaatttttcaaatagagaaaagtggtgagaaaattgagtcatcatgtggctctgagtagtagaggcatgccaaattaagagtctttgccatagtagtcagcacactttattgatgaaacattaatttatcaaatatatgttaaatacttcatcaataaacagtgagtgttaaacactgttctaggcactaaggatacagaagtcataagatagtcaactctccagtgtcacggaagttatattctgacaataaaaagatgaacatgaatttataatacaacatcagggagtcgtaagtcttgtgaaggaaaacgaagcagggcaaagagatggaggatgatgagggaggaggaaagctacagtaggcaagatgatcaagggaggattctctgagaagatgacatttgagcagacacctaagtgcaacaggaggcaaaggcatacaaatatctcggggagaagatttccaaacaaaagcaagagcaaatacaaagatgttgagaagaacagcaagaaaaccaatgtcaacagactgcagggagaaaggagagtggtatgagactaggtaaaaagaagagggctgaatcttgaagagccttgaggtcatagcaaaaagcctgaatttaattctaaggatgatggggagttactacaggttttttgttttgctttgatagagtctcgctctgtcacccacactggagtgcagtggtacaatcttggctcactgcaacctctgcctcctgggttcgagtgattctccagcctcagccacctgagtagctgggattacaggcatccatcaccatgccccgcttattttttgtatatttagtagaggcagggttttgccatgttggccaagctggtctcaaactcctgacatcaagtgatccacccgcctcagcctccctattacagggtttatacagttcatgcagaataccagaaagggagatggggactgtggggatggatacaggtaggcttgtagatttgctagagaaaataaggtagtttcttctgattgtttctctttctccagtgaaataagaagtgagacaatcaactgattgagagagctggggatggccattggagagttgaggtacaggtgaagatataaaatagttttctcagaaagtagaagtattaggtaaacaatgcaggatcaccgtgtagaacagaggatccactgcagtcagcatagttgtgtgtcctccatccatccacactcaggcccaaagtaggtggaaagctgaatgagggtcatagttttgccagataagaatgacagagaaagatgagcaaaggagttcagtgtgcatgtaaagaagagaagaaccatagcatctgagctgagcaaggaggaaagtgaggatacaggaggatgacggattgtacataaatcctgtaagtcaacagattggaggccccacaggatcaaagaactgttggagtagagatgctaatgtcacctgaggcagcagccctgaaaagataggaagtggtggtcagagagtgggatgctgtgaaacatactttgaaggttagcatggcatttcataacaagggcactattggcatttggggaaaacaattcttcatcgtgcataacagtctcatgtactgaatgacatttagcatccttaacttctgccctctaaataccagtagcactccttacatttgcaattactccctaggagagtggtacttcctagattgtgaaccattggcctggggtatgactatgaggtagggagagatatttgcaagtgagaaactcagggacctgatagaccaggtatgagtattctctgtggatgtttttactgagaatgatgagtataaagacagggcgctggggggaacgtcttcaataaatacagaggagtaggctgtagaagagttttatggcatgtgctttaaaagcctctgcggaggaagagaaaaggaactgtctagaagtgacaatgaacaataccagaagacaccaactccactgtcagacactgagaaaaaaacagacacccctggagagggtgatggggaagcctccttaagagtttgccaagagtatcaagcagctatccaaaagaactttctgtgatgatggcaatgttgatatctacgccatcctataagatagacaataggcacatgtacttcttagcccttgaaacgaggccagtgtgtctgaggatgtgaattttttactttgatttgaacgaatttaaatgtaaacagtcagatgtggctactggctaacaaattggatggggcagaacagtaaaaggtgaaggaagcattcagaagacaaaattcttcttaatctctgagtcttgaggaaaagggcaagggcaggtatgagtctagggaagtttgtacatttgtagcaggaagaggtgaggagcatctaatagcacaatagcatcagcatttccaataagcaggattccaaaaattcattttaatttatttcagcctcctctcagactaaattctataccatattgttgtggaagacccttaaaaaaaaccctcaaatatttaaaatatcaccatcatgtaagaattatttcttctcctaagaagcatctggtattaatagactatgactatcgcgtgttttctaagatctaagtgtcccttccctccaaagactggctatctatatctaacaaaggaaaatgtaacatttgaaaattccctgttaaaagattttgttgtcatttggaaatcatatttcttgctgtttgcatttctattaaaaatataaagaaatttgttctttggtatcccaaatgaagtaaaagtattctaattggttgcattcacaagtctacaatttgcggcttaacaaaattatttttgaaaaggtcataacctgtacccacatgcccacccaaccacacacacagacatccagaatggtcttgtgatcatgtcttcagaagtttggctgcaaagttacaagcaacaactgtccatctgcacccaccaacctagtgaacaatgccagtctgggacccaaggactatttactcaacagaagaattccaacttcaggcaggggataggcgaagtccagataacatctagatatttcttgacattgcatttgattggaaataaaggaaaagtaaagcatttctggttagtttctgtttcttagtgtctctagttcccattttatttcaatcaaaatatcaaaatactctttagcccatagaggggacagagttcctagtttaataaaccctaaaatatataattaagataaagcctctgtagggttactcagcacaacactataattgctcagattccctagtggattctccagtcaatttctctgcatccttgaggcaaaatcttttccttaattgtcctcacttagaccaggtgctaggtgtccttcctagcctgcaggtcttacaggcccattcatccctaagggggtcttatatattaaccttgcttctgaactctaagcactggcaagtcaggcagaaggcccaaaggacctaacagcccataggtaactacaatgttggtaaggtggattctgccagatgccagccttggatccattttgggtccctacagatttatgcttctactataatgaatttcataatttctagtatgtgacccagggttgaactaagaagttattcttgctttcccctttagttttccctaatgggactttgatcaacatgaaaactaaaaatatcctggtgctagaccattaacactagttaactattccagactgtggccactgtcaaagacagccatcttgtaattgaattccactggggacaagaagactcaaaacagagtaggtgaatggattgcttaaagtccatctcagctactaaggagaatgaagagcagcagaaactgaattattaattcccaactctattcacaagccccctctggtggaggaagtattagtaatgaaacagctataacaataaccaaaatttttttaaaagagaaaaggcaatccacaacaaaacaatcagcccctgcagaaatgagagtcaagtgtagtgattagcaaatatgagctgcaacctgaaaaccacttacagatgaagcagtatgatgaatgatttaccaaaaggtcaacaccgctcttttgtcttcatcacccatcagttttccatcgccctcaatttgtctggcacataacagaaagcagggcataaaatattccccataaaaattaaccttactttgcaacattaaaaaaaaaaacttatagttgtatatagttgaagcgtaggggccagcttctcaattagtactcctagcatacagtagaaaaagcgttgacacttaaagccctattacaagaggtaatgttcttagcaagttccggaactctctgccctattcttgccttgctgacccactattctcaagcgaaggaaggggtcagtaatccccctaccaaataccacaccaatggtggcaggaggggagcatgtgacagcatttccccttttactctcctggaggccaaacttctttgcaatctctgcttttagctagcgtggatgccagcctttcaaccttgctatgcctgcaatactttctgacagatgagctatgagatgtaccaccttcccactcccatttgacaacctttgtacaaaaagaaacacaacgccaagggaaagtatatttttaggcatgagggattctgaaaatgaacatatctgcaaacttctagatccccttaaccagacctgaaaaagacattaatctattttaactaaactgattaaattgatttaatcagaaagcgggtcacttccctcctccctatcctgtcgctgaatttactaattgtttctccggctttgcccaatcaataagatattttgcatcttgcagatataatgtaagttatcagttattaaaaattcctcttcccggtctctggttaaagtgggtacctaaatatctgcttatttatttacgtcgttgttatttgcagatttcttttttaaaaaaagcagaattaaaatgaaagaaaaggtcaaaagagtttggaaaaaaagctatctacagggatgttcatcactgcatcatttataatagtaaaacttggaaatcttaaatttccaagcaaaagaagactgttcaaattaattatggtatagccataaagtggaatacagtcatgcatcacataatgaagttttgatcaatgacagaccacatatatgatatcgatcccataagattataatggagctaaaaaattcctactgcttagtgacgttgtagttgtcataaagtcattgtgcatgcattaccttttctatgtttagatatgcaactacttacctttgtgttacagttgcctatagtattcagtaaagtgatgctcacaagagtatgaaattgtctaatgacacagttttcattaagtgaggcatgactacactatgcagacattgaaaattaagtggtggaatatttaataacaaaaaaagatttgtggtactattaaggggggaaacacattgcaaaacagtagatactgtaatatcatatttattgagagctgttatctttgtataccattggtttgacaaacattcattggtcagccatcttccattcataacctcttctctccagcattccttgcacttgggaattgttctataaaataaaatattaaagaagaaggctgctaggtagggcttttttttctttttttttttttgagacggagtcttgctttgtcacccaggctggagtggagatggagtctgactctgtcgcccaggctggactgcagtggcacgatcttggctcattgcaacctccgcctcctgggttcaagtgattctcctgcctcagtctcccaagtagctgggattacaggcacgcaccaccacacctggctaatttttttttttttatttttagtacagatggggtttcaccatgttggccaggctggtctcgaactcctgacctcaagtgatccacccgcctcggccttccaaagtgctgagattacaggcgtgagccaccatgcccggcctaggtagggcttttcttcttgtctgattaaaaggagcggatttatctaacaggtctctttttgtatttatcctttatctttccaatctaaacataacgtctggaggaacagcagcttcattgtgaccatgaagacaaaaaaataacacgctaagaacagtagaagagaaatgccaaaacatcagctctagattatcctctaaagacttggagaaagtcactattggttggattttctttattttgcagctgaacacattcctgatacacaggagattctgtttttgttttttgcttatctgtggcttttatattttctaccatagtatgtactgttttatcataagaaaaaaatactggatacaagaaaaagggtcttttgtattcttcaagagaaatctagaggctgtgagttggagtctcaaatcatccaaggaacaaaagcacaggcaaagaagacatgccaataataaaattcttagagctgcttaacattattaatattttcattcccttcaacagaaactgtttacagctattagtattactgtttttcgagtcatggaacacttaagatctactatggtgtcaggtgctacttaaggcaccaagtatccaaacaataaggcagcccatgaccaaaaggaaccgtaacaagcaaacgaagaggaaaaacctagcagggtaaaacacactgcctaacattgctcagctggttaatggtgaagccaggactggaatgcaggtctcttgacacctaacgaccttcatcaccctatcatatgcttaacccacttaccatttagaagaaagaagtgcagcttgctaccagcacaacgctctcggagcaaacgggaaatgggttaagcattaatatctggctaaaagatgtaagaaaaactctggtgagagtatttaaggagaatgatctagatgggggtcaaaaaacatcagagacagaccttgttcttcattaactagtatttatagttatagcaggattgttttccctaaataaagggaaaggtctctttgagtggggcagaaaggattccactttttggctgggtgcagtggctgatgcctggagtcccagcactttgggaggccaaggcgagtggatcacctgaggtcaggagttcaagaccagcctggttaacatggtgaaaccccatctctactaaaaatacaaaaattagctgggcatggtggcgggcacctgtaatcccagctactcgggaggctgaggcaggagaattgcttaaacctgggaggcagaggttggtgagctgagatcatgccattgcactccagcctgggagacaagagcaaaactccgtcctccccaccccccccccaaaaaaaaaaaagagattccactttttatctatctataccacaccgaatcagtcgatcaatccactgaccacagattgtaatctcggccaaccactatagtggggaaagaaaacatagcagtgcaatcagctgttggataccacaggcaacttgacaagtcagtgacaacttggcctatttattcatcttttaaccgtttgttctggtgtctgtgtagtcacaatcaaagaatagtccctaggaatccatggagtttcattgaaatggagttagggctttggatcatatgcagaatctcagtactattccaggagaagggcagccacattgcctctgaatggccaaaacatagggtagtgaagagtgggagaatatgccagcccgaaatatgccactttagcctaaggattatgtggagctaaaggcacattaaaatacaaaacaaaacccagcaggtgcaagaagtgttctctaaccctcccctttttcttcctgaaaacatgaaacaaaacccccatatagaagacgtccagctataccagaaggaaagtctcattcttatcatcaaggatgggaaaatgagactaggaaaagtctgtacaaacagatcttgttaaaataattcttatcttcctttagcctttccacacagttgagttacttttccacaactgcctctctttgttcaacctaatataaaaccatctaggttttgccacttctttgagtcttcatttccttatgaggtatctcatgtcacataaaacttatattaaataaatgtgtgtgcttttctcccattaatctatcttatattcatttaagtcttaggcccagctgaaaagaaaaccctaaaagagtgtacaattttgcctcctctacagtatccatcttgaaagctgaaagttcactctcaatatgccttaagaataagaacaagtgggggcatgttttttagccatagttattcgtaacccaaacaaacaagtaaaggataatataagtgccaaaaatataaatgttgtctggattcacacatatcttatttgagtgactgtcattttatactgtcgtaatctgtttgcatgtctgtctttccactaaactatatgctccctaaacgcaaggacgatttcctttcatctttgctaagaatgtccaagccttcctccttccaaggctcgaactggattccaactataaaagtctataaaatatgacagctatttggaccgaaatccttcattccaaactatcctacttaaaaaaaaaagtcaactttttaacatttccaaaatatcctgaagggagggaaaaatcacacattaaattctgtcaagtaacatttacctcctcaagccctgactaatcggaaatgactggacttggcagctccttttatcacgtggtctatcagctaaatttagctcctgttgtgccaattgaaaaatgccaacatcccttcccatctcatacaacatcccaacccgccaatgactctagggtctctctggcaatctggtgtgaccactcctcatcagatcaaaatataaattacaaaccaaacttaaagtgtccaagtagccccatccagaagagcaatgatgaagttagaagagacgaagacgagaagggtgccagattcattactattgattccctgctggtctttcaatgtcacggaaagatgtccattatagttctatgaagagcatttggctcagtttaaactcttttgttttcagttcctttaaaaacaaaaatcaaccacgaaggataaacaactagaaattaatggagcccaaagggtttctgcagaatgagaagccttcatcactgcaccctaattatgtaaatctgctcctgcagagtccagtacatttatttattaagtctcaccactgccatcctggtaacccagagaagaagccaatctataatgactcaagccacatttcaaaatagactccaaaggacacatgatgtcatttgctaaaatgactcaatccagatggaaagcattctgacctatacataattgattgacctttgctatgctttccccagttatttatatactatcatatgcatgaatgtatatcagtggtatttacacttggcagctacttttaagaacacattattcaattgggatttgaagctttttacgaccatttcctgaccaaacattcataaatgacgaacaaggaaagatgttatcttaaaaataatgtttaataggctctggagagtttagagaagctttgctactctagttattttaaattacaggggacaagatctatgtacataaagctgagttcaaaccctgaaactgaggataccaaaggacattttatttactttccagtttggagctcaataatgatagtaaaatatgctgtacagaaggcatggaatgttttagatacatgtgagaagagcatcaactgtggtgaaggtagttagagacaataacaaattatcagaatctaaccatggatttcattttccaaaagaggttagctgcaaattggataatacccagataatcaagatagtttcaagatgatcatagaaggggaggcagatagattagggaaggcaaatatgaagcaagcatgtctttactcccattaggaatacccaaggcagacatccataactgattactgaattcttaaccacagagccctcacttggctcaaaatacttttccaatagtactccaggcaaacaccatcaaccaaacagacttgtcctaataacataaacagagaaagttgtatcttatttactgatcaaattaattctatttattgttaccatatactccaagattcaatctaaaactaaacaggtttttaaattcaaaatttaaagtcacatctctgaatcctaagaaaacgttaagtcaaatctagtagttttccatacttcatggtaggctagaatgacccttaatgtaaatgaaaagcaagcaggaaagctaaacaggagaagatgaaaatgcttatatgttcacataggaatattatatagcagtgaaaaggaaggaactacggccacatgcaaccacaggaataaatcttagaaacagaaatccaagtggaaatagcacatggagaagactacatacagcagtgctttccaagtagtgtgcctcagtaagtgggttacaagtgttcccaatccccttagttctggggtgaatagtacctggagtagccaaagtcttgtgtcaagccagagcatttatatcaggaggttctagaatattttcaagttctatgtatgccatgatggaagaagttaggaagcactgacatacaataattctttccagagattaaaccattataaaaccattttataatacttaaaaactaaaatgtatctgcttaggcatatatatacatatatatatatatatatatatatatatatatatatacacacacacacatatatacatgtgacaaatttatttcaaaatgataaaagaaaagcaaggaaaacatgaatggatacttcatccagtacatccattcattcagtataatggttactgttggaaacaataggcaggagatgagttaggtacaaaaacacttcagtagatggtaatgttacagttcttaaggtagatggtggttcatgggtgtttagtttattatactccaagcatattattttataaatacaacatgttatatactacttttctcaaaacatcaaggttaagaaggaaggaaactttttagctgattctgagtcaatttttcacagttgaatctcaatatggcaattcaagaatagatacaactacttttggaagactgaaactcagaggtcaagattttgtcctcatgcaactagaatagtccaaaggtttctaacagtcaactcatgtaccctatttaatgattacaagattttgttctaatccaaatagagtattaatgaaaaattgttgtaaacctaaagttacatttccctactgaaacaaaaacatcacaaaacccatatgtaagcctcttagttaagatccatttagttataaaaaacaaaacccaacctgaagtgttcaagtaaaaggattctggatgaggaattagaggtatcctacagcacataggatagcaagtacagccaggccttatgaagaaccagagccagggtgtaggcagcctttcagatccgaggttgaaacattctctctctcttgggctgcaggttcttgtgtctctacttctttctggaacctttactttattgtccctacctttagctgtgctttttctgctttggcatcgacatgaccaaatatttgtatctcttgtgatttaagtttaaaccaagtagtgccctgaagacaatttcaaaatgcccagaggggaaaaagaatctaattaacccaaccaaggtcaaaatctgtctacaccgggtttaatcagacacagctgtacataaggagttaccaattccaacaactacaggggccaggcaggtaattaaaagtatgatgctgaccaggtgtaaaaccagaagctggaagaaaagggtcttacaacaaagagaactcatgctgcctctccactttggatatgtaataatagaaatccagattttcattgaaatttcttgatttttaaaatacatctgtatacgttaggccacaggcttctactgtcagcgtcctacaaaaaatgaattgtgaatatttcagtttcggggggtcacactgggcaaacctgacttagataccagccctttgggtagaagagcaggtctcacagaagggctcatggtcaggcagtactgcaacaaagcctggattatgcactactttacacaccctccccatgaaatacacacatcagctaaacttctaaaaatatcttgttcaaaatcagatactaagccgggcagagataatcatcatgtagctttgtatgggttcatagtaaaaagcattaaaaaacaaagaaatcacacaaaagcaaactagagccagaaaaacacagcaccatcttcttcttttctttctttcttttttttttttttttttttttgagacagaatctcactttgttgctcaggctggagtgcagtggcgcgatctcagctcactgcaacctccgcctcccgggttcaagcgattctcctgcctcagcctcctgagtagctgggattacaggcacgtgccaccacacctggctaatttattgtagttttagtagagatggggtttcaccgtgttagccacgatggtcttgatctcctgaccttgtgatccacccgccttggcctcccaaagtgctgggattacaggcgtgagccatggcgccgggcccatcttcttttctgtccacagccaaaacatcctgccacaaaaggaccatttgttacaaaacaactgcatattcttttttcagttaactgaaggtaacacaggccctcctgtgtcaatttcttcaccatacaaaactgggagacacagaagtcatagcttaagtaagtgtcacttcctctcggaagcccagcctgagtccctgatcttgtataaggcaaatgtccctttacaaagcacctgtttcccttgctgtggtgcctaaccacagcacaactgatattgtatatgcacaactgtctatttatctcttccacataggtgagcttctggaaagcacagatactgtctaatcctccttctctgttcttaacacctgtttgttaaataaatacattctgtagtcagacatgtcaaaaattttattttttaatttttagcagctaattttaaaaatgctgaatttagactagattcctccttattcttttgtacgcacttaaaaattttcaacaaaacacttaaaatcttttactcagaaaagaactacacatatcactctgaattactacagactcaatatcacattgttgtggggctttcaagaatctgtgcttatatttaagctaaaaatccttcacagcacctcctgtcagtttgtagatacgcatagattttctcaatatacctgtattgatatagatataaatatacctggtatagaataaggcacggtaaaattctctacctagacataaaacccatatatttaaacttatgagaaatctggagaagtacagtatatacatgtccagcaagacttatgttccattttaaagaaatgagccttggcaaatttccctagcactgagaactgtttagcaagaattaatttttaaatgaaataagctaaaaataaaatagatgtagtattatttatacttaagtcttgttctttagcaattattaaaggttacactggtatgttttatcattggtaactggactcaagtttgaccaaatgtttctctttacccatgaaaaatagttgcaatgttccaattttgactgccattccaggtctttggtggcccttcatcaagtgcaatttggtagcctaaatgatatgggagggacagagcataatttcatggcagtaagtatagctgagacagaaaggttaaacaaggtccatgtctttggacacttgaccctaagttatgacagattaactttaaaagacaatgttttatcttgaacagaggggagttttgtcttctccttccagctaggtggaagtatttggcaaatgtcttctttggaaagaattatttagcaatggaattataatcggaattatttagcaatggaattataatcaatgtagtaaggacagaaaaagcaaactaaggacaaaggaataaatgaagaaatgacagccacacttgccaaggtgaattccattcagggaatttgccaaatgaaaaggatattaacattaacttaagcaggtttccttacttcaggaattgtctgtctttaatattcataatggtcctcatgaattttccaaaggatagagtatgcagcatttatgattatttaaaggctttataaatgtaactgctcttgggcatagtggtgctatcaggcagacctaggttgaaattctggctctgtcagcggctgtgatttcatgtgctaatttcttaactcttatgagcctcaattaccttgtctgaaaaatcagccctttcatttatatttcaacagaacttctgcccttgatgtccctttgaagttatttcccataattagtcacagatcatagcatcatcagctgcaatcatcttatctccattctattaacaaatttacatacattcttttgtatgttcaacaaacagcatatgccaagctgagctggcaactggacaaaaacatattatatgtggtttctgaacacccagagctcactatcttgttggggagaaaggcagtgaggaaatagtaatgcagagcagtgacaggtgcccataaggggttcgcctagtttggagaggagaaaacatttgagttgaaatctgaagagagaaaatgaagccactggagatgaagaaaacaaacttccatggggctgagggaacaagaatgtgcaaatgctctgtgggaggcagaaagaaagagattttgaggaggaaaaagggcagtgtagtttgcgtgcaaaaaccaggtgagcaagatgggagaatcaggagaggctttttctttttttttttttttttaatgtcaacactgtttggtgtttatttggtgagcctgagggcaattttcattctcatttctttttcttattgattatttccaaccctttcaacagtgaacatgcgttgcttttgcaattacaacaacaacaagaatccctatagacaaagcaaaaaatatatactttgtaatgtttttaaaaaacaaagattaaactacactaaaatataaggtgattatctctgaatgataagttttggggcagttttttttttaccctcatcactgctttccgaattccaaaggtaaaaagatactacttgaataagaagaaaaataaagagagttgtgtttcaagctttccctcttcccttcttcccaccctatctaacacttggaatatcccatgagggtctccaacgtcagcaggaactaagagccaagagtcgactgagagatgactttctttctctttcttttttgttgtgtggtgaagaaagaaatcataatctgacgtctaaagagcacttcactgttgctcttggttggactctaaatcacattgggaaaattaaaactacaatgagaaacatcttacaccagtcatgatgactattattttttcaattttatttttattacactttaagttctagggtacatgtgcacaacgtgcaggtttgttacatatgtatacatgtgccatgttagtgtgctgcacccattaactcatcatttacattaggtatatttcctaatgctatccgtccctcctccccccaccccacaacaggccccggtgtgtggccccggtgtgtgatgttctccatcctgtgtctatgtgttctcattgttcaattcccacctatgagtgagaacatgcagtgtttggttttctgtccttgcaatagtttgctcagaatggtttccagcttcatccatgtccctacaaaggacatgaactcatccatttttatggctgcatagtattccatgttgtatatgtgccacattttcttaatccagtctatcattgttggacatttgggttggttccaagtctttgctattgtaaatagtgccacaataaacacacgtgtgcatgtgtctttatagcagcatgatttataatccttttggtaaacacccagtaatgggatggctgggtcaaaaggtatttctagttctagatccttgaagaatcgccacactgtcttccacaatggttgaactagtttacagtcccaccaacagtgtaaaagttttcctattactccacatcctctccagcacctgttgtttcctgattttttaatgattgccattctaaatggtgtgagatggtatctcattgtggttttgatttgcatttctctgacggccagtgatgatgagcatgttttcctgtgtctattggctccataaatgtcttcttttgagaagtgtctgttcatatccttcgttcactttttgatggggttgtttgtttttttcttgtaaatttaagttctttgtagattctggatattagccctttgtcagatgcgtacattgtaaaaactttatcccattctgtaggttgcctgttcactctgatggtagtttcttttgctgtgcagaaactctttagtttaattagatcccatttgtcaattttggcttttgttgccattgcttttggtgttttagtcataaagcccttacccatgcctatatcctgaatggtattgcctaggttttcttctagggttttatggttttaggtctaacatttaagtctttaatccaccttgaattaatttttgtatagcgtgtaaggaagggatccagtttcagctttctacatatggctagccagttttcccagcaccacttattaaataggaaatcctttccccatttcttgtgtttgtcaggtttgtcaaagatcagattgttgtcgatgtgtggtattatttctgagggctctgttctgttccattggcctatctctctgtttttgtaccagtaccatgctgttttggttactgtagccttgtagtatagtttgaagtcaagtagcgtgatgcctctagctttgttcttttggcttaggattgacttggcaatgtgggctcttttttgcttccatgtgaactttaaggtagttttttccaattctgtgaaggaagtcattggtagcttgatggggatggcgttgaatctataaattgccttgggcagtatggccattttcacgatattgattcttcctacccatgagcgtggaatgttcttccatttgtttgtatcctcttttatttcattgagcagtggtttgtagttctccttgaagaggtccttcccatctcttgtaaattggattcctaggtattttattctctttgaagcaattgtgaatgggagttcactcatgatttggctctctgtttgtctgttattggtgtataagaatgcttgtgattttttgcacactgattttgtatcctgagactttgctgaagttgcttatcagcttaaggagattttgggctgagatgatggggatttctaaatgtacagtcatgtcatctgcaaacagggacaatttgacttcctcttttcctaattcaatacactttatttctttctcttgcctgattgccctggccagaatttccaacactatgttgaataggagtggtgaaagagggcatctctgtcttgtgccagttttcaaagtgaatgcttccagttttgccaattcagtatgatattggctgtgggtttgtcatagatagcttgcattattttcagacacgtcccatcactacctagtttattgggagtttttagcatgaagcattgttgaattttgtcaaaggccttttctgcatctactgagataatcatgtggtttttgtctttggttctgtttatatgatggattatgtttattgatttgcgtatgtgaaccagccttgcatcccagggatgaagccaacttgatcgtggtggataagctttttgatgtcctgctggatttgttttgccagtattttattgaggatttttgcatcgatgttcatcagggatattggtctaaaattctcttatttggttgtctcactgccaggctttgatatcaggacaatgctggccgcataaaatgagttagggaggatttcctctttttctcttgattggaatggtttcagaaggaatggtacccgctcctctttgtacctccggtagaattcggctgtgaatccatctggtcctggactttttttggttgctaggctattaattattgcctcaatttcagagcctgttattggtctattaagggattcaacttcgtcctggtttagtcttgggagagtgtatgtgtccgggaatttatccatttcttctagattttctagtttatttgcatagaggtgtttatagtattctctggtggtagtttatatttctgtgggatcagtggtgatatcccctttatcattttttattgcatctatttgattcttctctcttttcttctttattagtcttgctagtggtctatcaattttgttgatcttttcaaaaaaccagctcctggattcactgattttttgaagggttttttgtgtctctatctccttcagttctgctctgatcttagttacttcttgccttctgctagcctttgaatgtgtttgctcttgcttgtctagttcttttaattgtgatgttagggtgtcaattttagatctttcctgctttctcctgtgggcatttagtgctataaatttccctctacacactgctttaaatatgtcccagagattctggtatgttgtgtctttgttcttattggtttcaaagaacatctttttttctgccttcatttggttatgtgcccagtagtcattcaggagcaggttgttcagtttccatgcatttgagcggtttttgaatgagtttcttaatcctcagttcttgtttgattgcactgtggtctgagagacagtttattataatttctattcttttacatttgcaaaggagtgctttacttccgactatgtggtcagttttggaataagtgcgatgtggtgctgagaagaatgtatcttctgttgatttggggtggagagttctgtagatgtctattaggtccacctgctgcagagctgagttcaattcctggatatcattgttaactttctgtctcattgatctgtctaatgttgccagtggagtgttaaagtctcccattattatcgtgtgggagtctaagtctctttgtaggtctctaagggcttgctttatgaatctgggtgctcctgtattgggtgcatatatatttaggatagttagctcttcttgttgaattgatccctttaccattatgtaatggccttctttgtctcttttcatctttgttggtttaaagtctgttttgttagagactaggattgcaacccctgcttgtttttttttttccatttgcttggtagatcttcctccatccctttagtttgagcctatgtgtgtctctgcaggtgagatgggtctcctgaatacagcacactgatgggtcttgactctttatccaatttgccagtctgtgtcttttaattggagcatttagtccatttacatttaaggttaatattattatgtgtgaatttgatcctgtcattttgatgttagctggttatttcgcccattagttggtgcagtttcttcctagcatcaatggtgtttacaatttggcatgtttttgcagtggctgttactggttgttcctttccatgtttaatgcttccttcaggagctcttgtaaggcaggcctggtggtgacaaagtctctcagcatttgcttgtctgtaaaggattttatttctccttcacttctgaagcttagtttggctggatatgaaattctgggttgaaaattcttgtctttaagaatgttgaattggcccccattctcttctggcttgtagagtttctgccaagagatctgttgttagtctgatgggcttccctttgtgggtaacctgacctttctctctggctgctcttaacattttttccttcatttcaactttggtgaatctgacaattatgtgtcttggagttgctcttcttgaggagtatctttgtggttgtctctgtatttcctgaatttgaatgttggcctgccttgctaggtttgggaagttctcctggataatatcctgcagagtgttttccaacttggttccattctcctcatcactttcaggtacaccaagcagacgtagatttggtcttttcacatagtcccatatttcctggaggctttgttcatttctttttactcttttttctctaaacgtctcttccggcttcatttcattcatttgttcttcaatcactgatattctttcttccacttgatcgaattggctactgaagcttgtgcatgcatcacgtagttctcatgccatggttttcagctccatcaggtcatttaagttcttctctacactgattattctagttagcgattcgtctaatcttttttcaaggtttttagcttctttgcgatgggttcgaacatcctcctttagcttggagaagtttgttattctgatcttctgaagccttcttcactcaacttgtcaaagtcattctccatccagctttgttcccttgctggcgaggagctaggttcctttgtaggagaagaggcactctgatttttagaattttcagcttttctgctctggtttctccccatctttgtggttttatctatctttggtctttgatgatggtgacgtacacatggggttttggtgtggatgtcctttctgtttgttagttttccttctaacagtcaggaccctgagctgcaggtctgttggagtttgctggaggtccactccagaccctgtttgcctgtgtatcaccagcggaggctgcagaacagcaaatattgcagaatggcaaatgttgctgcctgatccttcctctgaaagctttgtctcagaggggtacctggctgtgtgaggtgtcagtcggcccctactgggaggtatctcccagttaggctacttgggtctcagggacccacttgaggaggcattctgtccgttctcagatctcaaactccgtgctgggagaaccactactctcttcaaagctgtcagatagggacgtttaagtctgcagaagtttctgctgcctttttttcagctatgccctgaccctagaggtggagtctacagaggcaggcaggcctccttgagctgcggtgggctccacccatttcgagcttctaggccgctttgtttacccactcaagcctcagcaattgcggacacccctcccccagcctcactgccaccttgtggttcgaactcagactgctgtgctagcagagagtgaagccccgtgggcatggaaccctccgagccaggcaccagatattatctcctggtgtgccctttgctaagacagttggaaaagcacagtattagtgtgggagtgtcccgattttccaggtaccgtctctcacggcttctcttgactaggaaagggaattccccaaccccttgcacttcccaggtgaggcgatgtcccgccctgctttggctcatgctccgtgggctgcacccactgtccgacaagccccagtgagatgaaccgggtacctcaattggaaatgcagaaatcacccatcttctgcactcctcacgctgggagctgtagaatggcgctgttcctattcagccatcttggaacctcctcccatgatgactataagggaggcttttaaatggtggaaatgaatggtttccaccaggacagtggcaagattcaattatcattttaaaaatctctgtcaagctacagtgtggaaaatggattggaaggagacaataatggctgcaagggtatcaattaagaggctattgtagcaaggatgataatttaaactgcaattggaacagaagatatggtaaaatgtgacaaatctgagagatatttaggttggtaattaattgggtaagagaactgtggtacattttacacataaagtcctaaggtgcagtatttgatttggtctataaattgtactccaaatcagctgatgcttttatagttagagagaattatctcagtagacgtaatacttctctttcaaaaactgtcatggttcttaatcatattccacaatggtcagtatggggatgtttatgcctcatggaatagagaaatcaaaaatttaaatctatatttgatgttaaatataaatagtatcttcttataaaaatacattaccattactcttagcttgatatattgtaaattgctttattcacctcctcagccatttttcatcagcagtagtatatgtgctccctgttcctggcagtgattcactggatgagaacataaatgtatttgtgggaatatgtatgaacgttgctctgggaacaaaagaaacagttctgttataccacattggtggtaatcattctttcccaaaatcattgcttgatcccttaaacaaacaaaacaatgtgaaataacaagcattgcaaatacctaagactttggtgtattgactgcctatctgtcaaatttgacaggaaggattaaccatggtttcaatatttacacttggattttgaaagactagataccaagttgatgactctttgaaaataatatagaaaagtatatataaatacataggtaaaaaggatgggacaaaagtgtcaatggttactgctgaaatatggttttggagtgcaagtataggggatttctgctattcattttatgcttatgcaatgtttaagttttaggagcaggtatcagtttctaagaaaaatcgaaaaaagagcagatatgaaaaacaagatcaataaaatagtttcactgtttaataatgccaggttagtgagaggcaacattcatcatggaaactaaatgcattacactagactttcactatttataattatttttctaggaccatgatcagactggcccacggtatataatctacaaattgactactgatattgtaagagggctcagccatattcaaataccatctattaaaaaaattaaatatgctaattcgccactacaatttaaaattcaactgtaggtaaataaaagtaaattgtgccaatatgcatgtggaattacttgcttctgatcaactaaaaaaaaattagtaagaaatctggtgaacatcgtattggtaaacaaaaacaatttttaaaggaaagtggcaagatccatgtccagtctgatccaaggtgttgccagaatggcagcccgagttgagagcagaaatgtgtttctcctcacacctttccaacttttaggctgtggtcacttcaaactaagaagcaaatcacatcttagcccatgtagtaatgaggttatccacactagaatgcataaacgtcaccttgtggcttgttaaaaacacagattcttgcccatcacaagattatattaaactgactagggtctctaatataatgatgaataaaaatggaaataataaacacatttatgatctcaacaagaaaattgttaatatttcaaattaagtatgaagtctgctgtaggactttttttttttttttcgagatggagtctcactctgtcactcaggctggagtgcagtggcatgatcttggctcactgcaagctcctggggttcaaacaattctcctgcttcagcctcccgtgtagctgggactacaggcacctgccaccacacccagctagtttttgtatttttattagagacaggatttcaccatagtggccaggctggtctcgaactcctgacctcatgatccacccgccttggcctcccaaagtgctgggaatacaggccgccctgcccggcccctgctgtagttttttaaaataaatatttatctgattaaggaagctcagctctattcccattttgctgagattttaccatgaatgaatgtgtttgtcaattttttccccttatctattgagatgatgatatggtttctcagttttactctattaatatggtaagttgcattgactgattttcaaataatcagcttgtattcctggaacaaacccaacttgataatgatatattattctttttatatatcactggatttgatttaccaatgttttggctaggatttttttttcatttatcttcatgaaaaaaattgaactgtggatttattttcatttaatacccctcatctttggggtcaaggttatgctggtctaatgatgtgagtttacatataactgatattgcttcttccttaaatgtttggaagaatttgctggtaaatttaaatgggctcttttttgtgggaagatttctaattatgaagctaatttctgtaatagatataggataattcagattccctaaaaatatatcaaatttagttgtatttttaaggaatttaaccatttcatttaaatgttcaaatttactggcataaaatcttactaatatcttttttagtgcttttttatttctgattattatttcaataatttctgctcttatctttattttcttctactttctttgcatttattctgtttcttttttagattcttgatactgattactagattactaattttcaggctttcttcttttctaagaatttaaggctataaatttccatataaaaactgctttagctgcaacatcaaagcttgatatgttatatcttcattatcagaaatatttttaatttttgttgtgattactttctttgaaacatagggaagaaaatattacctaatttccaaatattggaattctatcattatcattttattactgatttccaccttaatactactgtgaacagaagataaactctatggtttaaagcctttgacatttgttcagaagtgcttatgtctaggtatatattatatttactaaatctttaaaaatgtatatgcttatttggttgttgcagtgttctatacataagattaagtttgttacaagtggtgtttgaatcttctatatgtttactgacttttttgtttgttttgttttcagacagggtctccctctattgcccaggctggagtgcagtggcatgatcacagctcactgcaacctctgcctcccaggctcaagtgatcctcccacctcagccttctgaattttttggttttgtagagatggggtttcgccatgttttccaggctggtcttaaactcctacactgaagcgatctgcctgcctcggcctcccaaagtgttgggattacaggtgtgagctaccaggcccagccgtttactgacattttgtcttcatattctattaactacctgaagaggtatggtaaaatcccaactaaggctgaagatttgtatatttctctttttcagtgctgttatttgctttcaaatattttgagaccatgctatatgtacctatacatatagctatgtctgcttcttttggaatactgtgtgtttgcacaatgtttctctttttacaactttgaatctttatatggatttatatttagactgtacctcacatagttagcttatagttgtcttgttttaataatccagtctaataatctgtttttaaatagaagtatttagtgttttgtattaatataattaaggttatatttatattcttatcactatcttaatatattctttatttgtctcacagttttctgttcctaaattctctttttgtcttcaattaatcaaatatattttatattatccattttccccctctatcagcttggtaactgtacattctttaagtggttaccctggaaatgaaaatatgatttcttgacttattagaatctaccataattgatacttttatcctgtctggataaggatttcacattattttaacttcatttaatccactctcattctacctgttattgtttgttgcctttattttaattccacaaatattttatttttcaagctttttattatggataattcccaacatatacaaaaatagacttaataatctaatgaaacgttcatatttatcatcctgctttagcaatcattagctcatgaccaatcttgttccatctctatccccatccattttctctccaaatatattattttaaaacaaattccaaacatcatattacatttcttatgactatttctgtatgtatatccaaaagatgagtatgctttttataatatataactatgatgtcattatcacacatacgaaaaaataatgataatgggccaggcgcagtggcttacacctgtaatcccagcactttgggaggtcaaggcaggtggatcacttgaggtcaggagttcaagaccagtctgtccaacatggtaaaaccctatctctactaaaaaagtacaaaagttagccgagcatggtggtgtgtgcctgtagtcccagctactcaggagtctgaggcaggagaatcacttgaacccgggaggtttcagtgagcagcctgggtgacaagagtgagactctgtctcaataaataaataatgcataataccatcaaatactctggaaatactcaaatttccaaatgtctcaaatgtgataaccatttttataggtattttgaaatcaagagccaaataaattctgcatactgtgattggtttatttgtcctttaagcttaatttaacctattgattctccctcaatctttttttttttgcccccttgctatctatgcattggagaaaggggcttgttggaactgaagttttccacgctctgatgttttttcccccatgggtattgtattaaataaaatgcttcctagctgtaatttctgtttgtttgcagttagatctagaggcatgcagattcaagttcatttgttttgtttttggtaagattacctcatggctagtggtttatgttcttttctcttttcccataaatattcagggcctggatccgttaattcattaaaataaaaaaataagaatattacacttttaaaacatttattagcaggaatcctattatcaagagaaaattcccccatctatgtttacttagtcatacaagagatgtggaacaaatgcttgattttttacatttgtataccatttttcaaaacaacaaattggttcactaacatctttccatggtaaccaatcggttataattattcttaatgttatgaactcatggatataaaatatttgatgaatttgcatctgctgcagttactgtcaatgagtgcttaaattgttctatctttagttataggacttacactccactaaacattactttgattgttttaaacaatccatattcatagacacttacttatatatttatactttttggtgttcttcatgccctccttcatttacatgatttcaactgggactatttcctctgactgaggagctccttttaatagttttgatatagatatgctgataattaattatcttagttttaattttctaaaaatgtcctttttgaaggatgtgttcggtaggtataaaattctgaattggcaattactttcttttggcactttaaccatggcatcccattgttttcttggttccattgttttggtttaaaaattagctttatgtctcattggtgtgcctttgaaaatatatcttttttcctttggatgcttttaagatgcatttatttgtcttcaatttttaagcagttttactacaatatgcctccatattttatttggctttttttttttcttacacagtttcttgaatccatggcttgatgttattcattaattttggaaaattctttactgctattcttcaaataatacttatgccccatcttccctgaaatctcctcttgggcctccaattgcctgacacagacctttacactaaccaatatgtctcttataaaattttctttatttttgcattctcttttccactctgctttaatctggatattttcccttgatctattttccagatcatgaatcctctcttctgttgtgtcaactctattattaaacctatctacttagttttaaattacacttactgtaattttaactttcatgttgtacatttgattcctttcataggatctagatctctggtgaaattctctgtctcttcttgaacatattaatctcttatctgaaacagattatagctatagatcttatagctccaatttctcagtcacttttggatctgttacttttggttggttttctgtcttgattattggccatttgttcttgtttcctggcatgcctactactttctagtgaatgacagatacactttttatggaaattgtacaagttttgaatgatgttatctttctccaaagatgatttgattttcttctggcaggcagatagagtacaggaaaatcatcttaatccagttgaggctggtatatttccagtttgctcttaccctaggttgtagttcttcaggggcctcaaggaccttgagtatttccatggtcctacttctttgaaagccctgaactctgtgagacactgagactgctacaatatctgctttgccatttactcctgtatcagatattttcagctttatattttgttgtctctccctgggagtgtacaaaaaggcctcaagggaaaattccatgcagtatgttgaacttacatctctgtggctcctttcctctgggatcttgtttcctccagtcctttgttggtagccctgaactccactggtcaggaaagaatttaagctatttccactttagaaactaaaatcttaagttacgctccttgttgatgtattcatgcttttattttccctgatttttaatattttaaaagctggtcacattctcatcattttggtatgatcacaaagaaacatgtagtaatggaaaacaaagaagtattgaccttcactaggcaatcaaccctcagataatgtcaggaaatctgaagctttctcaagtaggagtatggaagagtggagaagggagatgtgttatttatcacagacaatactcagcacaattttattgctccttggggaatccaaagcttttaaagatgatattattatttggaaggcctccagagagcactaagtattaaaaatagcacctgcattctgctaagtcaaatcacctgtttattatccagggtgatgaaaatcatttaataaaatattacagacgcttgttcaaaatcatgcacacaattcataggctcagagacattaatgtctatgcctggctcactacatatttgttaaattgataactcaggtggacattagttaatattaccactttttaaaaattaatgatatcaagttatttgaaatagccagtagaaaacctctgcagtaacatttcccatttttcctcatacaaaatttacataaaacctttgctttgtaatagccactatcttttttctttagagaaccttctcctcctcctgcctttagaatataaatataagaatgtgactcaggtctggtcagtccctgttcatcccattggccagagttattggttcagaaatgagcatgtgatctacattattccattgagactcagtacttggattttatgaacactactggaaagagaattgctgctggttggtaaagggatagaatgaaagattcaatgtggttatcaccacgtaatgaagacctgcctaagactgaagccaaaactacttaaaacttctcagttacatgaatcaataaatgccctttgttgcctaagccagtttattaggactgggtttcagacctggaaccaagagttcttactaatatagctataccaaaaaagtgtgtagcagcaaccaagtctgtcaacaagagtgattaaccctcaggtttaagaacaaaactgaaaagacgcagtagcattaggaacatgtttttgtggtgataagatttattccagtccactgataatgttttactttcccacctacatttacaggatgcccaagacatgaggcctgaaatttatcaataatatcaaataacatagccccattcttgaagttccaaagttagagtattattggcatttttcacctattcctcacagagcttagttatttggggatgaagtaagttacagaagtttccaaaaaagaaggaaatctctatgtgtttcatgtttttaaaattctgtcttcggctttggcttaagttatggttactgatggtagctgtaagtaatattcccaggagaaaggctgcaaataaaatgagaattcctcagcatctttattgtccttcaagtggacacgaattcaagcaggtgcacatactgaggatcatacatttctactcatggcatttaattaggaggaaagtaaaatgtgcagggccagaactttaaatattagtttaataacctttatgcacctaatttctgaatgattttcttactctctggagaggcatctaatgtcagacagtggcattaaggtgaaattaaggtgagtcatggtaactgaaaagccatgaggcaggcacatgtcagaattattaattttaaaggatatatgaaatattttctcctctgaaaatatgcccagttaatgtatgctgaacttgaagtatggctttatttccctcattcacaactaatcactgtctccaggaggaacagactaaagagagaaagattacaaaagaagtatagccatttcaaaatccccaaacaaatgagaaatcaaaagaacaatgacaagcttgttggttatgtagagtaaaatttttagtgtgccaatcatggctgataccatgttttgaccatgtcaaaattcatcaaggcaggagttttcaaaccttttttgaatatgacccacagtgaaaagtatttctatatctatctgtaatatgactgtgtatgcatatacatttacaaaactcttaccaaattaaatgaactctcatattttctattctatataatttcactaaaagcaatccctaaattgtctcacaactcaccagtagcttacaagttgatataaaacatataatttgacatatattccacatcttaggctaagagaattacacatattcaaatcattaccaatgccaatttcagattaagactgttctgaaatgaaatcaaatcaactctttctacacagtggaaattcttagaccgtttattaacttcactaaatattttcataaagcatttgaagcaagatgctttcttcaggataacacctccaaacatactttgtatctttcgtttttctttttcttttttttttttttttttttttttttttgagacggagtttcactctgttgcccaagctggagtgcagtggtgggatcttggctcactgcaacctctacctcctgggttcaagtgattcttttgcctcagcctcccaagtagctggaattacaggcacatgctatcatgcctggctaatttttgtatttttagtagagacagggttttaccacgttggccaggctaatcttgcactcctgacctcaggtgatctgcccacctcggcctcccaaagtgctcagattccaggcgtgagccaccacacccggcctcagaacatactttgaaacaacccaatgcaagctcaccacctcaaatccagatccaaagacgacactatctttaaaacaaacaaacgaaaaaccatgtctctataaaaaggaatgaaacataatgtcacagggtgatattctaatgagacaaagaggtagtcccattatctgttttgttttacctggtggtatcaactgttgtttcatcactgtttctgtgaagaacatgttttcttaatgaacccttgagaaggacagtgatttgatgaatgaaagatgtgacacatgaaacaaaatattcctcattccacacctgtgtatataatatcatttggctctccaaattatcttaaagtttgaatctcatttcttccttcctcaatattttcttttaccatggaggcagggacagcaaagaaatgtttcctctccagatccactattaactgaaaattccagtgctctgaatacttgtttttttttttttatttttaaaaagggacctgaatttctattaaaggatttcctttattaactcctgctgaagaatttacatattggcaggttggaaagtaagccctgtaggaaagaaatcggacttgtttttcatcatcaacatgacggtctgatgatgggtgtatgagtttcctgttgacacccatgtcacatttactgaattactgttgagaccacagggtagacccagcttatacaattcttttgtcttctttctgcttcacagatcattcataatcacacacggggtaaaaaatgagggagcgaaaattgtgtaagctaattttcactgttgctggaagcggaagcaaatagttctcagagctgagagtgaacctgggtggtgaagagcagtcagcattaccggtggcaagttcagcattctgaccaaaatgagccactctgaaccctggtgttcagtcaatggcggtttcctcaaatttgtccttaaaagttgaaatgtatcatacttctgctcagccacccttaagaaacttgagtgtatgagtgtgtgtgaaatacaaataaaacctacacagctattgtctggattgaacaaacaagcaaatgtgctcagttttccaaacaattgcagatgctgtaataattcagaaaagtgtgtgctgagcagtgggggatgctggcatgctctgttagaatcattgtggctgggtgcggtggttcacgcctgtaatcccagcactttgggaggctgagatgggcaaatcacctgaggtcgggagttcgagaccaggctgaccaacatagagaaaccccatctctactaaaaatacaaaattagccaggtgtggtggcgcatgcctgtaatcccagctactcaggaggctggggcaggagaatcacttgaacccaggaggtagaggttgcagtgagccgagatctcgccattgcactccagcctggacaacgagagcgaaactccatctcaaaaacaaaaacaaaaagacagagtcattgctaaccatgttgcttagcacaattttggaaggaggcatgatgctggcacagaaaacccttgtcagaaattcctattccttaattttatgctctttctttcattcttttctcacttcattgtcatacaggcaagtgaaaaagagtggaaagagaagaggcggtgtcaaaggaaaagagaaaaaatacacctgactcctgttgtttatgattgtcttgtcagttaacacctgggcaatcatcaaccatgtactttccttgagccaggtccttaaagaacccaagatgaaggaagtagacagaagcagctttggggtggttagggtagtgcttctagaactttaacgtggctacagatttcttgggagtcttgttaaaatgtggattctgattctagagtggggcctcaaattctgcttcagttggtgatcttgttaaaatgccgtttccgattatggggtggagcctcagattctgcacttctactcttagggaaacccaagcctcagggttagtctttgagcctggggcagtggcctatcctgggcctttttctttacaggtatttcacttgactacttctccttttttcaggggcctgcagtaaagagaaataaagcatgacatagtctgaaaagcactggttctagaatcaaacaaacttgggttggaattccaactctgcaactgatttgcaatctgtgtggtcacaggtgagttttttgaatccctcttaaattcattttctccatctataaactgggtatgccattttttaactctcagggcagctacaaggaacaaatgagatcatgtgcatcatcaggtaggttcacattcattatgaaatgaatgactaaagagcctaaagcacaaccgttctatctacaggtaataaaaaggaaggtagggtgcaacaatgtttaaatacatctttatttttcttaataccatgactttggctcttccttagatctacagctatgggttgtgtagagttgtaaccacattaagccaagcatgtcttcccatttcgaatacttttctgactccagaaattcattctctgatcatgctttcagtaatgacaaaatccagaacagattgggtttttgaaaatatttcttgctatatcaaatgaggaaaatttgaaaatatttcttgctgtatcaaatgatgaaaatacatctgatgatttacttgccctcaattaattcagttcttaggcttgctcttctggacttctctggctcctgtttccaacaacagatttcccttcttctcaagctcccctcttcccagtctctctcctccaatctgaaattgggctccctttgctcccatagtaaataaggcaaaagtgtcccttcattcccatgtgatccagctggggaatctcagtttctctaaaggaatcaagaagatacttcagagttaaccagaggaattaaagaaaaaacagttaatgccagccttctccaaccttcccacatcagcagactgaacaaagcgctcaaaactcagggtttaataaagagggaaaaaggaggaggagctactttattgggtgtagtagagacaaagagggaaatagaagaaaattgtgaagtagtgacattagctgccatgtcctacctcctctggcagttctccagggcagacagggctggcagcggatgggtgttataactcctatggatcatgcctgacccttctgggcccgtcatgacttctgtttagatgacactaaagggtctcagggcagcatcagagcaggaaggatgtgccaaccacagaagtgccaactcatgacaagaatcattgctcattcagggattgctgcccctgccatcaccccctctgtcccaggatctgcattccgctgttctctctcctgcaagctgtgacagcagaagaggggcctccttcccattagctcatttccatctcggacttagtcaaaggaataaattattgtcagctcatctgtcttattagattgagccacatgatattgccatgttgttgctccaatactggcaatttcatgtgattcaacctcatctgctgtttagagaaaggaagtttcactgctatgaaaaactaaaccatttctgtggctgagctatgctgaccagaacagagttatctcaaattcatctactcaaaagctgcatattttaaactgaaatgcactgagcgtcttccttatccctactttccacatttctaagacaagataaattcagcaacattctttagaaaacattccatctccaacagcaactatcagtcaaacaacagggaatcattgtgcatttactctgtataaagcataagaaggataaaaaaaataaacacaacatcttttctgtccctaaggagtaactgacgtagctgaagaaagaagaggggaaaaacaccacaaaaaatgtaaagaatgaagcaacaatataaggaatgtcacaagacagaccatgatcatttgctaaatgagtggaatggaaaataagtacagtgagttgagaggcaggagcaatcacctagaatctgatgtgagccactttctatctaatttagctcatcaatcacctcaccctcccacctacttactgtgggaagttatcacagaaaatgaaaatctcctctctgcctactcataactcccagatgtcggttccagaaatgtatgcccagcaggtctcagaccactcccactcatttattgggtccatctcaggaaaagatgggggaatggggacatttacactggatgcttttctttctctaggtgaagtcagcatgacacaggaaaatgggagaaatctaaatgtgtgtgcctcaatataaactgtagccacctggtagcctagcacttttcctgacttcatgactccttttaattctgaatttcaacctttctgagcagttgccaatagtaaaaaaaatgacataaatttaagcatactacaaatacctgtttagatacaaatgaggtcacattaacacctcacagcccccctattttagcaattccctgcgtgctctcactcacacaatctcccatggtaccctgctcttcctctctgctgagggcctccctcttgaggacaatgcctagccatggaccctgtctctagtgtcctcctggagaagggtgtttcctttcccagggggtcatagccaagggctctgcaaggcagcagcagccctggctgccccagtacttctggcatgaaagccatgctgggatgttccatgcagaaatgcagataatacccttctgcccaacactgtcaccctctactgcctgggttgaataaaagtgaaagtttgctaaggtcccaaggcaacatctctgaccaggccttttctccttctcccctttcttccttccttttttttttttttttcttttttttttttgacagagtctcactctgtcacccaggctggagtgcagtagcgtgatcttagctcactgcaatctccacctcccaggttcaagcaattctcctgcctcagcctcccgagtagctgggactacaggtgcacgccaccactaccagctaatttttttaaaatatattttcgtagagatggggtttcactgtgttgcccaggctggtctcgaactcctgagctcaggcaatccacccgcctcggcctcccaaagtgctaggattacaggcgtaagccacggtgcccagccacttctttccttttttgagacagggtcttgctctgttgccagtactggagtacagtgatatgatcatagcacactgtagcttcaaactcctgggctctggtgagcctcccttctcagtctcctgagtagctgggactacaggtgtacaccaccatgtctggctattttttttttaagagatggggtcttgccatgttacccaggctggtctcaaactcctggactcaagtgattctcccaccttggcctcccaaaatgctgggatgaaagccattgtgctcagccctcaccctccacttctaatccataagaaagacgtgtcaattttacctacaaaacatccctcgagtcctccccttcactccatctcggcagataccctgttggttgcttattaattaccatcacctcttacctgggcctctaccacagcctcctaatgtcctgcttccactcttgcccttccagttcattctgcacaaagcagcaagagggatcttgtaaaaagactaaatggatcatgtcttcctagacttaaaacccttcagtgctttccctgctacactcagaataaagtcaaagcccttggccctggcctacggggccttccaggacttggccccagccttgctctacaggagactgtccagtgaaggttataaactcaaagtccactgcttcccatgagaagcctgggtcagaattctgggtcttctgtttaccatgtgaactgtggagctttgggccagcttcttagcttccctgcacttcagttcctacacatggaaagttacatatctcactggattattagaaataaagtgagatacaacgtatacagtgctaggaatattgccagtcaatagtaaatgcttcataaatataatcagcctggtctgctttcatttcttcgaacacatcttttccacttcagggccttccatttgttgtcctttctgctcagaatgctctccctcctccccgtttgtacagaaaggccttccctgactaacagatctcaatggggactctccctgtctcactctgttattctctgttgcaactcttcatttccttcgtatcacttgtatcctgtgataaactgccattattttctttctttggctattcactgcttattgtctttcccttccatgagactttaatctttataagtattaccattgaattccagtactagaacatcattttgactcagggatccttcaagagcttccatcactatttaaatttttacagtgaggaagtggatgaatcttactaatctctcatctcatggtctatttccatttggcttttacttaaagggtcctctttctgtggaggtcagaccaactctctggggcagggttggacaaaaaacaccatgattgactcagtctccccaactcccctgaaagtacatataagcttcttttcaaggactccttgccttcttggacagatatttaactaagtaacctctgatggctccttttatctcaatccgatttaccttctctcttgtgtgtgtgtgtgtgtgtgtgtgtgtgtaatgcacacacttactaagatgttggcttagcccagagtcctcagaaagcacagcctgaggcaaaatcttacataatcctaatttattggaatgtgccatccagggaaggaagagggagagaagaaggaaatgaggaagggacggagaacaagcagatagatacaagggtatatttctgagctggctgccactgttactcagcacaactgatgtcagatctccaggacccatcttctgaggcaggctgtgtgaatgacagctcctttggacaataagtcagggtaagaaggagatgaattccaggttgcacatacgtgggagctgagccatctagtgcatcacaggcctcagtggcaacatgggagccctgggggagatgacaggctgacttgagagaatgggagcagtcactgtaacagcctttggcccttggcagcaacaatgtcagcagcattagtgacctggctctgtaaccatgagagcagcacaaaccaggcaagcatacagatctggaggatggcctaaactaagtctcgtactgatgggtaggaaggtgatgactgtccaaatgtagtgtttgaggatggcaagcatgggacatataggctcaccactcctgaagcttgcactcatggcagacatctttgtactttgtactttgtctggctgagcccaagtacagcctcaaaacacttcttcatacagagctgtaatcagccactacatcacaacagtaatgcaaatgatgacagcataagataaaaaaaattgtaattcacacctgaaatgataaagacaaaaacagtataaagctaatgaaaatgatgaatttcagaaagtgaaaaatccaccaaagggaagcccttccagagcatcttccatctaacccagctccatagcccagaaatcagcgtctgtggatcttcttgatattgcaggaaaagagaatgccattcaaatgacagcttttccagaactggaattctatgtacaacctagcatcacagctctcatcattctgtatttgatgacagttttgtgggtttcatatcccaaaatgatacctgcctaattcacagagcaaagtttatttcatttaaagcagttctgatcaggggaaaatgtttcattgtggtgttataaggaattgatctgctaatgttcttcttaagctttgacattaattacagagaagatgcatcatcatttctactgacccttcattccacccccacctaccaatacacccacccaaatgttcagagctttgtatatgtgtcttaataatctgtcatccaatacttggcaagtgaaatgtgctatcatatggtaccaagaatgttcgcagctctggctaaaacttcactggatctgatatttaagccttagtggtgatctaacataggcagagaactgtgctaagaactgatagatgcagaagtgaataaaacactgcccctttcccttagagtagtaagttccaaactaaaggatagaacccaatagtgggtcttgacatcaacttaggaaattgtaacgagaaattttaaaagctacaatagaattgaatatagtagaacatatctcaaataataataaagggtatagtttcatgaaggggtgtgtgtgtgtgtgtgtgtgtgtgtgtgtgcatatacatgtatttctttctgtaggtgatctaacagtttgaaagcctaagttttccaaaggtgaaaaccatcattcaaacacataatgataaaaatttacgtatagagaatccctggagtcatgcagaatcaacattcagtatgcatacaggatggcagagattagtactaagggggcctgatattcaggcaatggtgagaatctagagtttgccttctaaagcccacattcctcatattactctctgctcagaaaccactgtatgtgcccccatcactacagaacgtaatccaagctcatgagtatggcattgaaggacctccaagcttatttcccactactcttcacctcctcccacaccttcttgatgccatactgttgctataatcatttttgccattttgaatgtgttctgtgtttgaatacgttctgtgtttttttacttctggacccttgcacaaactcttccttcatgctggaatgtctttccttccctatctgaccactaaagtaatatacttacagtggtcagcctttgttttgtctctccagcaagctatccgatcctccttctggtaataatattttctttcctttgagaaactccctgaaatttcatgggttctgtggtcaatcataatgccccactgcctatggccacaggagaagctctgtgacaaacatacagtgattggttgaaaaaaacaagcatgtgacctatggcagaacattatactctatctcatgtacagacgggtacaattccttctctgaattctaacagcagccctcaaaatacagtgagcataataattacctggaagacttgctaaaccacagattggttccacccccagagtttctgattggataaatgtaaattatggcctgagattttgcatttcaaataaattcccaggtgcgttagcttcctcctgttgctgtaacaaattaccacaaacttagtggcttaaaacaacataaatttatcttcttacagttctggtggtcagaagcccaaaacaggtcaaggtgttgacagggctgttccttctggaggctccagggtagaatccatttttttggttctctcagcttctagaggttgcctgcattccttggctcatggcccttctcttgcatcactccaacctcttactgctgtcctcagaactcctactactaacgcttacctcctgtctcccccttataacgacccttgtggttatattaggcctactgagataatgtagaataatctctcattctcaacccccttaacttgatcatatctgtgaagtcccttttgccataagaggtaacttaggcctgagtcctttcacctgaggattaggatgtggacaactttgaggggtcattattcagtctaccacaccaagtgatgctgatcctgatagtccagggtccacactttgaaaaccaatgaattactatcactatcaaagccagcctagtattttattctttagtctgtctgcctcccactagattaagaggttgcagaggctggaatagatcttggcctttttaaaaattgctttaattctatgtacattctcctttctgaatactggtaaatacatctttcagttaaactggaggaataggtaaacagtctgaaatgctgatagaaaagaaaactgtgaagataaaaccccaaagtggagaggtattggttaataggattatctggattccttactgccaacagtaaatctttctacctaattatgctcccaaatttcaaatttctctattgctgacaactatcgccattttgatgccccccagttatttctcatttttctcaaaccaaatttgtgtagctggccagcctatcctgagttctacctcatgggctctggatgtcagagatagcttcaccacacactcaagaactcaagccagaaatttcaccagcatcataggaatagccgctgacagttattcccccactgatatgtgcttggcaacgttctgagttctctgtgggcacttactcattaattcttaccattcttgtcttgtccatttaaaaaatatctcccatagtgctttacatgtagcatacatacactttataagtctacattgcttggttcattcagtagaccataagctccttgagggaagggatgggtcttattcatcatcttgttgccaggatgaaactatgtcacttgtacctcatattacatttgcagtaaaatgttagagagatgagaccatatgtgagcagttggaattaagtcagtcaagttgaagtggggtctaacatcaaattgccttgaaaagcaggcagaacttaaaacatgatataataggcatctcagagctagtgcaaaatcctaagcaagagcataaagctaatgttgggagcaggccccccaaaatctggccataaactggccccaaaactggccataaacaaaatctctgcagcactgtaacatgttcataatggccctaacacccaagctggaaggttgtgggtttagggaatgagggcaaggaacacctggcctgcccagggtggaaaatcacttaaaggcattcttaagccatgaacaatagcatgagcaatctgtgccttaaggacatactcctgctgcagttaactagcccaacctattcctttaattcggcccataagagatacttttagttaatttagtatctatagaaacaatgctaatgactggtttgctgttaataaatatgtggataaatctctgtttggggctctcagctctgaaggctgtgagacccctgatttcccacttcacacctctatatttctgtgtgtgtgtctttaattcctctagcactgctgggttagggtctccctgaccaagctggtcttggcaagctaaaatcattttatagagccaaatcagtaagtccccagtttagcttagaaacaatcagacaaggaccaaaggctttctaggaggtatgattctttgaagagacaagggagattgaaattgagtccataaaattctcttccatcttcctgattctaggtgttgaggtatctgtcctttgttcttggtgatttactatatctgattgcaacttagaattcaaacattaggctctgccttcttttccatccggattctaaaatcaatatctttactatgacgcttattcccaggattaatttatgaaattgtatgatgtgctttgaagactgaaggcttcttagagagagagggaatgtcaccttgtactatcaaaccagtatattaaacagttactgctttaaaaatcagatgtttgttggttgagatgctattaaatcttaacctacaaaaccagcacatgatcatttcaatggtacaaaggcaaactaaatatagcagatgacaattgctacaacataagagaaaaaatgtaatgtaatattttaaccatttagttatatgccacatgaaaataaattcttataaagaataagttttagcacttgccccatttgtgtgatagggtacctaccatgtgccaagggctgtgcaatactgtgatgaacaaaagaatccctacgtgatggagccatcaatctagtggacaggatggatatttaataattatgaataattactacataatcacaggacagaataaaatgaaggatttccaagagcaatgtgaacatagaaccaaatatggagcatatctgaggaaacaagaggctgtccagaggagaccatattccagctgagattttaagggcaaatgagagctgacgagcagcacagaaggggaaagaatcttccagcatttgatcggcatgatacataaaaggagagtagcagggcatgggctgggaacctggaggcctgttcaagactgttcagccttgacaaggtaaagggcaagaggtgatatatttgtttgagctgaatctctcagcattttgcatctcaagtctcctagttttaaacaactttctagagaggaggctgctctttatagaactgagtatatggaagacagccttgagaaccttaaattcaatgcactgtgtagaatataaccatgattctaaacgatacttgttaaaaggcttttttttttttttcaaatggccatggctttgttaaaaaaaaaaaaaaaaaaaaaaaaaaaaacaagataatttggtaactgagtagagacaggacaggtttttctactgaagtctttggtttatggatacacctatagtgttggaaggaagcatttgtattttaaggtatctttcctaggtttgttgctaagttcatggacagcatacccccatgaagatgacaacacagttcttctaagacattatttatttatgtatttattttttaggcagagtcttgctgaagtgccataggagtgatcacggttcactgcagcctcagcctccttggatcaagtgattctcctgtcgcagcctctcaagtatctgagaccacaggtgtgtaccaccacacttggctaaattttttttcttttttttttggagagacaggggtcttgctttgttgctcagtctggtcctgaactcctggcctcaagtgatcctcccacctcagcctctgaaagtcttttaagatatcatattacggaaactttaattaagctcttgctacatataagacactttgcttaggattcaatgtatatctttcatttaaccttcacaacaactctaggaggtaggcacaattattattctgcttatcaacgttgtcaactgaagttagaaaggttagtaaatctttgaagttcacacagcaagtcagcagtgaggctgttaatccctccccactgttaaccaggaaaactctacttctgttaaattctgatcattttttgctaaaggggttagcagtgcttttgactcttttatgtttccctttgatttaccatctaatggttattgctacagtgtttaataagcaatgcattatccctgggcagtggaagtaatatcattactcagagacggtaaacagaagtttgcatctgtgcactgcctggaggtggaagcatcaataaaagcctgaggtggaaggaagagatgaatgtgcaggcttgaatcagaggcaagggacgcaatttgatgtggggtaataagaaattctgcctaggctagcaaagaaacacaatcctttaccactcctagcctcaactgcactgttagatttctcctaacactgcttttctttgctccacagggtacaacagtcccagccccgcccatcacacccacaacccttatgtacgcccaagggtgcctggcatgcaagattctaagagcaatgggttgcaagtccctttgacaaagtttgcctggggaccaggaaatttaagtctacatccgaggaccaaagatatttaaattaaaaacttcctaccaaatccaacagcagctaagagagtggcgaatgcgatattacagaaattggtctgcagcctccaaatgccaaagtggcagcttgttatttatgataagataaggagcagctcgttactaaagatatccatgtcaaccccacgcattgagcagaacaaaggatcgttaatgattcctgggcttgtcatgttagaatggggtggcgatgataaaagagcatctatatatgctttccttgtgacatttcttatttttaaactccaatataaaaatatgtgttaattgttatgatttgtgtcacatgctatgctccagggctggacaggaaacagtgtccccattctagtatttttataataagcaataaacaaacaataaacaatgacaacaagaagagaaccactttccaggatcatatgattagttctgacatttgggaaattgcttcattgccagaagtcaattcccgcgattgcgagcatcttccacacataaaattaataatgtgcccagctcccctcctgccttcattttattatatgaaatttggacctcccacagcatgtaaagtcacatttttaaaataaaactttcttcctttataaaatatataaggaaatgtcttatagagttacacagacctttgaaaacatacatttttccattcctttgtttattcaggcaatacccgtttgagtacctactaagcgccaggtacttttctagagtgaatatgacaatgagggaaaacagacaattattaatattccaaatgaacaaaataagtttggtagtagtaagtgttgggaaaaaaataaagtaagtcaacgtgatagagagacaggtccttcctaatggggacgggggtggaggggcggtcagagagggactctctaggaaggtgacatttaagcaacaagttgaattacaagaaggaatcagccataaaaagatctggagaggagcattcctggcagaaggaatggcaaatgcaaaggcccagtgccggggacaagccgggcttgttcaagaacagatgaagttcaatgacccgagggcattgaggagggcccagtggatgcgggatgaggtcagggagtgggggcaggagcagatcaggtggggccttgcaggcctaatgaagacttagtattttatattaatgacaaggacagccaccgaaggttcaaatctcggaaatgatagattctatttgatattttaaaaattacagctgtctgggcgtcatgggggaagaaaatggacaaaattgtgttccactcaaagatagcatttcccttacagatcccaaggccctgtctttgtcagtacgggtagtgattaagaacatagtgctagtcagaaaacctaggtttgaatccttgctctgccatcaatatgccatgtgatcttagggactccatcaaacttactaaagtcttcacgtgaaaactataataataactcttcccagagtcttggtgaaaattaaatgagatataacacataatacagagtagtgttagtgcctagtacttgatacatataataatagctgttgttgttattattattattattattaaaattaggaagaagaaagagaagcataaggtaaagcactcagcaactactctgatcattcaggtgagaatacagacttatgggagacaggatggaggtttccatcagcatagagcatctctgtgctccaggcccttggacaaatgtcacctctttaatgtcctgaagacattaggtagaatctagaccaaaacagaattctggaaaaactggaaataattcagatgctcaccaacaggaacatgaatcttgatatcatggatgcaactcacaaatatgttgattgaggaaagctagacaggagagactacatgctgtgtaattccatttagatgaagttcaagaacaggtgaaactaactgctgttggtagatatcaaagcagtggtaacattataagggaccgtatttggaaaacatttggaaagagcacaagggagcctgccagggtgctgaaaagtgctctataacttgatctagatggcagttacatgatggatatacatatgtaaaaatatcatcaaaccatatacttaaattagcatactttataaacttttactgatgtatgtgttataccttaatttaaaaaaatatgtatttcaggggatcagaaagtcagctacataaataaacaaatggtgactgctctcttcaggaaaacgatgacctcaggactacttaggagccagttaatttccaaagctacttcccgtttctaagttaaacagctctgcacataatgtcagccacagcaatggcaaagaaccgcagggcaggtgatgaaaaagctcggcttagcagcaggacaatggggaagtgtgttaaactgggaccatgaccaacttcccaaaaccctctctggtgattgccagtgcctgcttaatgccttacctttcaattgtgctgaatttgtctgcattaaatgaaagttcgagggggcaggatcacttcttttttgttttagaaatatagctcaagtacctgtgtgctctataaagaataaaaataataacaggaggccgtggaacaactgaagtatggaacatgtatttagaaagtactttctggcatttcaataaaggaaattcagagggcttccagcataagaacaggatccgaatggattcattttcctgatagagtgacccaacccacaatgcaaagtcattaagtcccatcgcgtggcattaaaaaatgcttttaagctaagatcagccgaaaatgtgcccagggcagatttttatggccatatcatcacaacctgaaattcaaattggtgaactagctagaaatacatgctcactagaatggttcagagtttttctgcatctatctcagtgaaaaatgttagcaaaggaaaccttattttcctggaaaaacactatcaaataataaaacaattcaggaccagttttcacaaagtaataacaggccatacataattgattgcctttagtcttcgtctctgggtattacaaatcacagttactagcgcatcgaacaagctttcattccggattcagactgtccgtcttggcactgcctgaaacggcttgagcacctttattgcacactttactgcattgttcttcagttgcttcttcagtgaagttctgctatacccaacaatgttataccctccttctttctgtgtgtttactgactgtccctgatggtaggcaaaaagtaacttctagaagggaactgatttagacttatgatctcacctcaggcttgcaaggcaatacacaccacccagggagataaaacatattcctatgaaatcatatcctaactctctccattaaaactctagaactgcactaaaagcaggaaagatatactaaaattataccaattctttggcttaccaaacatcaggcagctgcatccataaaaaaaaggaataaataattcattccaaaactcttttttgcacatctcaaggctcataacattggtttgtaggaggaggtctgaacgagggcctagaaattctgagttatgccttggctataacaggaacctgatccctctatcttactctccctttgtatgtacggctaatgatatacacctgggctgccagtgacagtagccatgagccacgtgcctattgagcacctgaaatgtgagtagtctgaaatgagatgtgctgtgagtataaaatacacacaggatttcagagatttactaccaaaagaagaatataaaatatgattctttaataatgttcaaatattaattacatgctgtacatgccgaaatgataatattttaaagatattgggttaaataaaatatactatttaaatttatgttacttcttccattgaacttttttaatgtggttattaaacatttttttaagttatgtatgtggctcacatgtatttcatttggatgacaatgatctagatattctgaattgctatgaaagctaagattctctccttgtggaaatgggtaattacaagcctaacagttacgcatgtcttaaaggatggagaacgtgggggaagaggaagcaatcaagtcaccaagtgtattacatatttagttatacttcaattttcctaagcacattacaaaaagaatggaaagaaggaagaaaaacatgcacagtccttcaccctcctgagacagaaatgagactgaaaatggactttgaaatcaaaccatttcagattagaattctgcctctaacctcagtttctccatttgtaaaatggaagataagcatactcaccttttagagaattaaataagatcatgccgatcaagtacttaaagcaacattgggcacggttgggaataaagatcttggcaccggagatgttgaacctggagcggaagggacattgagaccaaaatgtccattgggcaatgggaatctgagcctggagaccaataaaaagatggatagatgcaagtgtcctagcaagcaagccgcacaggtgagaaaacactaaaaccaggaagggagctggtgtcacataagcagctcacacttcatggaaacatcacagctgcagctgagctccagccagtcgttcccatgaaggaataataatggtacagtgttgccaggttttccaattttctaagagaatctagaaatccagctttttaaatgtttagaaattttaaaaaatttagtttaatttaaaaagcactcattattccagagagaacccacgggaaaatagtttaataccagccaggcgcggtggctcacgcctgtaatcccagcactttgggaggccgaggcgggcggatcacgaggtcaggagatcgagaccatcctggctaacacggtgaaaccctgtctctactaagaaatagaaaaaattagccgggcgtggtggcaggcgcctgagtcccagctactcgggaggctgaggcatgagaatggcgtgaacccgggaggcggagcttgcagtgagccgagatcgtgccactgcactccagcctgggggacagagcgagactctgtctcaaaataataataataataataatagtttaataactctgctgctgcctcaaaggtcaacaaggtaacttgttagatttctaccatatgaaagttaacggggatctcagatgaaattcccacaagcccccaaacagttgagctgccaaagatgaagagggagatttacctcttcctcctcccagctcttcatgctgtaggaacacagttgctgcgactacaggtgtcccagcggtctttccctctccccagaccgtgacctggatgttatgcagaatgtttcaaagagagctgcaaaagcacaaggactttttacaggagacacgtgacataaaccaaggtgctactccggctattatccattgcccgctttaggtctctctggaatattgtctgtttccatttcaggcactctcagctactacccattttggttaataaattatcatattgtgtaaatgtatacaatctgtaagcctggaagaactgtctggaaaaaggatttttaaaatatcacactaaaaaaataaatactagtggcctctctgtatctattgtaaggagtaaaaggatttacacctgaaaaattaaaattacagtagctactctttcctcaagtggttcttagcaaatgcattttaaagaggatgactttccagtgaacactttaattttaatttaaccttcccagaaaatgaagtgctttgtgtagattcttttggttttatttaaggcataaaaattagttctgaactgtgataattgtgggcttaggaatgtaatcattccaagcaccacttctcacttgcttataagccctacaggtcttgagttgctgtttattgctaattcgaagttggcaagttatttaactgtgaagctgaacttgaagtcagagtgtgacgagatggtgggaggtagattgttttgttttgctttcaacaggttatccaaagcccggatgcaaaatgcggtgcaagacacggttctagatatgtgctcctctaactcttaatcttaattaaaatgggatgatgaaatgttctaaaggtggaataaaatattacattaatctataactctatcttgtcaaaccaaccacagataggatacaggttcctatcatccacccttatgattttgttcttaattgtggcattttgttgttgctgtgaggactcaacctaaatactattgcttctatttgattgtttaaaggaaaataatgtaacaagctttggtcatgaaaaatcgtaatgtccataatacagtagatgcagcatttctaaacattttagaattacgtgtttgaatccacgaccacatactcacatacatataatcaacattaaccaaagggtcatatggcgatttttttcctttataataaagagatcctctgaaacattttaagataaatgaattcctgcttaagtatgggtgcatttgaagtgagaatgctttgaataaagttatcattttcacacaccactatgcctgaaagttatgagcattcagacagaaatcattgaagaaaacttaataaaaatatgtttggcatatgccgtatttagtgtgatcaatagtgtttagtaattcaagaaatgaattaaaatttcaccctcattttgccactcctaaatttccatttgaaaaacaataagagaaattattaactccctgaatatttctaatgggcttctcagcattattgagtaaaactaactccacattgcaggcctgtgtgctgactcaggtttccaaggtttctctgggaactctttggtctgttgttgctgttctttattctttattgaaaggcatttcctagtgcatttcctaattttaggcacctggctagactttggggatgaaacaatacatgtggcagaatccctgcccttgggtgccttaccctctccttcatacagcatctaatggatccaaaaccagggagaaggtgcacctcacagccacaggctgcaacagagaaaggtaaagtgctggtactacctggtttgtgtttgtctgtctgtctctttcttttcttctttttagtaggtgtcaatattttacataaagatctaaatttctgacttctcttaaaaaaaaaatcagaagatcttagcatactggaccagaaagactacttggcaacatctggctgaagctgtggggtgggagtgttgaggggggtgtggatggtgcacttttcctagtcatctctggatcaaaactggctctagtttgccagtgttcccaccactccctatagttttatactcactcatatccattacctgctttgtcctcgtattacagtatttacattactgacctgcaagaagtaactagcagtcagaaagcctgatactagcccttggtctgctgcttattaaatatatgacctagcatgaattcgtgaattgcataatgccttggagcctcagttttctcttaaaaaagattaaagacaaaacaaaacaaaacacgccttctctggcactgcaattgcaaatctccaaaaagaaatctatggaggggtttccaaacctggaaagcattaggccaaggaataatattattgtaattttgttttcagaagaaatatctagaaaatcagaaataacagcctatatctgattatacctataaagatcacaaagcactctcaactgaattaaatctcatgtgacctctgagataaatatcactttagccattttgatgatgaagaaactcaggctgaaaaggaccaagggatttgccccaacaccaaatgctgacatttttaaaaagtcaactttcaagatagttcccataattttaacacctatgaagacactattaacaactgacatcacatgatgaaacaataaccagtaagatgagccatcactttccaaggatatactctggatagagagtagcagcttctttgagctttcgtttgtttgcttgttattcaagagcaacattttttaaagggtattacatgttgtaatataaaggaaatattttaagtaaatatttgtaataggtactcatttggacttctaataaactagtagggttaaagcttttgaggacgcactttctcattaaatgtttgtcaacattacattattttcttagagattgtcatcagcaagtaacttctatgagaaacaaatgtccttaattttattaaagtctacttttattaatcccctccctacccctaattgagctaatttgaaccatagtgccattcagaaagaaatatgagaattcatctggctcattgtcacatacattttttccacaaagaacctaatagagttaaaagcttgatttaaacatgaattaaaggtttatcatttacctttaggaacaaactctccataggaatagtaagctcttttaatgcatttacattttattaggcttacagacattcaatttattggtgtctttaggtacacatttactgcatacagtcaaatatataacaccttcatagtaactttttttaaaaagagaaggtagacttatttaagttttttcatggttcaccataattcaggtagcgaagtctaaatgaacaagcagagggcagatgagtgactttaagtgcacaggagatctccacatagtaatttagagacaccgtgggaaataaataaggagatacgtgaaagagtaaccagctcttggcaggacatgtatatgactgagtaacatgcaaactactgtttatacattgcaatcagctggcagccaagcaaaaagcttatagatgagtaaggacactgccacagccatgtttttgttctgaacctcctgattaaacaaataaactcagactagagagccacatggagaatacaatgctagggatacaatacaatagaatacaatacacttagcatgcagggtctaaatattaacagcaactgcagaagatatcactgcagatttgagtaaactttctgaaacaataatctacaaaaccagctgtgtttggtgatggctcttcataaaaacaaacagttgcaagaaatctaacaggattccaagctacagttcttagcttatagatttcaaacactggagagaaatgcataacatcccagctttttattctccaaagtgaagattttgaaagcaaataggattactatctagtatggtcatcataacattttttaaaaagacattattattctggaataggaagtatatgatctccttacaatgaacaattccatgtagaaaaagatagaatatctgcaaagcacttttgaggtaggttaaggtcctgggaaacagattcctcatgcatttagcttgaagaaaggtttaaaaggaattctttagggatcaacacctgcagaaggaaagggaaatagaggaggaagcaggtgagctgaaggagaagtcccaatggtagcttgtggggaataatgaagatggggtgccttagcgcattctggcagttgtaaaaaatatcataaacaacagaaatttatttatgatagttctggagactgggaagcccatcaaggtaccatcagatttgatgtctggtgagggcccacttctggttcacagatgatggcttctgtctgtcctcacacagtggagggactagcaagctccctggggcctcttttgtataggcactaatcccatccatgagggtggaaccatcacaacttaatcacctcccaaaggccccactttgagggttaggatttcaacatagaaatgttgggggtacacaaacattgagaccatagcatggaatgtcctgagtgagggtgagaagggaggggcctttttaccctccagtgatcagtcactggaagcaggccacctcatgaaggaggtatgcctttgggagagggttgtctatgggcagcaccacagcaagtagggtgataagcccttagctcctaaaggaggacctgagcagtgcattacagagtccatgcgacacttctgttccaggctagataaaatatttttaagctctggctgtaaggacagtcacctttaagcttttaatcttagacaaccatcataatacaagggctatttgagacacaatggtaagacattaaaaggtcaaagcatataatgctcttactgtccatcagataacatctccaggaaaatcagtcctgctgctctttgataccaaatggcttcttaggtatcagatctgctggcttgttctgaaaaaaggtagagtgaactcatttttctctactccttccctctaaataccctggaagttattcaacgggaagtgataaagaactctaaaacctggaaaaaaaaggagatagaaactgactaggggccttagcacttgagggacaacaacctggtgagttccgtggggtttcctttttatttccaatataccctatgccgggttccagagacggctgcaaccccaaaacagcaacagggagagcctgctccctctggtcaaatgaccagtaaagaagtccagtagagacctagtggggaagccccagccccagcccctactctaccactagggcagcgatgggcagtgaggccctaggccatcccaaccatatatctgacaaagaattactatctacagtatataaataattctcaaagctcaacagaaaaaaaaaacaataaacagttagaaaatgggcagaaaatatgaagagacagctcaccaaagagcatatacaggtagtaagcacacaaaaaaatattcgacatcattagccataagagaaatgcaatttaaaaccacaaaaatattgttacatatctatcagaatggctaaaataaaaaagcagtgataacatcaaatgctggtgaggatgcagagacactagatcactcagacattgctgatgggaatgtaaaatggtacagctattctagaaaatagttcagctgttcattttaaaacaaaaaataaatttgctatattacccagaagtggcactctcgggcacttgtcacagagaaacgaaaactcatattcacacagaaatttaaacatgaatgttcgtagcagctttatttgtaatacccaagaaatgaaaattatccaaatatccttcaatggataatggtcaaacaaactgtgatataacataacacggaatatttcttagcaatacaaaggaatgaactattgatacacacctggatgaatatcaaggaaattatgctaagtaaaaattaaagccaatctcaagaagatacatactatatgattactttaatatagcattcatgaaatatgataatcatagagatcaagaatagagtagtggtggctagttgttcagaatggggtagggaataggtgttgactctacaggggtagcatgagggagtctctgatgatgggacagtgaagtatcttgatagtggttgtggtttcatgaagctacacttatgataaaattgcgtagagctacacatgcacacatatacacacacaaatgagtacctgcataactggtcaatctaaataagctctatggatatgcattgtactaatgccaatttcttggtttttatattgtcctctagttaggcaagatattaacattggggaaaactggaaaaagggtacacaggccctccctctacatttctttgtttgtttctgtgtatctactgttatttcaaattttaaaatttactttaattgacaaataatacttgtatatatttagggggtgcaatgtgatgttttgatatatgcatacaatgtagaatgattaaatcaaggtaattaacatatctatcatctcataatttatttgtggtgagacatttgaaatttatactcagcaattttaaaatatgtgatacatttttatttactatagtcacaatgctgtgcaatagatctcaaaaacttattcctcctgactaactgcaaatttgtaccctggtttttgcttttatttttgagacaaggtcttgctctgtcacacaagctggagtgcagtggcccaagcacagtttactgcagcccaatctcctgggttcaagcagttctcccacctcagcctcccgagtagctgggactacacgcatgtgccaacatgccaggccagtcttttactttttgtagagacaggttctcactatgttgccctagctggtttcaaactcctgggctcaagtgatcctcccacctcggcctcccaaagtgctgtgagccacaggcatgagccacaggcattagccactgcacctggccactttataccctttgatcaacatctccccattccctctccctatcccccagcctctagtgaccaccattccactcactacttctatgacaaaaattaaagtttgtttcttttttttttaattaggcccgttgattgctcagggtaagaaatcgtaataaaattctaggtatttcttcctttgcaatgtgccagcatctgcatctatcactggaaagtggattgcaaacccatctcagatgcccacacctccattaacctctcctactcccggcccaatttcctgctccataccccttctgatagttgcttgcctggaatcccttcaatggcttagcaaactctatggcagttcctgggttgcacttcaacactttcttgaccctggcccacctctgttgtaatccctttctcaaggtctggtgcaattaagaatgctgctgaaagggtttttgttgtagttcgtgcctatcaaacacagactattctgattacttgtggcattttgcagtgatataaaattaaaactaaagcacaggagaagaatcttaggtttttatataaataatttattgtctataaattctcccaagaggaatctatgtcagtctacagaaagtgtctctccattgagacccataccatttgcctgtaaattcagcacactgatagccatttgcaatctgcaaaagaaaagccatctatctaaaggggcacgccacactgttattcctttgtaatattaagaaatttatcctaatttaaaagataactgaattcttattcttttacaaattagactttaaaacacagccactgaattgaccaagcactaccaagcttttatcctacttttatttaaatgtactgaaacattagtgatgaaagctttcatttaaagaattctgatgattctaatattcacttataatgtccatttagctaccacattgtgtttatgccccttaaaagctgaagctatgactgctctagtactgagttctccagtgcttatcattaattaaaaggtaaaacacgattaccagggtatctgcaatcaagctttcaatgtaagaaatatcaatatccagtacttgagaacattttggaaccaattttaataggtaaaaaagtccaaagagaagaaaaaatgttctttattatttcaaattaaaaccagatcagtatatcttactgaaaagttgcaattgcccatgccttccaggcatctgcctagtttttctcttatagcagatgctaaagaagagaaatctggcatgtccatttctgtaatatttacagatataacacatcagcaatacatcagtttggttttttatggaagctaacctcaagaagcaaaacatgctctgtgagtgtacttgtgtacttacttcagatcatccttatgcttgggggtgggcagacagattattaaataatgactgtactgagtgtctactaagcacagtggtgtacttgtgttgagggcaccgagacgaatagaagaatccctaccctaaaggagtgcaaaatctagtatcggagccacatgaatattgtgcaagtgaaagaaggtgagcacagattatgtccatggtgaaacaaaagttctgaatatctgttgagactgataaaaatagatcctgctaatgttaatggcaaaaatggcctgagtgtctttagctccccaatcaactctaccagtatccacccaagccaccccaaataaagtgtttgcccagtgtacatatgcagtttcaaaaaagttgcccggtttctcctcttctgtattggtaggaattgagcaggacacagatggcccactgaaattagaataatttgaggaaggtttaataaagggactatttataaaactttgggtagtatgtaggaaaaccataagggacattcaacactctggaactgttatcatcacacgacataaagggagaaggggaaggagcactgaccagaacttggaaagagaaagtctggtggagaggtcaacctcgagaagagctatctgctttgatagaggaacatagccagctcaaagggaccccacagggagtgatccaaggcaactaataccttgacctcactctccttccattttccagtctcctgcttgggtccccccattggccagaaggcaaaaaaacccactgatgaagcatacaggtcagcaggtggaaaaggatagcatccctgattcctggtattaagaaaatcaatcagccgccaaccgcagagaactgctgtgaaaattaaatgatgtaaagcacattatgcactcaaacatacctcaaacatagtaagtaaatgagaaatgtaagttgttaaatatataatatgggatatttttcattatacaattcaatatagcaattatctatgcctcccaccattttctccccacatgagaggtacagcagagagggagaagaaccaatgtttcctgggtggctagtatgattgcagcagagtgctaagcatttgctatatatcccatcttatttcattctccctagaaagaatgtgataggaattattaagctcttaggaaaggtgagtaaatgaagctcagatatgttgcctataattattgcttataattaggatctcagatctgtcaaattcctaagctaatgacttctccattattttatgtagatgggctacctgtccatattagataattttatttttatcacgttgaggggaattagagaaaaacttgctaaaagctaagcatctaacttagggcttgccacagaagagatagtcagtaactgctatatatgatgatgaggaggagcaggatgataatgattgtgatggtgatggtgatggtactggtgatggtgatggtgatggtgacaatgataattatggcagcggtgacaaatgatggtggtaatagtgatgataagaaccaccctactttaacctaggagcaaagaacttctgcaacagacacgaagaattccttaaataaggtttcagtatatagttgaagtagtggaactgataaatatttgttaatcctggtccctcaatccaagaagaagctttttcagagcaggctgtgtggtgcatggctgggccactatgaatttcggtttccctgtgtgtgaaacgcaataattatatatgtggtgcctagagctgatgtgaagaatgaaaggaatgcatttagaacacttggaacagcctggagcacagcgaacactaggtcaagatagccacttactgtcggggaggttagttccaacatggctgggctctcagcaagtcttcttttgaggaaaggacccagaagtggaaatggcccctctccttactagctgtgtcctcacccactccactcatctacacagtttagaatctgagggtgaaagaaggaagagcaggcaagggaaggcagcagtggaaaacagctcttgggtggtaagtagggagcaggaagagcagttaccaccatgcttaaaacaaggtttttaaaaaaaaaaaattgcctgaagtcacatttgaaaataaagagcttggtaaacatgctgatggcaaagagaacttgtaaaacagtttcacttgaaaaaggccaaggttaatggtataatttcaattttgaaccttcttttaatatggattagtgctctcaaatatgggatttgacattaagatgccaaaagaagactcagaaggtaacctcaagcagtattttttaaggaaatttcttccttttatcatttgaacgcagctgaacaaaaacgttattaaaaattattctgtcataaaaacagcaacatcaatgaccataacaaatgctaaaaagcaaaattatccatgaaattaaaaatatttcacgaatccaaggtgagaaatattttagggatgacacttggcacttgagatttatgtaatgagacattaccaacttttatgtataaaatttcctttctgaaaaaaaagtatgaaaaatcaaaagaaggcaccaaaaaagtcccccactgatttggaaaacatattcttttttttttttttttacaattaactgcatttggagaactgcatcacacttttaaataaaatatacataacacattttctctttatagaaaaacctttacaaacccttaagtttgctgaattactgctgaaaaagtatttttgaaataaaatatacagaatgaataaagcatctttactccattcttcggaaattatctagatacaaatatatacatggctaagttcaaaaacttacatagtagaaagtttaataatttgatctataatattaagctgttgatactttcgattggaaagaaggaggggaaatagtgaaagaaaaattaaccacagaatatattctttgcagtttgagatataaaatgttttatcatttacattaatgtgcataacattttaatattaattgttgcctctttcatcttgctgtcttattttttaaaagcttatcatagaaaagtctctatatgaaattgttcatccaaacagataaaaagttggaattataactgggccaatgaaatgttgttgttttgtattttattgctttgcttcttctttagtaatcatctttgcagtctgtctaaacaattctctgtgcactgacatttgcaataatgtgtttacatcacaaagttagaccctgtcattcgatggaacaagaggctgtattttgtagcccccagacactctgcataacttactccctctttggcctgagagtgtaatcgttttttcatctgccatgtttaattacctttacaggcattaacaacagtttactagaaatcgatggaggagcaataaattcattaggttcagtggaggtaagaagtttcatattctttttctcaggtgaatacctatttgagaactactaacttcatcttccataaacctaaaaaatataatatatgattttcatctgtctaccagttcttaatctcctaccaaagatggagtcacaacacaaaatcaggagtcaatagttacaatgctttctcactctgacacaaaattgtgtaacttgaaggaaacgtgggttcccttatgcatgcaaatgccctatgcgactacagaatgtgttccctacacttcagaagctgttgatgttccactcagatctctgtaggatcccttttaccagtttggtgtcccattcctccctacaggtgttgctgcccatcttctccaaagaattgcccttgagtgaccagagcaacacccagaggttctggggagatatatcactaaattcggcccccacccagggtccatagctaaagactgaatggtgggaagggaaggtacaaaagtctacactcctgtctcaaggcagaactgaccctgtagtatgtttcatgctcccaagactccccatgtgatcaggttaatttcacctgaaaccacaaccttggtagcttcttccacttccttatactaattccctcactcccttcctggtttctcccaagagccctctcttactaatcacctgcacacccatctccagttctagggaattcaaccaaagaccctgtagaagcaaacattacagaacagacaggcatacaaatggttttccagtttttgcaggtaatcaatatctcagccattttaaaaggtactgtccacagtgttttataagcacaagttggggatggaggggaatcacatgcctgttatgtaattgtgtgaaaagaagttcctaagatctacaaagtcacatcatttgcagaagtcactaactgattcctgctccagggaaggctgcagttggcaagggctgcccttcttggcaggtgtcaggcagggctctgcactacaattctccctgcattgggagaacaaaaggagtctggggctaggaagaaaaaaaaaaatgacaagcgaagcattaaactacaaacagctctttgaagcctccctgatagaggtggttgtgtttgtgcaacagttattgggttgagtctaataatgaaaggacagatcaccacttactctgtgatgtcagtaatgaaagctatcaaaactaagcctgagtgggcctgactgtcaccctgtaaatctaacgtggacagcttaatgagggagggacattatcttttctcacactccaattttactcacataagaaatgtggcccacattggcaattaacttgagagattaattaaatccaataacaagttcagttccctccatagtgcattctgatatcatgtgaaggcaccaacatgctatgggcacttagcacatgttaaaaaataatggaactaatttgggctttttgtgtgtgtgtgtgtgcggaaaactggcagctaaccgcctcagtaaattaattccacaaactgatacagctactcgatagttcacacagtcttatttccaaactctgctttattatcctgaaactcccaagaaacattgcccaataattgtgtttcttccctcagcaattttactcaccagtagtatttaacatattttattgggccctctgaagaataaggaggcagccattcagacaaaacataaactctgccccagcttaagaagcaatagactgggtcccattgtgtctctttcaaaacaacggctgacactgacaaggaacaggaagagcagcaggggtgcaggcatgagcttcacttagcgtcagaaggccacgtgatatatgttctggttctctttcttttgggttccctaattcgtccttagttcctgtttttgtgttttcttctctgaaacggtaaagtgctttcctccactaccatatatgaaatttgatcttaagaaataggagtcttcaaatttgaccaattggccaaatggttattaaactgatgccttagtgaaagtcaatgaaattgttttttaactggttgctgtaaaatcatattcctataatacagatcaaattcatatactagagttattatatagatactacataataataatgcctactcctgccccactgctcccaaatcaacctactcaaagaagtgcttcctaacaatctcactaccaaggactccttttattatgatttgagaatggagtacatgtttgaaaatatttcatctatccaagattaacgattaattcatttcctttttggtattattaagaaaaatacatatcctgtctgatggaacttctaataaataaataatgaaattacaacatgaaggtaacctaatctttgacaaaaatgggaaatataatatttgggtagcctttcatagttactgtggttacaaataccctttaggaaataacgaaaagagcttgaaggtttcttttctattttggagagaattctatgacaaggtgatattttagacctaccctaatagtcactagtgcagaagatttacattaacaatctttcatacagccagaagtttcatctacctaagtggcaccttgaaactagaaagagatggtaaataacaacaagcctcaatgttctaagaataatcacatcacctgaagcatggtatctctgcgcatatcttcaattattaccaaaaatgtctatgctataaatatacttgatgacaaagcattcctacacttgattaccaaaaaaaaaaaaagtaaatggtaaacaactgattgaatttattggatctggggtgatcttatatttgtatcaaactgtaaatacatttaactcaactgatccaatattagcccattagtccatattttccacttagggtattattgcagacctactgataatcataatggctaacaatattaagctcttacaaaatgctttacatgcattcattcatttatgtgactcaacaatcccatgtaataagtactattaccattgtcattttacagatgacaaaactaatgtttagaaaggttaagtaacatgcacagccacacagcatctgggtttatctgctgcttggtaaatctggactaaacaaccaacagggatcaggcttgatattctgttccacctgatggccaaggaagatactgtgcaaatgcctgcacatttgtccttagactacaagctttctttcagtcctgtcagcattgacactgccaatattttaagaaatgtatttaaagtcccttctgatatttcttatatcaccagctaaactgcacacaaaataagttaattggttctaaggtttacctaaatatttctcattgtagcagaattgtggaaggagaagtagataatatcaagagttgactgttccatgttttatagaaagtaagagtcagaaaaaatataacctaaataattccattgaactctcagtatatgtaggagtaatggcataatgatatattgttgttataattataggtaaaagataaattcttggaaaataattttaattcacattctctaacatgagaaatttctcttcacttaaggtaaacttcgaatgtttcctttctttccacaaggtggaaatcttgaagtaatgggctactgaaaaaccagagaaattatatgcactgacttacttattcattcttaattttagattataaaagttttcttgtgtagcttagagaattttccaaatcctttataactgtggttgtggaattccacaatgttgaacctgaatagattcctatttatgacaagttacaaatttcattgtagaaacgtaggtgcaaaagacatagattccaaagatttaccactttcagtatcaaataatttacctttcatttttagcttgctctcacataaaaattgatccaaaatgctgttttaggaagaaaccagccctcataaattcttgatgaatccagatcaccaatatgaatatcagttattgaaatcctcagaacatatatgaaggggattaacactaatcatcaacacactaaatggccctaacttaggctgttacgtaccttcattcttctgctttatacagtctataactgtataaagtcttccaactggagttcatggaatcagatattcttaaaagaatacatttcaagatcctcaacttttttcctaaaattgatatgtctgaaaatgtatctgcagtaagggtatcatggggatgacaatttctgtttaaagatctcgccttttcatctgcaaacaattgtcaaagaatacattgctcctgagaaaaaagtcccatgagagcaaagcaaaatgggaatctgtaaaaaatacaatggcgatggtgtcttatttctctcaggagcagactcactgcaaacctcctcaccatatcagccaatctatttcagactgagaactcagaagtgaaatgacaggcatgggaaggaccacaaggaagtttaattgaatgtgaaaacccaagttgaaagaaagtaggcctgacctagctgattgattcagcaaataagtttttcaaaataaactataaagtggacatttttcataaagctaatgagttaaatctgcagttccaaggcttggaggaaatacactactcaaagaatgtactaagcaagagaatcttgtccaaaaattaaaaatcatatttgcagaggtatactgaaatttggaatatttcagttttcccacctctgagtctatcagattcaatatggcacctctaagagaaagaggaataggtataattaatgggcatttgagaagctttggtaagcctttggtgtacttcccaggaaaaagagaaattgaatatcttgagtgactgagcaacaaattctttttcaagacagtttttctctcaataaaattgaagtagaactaattgagttgtcagaggatgaatcataaaaaaaaatttgatgagaaattactatatgatttttggcataaaactggcaagaagttttaaaaaattcaatgacataaaaatacctccaatctcatctgcttatgtatgtgagaaagatttctcaatgcttatatctagaaaactgaaaaattgggattgtgctaaatcctgttttgttttgaaacaaataatatttgacttgatataggaatgaattaaaaaatcaaaaaaagccctgacaatctcattattaggtgaggtttcaataattttaacttttatatttaataattgttaatatataaaaaatataagaaatacatattttttgttttgatcaatcttgtgctaataatagtgataaaagctcaatccagatgtaatttttgaaatgtagaggattataaattcaaaatttttttaaaaaatttaatgttctgagactatatgatgatgcataaaatatttcaagcatattacattgataaaattctgtgagacaaatgaatgaaatatgacttatagagaaaggaatggtgcacaattttcaatgaataaagaatttgtttttatattgttaaattgacaatagtgagactcaactcattatagtatttagattccaaacggatatacttaaaaaatatttaacaatttttaaatgtcaataataagccagaaattatattctttgcaactctttaaacttataacaaattggaagcctatagtttttccagaagtctttcaaggttcagggagcaaaaaaagaaagaagaaaaaaaggagctttctgctttgtttctcctgccttgttattatttctggaattagaagatatgctttcctggccccactttcagatttgctctttgatccactctccccttagaaattggatttctgaatagctaaggtctccagatcactgaattgtggatatgataaactttccaaacaaatatgattctaattatttgctttaccctaagactcattacagcgttctttcaaataacaatcttctccagtgcttttgaaatatggttctataattataaaaattcaccttgcattctatttacaggcttttcattttatttaggtccaaaatacaaatgcattgctttgattctgtagcagatttttgagagtaatccctttttaagtgtctttacaaatatgttatctagtccaacaaggcaaaaaaggaaaatagaaaagaagggagagagaaaaaagaggaggtgatgaaatgccatcatgatatcagagaaggaggtggataatttaaagcagcaaggccctttcaaatagaagatggctaaattttatcactaattcacaataggattagaacatgaattaaatttcatttgaaaacaaagatacctattgctttatatagtccctgcctcaacagcaataccagcctgatttctttcacagttttctttctgagacaagaaataccctaataaaacaaagggaaaaatatatttcccagtgtctaatgatctttataagtcctttgacctttccatggacctcagttttcttatctgtaaaataagaaagttgatttaaaccagttatttgaggaggggcaagagacggggcaaggagggcagatgagaagaatcacaggaagggatgaatttttcgacagaatacccacactctgcatgactttccagattcctactcaagctgcaccactatccctatggatgctgagaactccagctgtgggaatttgtgttctctccttggaagaggacaaatggccggaaacaccatgcataactttaaagatcccttccagcaatgagataccatgattcttcggctatgactagaaaacatattgttactcatgtatttcttctctcctttcctttgtctctggcaagcatcactatttgctccttgctgcctagaacagtatgaggtatatatgcctggggtgtgaaaggagagatggagggagggacatatttacagcagctatgatgctcaagagctatattaatctgtagctctgtattttcatgacttcacaactccctaagcttaaaaatatatatacgtacatccggctgggcgcagtggctcatgcctgcaatcccagcactttgggaggccgagacgggcagatcatgaggtcaggagattgagaccatcctggctaacatggagaaaccccgtctctactaaaaatacaaaaaaattagccaggcgtggtggtgggcacctgtagtcccagctacttgggaggctgaggcatgagaatggcgtgaacccaggaggcggagcttgcagtgagccaagatcgcaccactgcactccagcctgggtgacagagcgagactctgcctcaaaaaaaaaaaaaaaaaaaaaaaaaaaaatatatatatatatatatgtatacacatccttatatatgtatatatatgtatatatatgcatgtatatatgtgtatatctatacatacatccatatacatatatatatgtgtacacacacatccatatatatgacattttaaaagatcctcttttctctcatcttgaagtgtgttaaaaggtatgcgtaaaaaggagctacaaaacaatgaggttactagataaggtacttttcctgaatcaaagaagctcctagacaaaatggggcctgacttggtggtcagctgtcagagtgaaacttaatttaacagtaacaatagacaaagtatgtcagactaagtgcttcatcgacaatctgaacaattttcaataaaatggccttgatgtcagttagggcagacaaccccaggtagagaaagactactcgggaaaaaaaattaagaaaaccttctgcagattcgaagggggatttttttttatccctctgaccagcctctctgtatgtaactttcagtggttcttgccttcaagaggttttcccaccacagtgaggggctgagggagatgtttgtgtccctggatctagtgacttgttttcatggctctgaagcccacagtcactcccatttagaaaatattctatatccttttggattacgcttgatctctttttatctaattaattacatctcaggaaccaagaagtaattacattaagaacttggaggcatgccttcaggaatgtcactatggctttctgtttgtttgttttaaagcaaatcagcactctggaacttggttcagattagcaattttatgcattcagctggatacaatgcaactcctggttattagaataagaaataaggtgaagaacatgaaggaatgtggttcaatctctctctctctttcccttcctttctattccactttagtatagcaattacaggcctctgagtttgggtttagcatcgtgatggtaggcaggtatttacttttttacttgagggtcaagtgggatgaaaagcaaggaaaaaaagccaggacagtccaaggactggcacatgtcaaagcacagaggaacaatacagatcttcagaggaactttttttcttttacttcctttttaaaaaactttgtcagtgtagtaagtggtgaagactatttgctaaagtgttcaacaacataactgctctgagatttctccttcactaggctactctcttaggcctctgtgaacatctgtgccatgtgtacaggccacttcctaacaggcccaaagaggatgtgttttcataaaagttgtaaacacatttaagaaattatctgaagctcataagccacctgatttcctaggcaaggcctctcatcacattaaccatattttacgtaatgagcagatgggcagaataaaaccagagggaggagaagtggaggaaaaggacagtaatgagtgatgaaatggaaatcacgtgattaatggaacatagattttaaaaagtaatgaagagtttatccctagggtagaaaacagggaacaacaaaaataagtaccacgttgtcaaaacagtaaaataagagagtagaacaaagaaacagagcaagacaaagaaatgctggttttaggataggccttattttaaagacacaggggattttggaacttaccattttgcagctatttgtttaaacaaaaataaatttatgttgcctggtgtcctaaaagttacttatgacaacggtcattaatagataagagcctgcagctatccgggtacaccaacaccagcctttgtgtttgttcaacatttctttctgtgggaaatgtaatttgtagcataagagttcacaagaaccctcagctccatggctccatcactaatgaaacaagtcctggattttcatagcaaccatcaagcataaatttggctccccagagcatgtgaactttatgtgtgaattacttatgtgtgtgcacaaactaaaggcaaattcatgtgaagcatacaggcaatttacaaactctatctgttctgaaagtctgcacagtaacaggaacacagacagaaataacaaaatgggtgtatatgtccaggtttctccacaaaagatgacctgtatacttgcaagggcaaaatatcacaaaaacaaccctaatgcaagagtagtaatgagagcaactaaaaataaaatacagaggctgggcctggtggctcacacctgtaatcccagcactttgggaggccgaggtgagcagatcgcctgaggtcaggagttcaagaccagcctggccaaaatggtgaaacaccgtctctaacaaaaacacacaaaaaattagcaaggtatgctggcaggtgcctgtaatcccagctacttgggaagctaaagcaggagaatcacttgaacctaagaagtggaggtgcagcaagctgagattgcgccactgcactccagcctgggcgacaagagtggaacttcgtctcaaaataaacaaataatagaaataaaatagaagataatgactgtgtgtgtgcactttcattattttgaatgttagtgctcaaaggaaagcaaatttagttagaaaacaagctgatagaaaaacagtttcagagattcttaagagaacttcaggacacatttaagaaccatgaaggctggtaacacaagttttgaaaaaattaggccttgtttcaggacaattttgtttttcccatttctaggaatccgatgtatcattcacacaatttgtattcccattagccttgattagggacatatctgtgctcacattagactccctgaatacagggaccaaaattcattcaatgttgccacttgggtgtctaatatgctgcaaaaatctctaggaaagatataaatgaacaaataaatgatatgctgagataacattgtgaagaatttggcaatgaggaggggcattatcttcttccataaagacattgatttattctttaatatcactcagaatcacaagaaataatcagctgatacagaaatggaacagctgtctcacacagaagtggctaaagagaaaaaatttccacaaaatactggaaaagatggtaacaaatcaaatttcaaagttgggcagccctaccaaaaagagaaaaagaagatacgagaggagtcaatagtgacagcactactgaaattcaaaaataggacttgaggtctaagacaaactgataaaaattaaaataatggcaattactcattgaacatttactatgtgccaggtactatatatgcatgatctaatttaatctttataataatccatttaggtaagtacttctatcatccttattatacagatagtcaaacacgatgataaaaagtaagtaactttctcaaagtcacccacctagtaagtgatggaaccagtactttaaaacatgtctgtctgactccttaatcaatgcaacactaagatacatgtgactaatcaaggaaaaagaaagagttttgatttttgtttctttttccaatttagaaaagatgaaggagaattctagaaccttcacttctgagcaaatagcaaaccaacttgctgttgggaatttaagtgtcatgcacattaccatttacattagtttgaaaaagaagtaaatgtccaacttttagtttctctaaacagttattctagttttcctaagtttgaccccaaaagggatttgactgtgaaacaaaactctctgtagttctcagatatggttagacagtcagatgcccacaagtaacagcctgtgcagaacatcaacacagtatatcaccccagcaaggaaagttcaaaggaaagatttctaaggctactgagataaaatggaatagaatctttccagtatatttctctttgctatcaaaccaaattagaaaagactaatttatactaaattataaatcacagcatttctaatttaatcactgtctgtttttttaatttttgttcttgttttagttttgcatttctttcacccatgggatagatacacattctcacttaagcccctgttgaaactatttccattgtcccctagatcctcattctactttaatgtgtctatcttcagtaaaacacaactgataaacctgaaagataataaactggacagactagcactgagattctaaatgagataaaccggcagtcatcctgacagtaatggaataaataaagcatgaataattacattaaaagacaatttctgatttaaactttgcttttcctgtttttacacagtagaaaaaattaggctgtctggccttccttaggagaaatctttcttagaaggaatgtgtgcttatttttaaatctatcataacaactgatatatcagcaacaatgtacccatatttacctcatatttatatgtatgtcttctctattataagcaatatgttatgaaatatattagagattagttcaaagagttgagattggttataaagaattatattagtcgggtttaaaacgtatttggaaagttcccagtataaaatagtttagttgtgttattttcctcttgatgtcttgaatgttgcaaggtactattctatggctggtaggggcatgcaacaggtgggagtaaggaaggaaacagcaagccaataataagttttgaaaataagcccaatcattaagtatatgttgagtctcttcattaccgtgaataggaagtctaatagattgccatatgcagaaacagagaaaatgctgttttagtggcacctaatgaggttccaaaaatgcagtaacttgtagattctttcacattcatactctgtgtaatataacgctatatagcacacttagctctctttataccttgatattttaatgcaaacacagattcttttctctatggctttaaacattacacaggaacaagctcccatgaacctctttcacattcctactcagagctctctgtgaaaagctgtcatttcttgttctattcaagtcagactacctagtctccaggcacaatggtaaaaggaatgtcaaggtaacatcttcatttattcatatgattttctctttttttttaattatactttaagttctgggatacatgtgtagaacgtgcgggtttgttacataggtatacacatgccatagtggtttgctgcacccaccaacctgtcatctacattaggtatttctcctaatgctatccctcccctagccccacaaaccctgacaggccctttgggtataacctagtaatgggacggctgggtcaagtggtatttcttgttctagatctttgaggaattgccacacagtcttccacaatggttgaactattttacactcccaccaacagtgtaagagctttcctacttctccacatcctctccagcacctgttgtttcatgactttttaatgatcgccattctaactggtgtgagatggtatctcattgtagttctgatttgcatttctctaatgaccagtgatgatgagtttttcttcatatttttgttggccacataaatgtcttcttttgagaagtgtttgttcatatccttcacccactttttatggggttgtttgtttttttcttgtaaatttttttaaggtctttgtagattctggatcttagcactttgtctgatggatagattgcaaagattttctcccattctgtaggttgcctgttcactttgatttcttttcaaggaagcactaaatatgaaaaggaaaaactggtataccatccactgcaaaaacataacaaattataaagaccatcaacactatgaaaaaactgcatcacctaatgggaaaaataagtagctagcatcataatgacaggatcaaattcacacataacaatattaaccttaaatgtaaacaggctaaatgccccaattgaaagatgcagactggcaaattggataaacagtcatgacccgtgggtgtgctgtatcggtgcgctatattcaggagacccatcttatgtgcaaagacacacaaaggctcaaaataaagggatggtagaatatttaccaagtaaatgtaaagcaaaaaaagcaggagttgcaatactagtctctgataaaacagacttttaaccaacaaagatcaaaaaagacaaagtagggcattacataatggtaaagggatcaatgcaacaagaagagctaactatcctaaatatatatgcacccaatacaggagaatccagattcatatagcaagttcttagagacctacaaagagacttagactaccacagaataatactgggagactttaacaccccactgtcaatattagatcaacgagagagaaaactaacaagaatattcaggacttgaactcagctctggaccaagcagacctaacagacatctacagaactctccaccccaaatcaacagaatatacattcttctcagcaccacatcgcacttattctaaaattgaccacataagtggaagtaaaacactcctcagcaaatgaaaaagaacagaaatcaggccgggcgcggtggctcacgcctgtaatcccagcactttgggaggccgaggcgggcggatcacgaggtcaggagatcgagaccatcccagctaaaacggtgaaaccccgtctctactaaaaatacaaaaaattagccgggcgtagcggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaacagaaatcataacaaactgtctctcagaccaaagtgcaatcaaattagaactcaggattaagaaactccctaaaaaccgcacaactacatggaaactgaacaatgggctcctgaatgactgctggttaaataatgaaattaaggcagaaataagtaagttttttgaaaccaataagaacaaagacacaatgtaccagaatctctgggacacagctaaagcagtatttagagggaaatgtatagcactaaatgctcacaagagaaagcaggaaagatctaaaatcgacaccctaacctcacaattaagagaactagaaaagcaagagcaaacaaattcaaaagctagcagaagacaagaaataactaagatcagggcaaatttgaaggagatagagacacgaaaaacccttaaaaaaatcaacgaatccagtagctgggtttttgaaaagattaacaaaatagatagactgctagccagactaataaagaagaaaagagagaagaatcaaatagacacaacaaaaaatgataaaggggatatcacaactgatcccacagaaataaaagcaccatcagagaatacataaacacctctacacaaataaactagaaaatatagaagaaatggataaattcctggacacatacaccctcccaagactaaaccaggaagaagtcgaatccctgaagagaccaataacaagttctgtaattgaggcagtaattaatagcctaccaaccaaacaaagcccaggaccagatggatccacagctgaattctaccagaggtaaaagaggagctggtaccattccttctgaaactattccaaacaataaatagaaaaagagggactcctccctgactcattttatgaggccagcatcatcctgataccaaaacctgacagagaaacaaaaaaagaaaatttcaggccaatatccctgatgaacatcaatgagaaaatcttcaataaaatactggcaaactgaatacagcagcacatcaaaaagcttatccaccacgatcaagttggcttaatccctgggatgcaaggatggttcaatatacacaaatcaataaacataatccctcacataaacagaaccaatgacaaaaaccacatgattaactcaatagatgcagaaaaggccttcaataaaattcaacactccttcatgctaaaaacgctcaataaactaggtattgatggaacagatctcaaaataataagagctatttatgacaaacctacagccaatatcccaccaaatgagcaaaagctggaagcattccctttgaaaaccagcacaagacaaggatgccctctcaccactgctattcaacatagtgttggaagttctggccagggcgatcaggcaagagaaagaaataaagcatattcaaataggaagagaggaagtcaaattgtctctgtttgcagatgaaatgagtgcatatctagaaaaccccatcgtctcagcccaaaatctccttaagctgataagcaacttcagcaaagtctcaggatacaaaatcaatgtgcaaaaatcacaagcattcctacacaccaataatagacaaacagagagccaaattatgagtgaactcccattcacaattgctacaaacagaataaaatacccaggaatacaacttacaagggatgtgaaggacctcttcaaggagaactacaaaccactgctcaaggaaataagagaggacacaaaaaaatggaaaagcattccatgctcatggataggaaaaatcaatattgtgaaaatggccatactgcccaaagtaatttatagattcaatgccatccccatcaagctaccattgactttattcagaattagaaaaaactacttcaaacttcaaatgaaaccaaaaaagagctcatatagtcaagataatcctaagcaaaaagaaggcatcacactacctgaggcatcccgctacctgatctcaaacgatactacaagattacagtaaccaaaacagcatgatactggtaccaaaacagatatatagaccaatgaaacagaacagaggcctgagaaataacaccagacatctacaaccatctgatctttgacaaacctgacaaaagcaagcaatggggaaaggagtccctatttaataaatggtgttgggaaaactggctagccaaatgcagaaaactgaaactggatcccttccttactccttatacaaaaattaactcaagatagattaaagacttaaacataagacctaaaaccataaaaaccctagaagaaaacctaggcaataccattcaggacataggcatgggcaaagacttcatgactaaaacaccaaaagcaatggcaacaaaagccaaaattgacaaatgggatctaattaaattattcatactattttcatgttggacagtattataaaagccaatcaaattggagaaataacatagtatattttacaaaatgtaaatttgtgatgcaagcagaagagcttctgctactcatgagagttatattcttgttacccaagaatataacttcgcatcttttcaaaacaacctacacagagtaactcttaaaaatctgctagtgagggggaaaaggagggagaaagcaaagcttcaaaggactttctaaagaaattataatactaagacttttatatgacattcaaccctgttttccccccttctcccccaacaaaataacctagccaaacaatagagaggcaacgtttaaatacaaactttcttccactcaacactagaaaactggtaagattaggtcttcaaagaggctgagctaagaattctcctaagctttaaatttcctgcaaaggctgagttttatttcttaagggaagagcttctgtttggcttttctttttctttttaagaaaaaaattctatataattataggtttattgttacatttgtatgtatgagcaaagtacaggcaaagaaagaaaaacattgtcaagaagctggttatgactaaatatataaagatggaatagtctaacaatgccagttgaataaatactgtaacaaaactgtaatttaaatgaagctaccaaaatatttcaaaagacaacgcattttatgattttaaagtttatcttcaaaatgaaatatgatcatagctattaacaatatgctgtaaaataaaatatgctaaacattgcttctgttagtaaccactagtttctcaggaaacattctttatagagcaactctgattaatgtacaagtgacagcttttttttttctgagcactaaccttacagtataccattgttttcaagacagtgtttataaaagctgtaaagatacgttttagacattaccttgtctatatctatgaactgtcagcaaaaaatatccctttttcaccttctctccactctccatttccagttagacattgtgttttcatccctatatagcttgcctaccttaaacagaaaaatgaccaacatattcttatgtgcaaaatctgaaaacatttctttcagaataatatgacctgttagacatccgaagatcaagacagggataaagatttattaggccaaaccacacaggacttatatgttatgggctgtaggacagagcgtattaaattatttccctgatcacacaactgaatgtaaaaggctaaacgtttcactgattgtggtcaaatatgattgttgctgcagtagagtaaaggccccaaaagtacccttagttaggtcagtgaccaaatgtcactctatatgattttgttcttcacgggcaatgtctccaaagtgctaaatgtgtgaaactccagcttgaaccaaggaatgaattttagtttgctcttaccctttgaatggataagcacattgaacatgaaaatcttctctcttccttatcaacaaggcactaacagaattcagatttacagatcagacacagaaatatggaaaatattcttaatgttagatcaaatacggaattatccaataaataaatattgagtttacaaaccatctaaactttgactctcctacttcccatctaccaaggaagggagaaaagtaagaaatggaagttaagctcaaattactcaggtactgtttgttaatatatctggtgactatcttatgtgagggaaaaactggaataataggaaaaggtttggtgattctacgtagcttttgtgactgtagttctagctcctaagttttactttccaaatagctaagggctgctgttctcaaaagagctaccctttctaaattcaggaaataacaatggaaagaaataattgttaaataaaagtatatgttgatgtttaccctattatatattattttcattttatatgttatatgcacaaaaatttattggtacatatttctaaatgttaaaatcttggttctctgggtgataggatcatacatcatttttatctttacatctatacttttgtgcattttctgctgttctgcaacaagcatgaaatgattttatgctcagggagaagaaaaaagccatctcccaccactacgcccacttcaagaagaagaatgaagagtaaaagaggagaaatatggtaaaggagtcagctttgtactctctgtctgctgttttttgcttcctctcatttctgctttccttagcagaagccaagagtgtttggggggcctaggtctgaggccagctccacctctgaccagtgtacctccaattctctccgagccttggtttcctcttctatagaacgacaataataatggtactcacaagaagtcaagaagaaacaggataatgcatgtaaagctgttaccatggcgcctggctcaaagagaatacccaccaacattgctgcactttttttcgccagccttacctgatcatagaaatcttaagatttataaaatactttaaagcaaacttgtccaacctgcagcccacaggctgcacacagctcaggacagcttagaatgcagcccaacacaaaatcctaaactctcttaaaacattatgagaccttttttttgcaatttttttttaagctcatcagttgccgttagtgtattttatgtgtggcccaagacaattcttccaatgtggcccagggaagccaaaagattggacgccgctgctaaagcttacaatgagctttaacaaacagtaatttaatttttaaactgatagtaaaaagcagagctagaattcaaacctcaccttcccacatcctagctctgataaccaaacaccacttttgagttggattgaaacagttgcctactggagctgcctccctgaggcttacctgcaattggtaaatttcagtaactttgcataccagctgttaaacacagacattattttaaattattatagaattatacaaattaaaatataaaagttacaattaaataaaaatattttaaataaataaatatatgaagctcgtcatgtccttatacttttttcttttttttgagatggagtctggctctgttgcccaggctacagtgcagtggcgcaatcttggctcacggcaacctctgcctcctgtgttcaagtgattctcctacctcagccttccaagtagctgggattacaggcgcctgccaccatacctggcaaatttttgtagttttagtagagacagggttttgccatgttggccaggctggtctcgaactcctgacctcaggtgatccacccacctcagcctcccaaagtgctgggattacaggcttgtgccagcgcacccggcccttatacttttattatctatactctttaagcttatttgcacctattgtatttgtagagtggaaacactacataatagagtgctacatgtatctcttcctaattcacttgcagtaaattcacattggtagcttgaaatcagccaaactggcaaatgccacaaatcaagactcaatatcatttcgttgacttgagagtgatggagaatatgcagattaacttaaagtgtgccatatctgtggctgttatattctgaataacacacacacacaaatggagaacccattcttccagtattataaactatcatacaatatgtatgacagaaagatgattattcatcagttgcaaacatagactggctatggatataagaatttggcaaaaatcaaccaaagcagtgtgtgagaatctactggctatccaggatttacaatcaagagtagtgattattttattcatatttataaattacatgttacatgtcctttatatcagtaaaattaataataaacacacatgcaagcatgcacattagggcatgcatgcacacacatacacatatttttccttgagagccagctgttaaacatttaccagcataccactaaattgaccattattttaaactaagaggaacctagaagctcttaagcagagccctaggctcatcttcaaatcactaaggttgggttataaatggttttagcttcaggtaaggctaccaaattagatcattgtatttaaatatactatgttggcaattcctatcctgcacaatgatgaagtaggctcatagcttcaagttccaccattattacagaaaaatttattctatggaaacgcaacttagggaaagtcaagatagctttctacaattcacaaaaactatggagacatacaaagaagtaagatatggctccttcctgcctccaagacagttgagcagggaggacaaacacataaacctataatataaaaggcacagcactgatagatacaacgtgctatgggatgacaagggagagatcccatgagtttacacttcaggtcctggttaatggcaccagtctcacctgcctcaaaagaagcaagggcaaggaggcaggttccagggagaaggagaaacctataaagtatggcataataggaagaaggattctagaatcaggcagcctgtgctcaaacccagactctttcactaactgtgtgaacacgtccaagttacttggcctctctaagcctctgcttcttaatctaaaaaaggagaatagtaactcctgacccagagcactgtagtgaggatcaaataagacaacatctgtgaaacacttaccccagtgccccataattcaaaagtgctcactcaatgaacattacctactactgtgatggttgttgatagccttgagagttgaaatggctgactttggggactaggagggtgcaggaactagacagagggattccaggcagaaggaagaaaataagcaccccccaccaacaaaaaaaaaaagaaaaaaaaaaacagagattacatacaggggcccacttagtagtcctgaggtagtagaatattcctggaggtctaggtcaggcacagctacagcaaataaagactgaggctagaccaaggctcttccagaatggttcaaatatacactcattcctcatgctcttctgagaaaaacgaaacaaaatcaggcttttaagatgataccctttttcttctgacaggtactgtaaattgtgtctctgatatattttgaagagcctataagggaatgataaatcaggcaatattacatatattcatcagtaccttaattgttgttaaatactaacaacacctaaaattgatctgtaccaagatttactgctctgacaaaaaaccacctggaaaagagcacatgataattaagaacgaccaagggtttgaagcaatctaacgcgtatgaacaagatttaaactcctccccgagggaataactaggtgatgtttattctgtagatgaacaatgtgattataacaatggaagattgatgagatttttttactgtgggaatctgatttagccggctagctcagataataggaggatgcaaaactaagccatccagtaccacttaaaaattctttgtgagggacacatcttcagtgacctgaaaaaaatggactgcaagtcaggcaggcatattaggcagctacaaactgtcatacaaaaaaacagcatttaccaaaaagtttctaaatgcaccacaactgagttcaaccaaattagagagaaaaggtaggaagagaattacattcttatcagaagcaaaggaatttttttttcttttggtggtcttttgggcctaccaactgttatttgagtctaacaggttattcttagtaatccctcttgtccaggaaaagaggaactgcttggtctattttaataaacacacaaactaaaagcaaggcaatattagtcttccagagccttgctatgaaaagtgtaaagagctatcacctaggagcttgttagaacctcaggctcttgggctccaccctagacctgaatcaaaatctacatttttgtttgtttgtttgtttgtttgagacagggactcactctgtggcccaggctggggtgcagtggtactatctcagctaactgcaacctttgcgtcccagactcaggtgatcctcctacctcagcctcccgattagctgggactacaggcatgtaccaccacgcctggctaatttttctatttttagtagagacagggtttcttcatgttgcctaggctggtcttgaactcctggcctcaagccatccacccacctcagcctcccaaattgctgggattacaggcgtgagccaccatgcctggccagaatctgcatttttaacaagaaccccaggtaattcctttaaagtattagaagcaatgctctaaagagacattcattcgttcattcaatacgtttgcgagatctgcagtgtcatttatggtatgtagccactagccaaatgtgactattaacatttcagttagttaaaattaaataaaattaaaattcaaggatttatttgcactaaccacatttaagttctcaattagcacatgtggctaatgtctgccatatacattttaatcatcacagaaacttctattggacacatcactgaacaaagaagacaaagatctttgtactcacaaagtttagattctagtggtgggaaagcagatacaataaacataagtgactcagttaaatggtatgttggacggacagttcaaggctaaggacaaaaattaaaaaacaaagcagccttagagggatcaggaggatggaaagacaggaattttaaatatggcaggtctggtagtttcaatgaaaaagttacattaaaggagaggcaggccgtgagctgcccgggatgggggcaggggggtagtttcaaagggtaaagcctgtgcaaaagccctagggcaggtctgtttccataacagcaagggtcccatgtggctgcaggagagtaaggggagaaggcaagtaaaatggtaggagaacagaggagtatggatcctgggtatggaaagggcttccttatccattgtcaaagatttgagcacttacatgaaacgaaataaggggtccttgcagtgttttgagcagacaggtaacatgcttcaacccgatctcaaaagttattctcgttcagcaaaaaatgactataagtaaaagttattattattttttaattcaaggtcatgttcagatgtagaaagatactatctgcagtggcaaaatgactttgtttacaagttttggtaaccatgagaagcttgttaatgatacacaaacaagttattaaaatttatcactgtaaaattcagatactttttcaaaatcctctatgaatatgcagagtcacaaggtcttacaggttaccacccagaaccagtagccatctttgctataaaacttttcagcaaatcctgaggaatgcaaaatcagagttgcccaattgcccaaaaggtggaactctgcttgagtgtctcaacctgaaaatttgttgattactttatagagagaaagagatgaaaatctgttaaatagtttcaattttttcttttttaccccaactcatgtaaattgaattcatctactctaacatcccagttaaatgtcaaagctttgggaatcaaggtagggatttttatttatttttcaaagttcagttcccagaaacaatgacacattttacccacaagtgagaatgttgttatcttgtaggtaatccagctactgttctatgaactgtaggtcactgtagcctgtctacaaaatgccatcatcagcttcaaggcctgtgttcactaagacagccacatggaagttatactgaacaggcaaccctaaaatgactgagcgccatcgcctgagatttattccctgaggaccaccaccaactgtgatccagccagaattctggcaggaaaataaagtaagttcaccttctgtaagttaaatcaaatgaacaataaatcaaggcatgttgggtcattgggaactaactgctcagatgctcatggccggtgagtgaatcaactggcatcattttaaagcatctgggcatagcatttttgagctatagaacataagaggagattttagcaaccaaattattaccaacgtcagtgattggagtccagaactggagctgctttgatagttcattcgtgtattccttcattcattcaacaaatatgtgttgaggaactcctacaggtaaataatattctgtctgctaaaaatacagaactttacatacagtaaacttgtccacatgaaacttaaagtttcagttttaacctcctcatggctccctcttggagccaggaaccttccagagctaggagacctcaagaggtctttcatggatgggaaggattcagagactgttttagagtgataaggaacataaggtgtactaccagaaggtgaatcttcacagggtaagaggtgtatgtaagcagtaagttttatattctctatcctgaagccagagcacctaagagcttctttcatttccctcatccacccacagaagtcacccctaagaactgaagcattcttcatcccacctcatttctggcacagcaaaaccagaaggagcagggaaaacacattcccagaggccagacatattaagatactggaagtaagcaaaggggctaatagacctaaacaatcagctttggggaaaagaagatcctctctgttgcaaacagagctaaaaggaacagcctagaacagagcctacaagccaaagacagtatattagccaggcttctccagagaagcagaaccaatgggataaatgtagatatacagaaagagatttattgtgagggattggcccatgccattatggaggctgagaagacccactatctgccatctgcaagctggaggcccaggaaagcaggaggtatagttccagcccaagcccaggggcctgtgaaccaggagagtcaatagtgtaagtccctttggatcaaaggcccaagatacaggagctctgatatctgaggacagaagaagatggatatacctgctcaaacagagacagtgaatttgccatttctgcacgttttgttctattcacgtcctcaagagattgggtgatgctcagtcgccttgatgagggtgacttttacttagtctgctgattcacatgctaatctcttccagaaacaccctcgcagacacacccaggaataatgagcatatctcttagcccagtcaagttgacacaaaattaaccatcacttgtgtcctgccacgtatttttgttaacaaagctttactggaacacagccagttatttgtttacatattgtctatggctgcttttgatataaattctactgtccaatatagtagccactggccacataaaatgtgccttatccaaattcagacatggtgtaagggtaaaatacacaccagacctcaaagactgagtaggaaaaaaactgtaaaatacctcatcaataattttttatattgattacagggaaaaaactaatatttttaatatttttggctaagtgaaatatattattagaattaatctcatctgtttctttttactccttgtaatgtggctactacaaaatgtaaaattacatatggggcttacatctgtggttcacagtatatttctattggacagcctggcacagaaggaaagactccagtatgtatacagaccctggagacaagttgaatagaaaaactctgttcttactctaccttccactttatgtctgtttttaatactccaaccccaggtctttcttttaataattatcctaaattaacaaacacacaaatctgaaattcttgcaggtcactattgctgaaaattcaacagaagaaaatctgtgtatatcagaatttcacacaaagatgggtcagtggctgggctgcatagtggatatttgctgcctaccaacattctttctactatagcaagactctaagcaaactccacaaaggagacactctgaagtttcatgatctacatagatgctcaactaaggtaccaagtcatttaatgaagaaataataatctcttcagcaaattgtgctggaacaactgaataaccacacatgccaagaataaagctggaccccttcctcacaccatatataaaaattaacccaaaatggagcaatgatctaaatataagtgctaaactgtaaaactctttgaagaaagcataggggtaaaatcattaccctcacatttggcaatgaattcttatatatgacaccaaaagcacaagcaacaaaagaaaaaatagataagtggtacctcctcaaaattagaaaccttggtacatcaaagacattatcaaaaaaatgaaaagacaatctacagagtgagagaacatatttgtaaatcatatatttgacaagggtctagtatccagaatatacagtataagaaattcttacaactcaacaacaataaaaacaaacaaacaaaaacaacaaaaaaaccaggtaatgggtagaggactttaacagacatttctccagaaaaaacatgcaaatagccaacaagcacctgaaaagatgctcatcattagtcattagggaaatgcaaatgaaaaccacaatgacatgctacttcacacctaataggatggctattattttctttaatggaaaataacaaatgttggtaaagatatagagaaactggaactctccaacaatgctggtgggaatatacagtgacttagccactgtggaaaatagttttgtagtttctcaaaaatttagatatggaattaccatgtaccccagaaatctcactggtaggtatatatccaaaaggattgaaaacaggttctaaaacaggtacctgtgcatacatgttcatagcagcactatacacaatagccaaaaggtggaaacagcccacttgtccatcaacacccatcaatgaatcaaaggataagcaaattgtaatatatccatacaatgcaatattattcagccctaagaaaggaataaacttctgatacatcttataacctgggtgaaccttgaaaacatgccaagtgaaagaaacaagacacaaaagatcatatattgtatcattccatttacataaaatatccagaataggtaaatccacatagatagaatacagattggtggctgacaagggtttggggaaatgaggagaagctgcattgaaatgaggagttttattttagaaggatggaaatgttttggaactggatagagatgatgattgcacggcactgtcagtgagttaaacgccactggattgctcactttaaaatggattttttgttatatgactcttatcttaataaatttttaaatcatatattttttgcatttcacatgtcacaattctgatcttttaaatgtaaaatacattttacattacttaactatttctagtcctcacttctcctccaaaaaaattacattacagttgacactagattttgttaaactacccaaaatttactttgcatatatccctcttgtgcacaagttagtcagaattagtttctgttgtttgcaatcacataactttaattgatatggtaccttagtatgtcagtcagggagcctgaggtctaattctaggtctgcatctaattagctggtaatctcgggagaaattatttaaattagcttggctttagctttctcatatgtaaactgaaaggattagactaaattattcctgagggtttaaaattccataaatgacataacatctccttttaaaatattatccaagaagaagtaattgtcagatagtgatgatgtgacattttttccagtaaaaagtaaatttggaaggtaggccctgcttttactctagttagtccctccacctcactcttctggctcctcagtaatgtttagcatgcatattccaatagataaaatccctcaaaggtgttcagtttcatttctctgatgtgaaagggcaaatcaaatgaaatggttagagacaatgctcaaaatttaaagctgtatctaagtttcccaactcgattaggccattcttacattgctatgaagaactacctgagactgggtaatttataaagaggtttaattggctcacagttctggaggctgtacgagcatggcactggcatctgctcggcttctggggaggcctcagggagctttgactcatggcagaaggcgaaatagtagcaggcacttcacatggggaaagcaggggcagaacagagtgtggtaggttccacacacctttgaacagccagatctccaaaactcactcactattgtggggatagcaccaagggactgatgctaagctattcatgagggatcagccccccctgatctaatcaccccctaccaggccccacctccaacactggggattaccattcaacatgagatttgaggagacaaaacatccaaactatatcactaaccgagtgttcagattgtagtatagaaactatccaagggcacttcaaatgttcctcttatcattgaaggggctgaacaataatttgacccaaaagcttggcattctgcttttactagactaggctggtattataatgacctttccttttgaaaaacaatagtggtttctatctgttgtcttgtaaagatgagttttatattattaagaataataaaagattaaaaaatgttttaagcatttcatccagaagctacaaagcattatgttggggaagtttgaggagtttattaggtcaatctaggctctaatatactcagattattgatttaaaccggtgagcacaataaatcacactggtcatggaggtggcaccagctgaaagtgagaacacagatcaattacccgagagttctgggctttctcactgacttgccattaaaaaattaccttcgtggtttcacctcaaagatcagtctgctttgttttttttttttgtttgtttgtttttttgagatggagtctcgctctttcgcctaggccggagtgcagtggcactatctccgctcactgcaagctccgcctcccgagttcacgccactctactgcctcagcctctcgagtacttgggactacaggcacccgccactgcacccggctaattttttgtatttttagtagagacagggtttcaccgtgttagccaggatggtctcgatctcctgacctcgtgatccatccgtctcggtctcccaaagtgctcggattacaggcgtgagccaccgtgcccggcccagtctgctttttttatgcaaactttgaccgcttagaaaagcgctacaagactggagtggttatgcttggctctggtgtcagagtgcttggattctagctaaaatccacccagggagtgtcgcttaaccttattttctctccgtttcctcaactgtaaagcaagaaaaataatagtgtttcccaaagcctggcacatataccactgggagtataccagatgatattagatggtacatgagtggttttcttcttctgttaacaattatgtgtttaattcccagcatattaaaatatatataattagcacatcaaatgctatggtttgaatgtgtcacccaaagtccatgtgttggaaacttaattcccagtgcaacagaggtgggtccttcaaggggcaattaggtcacgagggctctggcctcatgaatgaattaattatgttatcagagaagtgggttagttatcaccagaatggattcctgataaaacgaatgagttaggcctttttccctcactcatgtgtgcatgtcttttatccttctgccattggatgactcatcaagtaggcctttgccaaatgcagacccttgatcttagatgtcccagcctctaggaccatgagacaaatacatttctattcattataagttacccagtctcacatattctattatagcagcacaaaagggactaaaacaccacactaaaattattgcgtaggacaaatctaagtcaaggaaaagaagtgcgctccaaacagtcctagtcagtcagggaaagttctttacagaaaaagtctagttgacaaatggaaaataattaacagaattagaaatcatgatttttgcaattacttaatgacataattgatttaagtaacaatcatcaattgaagaaacaatcacatgaaaaattaatatggaactttaaaatggaatagtcagtctgttacctgccaaaaccaatgatgaatctcagcttcaataaaacaggttctgaatagtggatgcttcctaataaacgtagtaaagacaccctctgcaaagcattcttgccaaaaacatttacgttaaatcaaatttagagacagcatcccttaagaaaaaataagagtggtgaaggaacacattaaagaagagcatatgaaaccagaatgtgtgacttcctacagaacaaaagatcctgcttctataacaagtctacagtgggaatggaggcaggatttctctaggttaagagacttaaggaacatatgtaatataatgtttgaatttgtttgaatatgaaaataaggaaaaacagtaaatgacattttcaagtcagttggggaagtttcaatgtggagctggattagacaataccaaataattactgtttatattgcttgatataataatggcattgtgcttaagtacaaaaatgcccatatttgttacagctgcattctgaaatacatcagagtaaagtgaagtgatgtctgcaatttgctttaaaatacttcagaagagaaaaagaaaggaggggagggaaaaagacaatatgaagaaaatgtagtaaaaatcttgatgattattgaatctaggtatacaacctgcttgataatttgcaggacccagagcaaaataaaaatgcagggtctcttataactgcttaagaatttcaaaacagtgacagaagaaccaaataaccacattaaaccaaatgtgggccttcataagccatgggctctgaacaactctcaggctgcatgcacatgaagcctgctctatgtgttagataatatggaaattaattgcactattcactctacttggtgcatatttggaaaacttccataataatttaaaggggatcacttaaaaatatatatatataaagtaaagattatatgaggaaatagcaaaaatcaggaaggctacaattggccgcaatttccaagatactgatgtaatcatgaaagacactcaatgtggtgcctgacacacagcaaatgctcaggttagctcctactactgttgctaccaccagcactaccattttgacaaagactacccttgtatctagtaagaaacatgaacgttttatagagattactacaacaacattttacagaaaggttactttagacatcgtgaaatccttactgggagatctacttatatacagaaagtcttacaattcttaccaatatttctgattgtattttgctcccttgtgccctatattctttaaaacttgcgagggatttccatcaatgacagactggataaagaaaatgtggcacatatacaccatagaatactacacagccataaaaaaggatgacttcatgtcctttgcagggacatggatgaagctggaaaccatcattctcagcaaactaacacaagaacagaaaaccaaacaccacatgttctctctcataagtgggagttgaacaatgagaacacatggacacagggaggggaacatcacataccggggcctatttgaggggtaggagtctgcgggggttagcattaggagaaatacctaatgcagatgacgggttgatgggtgtagcacccaccatggcacatgtatacctatgtaacaaacctgcacattctgcacacatatcctggaacttaaagtataaaaaaacaaacaaacaaaaaaacttgtaagggatatcaactgtgggccacaacagcacttagaacagaatattattactaacttgaagattcttctgaaagccagactcctctttgtaattcaagtgacatcacttacagtagcaaagaaagagcatcagaatgaaataagtccttgtgggtctcaatcatggtgaataatactgtggtttttcttgaatgagaaagggcatttgcaaacctcaaaggggtttaacgaaaccttactctcccctttaaatgtccaaattaagcttctttggaataaaaccttctcaaaagaaagcaaatgtaaaagttagattattgtatatgacctaaaacatttgctgaatcacaataaacacataccagcatctactatagcctgttacctaaatcaagtttcacagacccagagaattcctccgccttattttgttttttaaacattggattgaaagtactattgaggatcagcatgatcagtgcaaaccttattttgcacaaagagcaatttaggaaaaatggataaggtgataggccaccaatttatttgtctatccagaatgataatggttttattaaatcccttaaagaaagatgaatttttataagctagactatctaatttgttaaatagcacatcaatctgaatattgtcactgttttttaaaatactctaatgttaatattttggcatgtttgaattgaggcaacacagagttttctaatcgttaatctttaacttgatgaagggatctacacagaatgaagcagactacacacggcccaagggtagtggagatgtgtgtggtatctgttgcttctattaaacatttgcacatgaagcatgggtatatgctagcagaagaacactttcagacatcccatccctattcagttatccttcaaatcatatggcaacaacacaataagagccacttataccttattcccccgatggaaactctttgcctcttcagagagcccataaccagctgagggcccaggcctgactggtaacccctcagggagggagcatgtccataaatcagcaatatagcagagatggggcttcttatccttggcagccattttccctgcctccccttcctcccctaggacatcccctctctgccctggtatgcatcttggacactggatgtctcaactcagtttagaacttactaaaacaaggtttaataacctcatattaaaattttcaagactggctgggcacggtggctcacacctgtaatcccagcactttaggaggctgaggcaggcagatcacgaggtcaagagatcgaccccatcctggccaacatgcggaaaccctgcctctactaaaaatacaaaaattagctaggtgtggtggcacgcctctagtcccagctactcaggaggctgaggcaggacaatcacttgaacctgggaggcagaagttgcggtgagctgagatcacgccactgcactgcagcctggtgacagagcctggctccatctaaaaaaaaaaaaaaatttacaagactaccgagaatccgcacctcctaagaaatggagatcaagtctgtgcgagtcatcattcctcttgggtctcttgatttatctatcaattagcaacactatttgaccttctacctatgtgtgatcatggatattaatcagcccttctttttactgatataattcctactttttcagaaatctgacaaactcacaattgctgatatctaccctttcctccttacgaagatagaaatgcccatctataatttatagacaggtatgattccacaatttaaaaaataaagcaaaaaaaaaaaaaatccgctcaactcaaggcttatacatcactgattccctcaatgcccttacttggaaagcagtaattcttttgagctaataaaatgcatgttatgaaccagaacaataccttaaagatataacaaaagtaattatgataataatgaaaaaagtgagaatttcaaaatctttgtgtagttcttgaaagtatagtgcagtataatgtgagaactgaaggctgtttaccaaaaattcatatatctctccttctaaatatttattatttttgaacagacccgcttgtgtggccaggtgactttagccagtggcatatgtgccaattctgttaagtattttaagaaatggttttaccttctttctctttctctcccttccaccgtctggatgtagatagcactacggacctagggaaaggcagaaacacaagatgggagacatatgaaatatcccaggaagaaaactcttttgcagaagcactgataccagactcttacgtaaatgaaaaaaaacttccatttagtttaagccattattacattttggagtctataatgctaaagcagctagtatcaccctggttaattaatgaagtaaattaaatggttaaaagcatataacctacctgggacatcttgtagggcagtaagatggaagttaaaggacaacaggattgaaacttaaagtgttcaaagatgaaatcataagcagtatggaacctcggaggtaagttggggtataaaagaaacaaaactggccatgagctgattatttttaaaacagaatatgggtatatgagaattgatcacatattctctctagttctgtatatatttgacattttacacaataaaaatttaaacaggcagggtgcagtggctcacacctgtgatcccagcattttgggaagctgaggtgggcggatcactcgaggtcagccgttcgagaccagcctggccaacatggtgaaaccctgtctctactaaaaatacaaaaaattagctaggtgtggtcgtgggtacctgtaatgccagctacttgggaggctgaggcaggagaattgcttgaactcaggaggcagaggttgcagtgagccaagatggtgccactgcactccagcctgggtgacaaagtgagcatctgactcaaaaaaaaaaaaaattaaacacttttttttaaaaagtaaggatacctggagttcccactggcctaggaagggaatatctgagcatcaaaaaggttaagaacagaaacaaattaaaacatacaaaattttttttagaacaacagggagaggttccaagatggccgaataggaacaactcctgtctacagctcccagcttgagtgacgcagaagacaggtgatttctgcatttccaactgaggtaccgggttcatctcactggggcttgttggacagtgggtgcaccccatggagtgtgagccaaagcagggcaggcattgcctcacccaggcagtgcaaggggtcagggaattccgtttcctagccaagggaagctgtgacaaatggtacctggaaaatcataacaaccccaccctaatacagcacttttccaactgtcttagcaaatggcacaccaggagattatatcccgcgcctagctcggagggtcccacgcctagctcggagggtcccacgcccacggagccttgctctctgttagcacagcagtctgagatcgaactgcaaagcagcagtgaggctgggggaggggcatccatcattgctgaggcttgagtaggaaaacaaagaggcccagaaactcaaactgggtggagcccaccgcagctcaaggaggcctgcctgcctgcctctgtagtctccacctctgggggcagggcacagctgaacaaaaggcagcagaaacttctgcagacttaaacgtccctgtctgacagctttgaagagagcagtggttctcccaccatggagtttgacatctgagaatggacagactgcctcttcaagtgggtccctgagacccaagtagcctaactgggagatacctcccagtaggggccgactgacacctcacacagccaagtacccctctgagacaaagctttcagaggaaggatcaggcagcaacatttgccattctgcaatatttgctgttctgcagcctccacaggtgatacccaggcaaacagggtctggagtggacctccagcaaactccaaaagacctgcagctgaggatcctaactgttggaaggaaaactaacaaacagaaaggacatccacaccaaaaccccatctggacgtcaccatcatcaaagaccaaaggtacataaaaccacaaagatggggagaaaccagagtagaaaagctgaaaattctaaaaatcagagcgcctcttctcctcgaaaggaacgcagctgctcgccagcaagggaacaaagctggatggagaatgaatttgacgagttgagagaaggcttcagacgattgttagtaacaaacttctccaagctaaaggaggatgttcgaacccatcacaaagaagctaaaaaccttgaaaaaagattacatgaatggctaactagaataaccagtgtagagaagtccttaaatgacctggtggagctgaaaaccatggctcaagaactacatgacacatgcacaagtttcggtagccaattcgatcaagtggaagaaagggtatcactgattgaagaccaaatgaatgaaatgaagtgagaagagaagtttagagaaaaaagagtaaaaagagatgaacaaagcctccaagtaatacgggactatgtgaaaagaccaaatctacatctgattggtgtacctgaaagtgatgaggagaatggaaccaagttggaaaacactctgcaggatattatccaggagaacttccccaatctagcaatgcaggccaaaattcaaattcaggaaatacagagacgccacaaagatactcctcgagaagagcaaatccaagacacataattgtcagattcaccaaagttgaaatgaaggaaaaaatattaagggcagccagagagaaaggtccggttacccacaaagggaagcacatcagactaacagcggatctctcagcagaaactctagaagccagaagagagtggaggccaatatccagcattcttaaagaaaagaattttcaacccagaatttcataactagccaaactaatcttcacaagtgaaggagaaataaaatcctttacagacaagccaatactgagagatttagccaccaccaggcctgccttacaagagctcctgaaggaagcactaaacatggaaaggaacaaccagtaccagccactgcaaaaacatgccacactataaagaccatcaatactaggaagaaactgcatcaactaagaagccaaataaccagctaacatcaaaatgacaggattaaatacacacataacaatattaaccttaaatgtaaatgggctaaatgctccaattaaaagacacagactggcaaattgggtaaagagtcaagactcatcagtgtgctctattcaggagacccatctaacatgcagagacacacacaggctcaaaataaagggatggaggaagatctaccaagcaaaaggaaaacaaacaaacaaaaaaggcagggcttgcaatcctagtctctgataaaacagactttaaaccaacaaagatcaaagagacaaagaaggccgttacataatggtaaagggatcaattcaacaagaagagctaactatcctaaatatatatgcacccaatataggagcacccagattcataaagcaagaccttagagacttaaaaagagacttagactcccacacaataataatgggaggctttaataccccactgtcaacattagacagatcaacaaggcagaaagttaacaaggatatccaggaatagaactcagctctgaaccaagtggacctaatagacatctacagaactctccaccccaaatcaacaaaatatactttcttctcagcaccacatcgtacttattccaaaactgaccacatagttggaagtaaagcactcctcagcaaatgtaaaagaacagaaattataacaaactgtctctcagaccacagtgcaagcaaactagaaatcataatcaagaaactcactcaaaaccactcaactacatggaaactgaacaacctgctcctaaatgactactgggcacataacgaaatgaaggcagaaataaagatgttctttgaaaccaacgagaacaaagacgcaacatactagaatctctgggacacattcaaagtagtgtgtagagggaaatttatagcactaaatgcccacaagagaaaacaggaaaaacctaaagttgacaccctaacattacaattaaaagaactagagaagcaagggcaaagaaattcaaaagccaacagaaggcaagaaatgactaagatcagagcagaactgaaggagatagagacgcaaaaaacccttcaaaaaatcaatgaatccaggagatggtttttagaaaagatcaacaaaattgatagactgctagcaagactggtaaagaagaaaagagagaagaatcaaatagacacaataaaaaatgataaaagggatatcaccaccgatcccacagaaatacaaactaccatcagagagtactataaacacctctatgcaaataaactagaaactctagaagaaatggataaattcctagacacatacaccctcccaagactaaaccaaaaagaagttgaatctctgaatagaccaataacaggctctgaaattgaggcaataattcatagcctagcaaccaaaaaaagtccaggacccagatggattcacagccgaattctaccagaggtacaaagaggacctggtaccgttgcttctgaaactattccaatcaatagagaaagagggaatcatccctaactcattttatgaggccagcatcatcctgatagcaaagcctggcagagacacaacacaaaaaagagacttttagaccaatacccctgatgaacttcgatgcaaaaatccttcataaaatactggcaaactgaatccagcagcacatcaaaaagcttatccaccacgatcaagttggcttcatccctgggatgcaaggatggttcaacatatgcaaatcaaaaaacgtaatccatcatataaacagaaccaaagacaaaaaccacatgattatctgactagacgcagaaaaagccttcgaaaaaatttgacaggccttcatgctaaaaactctcaataaactaggtattgatgggatgtatctcaaaataataagagctatttatgacaaacccacagccaatatcataccgaatgggcaaaagctagaagcattccctttgaaacctggcacaagacagggatgccctctttcaccaatcctgttggaagttctggccagggcaatcagacaatagaaagaaataaagggtattcaattaggaaaagagtaagtccaattgttgctgttggcagatgacatgattgtatatttagaaaaccccatcgtctcagcccaaaatctccttaagctgataggcaacttcagcaaagtctcaggatacaaaatcaatgtgcaaaaatcacaagcattcctatacagcaataacagacaaacagagagccaaatcatgagtgaactcccattctcaattgcttcaaagagaataaaatgcctaggaatgcaacttacaaaagatgtgaagaacctcttcaaggagaactacaaaccactgctcaacgaaataaaagaggacacaaccaaatggaagaacattctatgctcatggataggaagaatcaatatcatgaaaatggttatactgcccaaggtaatttatagattcaatgccatccccatcaagctaccaatgactttcttcataggattggaaaaaactactttaaagttcatatggaaccaaaaaagagcccacattgctaagtcaatcctaagccaaaagaacaaagctggagccatcacgctacctgacttcaaactataccacaaggctacccaaacagcatgatactggtaccaaaacagagatatagaccaatggaacagaacagagccctcagaaataataccacacatctacaaccatctgatctttgacaaacatgaaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactcaagagcttctgcacagcaaaagaaaccaccatcagagtgaacaggcaacctacagaatgggagaaaatttttgcaatctacccatctgacaaagggcaaatatccagaaatcttccaagaacttaaacaaatttacaagaaaaaaatcaaacaaccccatcaaaaagtgggtgaaggatatgaacagacagttctcaaaagaagacatttatgcagccaacagacacatgaaaaaatgctcatcatcactggccatcagagaaatgcaaatcaaaaccacaatgagataccatctcacatcagttagaatgacaatcattaaaaagtcaggaaacaacaggtgctggagaggatgtggagaaataggaacacttttacactgctggtgggactgtaaactagtgcaaccattgtggaagacagtgtggcaattcctcaaggatctagaactagaaataccatttgacccagccatcctattactgggtatatacccaaaggattataaatcatgctgctacaaagacacatgcatacgtatgtttattgcggcacgattcacaatagcaaagacctggaagcaacccaaatgtccaacaatagactggattaagaaaatgtggcacatatacaccatggaatactatgcagccataaaaaatgatgagttcatgtcctttgtagggacatggatgaagctggaaacaatcattttcagcaaactatcacaaggacagaaaaccaaaaaccgcatgttctcactcataggtaggaattgaacaatgtgatcacttggacacaaggcaggggacatcacacaccagggcctgttgtggggttgggggagtggggagggataccattaggagatatacctaatgctaaatgatgagttaatgggtgcagcacatcaacatggtacatgtatacatatgtaacaaacctgcacattgggcacatgtaccgtagaacttaaagcataattaaaatatatgtatatatatttttaaaatccataacttcataatgacacatgcatgaaaactcattagacgttaatgaatgaatgcctaataacttctagttggtaaccaatgttaccaaatagaagttattaggcattcattcattaattaaaaattaaaatatgataaacaattaatttcctgcctatgtgaactgtatatcagagtaaccaaatggttgataagaaaaagtttttttatagatctccatgaataaatgcaggagaaatgacacaactagaaaactgctattttgcatcccctaatgatataagacctatatccagatataggaaactactatgagtggacataaaaccatcagtgtaagcatgatagggaacttggtaacagaacagtctgacaatacctgaatgaactaactcatgttatcttcactaaaaggacatatatcattatttccttcatgctgtgatgaaataggacatacatagcaccatctatgaagtattcttgcctaaaaaatctctataaaatctagccaagactccagactaaataccaggttatagtggtgattgggttcaggacatgctttcctaaaatatgacaccttggtatttaagaaaacagcagaagcgggaaggtcactctcaccttctgccgttctctcctgaagcaggtcatgaaccaatggaaggatttttttgagcgtcccctggagcaggtcataagaccattttagaggtgccctccttatacatggaggaaaggaacatccttacctctgaagacacagggacacagagaagaagctgaacaaacaggccttgctaagttccctcccccagtttattaccattagatcacactcccaatcatatgtccaatcatacttcacctcttcccactcttcatcaaacctagcataaaaagtacacggtttaaccatttctttgggccttcatttccttatgaaggctcccatgtcacatgaaacttatattaaataaatcggtttgcttttctcttgtaaatctatcttttgttatagcggcttccatcataaaactaggatgggaataaaaggtatttcttttcccatacagagaaataaattaaacactgccacaaaaaagcgaacagccatcttcaaaatatagagcaaatgatccagtttctctcacaaatcaaagttattgagaggaaggggataagaggactaattaaaaaaaaggagacaagcaacataacaattcaatgcaatgtgtgaatctcttttagattctgacttgaacaaaaccatcaacaaaagaacaattagggaaatgcaaatatggactggatattagaaaatattaaggaattattattaatttcattaaatgtgatgatggcatggaatttaaataaaggaggtaaggcccttatcagttagagatatctactgaagaattttcaggtgacaagatatgatatccagcatatgctttaatgcgctcaagcaaaagaaaagaaagaacgaaaaaataaaatggggacagaggaagtaagattggcaagatattgataattattaaagctggatgatgcacgcatgggtgttcattatgctattagttctacatttgtgtatatttgaaattttccaagatacagttttttaaggcacaagataggagtcagacattggttggaccagccctttcacttccagctgggagaaactgggcagatcactacagcctgcacattgccctcctttgtgtcatcaagtgcacagatatttcttctaagaatgctccaatactattccttggattttcttccgagccatagacacctattttgtgagttttgatgcttccctttcaatactcatacacgtgcagacaaacaacagttgtcccaactgctacctatctgaagtgattataagtgactatcaattatgacatatatcccaatttcaaagattaaaatgtgaaaaaaatgtgcgttaaaaaaatctatgaagaaagagacctggagatgaagttataataaaaatgtctatgacaatgagattttctgaatacctacaaggcatctcctgctttggctccataagtaccactatctctgtttgtttgtttgtttgtttgtttgtttgtttgtttttgagacagggtctcaatccctcgtccagactggagtgcagtggcaggcactccccaggctcagatgatccttccacctcagcctcccaaatagctgggactacaggcatgcgccaccacacctggctaatttttgtatttttggtacagacgaggcttcaccatgttgcccaggctgatctcgaactctagcctcaagccatctgctcacctcagcctcccaaagttctgggattacaggcctgagacaccacccctggcttcttgggttattttgactgacatatctcactggctaaaatacttccatttttctagaagctacggcaactaccactgggttggcaaatgacaggccctggaaatgtttctgatagatgtttgttgcatgaataataaatatgcaaattttaagccaaaaaagaaatataacacatgcaaagagatgtggggagtctcgtgcccttctgtataaagttctggaagctaattttggaaactctatcaagaagttgtgtgtgactatttttccaaagtagagtcaaaattcatgaggcagggcaaaagttacactgcatctaatgatgagtaagaatgcacatctgttccctggagctgctctctatacacatattctagtaatttccacacaccatcagaagatagaagatggagaaaaccagtaaagatataatctttgagaaaagacttttgttggagcctaaacataaacttttccttcaagtccatgtcctgagagaggtttgtaaatgtgtgacctaaatgaggctaccactgaattttgtttcccaatatccctcagagaggctataaggcatatacaaattctacttaaaagcaaatcatggtaaacatttattaaattttattacgcaccaagtaccacactcgtgttcttcccaggactgccaaagttggctgaaccctgatgcagtaactctgcagatgtacctataacatctcaactaatcctagcagcaaccctgcaaagaacagtaccaccttacttatattttcaggatagagagtatgacctttagaaagacttgctaactggcccaagttcgacagccggtaaatagcatatccaggactcacacccacggctatgaaaaatcggtgcttgcggcttgtgtttttcacctaaatacacaagtgttacatgaatgaactgtgatggaggatcagcattgttcctgccaaccacacccacctgcagtctagcgcagatcaatacttttacaaagtgcaatgaaaatgaatcactggggaataaaggcattcaaagtaaaagtcaaaagttgttattggagtcaacagacaaatttatgctgttattgcccacgagtttctaaatccttactctcaatttatatgcttattttgttgcatactggcaccaggacaaggaccaccctttgagtagtgctgcactacactttattgttagatccatgcttagaatgaacacatttataataaggttccaagatccctccacctattgagaggctggtaattcttttagatgttaattaatctatttttttttaaatgaagatgacttttagcattttcttctttcctataaagattcatcaagatatcagacataggttccaaagtcaacaaaaataaagaacttgtgaaattttctgctgctgtatgatacaactgctgtggtattttgataaatattaacagaaaatgtgaaactttgaaatatgtttccttaccaagggaacaatgaataataatgaaaccagggaatgaggactagaagcaccaggtgcccccgcctcccatccactgcagggaaggactctcttccaaatccaccctgaaaagtgagtggctgttgggaaactaaaaaatgtacttaagagatctcaaatatatggtgacacatggaattcttcaacctgccatgcctcttgagaagttctcaggtaaataacaagaatgatgcccacaatacattcacatacataaaaaaaatgtcctggaaagaaaaagaggatgggagaagaagttaatgattcttggggctttttaaaaaaattgtgttcggctgggtgtggtggctcacacctgtaatcccaacactttgggaggccgaggcaggtggatcacctgaggtcaggaatttgagaccagcctgaccaccatggagaaaccccatctctaccaaaaatacaaaattagccgggtgtggtggcgcatggctgtaatcccagctactcaagaggctgaggcaggagaatcacttgaacccaggaggcagaggttgcagtgagcctagatcgtgccattgcattccagcaacctgggcaacaagagcaaaactccgtctcaagaaaaaaaaaattgtgtttaaagtttcaagttaattttttttaagtcaccatagctcatatggccttggtatgagttgatgggtcaaacccatagcttctctggctactcaggaaattagtaaaggagggcaaggaaaggcacaatatggaagagagaaattactagacaagaatcagcaatctggagcgaacccaatctaaaggaaacaattagaaactggcacaggtcccaaatcaataagcagaggtgactgtgggcagtgagcataatggctgggtaatgaaaactaaaatgcaggtaagcaagcgctgggaaaggagcagctgatgacagggtcatctgtccagaggcttgaagagacctgtctgaacaggctctcacagcccagctagtccctgatgtcacagcctgtgtgaataaacagcactggtgtggtatccccaaacttcataagaaatgaagtcttcatggctcaccttgtcaaggccagagaacaatcccaacaggaaaaacacttcttacagattatgcagtggattcaaagagcactggaactgtatttcccattagctctaatggaggttgtgctaataaattccccagctctgggctgaacaggtgtaattcagtaatgtagctataattgagtgatgtcaactcaatataatttgtaatgtttttgtaacaaattatctctttttttttccagaaaaaaaggcatctgtgattccatatgataaattactttaaaagggtgacatacagtgctaatgataaagatctttaattgatagaaatgttaatagtagcatcagctaagaattatctttgctgattctttatacacagtaacattttaaacataacaagctttcgtttttgaccaaccaatgtttttgatttgtgactcatggttttcagatatttctgtatttcatcaatataactattctactagagaggttctgtataaaccctgcaatttagccattcccttccctgcacagttcccaagccagatctagacatttctacctctgtgcctaagagaacactggtctcctggtctggatggacagctgtctcctcctcttccatgtacctaagaatgacctgttggcccagtcaaaaccctccttctatgaagctttccagacctatagccaggattactctttcacaccctatacccctgggacactttggggtccctctattacattcttacttttcagacccccttgtacatgctattcctctgctgctctccctggttagggcccactcatccttggggtttcagttcaacgttatacctcaaggagaaccttccctgctttggaacagggcacattacacgtgcatttgcatacctctgcattcctttcctttgttgcactaaccacagttgttgttagtatcttttgtttgtttgtttgtttgtttttcaggaaaaaaaggcatctgtgatgcgtctcttttccactagggctaggctttagacaaggtctgtgttgagttttcctaaatctagtagcaaggacatgatgctccatatctgaagaaagaatgcatggatgaatgaatgaacaaacactatctctgtctgtctctccctacctctatctgtcctctccactaaacttgaactcaaaggtaatacagtgctcattgtagccacaataatgcctaattagggtctcgtccataatagagatgagaaaaactcagttgaaataaatttaatttctcctactgtagtgttaacatcaggttagtcatagagaattcagttcccaaagcttatagtgtttttcaccatatgctatccactgaccctcatcaagctccaaccacgtgctagcccctctgcaagatactgtggaagagaagtgaatgatatttagaaccaagtactctacagtttctgggtgattcccatgtataaccacatttctgcattcatgccagatactgggggaattcaaggttaatcaaacacagatggtgtcctcaaggagctcaggatctgggagaagagataaaagtgaagaaaaaatatcatgaggtggaatccatgagtgacataaaaggagtcccaatacagattctaggtgttctaatgagggacagagagaatgtaggcttaagtgggggtattttttttaagttttatttttaatttttgtggatacatagtgtatatatttatgggttgcatgagatattttgatataggcatgcaatgtgtaataatcacatcagggtacggtctccatcatctcaagcatttatcctttgtgttacaaataattaaactcttttagttattatcctaaaatgcacagataaattgtttttcactctagtcaccctgttgtgttagaaaatactaagtcttatttattctttcttactattttttgtatccattaatctttcagtggggacagtttttaaaatgagtctttacctgttgggtgggatggctcacgcctgtaatcccagctctcagggaggcagaggcgggaggatagcttgagcccaggagtttcagacctgcctgggcaatatagcaagacaccatgctccacaaaaagggaaaaaaatgagtctttacccaggtgaagattgggattagggacccagccaaaaggaagcgaggttgaagagcaagagtgtttattccttggttcaatagatctttgtcacctactgtgtgaggcataaataaacctaagtccattctcaatgcagcttacattctaattgtggagacaggtgaaagcaaacaaacaacaatgccaggttataatgagtgctctgaaaaaacagggcagagtaagaagcgaagctgatgagagtgctaccccagacaaggtggtcaggggaggccttcccatgtcaatgacactgaacaatgacttgaatgaagcgaaagagtgagccatgtaacacgccttgggaagtgcattcccaacagagaacagcaatcctctccacagaggaaggacagatgacccacacctttttcaaactggggtctctgagcatgttcttagggatctgaatgttcttgatgagactttttatttttggttttatttagataatactcacttaaaatagttcaagtgtattctgcatcagctacatagcacctaaaatacgggtaccagcacaaaagttttgtgactcctttatgtttgcatttataattgtggtggtatcaggtattgctgttttagctgtcacaagcaaaagataaaaaaaacaaacttactacttaaataatgtgtttgtgcctcatgatctcagagtaggggtggagtacatatgaattgtcccagtaatagcagctggaagtgttagggaaattgagtcatcacacagcctaggctaacacaaacatgacaagctgtgtagaacctttgacataacagacatcccgtattgatgtttccagagatgattctgtttaaacaaataatatcattcatcttgttaatgcaatattcctcatttgaatttagttttgtcattttgattgcatgtaatttgtaaacgtgttatggtttcatatttgtctaagaaccacacaaagaaattcatacctacttttgtattttcatgtggttcaataatccaataacaaaaacattaagttaacattgggggttcataagacttttttttcccttggaatggcatccatatgttactcaaggttggtcacagtgaaagctggtggtggaaaaggcctttgttttccagaaccatgaccaggtgatagctctggatggtttccaatgaaacacacagtaagtacaggaaagaagggagatgaatatctttggtaggaaaaaaaaaatcacaaatcagatatacctaatgactgtaacttttattattctctgaacaccaaggaacgtaaaggccataaattatgttacatgttggttaattctccttcagaacacccaggccattggaacattaaatgtggaaagtatgtggcgggggagagagggtgaagaagctataatgaaaggttcactgcactcgggtggcagattaaacacagagccagatgaggagtcaagcgtcactaaaaatgcaaaacaaatccagctaaattatttcacctgcaaggaaaagtttttctcacaacacaacactgttctatgccaacaaatgtaaacaagagctaagacgactatctgaaaagctcaggcagttggtgaggaaggctccttgggtcacagaaccctccaaaacttctcactgtagcagctgagagctggcatctgaaatcaaactgggtagagttcaagaatcacctctaacagagattagctctgagacctagcaagttctttaatatcacagaaaaaaaaaagacaaaacaacacctacattacaaagttgttgaaaggattcactgagataatcctcatagaccacttagaacactgcctggcacgtaataagttctccataaacgtgagccatgagttttatgatgctataggtctatgattatataagcatgagtctccacatatggcacaacaaactgctctactcaactctacagccctggatgatgtctccacattttacatattccatgatagtttccaataatttatatacatgtaaagtatatttgagatggtcggtaagataacatcattctcattcattcccctccccaatatagttcctaaggaggaaagatatgaatagtgctatggtttggatttgtgtccacgcctaaatctcatgtcaaattgtaatcttcagtgttggaggaggggcctggtgggatgtgactgaatcatggaggcagacttcctccttgctgttctcgcaataatgagtgagatctggttgtttaaaagtgtgcagcacttccccctttagtctctttctcctgctcccaccatgtaagaggtgcctccttcctcttcaccttctacctgaggcctctccagccatgcttcctctacagcctgtggaatgtgagtcaattaaacctcttttctttataaatttctcagtttcaggtagttctttatagcaatgcaagaacggactaatgcagatgggtctacagaaagagcataacccaacaaccttacatggtaggtaccattattgtccctattttacaaataaacaatgtccagagaagaggatggacttgctcaaggtcatacagctcataaatgatgcagccaggatttgaggtcaagtagtcccagtctagaatctaccttcttaatcaccacaagactctactcctccaaacaagtgtccttcctctgtgtccagtaaagaggaactctgggaactgctggtcacataattgtttattcctccaggttccccaatgtctggccctagaaaatgaggatgtttcactcccaactaagcatttccctaagctactatttgttatgctgttagctaagatagaaagtcaattttaaaatcgtccatttgaacagttatagtaactttcgtaaatggtaaatgaaacaatttgaaaacactgtccaacattttacacagtatcccatcgaccacagctaactaaagtaattcacatgtgaattttattctcaaaaaaagtgtatgctttgcttttgacagataatgaaagccatttaattcaatgtggctttttttctttgctttttcctttttttttttttttttttttttgccagaaagcagtgagataaattgaatacccataaactgaagaaaatctgttaatttggggtgtctggttacacctattcttgtgcttttttaaaagagagtctgccaaagtttattctcttcttaaattacctcatctgagcagtattttcatttgtaaataatggccacatattctctttaaagtaggaggaaatggagaccttaagtgtttcaaggaaacttcaggtccctcaaacctccttcaaagaaaacaactgatgattgtctttgaggcaaggagacactagtcatcaggccatcaagggcagggaacaacctgaacactttgcagctctgcactacaggtcctcaacgtcgttcttgcattagcccattcttgcattgctataaagttcattcaatgccatctggttataacaccgacagaaaataaattgattcccagtggggcccctgtctatgtagggtctgaacattctccccatgcttgcatgagttttctctgggcagtcaagttttctcccacatcccaaagatgagcatggtaggtgaaccggcatgtctacatggtccccatcttagtgagtatgagtgtgtgtgtgtaggtgtgtaggtgagtgggtcctgcaatgggatgatgtcctgtccagggtgagttcccaccttgcaccctgagctgctgggacatgctgcagccatccgagaccctcaactggaatataaataattatcttacctgtttttattactctttcttaaatgtgtatatagttcgcatagatttcaatgtaaaatattcaaagtgttttggtctatttagaagtttgatggtatagttgtgaccagaaatatgccataggaacttaactcttatttatatcaattagtctatggtgaaattggttatatgttgctttgctttatgtcccagtttccaggaacctatcaatgacattaagtaaggacttactgtactttactatagctgaacaggctgccacccaaaaccataatgagctactatgacgacagtcaatcaggagacatatctgtgtttcagagaagaaagccagcagctttctgggaaaaagcacagagggaaactcccctaagctggagctatttcctagcagtaacttgctgctgcagtttagccctgtcatctgtgtgtactcctcattaagtaccacattatgggccatcatatcttctccagctgcaagtaaaggcaatgtcctggaattgccctatggcccaaatgtgtgactaatgactgagactttggcttcttgcttgatgtttggccttcagtattacatgaacctgctctgaaagacacaacactgtcacagatgtatgcggacagattaagctccagatggaaggctgtcaatgtcaatcagtcactgttcttacagcctggctggcttttcatctaagcaaccacagagcatgatcctgcagcactcagttccttagctcaattaagtcttaggattggaggtcaagttaccctggtttcctaagcattctctaccaaatgattgtttttgcctcactcctactgattcatttatagtagcttcttttgatgcattcatccttgagcatgtcttcccatttccaagtgacttgtttcactattctgcagaatgttccagccctttgatgaactatatataattgtcgaatcagctgtcccacaaagagataaaatctgaattaaatacaggacttgttgtcaggagagaacagataaggtgaagaattagaagactagctgggaagaagtgagatgattgaagtttatgaaacattttcccccctcctttgagtctcccaatctgctagtttcagtcggttggttttgtgttcctgttgtgatatatgtttagttcaaggctgtggactttgtgccttggttacaggtaagtgcctctgtgtttctcatctttatctatccagtcacttgtctcctctcaaagtttcactttttaaatatatatatgttatttaatatcaaaagaatatcttcacctttcataaattgctaaccctagactctggatgcctagggtaaatttttaattctattttatttattttaattaaatttaaattaaaatttgttttaattaaatttaaattaaatatctaattctacttttatttatttatttaattctatttttaagtctatggacttgcttgaacacacagctcagcaatgatgcaggcaggattcaagtccaggcaaatcatggctctagagcttgtgttcttaacttccacatgacattgtccctcgggaggaatattgtaactccctacgtttccattccaaactctcaaatataaaatgataattacaaggtacacgttattgcaaaacatgtataaaagcatataaatcaaagattacattttgcctcctcttctttttcccatccctctaccctcatatccacacaatttcattccctgagggagcctatattaataatttggcatgtacatttttgcatacagacatatatttttctaagtttctataatacatactgttctgtcacatgtttgacatcttttcatgtcaattcatagagatgcttgttaatggctgcagagtaatttcaatgtatagacatataatactatatataatactatattgaacctctttagctacttggtcaaatatatctacagaatacgttactagacatttcaaggaatttctatgtcaaaatatttcaaatagttaatagttccaaacttcccaatccaagtataatatttttatttatatccacaacagggtatccccctgattttgcccatagtgcttattatcctaaccaactgattgatatttttagtttaattatttaaaaaatgaggttataatgaggtccctaagagtcccttaacctaatttactaggatctactttatctggagagtaaaataaagcaactacccaatctcaaaatatccttttgcccctcccaaatgactcttctggaatcatttatatgctgacctccatataatttattggatttatacgatcttatatctctagattgagttacaaatggatgaatctcttgaaacctagaccaaaaaataagaatagaataaaaaaagagtttttggtatggaaactgtgactctccaacgtcagtagagacattgagaatggtttcccatgtccccaggcataaactaaaatatccactgcttttggacagtataaatgcagaatatgcccccagatgaatagaaatgagcaaatcttgagtgcagaactgaatttcttggagctgtattggttacctggagccatgaattaagtggatctgattctatctcttaaaggaacagaaaaaaaattattccaggtgattactgctcctcaagcatgtggtcactcaaaggaccttcttctagctccacgggatacatagttgctattcatcagctctgctcactgaagatgctgtgctacgcattccaaatggcgccttggaggactaactgatatcattaacacagactcgtagagatgtcatcattttcttcttcatcatcttcgtcaagattagttttaagtgttgggagtccgaggtgggtggatcacgaggtcaggagatcgagaccatcctggctaatatggtgaaacctggtctctactaaaaatacaaaaaattagccgggtgtggtgggtgcctgtagtcccagctactcgggaggctgaggcaggagaatggtgtaaacccgggaggcagagcttgcaatgagctgagaccgcgccactgcactccagcctgagcgacagagcgagactctgtctcaaaaaaaaaaaagattagttttaagtgaaccatgtactagttctcaaatcaaccacatcgggtaggttccattattatttaattctgcagatgtgaatacaaggccacaagttcgtaagtgatactgccggggctcaaaccacttatgtattatgtcaaaagccatgctcttaaccattgcactatactcccttctacaggcataaaattttaaaaatatataccagaagagcaaaacaatcccaagtatgggaaggatgaaagagaagggtggcagttggcacagtggagcataatgggccagtctgactgtaagactcctgtttcataatgtctgcatgtcactaaaaaggatctagaccaaggttcacaaacacaaatgaatatgggggccaggacgttaacatacatgagtaaagaggaccaagtgcatgacagaaagagtggtgaagaacgtggtaaactgaaacacatgcctcaagggaagaaggcaatactctcatgtgtgtatgtggttcaaatgttgccaaatctatgaatttttttaacagaagaaaaaaaatccaattttaatgcaaaatgtttctatttccaaattatgatttcaatgtcatgtttaaaaacactttgacgatgacttagttccctctgacctccacacataagcattaacatggacagaagtatagcagcagtgtgaggtgcttttccagcagccatcagtccttcatccttgctaacataccttgatctttctcaggtacctgcaggtggtagtgtgtccagggaagataggccttactctcagcataagaggctgaaacgtactggtctcagccagtgaaggtaactgaatacttcattgacattgactggtctgggatgggatgcatgtgtgactcagttctagccaaagagaaatcgaaagatatctgctaagagactttaaggaaagattttctttcctgaaatggaaagagagagagaggcccaccacgagatggccctttttgctcccttccctcctatcctgtgttgaatgctaatccaggacactgtggtgttgaaagctctggcagccattttgtggcatgaggtaacaagtctaaggattaaggccaatacaccgccaatggtggaatgaaagcatgaaaggagcttggatccttgtttagcagccaaatcaacactgagactacttaatttgaggtttcttatataggaaacagtaaatctccttgtgatttatggtactattagttgggtgttctgttacttcatactgaatacattctaatgaaggatctcactttcaaccttacttcagagttctagctttttgtttacagcatccttcatgcaggaaaacttcaagtttacacagagtgtgcaactagatgtgagataaggctctgccacttgagaacgcccacacgctgcttcaaaaatttaaattatgctgttagcttttcaagatggatgaaatccttcataggatcatatagcaaggactaaattgctctcacagttgccaggcaactgtgtatatgctgcctagagacaaaaattcatgacccttgactccccaaaggagagtctttacccacaactgatatgcatgtgcccaagtctaacacttccatccagcaaaggtcatggtgtacatctgggctatccaacatcccaagctcattatactgccaacttatatcattcttgatcacaccataaattatgatttctgcatgcaaatccaaatgacagagcagagagtgtcctggggcataattccctgtcctttggcctgtcttattatatagactgattgggtaccatccaggcaaacaaaaaaaagacacatgaagattcctattagcctgaagaatcactgtcaggtaaacagagttttgtaaacagcttccaatattcaaggaaagtttgagttttcacagtgagtaatgtgatcaactttaataatgtctcaaggggcttctatctcacgagtcattttcaacacacacacacacacacacacacacatacacacacaggctaagatgtgctcatcattctattagaaaggaaatctcaaaatgcaaatatagatggtgtgttcacatttacatttcataatgatctaagtgttttgtttttgcatgtgaatttcataatactttaaatcatagaatcatggaatataaaaatcaaaagtgaccctgagatcaagaaggtccaatccaagagaaattaaatggcacagctgcttaggggtgaacactgaatccaagttgctggactctcagtctactgcgcttccccaaaactaacatgcttgtccctcaggcagtcaacccttaatcattgtgatgataaacatcagggacaacttaatttcaacttgacaataaatcaaactctccatgtagccattagttgctgtactagtcagaaaaaggttaagttgaatgtgaaccactctttcactacctcccacctcaaaaaaaaaaaaaaatgaacggaagcttgaatatacaagcttttattctctcatttaacaagtttggagatcagtagtctagtgctgacatggcagttctacagacccattacagacctagatgccttcaacttactgtatctccattcctagagggtgactgtcttagtctgctttgtgccgctataacaggacctgagactaggtaatttataaacaacagagatttattagcttacaattctggagtctgggaagcccaagatcaagggcccacatcttgtgaaagacttcttgctgtgttacacatgtaataaggcaccacatgatgagaaacagcacgcaaaggagcaagaagtgactaaactcacttggataacaaacccactcttgcaatagtgaacccattaacataataatgacattaatttattcacgggggtagatcccccatgccctaatcacctcttaaacaacccacttctcaacactgttgcattgaggaattaagtttccaaaacataaactctgggggacacattcaaaacacagcattcatcttcttaacatagccaaaaaggccgggcatggtggctcacacctataacctcagcactttgggaggccaaggtgggtggatcatctgaggtcaggagtttgaaaccagtctgaccaacatagtgaaaccccatctctactaaaaatacaaaaaattagccttgcgtagtgacatacacctgtagtcccagctactcaggaagctgaggcaggagaattgcttgaacctaggaggcaaaggttgcagtgagcagagattgtgccatttgactccagcctgggcaagaagagcaaagctctgtctcaaaaaaacaaaaacaaacaaacaagaaaacagcaaaaagtattaatgagccgttatgtctgcaccccagttggcagcaaggaggaagctgtaatgcatcttctctttaagaattctcctagttagtgtacccctgaaagcaaagcctaagacaaggaccaagggcataggtttgggtagattatttggatggtgatctcagaaaatttgaaagaaagagatgagacagtaaacactggaaggaaaaaggaaacagcatgtgttatcaacacctggggtgctatgtgaggagctgtgtggaatgtacccacaactgtccatctgatagaaggctgtggcaacccaccaattggttaagcattgcctgtagtgctgttacttccccggctatgcttgtgcgtgggctgggaagccttcttttggttttgagtaaggcctaaaccagaatagtagatgtacagcacagcagaacttgaggaccctggcagcacatgacagcatctgccacagctgcaatgaaattaggtggggatagggaatgtggcactgtgcacctgctacaagaaaatgtccagaaagttgctcataaagtttcttattatctctatgcatcaggagtccccaagacaatccttagactcaatgattcactaaaagactcccagaacccagaaaaactatgtactcatggtgatggtttgttacagagaaaggacacagattaaaatcagcaaagtaaaaaggtatataggaaagaatccaggagaaaacaggcacaagtttacagtgtcctctaccagtaaaatcacacagctggttcttaattgtcccagcaactatgtatgacaacatgtataaagtattgccaacccaagaagctcacctgagccttggtgtccatgatttttattgggggtcagccacatagacatggacttcccacacgaatgaccttaattacccagtctccagtccccccagaggtcaaattgatacaacatagcccagggcttcaggtgaacagaaacagcattcaccaacaatcacattgtcagtataaactatctggcaagacccacagtttcaggtattcaaaggcacttttctcagttagggtgcttcaaaagctccaaggttatctctttggagatggtcaagggccagtcttttatttggtatctgcagaatttgaacaccccaagccttgagttaaccctttactgaacaacctgtttggtcagaacttagtcaaatggccataaccacctgcaacaaaagtaagaaatgcagtctttgttctgggcagctatattcctactcaatatttgggaattctattattgtataatggtggttctcaaacttcagcacatcagaatcacctggagaattcattaaaatagactgcacaaccccctcctcagagtttctgattaagtaagtgtagggtgaggcctgagaatttgcatttcagtaatttaccaggtgtattactatccgaataaagccagaacaaatttacacaaactttgggcttaaaacaacacaaattcattatcttactattctgtgggtcagaagtctgacacaactcgcaccaagctcaaatcaaggtgtaagcagactcctttctgcagtctctaaggaagaatgtttccttgctcattccggttgttggcagaatgcagttctgaagtcctgtttccttattgcctgtcagctgaagatcattctgaatttctaaaggccttccacatttgttaggaggttgacccctccttccatcatcaagtcagcaatgaggggttgggttcttttcatgctttgaatctcacctgcctcctctatcgccatatctttctgattgcagcctgaaaaggttctctgatttttagagctcatttgactagactgggcccacccaggtattcaggagaatccccccatctcatggtctgtaatcttagtcacatatgcaaagtctgttttgccaggtaagatagtatattcacaggttctggagattagggtgtagatatctttggggggagggcgcatgattctacctaccacaccagtcagttcactctgattctgtggttagggaacacactttgagaaccaccaatatagaaaataagagaaccagaagactcttccacaatgtagccttattttacattgttggaaagtcaatgaaagcttttaacaaactggttgactgcagctttacctcttcagtgggcccctttcctactcaaaaagtaatgagaaaaaggcagcaagggggaccagagaatagagaaacaaaaactgaaatcactccctgactagattaatcagctcttgcatactctggccatttatcagatatattcagtgaaattcttggttgagagaaagagggagaaaacacaagccaatcctgaatcaaaattaatagagaattctactagaattcaacaggtttttcttttttattttttaatggcaagatccctgaaggcctttaaaatacgaatgtctgctttaaatctccaagaaggagggcagagttcttgaaaatgatagccatggtttttttcgtggcacatataatggaattgggctgcctggaaaaatgcttgagtaaaggttgctccacaaggggaaaggtggtaactcaatgcaccttcactttctaggttggtgcttctcaatttggctgcatattgaaatcatcttaggagctttaaaaagcgctgatgtctaggtcacacaccccagtgattctgaagcaattgctctggggcatgtcttgggcattgtgcttttcccccaacatctcgcagatgattctaacgtgtagccatgattaaggactgttatggtaggtgataaccctgttttcctgagtctattagcatatgtagttactaaccagagtcagtaaactaggtattgttctctgtattttaattcctgcccaaccaaattaaggaagtaatttcaaaaattaaaagagaagagataatctagagtggcaggcagtactaaccaactccacattcaagaatagcatcctttcttaaccagcattgcgtgattttaaactcttcgtatccccagaatttagcacagtgccccacacatagtatatgttcaggaagaactgtggtaaatgataaagaattatgaacaaagtcctcttcaaaatgaagattgcaggagaatcaagcttcagtcagatctaagtgcacactactctagtgagataagccaatcagataagcaggatggggaaccaccattttggttttgttgttgttgtcattgttgtttttgagacagagtctcacctaggctggaatgcagtggtgcgatctcggctcactgcaatctccgcctgcaggttcagctgattctcctgcttcagccttctgagtagcacgcctggctggctaatttgtgtatatttttagtagagacggggtttcaccatgttggccaggctggtctcaaactcctgacctcaaatgatccactcaactcggcttcccaaagtgctgagattacaggcatgagccgtcgttcctgaccaggaaccaccattttgattggcatggtaccaggtacacagaatttagccaataaactatttgatgtgtgaaagaatgaataaattttggcattaaaaggcaggcttcggtatgtcagagcaagaggtaattggatgaggaccagaggatggagcccagagcaggaaatgaagctcagagaagaggtagatgttcaacgtactgtgtctcctcctccagttttgagtaggtcactgaaaacacttggcatggcagtgaaaatcactcaaaagacccccgtggaaatggacagacttgtgtggaaatttgcagatcttggctgcttctaattcatttgtctttctaacctattagaatccaattcagtctctttggctctacccaggataatgcaaaactgaattgtacacataagcttcctgccttctgctccttctcttcataaccaatatgttgctaaacaacaatttctaattgccccttcccaggacaccttttgagagcatctctctttgtaccccctgaaatacataatactaattttctttgacatgctatatattttgaggatccatgcatccctaacaagtgcccagtcttacgatggtgcagcccctcatccagtgttctatcatttaattcatgatgctgtttatcttggctgcaagagagtgaattattggcatattcagacagtctcataccacctctcgtcctctccattatcataaaagttaaaattatttatttatgaaccaaataacttgtctgaatattttaacaatgcacgagcacttatggaggtttttatttcaatttgggtagagatacaaagtcaaatatgatttcagtacaagttgtgatggtttttctcaatatcttatatggggttccatttttgccttgtacaattaatacaagaagcataatgaactcagcaatccccttgagaaataacaaataggtataagcaataatttatctgtggaatgcagggccttgatacataacttccatatctactccaaaagaaaaagaaaagaaaaaaaattcctagctaagagccatgaagaaagagtccaaacactctcacacattgttgttggaaaggtagactatacaacatacttggattgcaatctggcaatatgctttgaatgttcacaattttaaaacatatatttcctgacccattatttcaaagactgtatcctgatcctgatgaaataataaaagatgtgcctaaagatatatcatgtgtggatgctcatttacagtgttacttcccataaagagaaatagggagaaacaaataagaaacctttctaatatattttgttatctataaaatggattgctatgcagtcattaaaaataatgttcctaaaaattagtttataggaaaatgtataaaaatgtacatgacataaagttaagtggaacagcaagatataaaacagtctatgcagcctatttccaatatgtttataataagtatttccatatatatttctacgttggcatattattctacacagaaaatgatcagtacatatttttgagtgtataagcagggtgtgtgtgtttacaaagacaaagatgaaataccccaaaatattaatagtggttatggctagatagtgaagttatgggggatatttattctttgccttatgttatcctacattttctaaatagtctcaatgcaaatgttgtttttataacttattactgatttgtgagctaaacagacccattgacattttccctggaatattctagtgacacaatcactctcctgttagatagtcccacccctcatgccccctcatttggtctcttccaagatccaggactttagagccagaaacatttggattcaaatcccagctctttactttctagctctatgaccatgggtaaggtcattctctctgggtgttctggacctttgggatagagttgttgggagagttaaatgaggagtgttgcattcctatccgatagttatttctccctccccttcctttctaataggatctgactttgtgattttattcaggtattgactgcccacaacctatacccagggacaagaggctggggcctactcagacctaaggcttgaagcttaactagactaggacaagcatggtaacttcattccccttgcaagggatcacttcagggtatggtttgaaattctggccaatcaccaagtgggacaattgttggaggccagggtcgttctgaaaaagttttcttcacatttaagaaaacaaaggacacccagaaggatgagtattcattgccgtttctggccttcagacactgaggatttctggatgcactatagccaaacttggaccattagaggacaagcctgcaaagaaaagtaacacctgaaagaggggagaaataaaagacagaaaaaaaccttgatacttgataatgttgttgctgaattctggcatggccctattttttttatttatatttaaaatttttgtttaaatcagttgaactaggatttctattacttttatctgaaaggatcgtaagtgatacaaaaagcaaaagtgccaagctcatgacagagagcagagttcaacaaataaaaaataaaaaaaagtcttttctttctctcaccttccaaatacatatttagtatacacagtatatacttgtttatggcttgtaaatgtagttaatagagaaagtaacaagaaagaaaggggtaaatgcaccttttcctcctcttaaaacatgcacaacaggacccaatttctctaatttttttataaaggcccccaaaaactatggacaaagacaaagttttccaaggaaagacatgtgctgtaatggattatatcttgctaaaaattcgaggccttctaaaaaaaacaaaatcttgaacaacaaagacctcttccaatccctcctccctgtaggtcttgaacaactagccagaggccctgcttttgtaagaggttccctagatagatcaggatggatggagtgtatgctgttagatcaaaagaaatcatttgctacttgtatgcatggactaccttaactgtgagtcttaatcaagtaatggagactgacaggcttcttggcctataggggccctatagtaataaagtgtgcacttttctaaaaatggtattcataagagtcaagtgactggacaattactttgtttgattccacatcccaggctgaacaacctcctcttcccatattcttctgcgtctgatcctgatggagaagaataagccagcctgagctatgcttagatattttaaattttagtgaaaaataaaatatatgttttaaagcctggaatattatttgtgatttgggtctaaggtctaaaaaatatggacaagtgggaattcaaaaatcaccctaccagcactgcaaagaattcgtgagtattcaagctttaggagttgggtttgtgcattttccttttataactattgctagccatcccagaatgttgcactcagtaagaagggctaacagtgtcctgctggccctattcctatgtgtcatcttgcggcatttccagttaatggcatgactgtaatgactagcaatttaaataatagaggctgaagcagaggcagctataaggacacaatgcagaaattgccacagtttatcaacatcactggcacccagctcttcattacctccttgaatagggtcaaagtagttaaaatgatgctgtaaatacatgactaaaacaaagcagcggtttattcttgatttggcattgggtatttataacaaacaagttgcatttcccaggcatgggttattagacacgagaatgtaattgatattaaccaactttcaggctccagtaactttttccactgcatgtcagtttaattttttttaaagcataagcagcacatgccaaatggaaaacaagaggaagaacacaaaaaaccccttaagccttcagtactaagtgaaaaacaactaacccatttatcttatagaatccttcagagttttgctataaactcactcggaagagaatatcacagtcttctctttttgagagggtattcgagtgatttttagaaatgagacatctctaactgtaatcttgttttttgttcagaactaaaagagtatgcaagaatatctaaaaatacaaattgtgcacctactgcattacggcagaggttgaacactggtgacccatgagccaaatctgacccattgctctgtttcatttggaccatacagtaatggttgactttgtgttttaacattttaaaattattttcaacatttgtaaatcgagagatttcacagaaaatgctggaagctctgaccctaccggcaccacactcctacaagataacaaatggctggggctgagttgaggctgctcttatcctttgcctcaattgtatcactcctacagtctccttgtctctgaggcctaatgtcaattacctctcttcttcttaatagtattgttatttttcctaagtaatgatcaaagacaaatattcattttggtgagccttgatcataaatggggaaaataaagatgggttaagaggactgagtgttttagaaaatgaaaaggctgtaattccttatagaagtaaataatttcttacttaaccccctttaccccataacagaatcctcccagctggcatccaagagcattgagtgtgtgaacctttgtgaaaagcatcaagttaaacgttctgtgtaaaggataccagacacatggaaaagccaagctaggttcagtctcagacaaaagctgtcaagctgagaaagggaaaagaaagcactgcacttgtaagaaaaacaacaaatggcaagcacggaattgacggctagaaagaacaaagcaggtttcaatgttctaccaaaaaatgtcttagcccctggctaaactccttttgggaaaaataggcacaacaggaagatgccttcacttcccaaagtcatccagacattctcagtgggagcttctgcatcaaccttgtgtcgcatctggagctgcagaccctcactgcccattggtttaacaatctctctcctcctgcaagaagagggtggtggcaggggggagtactataagggatgtttgttttattaaaaagaataaacatacatgcacatacacacctacccagaaaatactatttcatggcatctacacttatagggaattcactcagaaacagctttttagtaacacaaagaattaaaatcattagcacccaacaagtcagaaatgatggaagattaggaagaccattgcatagaaacaaaattaaaaaaagataaaaccctttatagaaccagaaaaggtgaggagaacacaaacaatccttttcactgagattgagaacccagaaaaaccttttgatataactagggaaagttaagtagagtcaggaaaggaataagtgtgtattaatttcccactgtgtagaaagcactccatatacattttaatacattttgataataaataataaataatactttatatttttgttcatttatccattaaataagtattcgttcactgccttctatgtgtcagacatctctagggatataaacatttaaagacatggttttcctattaccaagttttgagtctaacaaggaactagacaaacactctaatgaaaataataatgattataaatacaaacagcaataatacaatagcttaataacagctgtcctttactgagtgcttccaatgtggtaagaattgtgttgagcactttacattattattcgtttaatccctcataagtgccctatgaccaagttactaatatcttcattttacagagaagggaagtaagctatagactaaatgattacctaaggttataaaggtagcagatgaaagatctgagatttaaacactacctgttctctgcacaccaggccaacagataatctgcgatatcaacccctaccagctacgatggaggcatgccaaaaacaagcgatgcagaggggagacccttaaacccttttgaatttgcaaagcacttccccatagagaaaataagcctccagaattcatcagccccaagaggtggtactggtagaaaatataatagtctttcataatagcttaggtcagggtgtgaaagacagagctataagggctggtaaaagaacgaaagctttccaatccagagacaaaaggaaaagtgagatccatccatgacatgtctcttgaggactcttttaggaccaagatggtgaatgctgaacggaccatgcatgcctcagtctgtcaaattgtatgtttctaaggacaaataggctacaaaactttcaccctatttttatatgggaagtctgttgaaaagaatacaatacataaaagatgaattacttattgagtctttaatatgtctctagcacagaaataaacatcttgtgtatattgtttctaatttccacaataccatgagctagaaatatacagaatagaagaacagtgggatcagagaggttaagtgatttatccaagaccacacaggtgttaagaggtagaggaatggtttgaacttgcaacaatgtgactccaaaatcaatacattttccttacactgaaatacaaagtatcaggccaaatctctctgcaaatattcatcctgtttcttttggttcttcattcatttaattaaaaacaagtttattatgcacatacaaggaacatagtattcatccttgtgcatctgacaagtaagtcaaggagacaggtgtgtaaatacctaaccaaacttacaggcaggatgaatgaggctaaatgtgtttattatttaaataaactccatgaagtcagatacttcagtttgttgatcattgccacatacctgaaacacaatcttgaaccaacaaacatttgtttgatggaaggataaatgaagaaaatcccacttaaggaagtacaaacttaaggtagaattaattctgcctaagataaatcaacgaaagcccccaagtgcagtgtcattgaattggacttggaagaatgtatgaagtatatactagtgagaaatgaagtgacaggagctatggctcagggtaaacacaggaatggaagcatagaagcccacaaaatatttgggtaatagagttcaagcatacttagagcacaggaaaggcgagaaattagagtgagaactaaagtcaaaaaggtaatttggcaccactttgcacaaagccttcaagtcaattattaaaaaaaacaaacaaacaaacaaacaaaaaaaaacagccatgccagtagaatgcagtaatctgacagcttttagcaaagtgggaatgtatcacccctacttcctccccactgatcttagaagaatcctaagtgtttacacctagtttgtaagatcccaagaaactctccagtggtctaattcccaccactcagctaagaactctcagctcaaaagatactggcatctggaaagcctttttcaaagtccctaagtctgagttccttacatcccacacttcacccatctcatagtgtgtttttcttatctctctccaccatcactggcttccatgtgagcaggcactatctttgttgattcctagcatgttgcaaacagcccggcacatagcaactactcaataaatatcctggaaataattattacattagtgaattgaatgattgatgcactgactgactgttgaagaaatagagtcaaggagagccataggaggctgccacaatagcccacggaaaacacctctttataaaggtccagatgtatttctttaagtaggcactttgctaactggggagagcggtggttagttaaagcagacagcaaagcagaaaaaggcagggccagcgggcagttgctggggagaccacaattccatgggactatagccattagcatgcaacactgggtaatctgattttcatgacagacagatttattatgacttctaaatatataaatcccaggttatgctttccagctaacctaacaacttgatatatgtgtctgacatcccgtcttaaaatcagattccagcttctaattaatttttattcacccatcgctctaacaagagaggcaggaagtctcagggggataaacaatagacagggtattagtcgttcctactctgtggcacattttccactgagtctctggagttttctttttctttgctaccaaaaaaggggggccttacccattctctctgtggcttctaggaagaacgagtggaaaacattacacaggcacccgatagtcattatttctattaagcaaccaatgcttcatccatcacttccacctccccattccctgctttcatctacccatgcagaaattggaatgacatcatggtctagtcagtttaaagactgatcattgcttatgtattactatacatcttgctttctccaataatattatcagcaaatagttcttgaagctgaattgcaagtgccacaatgacctgactttaaaccaataatagtgatcataaaggctaaaagtaccacctaccgctttttatataatctgaacaatattaataattcactcacattcagatactttattaacaatgaaaagtgatacagctgtacccaggaaaagttttgtaatccactgatttctttaatgagcattctatgaatctgtgttttttaaatataattttcatatatgaatacaatttaaagaacattttcttctatgtcctttttccaaaacatgaaagtcaatatgggtaccacagaccaggttagaaaaaaaaagatggtcacattcaactttttaagttttttaatatttagttctcactatgtgctagagattgttctcaaaatgttaaatgcattaaatcctcctcaaaactctatcaggtatcataatttatccttgtgacatgtttaaaaagttgtttgcagtcacaaaagctagcaagttgtacaactgagatttcaattgaggctgatggctgaggctttaccaccttggtcttaatatactgcctggagatttaattactaaataactaatagtataagtagccagttgtgtttgccaaacccataaagccaaactacacaatcatcttcactttgaggacactatagtgtttctggctttttgcaagcagatttaaaaaatttggataccagtctgtttacctgccataatatggaatataaactaggaggagaaacacattcagcaaagaactttgtttgatggacttcacgaatcaaaaaaaatgtcatttttctgttcataataaataaatagtaaaaataggataataccaaaaaatatgcaaaatcttctcctccctatttattacaagtatatactttctaaatctctagtgtctatgtaatttatttgatggtatgaaagatgtatttcacatgtacatgcacaggcacacatgcgtgtgcacacacacacatacacatgcaacctatgtataccagaattactctgtgctcaatttatcttcagttaagcactgaaaacaaaatagaaccaaaaaaatggattcataaagtgacaaaaagaagttcattcacttgcccttcaggtacataccatactcatatgaacaaacttatatattctccctacaaaatcacacttaaatatgtgatttaaagtattttttgctaagtatttttatttctttccccaaaattatttgtgaaaatggaacatgtcctatatatcaataaatgtcatttaaaataaataaatttttaaattaaaattatcatcaaactcttaaagtatttcattttttaaaaataaatttacactggaatagaagtcaaacaaacatttaaaagcacacagaaagcattcatattacaactaatctaaatggctgatttggtaagttttagagccttttaataaaaccatatttttactcaagtactatttagttagagctttatcaaaatacttaattacaaaataagatctaagatgttcaggtaaaactatgcacaatataatcaaatccttagcatgaagccattcaagttgtcatttagagatctgttttctgagcctactccagttttaaaatagtttcctcagtaacatcaaatctgcccttcctcccctttgccctcagaattattagagcataatgtaattcttttaccagccttaggaaaacactattggaatgcatgagccaaaatgcagagatgaaacggaactgaaaaaaaaagttttttaaaaatggaaaatcaattactatttttaataagtagaaatagcttttgtgctaagaaaagaaaaattgcccagagacaaaatagatgttcgatattatagtgcactaatgagtacatttacatgtaattttctgaaatttatgtccaagactaactgcaaatagaatttagtatcaataggagtttacaaaacccattcatttttcctctaatcatattgaatatttaaggtgcttgattagactcaattatttttctttcggtgccaaaaaagagccctgacagctttgaaagagatggattagtggggcatttcccaccaatggggaaacattcctggctcccacagcaggaaaaaaaaaaacaatgagaaagttcatgccaattcacatgcatgccactgaatgaaatctgcagagaactcagagaaggtcagcttgtcaaaggatcacggcaaaaagcggaagaggcagatacccaaacttagtaggactttgtggcctcccagctcacaagcctgcttcttcatttcaaggcggcctggagagaagcatctgacaaagatctatctcccactgcccagaaaagattaaaagaatatgggccctagcaaatctcctagtacttggaattgagaaatagaaagggaaatgtagctaatttgcagtagccctgcttccttgttcagatttcccgaagcataataaaatagagaggctgtgtctccagggttccacttccagctgtgccccacaacttggaaaaaacaagaagggacatgttacctactcacaccaacctgcctctcctgctgcccctcctgctgccattctttcaattcattctaagggaggttgtcagccctctctgaaatgctttaaaaagaagctatattcctaactggtcaaggagatttaggtgaattcctggctgaaagcagaatgaggaaaaaactgttccctcaaagtgcccaatctttgatgcattatgttctactgtctgctaaaaccatcatcgtagccttttaattaaattttcaaattctggtttgatggtccatgttaaactcaatttggtcaattcagggcaccatccacccagatattcctccctctgagacttctggtagaatccttccttgcctcttcctaatttccagtctctgcctctgtcatcatgtgacgttctcccctcatctgtctgtatcactgtgtcttttctcctcttctatgaggacaccattcacattgcattaaggttccatcttaactccagtatgacctcatcttaactaattacatctgtaatgacagtatttccaaataaggtcacattctgaggcaatgagagttcaaacttcaaatatctttttgggggcacacaagtaaacctattctgtgcagggcacacaattcgacctactaacactcccatattaaatcaatcaccaagtcgtgagcagacacctaatacctctcaaatctgtcaacttctttctatacccaccactaccctgaatcccatacaattgtctcacctgggtaattgtaacagcttcctttaggaagctcccctcatttttgcattgctccaatagattctccaaaaaaaaaaagtgcttattgaaatgtaactgatatagagaaaagtgcataaatcagaatgaatttttacagggcacacatacccacttaaacactacccaaatcaagaaatataatattatcatcatcctagaagcacatttcatatcccttcccaattaatttcctcctgctccagcccaaaggaaaccattatcctgacctctaacaacattgattagttttacatggtttgggattttatatgaatggtaacattcagcacatgcttttgtatctgtcttctgctgttagaatgatccttgctgttgcaactagaagtaattgattcattttctttactttataaatatttcattatgtgaatatacccttttacttattcattctaatgttgatgaccattcagattgagttccatttggaaaagctattaaaaataatggagctacgaacattctcacatttttagcgtatatctagtagaagtgaaaggtcacagggcctacaattgtttttcactaaatattgccagttttctaaagtaattatattaattttcaatcccacaccactgtatgatagttccagttgcttcatacccttgccaacacttagtattatcaatcttctttcattttagtcattcagatgagtgtccaatggtagctcattgtctctaataactaattatgataagagctttgtaatatgctgtgtagccatgtgactatcctcttttgtaaagggcttgttcaaattcattgcccttttttccaatgggctatttttctcccatccaagtactaatcaggcccatccctacttagctcccaagatcagacaagattggatgcattcagggtggtatggccgtagactacctctttttcttactgatgtgtagatgatatttatatgatctgaatactagtcctttgccagagatattgtaattatcatctcccattctgtggcttgccttttctctcagctagtgatgtctttagttcataaactttccattttgatgtactctaatatatttatcttttcattttttgctattgttttaaaaatagttttattgagatataactcacataccatccaattcaccaatcaagtgtatgtgactcaaagttttttagtatatccacagagttgtgtaacaatcactacaatccaattttagaacattctaatcaccccagaaagaaacgttggcccggcgcgttggctcacgcctataatcccagcactttgggaggccgaggcgggcggatcacgaggtcaggagatcgagaccatcctggctaccacggtgaaaccccgtctctactaaaaatacaaaaaattagccgggcgaagtggcgggcgcctgtagtcccagctactcgggaggctgaggcaggagaatggcgtgaacctgggaggaggagcttgcagtgagccgagatcgcgccactgcactccagcctgggcgacagcgagactccgtctcaaaaacaaaaagaaaaagaaaccttatacctactagctgccactccctattcctcccaacaccttcaccctcactaaactctaaccaaccactcatccactctctgtctttattgatttgccttttctgggtatttcttatcaatggaattatatgatatgtgttttttttattttgtttttgtgactggcttctttcactttgcatgatgttttcaaggttcatccatgttgcagcatatatgagtacttctctacttgtttgtctaataatattccattgtacggatataccacatttatttatccattcatcagttgatggtcatttgggttgtttccactttggggctattagatgaaatgatgcttggatagtgttttttcatgtcctgtttaagaaatatttggctatcccaaaatcatgaagacattctatgatgttatattctagatgctttattgatttagctctcacactcagatcagcaatccaactggaatttatttctgtttatgatgtgaggttcatttttccctgccctgatacccaaatgattcagcactatttaatgaaaagatcgccctttcttcattgctccacagtgtcatctttctcaaaattcaagtgtccctacatgagtggctctatttctgtacactccattctgttccattaatctattgctatttgcttatccttgtgcaataccacattatagtaattattgtagatttataatgaatttatgaagagctgatagatagtatatgtcctccaactttgttctgattccccttcagaattatcttgcctattctttgccttttgcataatggtgttttgattagaattgcatgaaatttagagatcaatttggagagaatagacctcttgaccctattgagtcaccaattcatggatatattgtgtcctttcatatattaggtcatctttaatttctttcagtaatattctgtacctttctctgtagaggtctaatacatcttttgttagatatattcctatgtttttaatatttcaagctattttaagtggtaactttttaaatacatttattgaggtaaaatttacatagcatgaaattcatctatttagatgtacagtttgatgagttttgaatacatttatatagttatacaaccatcacctctacatagttttagaacacttctatcaatccaaactgttacctcatgccctttgcagttaatccccactccccacaccaggcagcaactgatttgctttccatctctgtagttttgccctttctaaaaattgaatcatacactatagattcttttgtgtctggattctttcacttcacataatacttttgaagcatatccaggttatttcaggtatgggctgttcattcctttacaatgttgagtagtattcccttgtataaatatactaattattgcttacccatttaccaattgatagatacctagattgcttctataatagcttgggaccattacaaacaacattgctataaatgtagacatacatttcatttctccacaagttttcatttcaagaccttgaagtggaattgctaagtcttatggtaagtacatgtttaaccttttcaaaaagtgccaaattgttttccaaagtagctgtaccattcacattcctaatagctttatttaaaggttacagtttctccatatcttcaccagcacttcttattgccttttttactttagccatcctagtgggtataaattggtatttcaatgtggtatataataatatttcatactattcctctcctttaaatttgcattttcctggtgatgataagcatttttcatgtgattatttgccattaatgtatatgctttggtttgttttcttattaccgacataagaattctttatatattcttgatattaaatgctttatcagatatgatttgcaaatatctcatcccattctgtggtttgtctttttattttcttaatagtgtccttaaataactcacgttttaaaatgttatgaagttcaatttatcagtgtttttttcttttaggaaatcttgattttggtgttatatctaagaaatatttgactaatataaagtcataaaacctttcctgtatgttttcatctagaagttttatagttttaaagcttatattttggtctgtaatccattccaagttaactttgtatacagtacaggctaatttttggataaagacatgcaattgttccacctcaccttctttggaaaaacaatttgttcatagtttataaccctttttatatgttgctggattcattttaaatggtatctttttaaaatttcattttgtaattctttgttctggtacgtagaaatacaattgatgttttatactgactttgtatctagcatccttgctaaattcatttgttaaatttacataattatatgttctgcaaataaaagaattttattgtttcctttcaaatgctcatatcttttttttctgtctctctacattcaccaggacttccagtacaatgctgaacagcagtggtgagaacagtcacccttttctcagacctaatcttagggcaaggctctcaatgtttcacttaagtatgatatttgctgtagtttttaaaaaatatatagagagtctttattaaggatgtttacttatagtcctagtttgttaaaagttcttatcaggattagatgttgaattttatcatatggcttttctccttttctgttattacatcatttgatttttgaacattaccttaccactcatatctataataaatacaactttgtcatgacatatattgtttttctatattgttcagtctgctattgctttgtttaggatttttgcattcttgagacctccaaaatctcttccccatctctttagctgctgctttctattggacttttaagcttttcaggtctttgtcatttacaaatcaacaaatgcttcaaaaagaaaaagaatgagaatgttgaagtcacttcaatgcacctcctccctccagggttctgacccctcaagtcctggatgccttggtagcccttcaataccttcaaacaaatatcttctctttattttggctggcttttctagttattctcttggtggattattagctaccctatcattaccagaagcagaaattcatcctataactaaataaagtcatcatataaactaaatcatattattcttcctccttgaatttgctaatgtgctgataaaaactccatattctgtactatgtcctataagattctagtgatacagacatagcctttccctccatcatctcctaccactcactcccttgttcactcctctcccaccatatgtatctactttctgttcttctaatcccattgggttaattcccaaatcagtgcttttgcatttgttcttccctctccctggaacaccctgtccctgatcttcacatgcctgcctcacttttgtcaatccatctcagtttcaatgtcacctcttcaaagaggccttctcaagacaatttatctaatcttgtgtctctcctgcctgattccccacaaacaatattctatacatgaaagaaatgataatgaaattaagccaacagaaatagagtttgaactttccaaaagccacaatgttatctctatcccacttccacatccaacataaagagaacaacaaactaagaatatgtaacacctttggggaccacttttgtatattattatacagatcttaagagtatataatctttctctggagtgtgacaaacctaaatcaccgctacatcactttccagatgtataacttccagcaaggttctcagcctcaacttcctaaactataaaatggggataatggtagaatccattcgataatattgttgtaattataaaataaatgttattttgtatgcaaagtgcttaatacagtgctgagtcataaaaagtgttccataaacaagagctattgtgatgactgacaatgatgctcatgatgataatgatgacaaaaacaataaggctctggagcatctggtaaaatgctaagtaattcaatcaaacacacacagatgtacacacacacatacgcacaaaattacatgttgtaattcatttccaccaagtagatacagcctttatcacttgcattggtagatttggtagagacttcatttctttgatttctgtactaggtaagtttggtggcaagaaatataggccagccctagcaagtctattcaaaaataagaaaaatgaaaagaatactacagtatctcacaaaattgaaaggagaatgaaaacccaagctttgtgaagaaggaaatcaaggtagcttcagagaactgagaggccggatcttagagacctccctctagagcactgctatttgaatgactaaaataccattaataactactttttgctttcaattcaaaattcaaaattcttagaagagagaatctgattggcataatcagatacctagccctagatcactcatctctgccctcaagttaaaaagtcaaacattatggtctcagctgctgggagcccacctctgtggatcaggggacactgcccagaaaagagttttgttttagaactggaaggtcatcccaagaaatattactataatagaagggactctgtctaagatgggctctctctaaaagaagtcattttgttctactatttgcccatccagaatagcagtgaccaagttatgcaccattagctgcttgggagggagctaattacaaattaaatataattgaatcagtgagtctgctttcaagtcctctaaatagaataacaacatgctaccttgtacagccaatttagcaaatcgaagctgaatcccttgctttctatgaagataaagagcctttgtgaaatttttaaagtatagatgtaaacttcaaaaaattttgcaaggcaagtcatcaaaatctgggagaaaatatattggaaactgtgctccaacaggagccaatgaaggaaccttatgagggagtataaaatattaatattcaccaatgccaagaaaattttcatattatgcaggtatccaaaatgggactactatctttgatttcacaattcctttctacttctctaacacgaatttttagtgacccaaaatgctgggaagaactacaaaatacagtgaatgcattctacttgaacattatcttatgctgttgtacctaccaaaaagacaccatgaaaactgcaagtatggctgcgctggaaaaaaccgaaataagtagtcatctgtgaagtactgcaagtgtgggaaatggttgagagtcatggacattggggaatatcaacaaaagaggaagaaaaagaagattaggatggaggtagaaatgattcccatggaattactgacatcagtatatattcccttagcctattattacatcagtgtctcctactgggaatatttactgaaccagtggtactcagactttttttgagcagggaaaaaaatttattcaacatttggaaaactggcatagggcatccaaagtggggtgagaaggctcttgtgtcagactaccaggtccattcccagctcaatatatacatactgtggtaagatatccgtaacgtaaaatttactattttaaccatttttaagtgtacagttttgtggcattaagtacattcacaatgttgtggaacaactacctgtatctaggtctaaaacatttcatcacctccaagggaaatcctatacccattaagcatacattccccgattccttcttcctccagtgcctggcagctactcatctgctttcaatctctatggatttgcccattcaggcatttcatataaatggaatcttctaataggtgaccttttttgtaatggcttattgtacttagcatgtttttaatgctcatccatgttgtagcatgtatacttcagtaaaaaaaaattgaatacaattgtaaatatttgtttgaaacacataaaagaaatagttaaagggattgagcctatttacagaagacttgaactctggggcaaggagagatgaaaagggggactaggatagcagttgtcatttcaaagactcattgtgtgtaaagagactaagttttattctattcagccccaaattatccccccataaccaaagagtagaaactataagaagagagatttcaatttgacataagaaaaatctttcaacagtgttatccaaagacagaatagactgtttttataaataatgagttccacttatctgtaggtattcaagtataaatggaatattcccttcgcagaaatctttagagaagcaagcatcagataagattgatctgaatcagtggttcctaaaagccaatcaacaagcgcatgccaatacatgatgaagttttcattcactcgtggtgaaatgccaaaatcaaagaggtttttataaagctaaatatatatttaattattttaattccaagattatgcctttcatccttttagtatcaaaatagccccccaaaatagtgaatgatagttttcttcattcatgcccttttttggggcaaaacttcaaggtgacaaagtaaagtcagccctttgttttaggggggaaattgtaccagtctcaaagtgtgagaatcatttgaataggtgattcttaagacattttcaaaattccaagaacccatgtttatgaccaaggattgttatgaaagttgcttttgttgttcattttatccatatttcaactgtgtatgcaaggagtggagcacctcccaagaggattttccccaaggcttctgcctttgtagggatggtctgaaatgatatagaatttgaacggatttctagtctcacagggatttatattacatgaaaaaagagagagctttgctttagagatgtttatccaaattcaccacggagtcaatgggccaaattccaaatgccatgggcctcccagtgggtgtcaattttactgggcggctgtgtttgggagaaaaagtacatatgcatgtgtggctgtgaatgtgtgtgtgtagagataaagagagaaggatatgaacaaatagatagaggcatcaacaatcacaagagggaaagggatgatatatgtttagaattatatctaaggactgtctaaagataaacaaaaataacgtttttccccttttttgtcacccttgttaaaatcaataggaaaaatttgaaggtaccaagttattttattgtcaggcaccaaaagagtaaaaattgatgacatcactccatacaaaacccccagagctttctgattctgctgtttatgctttctcctgcaacatctccatttggatcctgctggaaacacttttctttctgtcactcacaatctgtcaagacagcattatcttctgtggtttaaaaacagaaactccatttaacttcgtggttgataaagacatctcgttcacatcccttaactaacaataattattctaatttaccacataaagacaagaaaaaatatgcacttaacattttgcagctggttttgtatcaaggaacacatggaagagaaatggtcccactcttgcgataaaaaaataaggtattaagtaaaaaatagacctaacatgaatgtatgcttttggtacatcctccctacatgccaatcagtgaagcaattaggagtttgggctctcaaaacatacttggattccaatcctggatttgcctcttattaatctaagaaggcaagacacgtaaccttcctaagtcttcttcatctgtaaaatgggagcatatatcaatatctacctcataagattaaattagataatcaatctatgtcagctgctgttactattgttgtcctcctcctactcgtcctcatcatcaccactattaacatcaaatcaacgtattagttaaggttctttggggtcaagcaacgcagatcatcctgcctaacgttagcaaaatagaaaagagatctactgcaagtatacagaatagtgcctaaaaatcaaagtaaaactaaatgaagcttagaaccaacaggaggctgggggcagtggttcacacctgtaatcttagcactttgggaggccgaggcagagggatcacttgagcccaggagtttgagacgagcctggacaccatggcaaaacccagtctctacaaaaatttagctgggcgtagtggcacccacctgtagtcccagttactagggaggttgagatgggagaattgtttgagtctgggaggttgaggctacagtgacccatgatcatgccactgtgctccagcctgggcaacagagagaccttgtctaaaaaaaaaaaaaaaaaaaaaaaaaaagaagcaacaggagtcaggctcccaggaattcatggtcagttagttcttcaggctactatcagcaggaagaatcagcaacaaccattttccatccttgggtcaatgtactcaagattcagaatctctgaaaaaaaaagagtggtggggtgggggtaggggggtggggtttgggacttgggcactgccttggtcacatgaccactgcttggcctggggaaggcaaggtgtttgacagctccaataatactgtgtttggtggagaaggctattccccaagggaaaaatctactttataactcaaagaagaggagtacagatactgagcaggtacatataccaagaactatttttcttacaccattacatcccaacgacccactacgtcaagctcaattaagcctgcaccctcttctccatcatccttcctatttggtaattactcttttaatacatgtttttaattttgaagttgttgttaaaactcaatttgagaaaagcaaaaaggccccagagctctaaagtatatatgtcccttaaaaatatatatatatatatactgcttgctgacaataaattattttgttaaaaaacttccgtattagaatttccagaaaatttattgtctttatgttcaagttatttagtagtaatctgtgctattaagaagcacataaagcacccattgaaaaagttatctgaagatgatttagagaaatagtttgttctcttagaaagaaatctcttttatgttttaagttcaataagatgatatttatgctcataaattagggtcaaaggcaacattttgttttggtaatttttttgtggatgatgatgttttagtgagaaaggattgacaataaaagcaagaatgtaagaataataaaaataaataataacgaaatacatgacctacaatttcattaaaattttcttccagcttactagctgaacaaatcccaaacaatgaaaatatacagagtctgattaatttgaagccctaaacaactctgtagctcagtgaaaacatttctcataaagcccagggccctgagggcacacagagctaagacaaatcccagtgtggtccacccttagcagctgtgtgactctaagcaacttactaatctgccaaaatacccaggtctcgcctcatctgtaaatgaagtaaacaacgtggtgggatgttttgaggacttgatataatgcatggaagggtcttgacactttttctggcaaacaatgagcacacaacgataaacgtttataattctatgtatggagagagagagagagagactgagaaagcatacaaaagagcaagaaagcagtagttctcaacagggagtgatttttgctcaccagaggacatttggcaaggtctggagacatctgtgattgtcaaaacctggagggtagagggtgcttctggcatccagtgggtagaggccaggcatgctgcttacagggaagctcttacaatacagatgacaagcccccacaacagaattatccaagccaaaatgccaataatgccaaggttgagaaacagaaagagattgagaaagagaaagcaatgtgatgtaatgcagaacctgtaacagatttggaaggaaaggtacattcaaagccgggataggaaagtagatcagagcagatttgaaattagattgacaggcatctgccacatgtaagctattgaggaagtgctctgagcctgaggattctcatttgaacaacgggcataatatgtaacatcacctacctcaaaaagttgttagcaggcatgatattcacccctgaccaaatcattacagatgcccactgcgtataaccagtaggacttcaccagtgtgtatacccactgtcaaccctaagagttaggtacacgtaataaataaatggttactagtcttgttatatattagaccaacagccaggtttgaagtttgactctgctacactggaaatacttgaaagggtttgttaatatcagcaagaattagtgccctcataaggaagtaaacagcaactagactccaagttcaaatgagttttccctgtaggttaggtgtcctcaacttgggatccttaaaacctctgaaattaaaaagaaaaaattacacatatgcacatatatacatgtatgaatgcaaccaagtgtgtgtgtgtgtgtgtgtgtatttttctctgaagaggggtccaaaaatggtgacgcatcactgggttagaggtatacagttttcaatataaagtaataaccaggatgcagtagagtttctgaagatatcattgtaatgtgaaggagacagtatttggaaatagttatgaactcagatctgggagtttgaattctgcctctgccacttactgtctgtgcaaccttgcataactgacagaacaataacttctttgcatctcacatgcaaaggtggaatgctcataatatccacctaagaagaatcttagagcaataaaattagacaattcccatatggtattcagcacagtactcaacacatagtatagaagtccctggttatccgcaggacagatgcttcaagatccccagtggatgcctgaaaccaaacagtactatgtttctcctacacatgcatacctatgaaaaagtttaatttataaattaggcagagtaagatattgacaatgatagctaatgataaaatagagcaattataacactatgccagcattactactcttgtgctggggccattattaagtaaaacaagggttccttgaacacaagcaccatgataccatgacagttgatctgataactgagataatgattaagtgatgaatggacagggagcatctacagtgcatatgctggacaaagggatgattcacttcctcacaatggagcgagacagcatgagattccatcatgctacttaggacggtgtgcaatttaaaatttatacattgtttatttctggaattttatagttaatatttttggaccacagttgaccatggttaactgaaaccacagaaagcaaaaccgtgaataaggggagaccactgtatgtgaggactaagaattagatactgcaatggaagtatttgcaaagactattatattcagatggtggtgaaggtttgagccttctctaactacgtatggcacacactatcagaaaaatggcagggattcatcaattaatctatccatttactactagttcagccagaggatccactaattctgagacatgccttgtataataatatctatacaatgttgaaaagtggacagaagtagctgtgaatctggtcacaaaacctctttttatacaagaaagcctcattcaaactttctcctctgacacatttcccagggccccctctgggatttccacaaacatgatgttgtgcttgactgtgcattactatggaacaattctaagcctgtctcacctacatataagatacagactccgcaagggccttttcaatctccttcattcctctcagaacctgtgcaaacaggattttatgcacaggtaacccaaataaagcagggttgccttgagacttgcatctgcccaataacatatccacgaagaatgactctgtaggcatttgccagtgcattgcacagcagcacagcctaaaattcttcctcacccatccattgccccaaccttaaagcatctgttttaaaaaaaaaaattcatctttccctatctctcattctaacctatccccacccaggatgccctcagtgccattctgctttttcgctgccaccacatttactgtgctcatgacacctgtcccctctcttcagggtatcactcctgcaaggcagagagcctggcctgaatacctttcttctggaagcagccctctagaattctgggtaacagatttgctatcttgttctatagagaagttcattacaagaaatgcctccattcctggctcaacgctcacttaaccttcttctagaggccacaggcagatgatcttccaagtttctcttaccctagaatagtagtgaagaaaaaaggacctcatctgcactctacctgacttgcagggcaaagtcagtattaatcagaggtgccctttttgctactgacagacaaagtagatgcactcataaccaagagcttttcaccaaaccctcagggctttaaatctttctcaaacaaactgcaatttgcaaagaaacaccctaaatgatgctgtgcaaggaagttacagcaggcacagaaggatggagtaacatttcaccatctgcttgtgataataataatgcctctaccttgcaaagtgtctaattgattgtgtgacacaggcacaaagttcctgccacaatttcaccaacaaaagttattcctaaattgtaccctcacagagggagagtgctaaggtcagtggtcctaaggaccaattttgagcatatgaactttctggtggcagaatgataagagtcctgggacacagttaggcaagattgaaccaactcaccctataatagttgtttcaagcaatgtccagccggggacacagagaacagagaggtaggggatggatctagggcagtgttttccacttgtggaatggaaaatgccttaaggtaatatggatgaacaactgtctgggtttcctgtggaggaagcctgggctgctttactctctagggtgttgagccagaaggctttattctggtacagccacctcattgatagtgaggtagcaatgcctgacaaaagtagatgttcatgctttgtgctagaagagcatagacttagccagatgccatctttttctaaattggcagcactcaggcctcaactgaaggggttgggaaaagtgagctggaaaaaagaggccgggagcggcagctcacacctgtaatcccagcactttgggaggccaaggcaggtgcaacacctgaggtcaggagttcaagaccagcctggccaacatggtgaaaccccgtctctactacaaaaattacagccagctacgccgaaggctgaggcaggagaatcgatcaaacctgggagggggaggctgctgtgaactgagattgcaccaatgcacttcagcctaggcaacagagtgagactcaatctcaaaaaaaaaaaaaaaaaaaaagacgggggcgattccaagatggccgaataggaacagctccagtctgtacctcccagcgtgagcgatgcagaagatggatgatttctgcatttccaactgaggtatcgggttcatctcactggggcatgtcagacagtgggtgcaggacagtgggtgcagtccactgagcgagagccgaagcagggcaaggcatcgcctcacccgggaagcgcaaacatgtaccacatgttctttatccagtctatcattgatggacatttagattgattccatgtctttgctattgtaaatactgctgcaatgaatatacacatgcatgtgtctttataatagaatgatttatattcctttgggtatataaatacccagtaatgggattgctgggttgaatggtagttctgcttttaggtctttaaggaatcgtcacactgtcttccacaatggttgaactaatttacactcccaccaacagtgcataagcattcctttttttccacaccctgaccagcatctgctactttttgactttttaataatagccattttgactggtgtgagactgtatctcattgtggttttgatttgcatttctctaatgatcagtgatgttgagcttttttttcagatttttgttggccacatgtatgtcttcttttgaaaagtgtttgttcatgtcctttgcccactttttaatggggttgtttttctcttgtaaatttgtttaagttccttatatatgctggatattagatctttgttagatgcatagtttgcaaaaattttctcccattctgtaggttgtctattcactctgttggtagtttcctttactgtgcagaagctccttagtttaattagatctcatttgtcaatttttgcttttgttgcaattacttttagcatgtttgtcattaaatctttgcctgttcctatgtccttaatggtattgcctagttgatttccagggtttttatagtttggggttttacatttaagtctttaagctatctcgagttaatttttgtatatgatataaggaaggggttcagttttaatcttctgcatatggctagcagcttaacccagtaccatttattgaatagggaatcctttccccattgcttgtttttgtcaggtttatcgaagatcagatggttgtaggtgtacagccttatttctgggttctctaatctgttccattgggctatgtgtttgtctttgtaccagagccatgctgttttggtcactgtagcctcgtagtacagtttgaaattgggtagcatgatgcctccagttttgttcttttagcttgggattgccttggctcttgggctcttttctgcttccatatgaattttaaaatagtttgtttctagttccgtgaagaatctcaatggtagattaataggaataacactgaatttctataaactgttaagggccatatggccatttgcatgatatttattcttcctatccatgagcatggaatgtttttccatttgtctgtgtcatctctgatttctttgagcagaattttgtagttccccttgtggagatctttcacctccctagtttgctggattcctaggtattttattcttctgtggcaattatgaatgtgactatgttactgatttggctctcggcttgactattgttggtatataggaatgtttgtgatttttgcacatggattttgcatcctgagactttgctgaagttgtttataagcttaagaagcttttaggctgagacgatggggttttctagatataagattatgtcacctgcatttgaatgcactttatttctttatcttgcctgattgccctggccaggacttctaacactatgttgaatggatgtggtgagagagggcatcgttgtcttatgctgattttcagtgggaatgcttccagctttgcccatttagtatgatgttggctgtctgtttgccataggtggctcttattattttgaggtatgttcctccaataaggagtttagtgagagttttttaacataaatgggtattaaattttatcaaaagccttttctacatctattgagataatcatgcagtttttgtctttagttatgtttatgtgatgaataacatttatggatttgcatatgttgaactaactttgcatcccagggataaaggttacttaatcacagggagtaagctttttgatgtgttgctggattcggtttgctagcattaggtcaaagatttttgcatcaatattcatcaaggatattggcctgcagtttttttttgttgtatctctgtcaggttttgatatcaggatgctgctggcctcatagaatgagttagggaggagtccctcctcaattttttggaatagcttcagcaggaatgctaccagctcttctctgtacatctggtaaaatttagctgtgaatccatctggtcctgggctttttttggttggtaggctatttattattgtctaaatttcagagctccctattggtctgttctaggtttcagtttcttcctgattcagtcttgggtgggtgaacgtgtctaggaatttattcatttcttctagattttctagcttatctgcatagaggtgtttataatatactctgatagttatttgtatttcggtggggtcagtgataatatcctccttgtgatttctgattgtgcttatttgaatcttctctcttttcttctttattagtctagctagtggtctattttattattaataattctttcaaaaaacagctctggattccttgatctttttttatccaagtaattgaacaattctacaagtattaaattttacaccaggaatgtatgaaggttcccgaatccttgctgatgcttgttattgttgtctggtttagtgggtgtgaagtggtgtcatattgtggttttgatttctatttccctaatgacagataacgctgagcatcttttcttttttttattatattttaagttctagggtacatgtgcacaatgtgcaggtttgatacataggtatacatgtgccatgttggtttgctgcacccatcaactcatcatgtacattaggtatttctcctaatgctatccctctcccagccccacaccccccgacaggacccagtgtgtgatgttccctgccctgtgtccaaatgatctcattgttcaattcccacctatgagtgagaacatgcggtgtccggttttctgtccttgtaatagtttgctgagaatgacggtttccagcttcatccatgtccctacaaaggacatgaaattatccttttttatggctgcatagtattccatggtgtatatgtgccacattttccttatccagtctatcattgatgggcatttgggttggttcgaagtctttgctattgtgaatagtgctgcaatacacatacatgtgcatatgtctttatagtagcatgatttataatcctttgggtatatacccagtaatgggattgctgggtcaaatggtaattctagttctagataattgaggaattgccacactgtcttccacattggttgaactaatttacactcccaccaatagtgtaaaagcatttctatttctccacatcctttccagcatctgttgttcctgactttttaataattgccattctaactggcataagatcgtatctcatcgtggttttgatttgcatttttctaacgaccagtgatgatgagcattttttcatgtgtctgctgactgcatagatgtcttcttttgagaagtgtctgttcatatcctttgcccactttttgatgggtttgtttggcttttcctgtaaatttgtttgagttctttgtagattctggatattagccctttgtcagatgaatagattgcaaaaaatttcccccattctacaggttgctggtttactctgaaggtagtttcttttgctgtgcagaagcactttagtttaattagatcgcatttgtcagttttggcttttgttgccattgcttttggtgttttagtcatgaaactctttgcccatgcctatgacctgaatactatcgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccatttcttgattttgtcaggtgtgtcaaagatcagatggttgtagatgtgtggtgttatttctggggctctgttctattccgttggtctatctctctgttttggtgccagtaccgtgatgttttggttactgcagtcttgtagtatagtttgaagtcaggtagcaggatgcctccagctttgttcttttgcttaggattgtcttggcaatgcaggctcttttttggttccatatgaactttagttttttccaattctatgaagaaagtcactggtagcttgatggggatggcattgaatctataaattactttgggcaggatgggcattttaatggtattgattcttcctatccatgagcatggaatattcttccatttgtttgtgtcctcttttattttgttgagcagtggttggtagttctccttgaagaggtaattcacatcccttgtaagttggattcctaggtattttattctcttcatagcaattgtgaatgggagttcacttatgatttagctctctgtttgtctgataatggtgtgtaggaatgcttgtgatttttgcgcattgattttctatcctgagactttgctgaagttgcttatcagcttaaggagattttgagctgagacaatggggttttctaaacatacaatcatgtcatctgcaaacagggacaactggacttcctcatttcctaatcaaataccctttatttctttatcttgccttattgccctggccagaacttccaacactatattgaataggagtggtgagagagggcatccttgtcttgtgccagttttcaaagggaatgcttccagtttttatccattcagtatgatattggctgcgggtttgtcataaatagttcttattattttgagatacgttccattaatacctagtttattcagagtttttagcatgaagggctgttgaattttgtcaaagaccttttctgcatctactgagataatcatgtggtttttgtctttggttctgtttatgtgatggattacgtttattgatttgcgtatgttgaaccagccttacatcctagggtgaagccgacttgatcatggtggataggctttttgatgtgttgatggatttggtttgccagtattttattgaggatttctgcatcgatgttcattagggatattggtctaaaattctctttttttgttgtgtctcttccaggctttggtatcaggatgatgttggcctcataaaatgagttagggaggattccctctttttctattgaatggaatagttgcagaaggaatggtaccagctcctctttgtatctctggtagaatttggctgtgaatctttctagtcctggacttttttggttggtaggctattcattattgccttaatttcagagcctgttattggtgtatttggagattcaactttttcctggtttagtcttgggagggtgtatgtgtccaggaatttatccatttcttctagattttctagtttatttgcatagaggtgtttatagtactctctgatggtagtttgtatttctgtgggatcagtggtgatatcccctttatcattttttattgcatctatttgattctcctctcttttcttctttattagtcttgctagtggtctatcaattttgttgatcttttcaaaaaaccagctcctggattcattgattttttgaagggctttttgtgtctctatctctttcagttctgctctgatcttcgttatttcttgccttctgccagcttttgaatgtgtttgctcttgcttctctagttcttttaattgtgatgttagagtgtcaattttatatctttcctgctttgtgttgtgggcatttagtgctataaatttcactctacacactgctttaaatgtgtcccagagattctgctacattgtgtctttgttctcattggtttcaaagaacatctttatttctgccttcatttcattatttacccagtagtcattcaggagctggttgttcagtttccatgtggttgtgcggctttcagtgagtttcttaatcctgagttctaatttgattgcactgtggtctgagagacagtttgctgtgattccttttcttttacctttgctgaggagtgctttacttccaactttgtggtcaattttagaatacatgcaatgtggtgctgagaagaatgtatattctgttgatttggagtggagagttctgtagatgtctattaggtctgcttgttgcagagctgagttcaggtcctggatatccttgttaaccttccatctcattgatctgtctaatattgacagtggggtgttaaagtctcccagtcttattgtgtgggagtctatgtctctttgtaggtctctgaggacttgctttatgaatctgggtgctcctgtattgggtgcatatatatttaggagagttagctcttcttgttgaattgattcctttgccattatgtaatggctttctttgtctcttttgatctttgttggtttaaagtctgttttatcagagactaggatttcaacccctgcttttttttcttttttttttttctttccatttgtttggtagatcttcctccatccctttattttaagcctatgtgtgtctttgcacatgagatgggtctcctgaatacagcacactgatgagtcttggctctttatccaattttcccgtctgtgtcttttaattggggcatttagtccatttacatttaaggttagtattgataattgtggatttgatcctgtcatcatgatgttagctggttattttgcagacttgtttatgtggttgttttatagtgtcactggtctgtatacttcaccatgtttttgtagtggctggtagccatccattcttcccgtatttagtgcttccttcaggagatcttgtaaggcaggtctgctggtagtgaattctctcagcatttgcttgtctgaaaaggatcttatttctccttcgtttatgaagcttagtttggctggatatgaaattctggattagaatttcttttctttaaaactgttgaacattggcccccagtctcttctggcttgtagggtttctgctaagaggtctgctgttactctgatgaacttccctttgtaggtgagctgacctttctctctagctgcctttaacattttttctgtcatttcaaccatggagaatctgacgattatgtgttttggggatgatcttcttgtgaagtatcttactggggttctctgtatttcctaaatttcaatgttggcctgtctagctaagttggggacattctcatgaatgatatcctgaaatatgttttccaaattggttccattctccccatctctttcagagataccaaagaatcacagatttggtctcttcacataatcccatatttctcagaggttttgttcattctttctcattcttttttctctattatctgactgtcttgtttcagaaagccagtcttcaaactctgaaattgtttcctctgcttggtctattctactattaatacttgtgattgcattatgaaattactatagtgtatttttcagctctatgaggtcaattacattcttttctatattgactattttttctgtcacctactgaattgttttatcatgatttttagcttccttgtattgagtttcaatgtactcctgtagctcaatgattttcattcctatccgtattttgaactctgtttctgttatttcagccatctcaacctggttcagaacccttactggagaagtgatgtgattgtctggagaaaagaaggcactctggttttttgagttttcaggattcttgtgctgattctctctcatctttgtgggcttatctacctttaatctttgaggttgctgacctttggatgctttttttttcttttaacctctttgatgaccttgagggtttcattgtggtacaagatggatttgccccactggcttcgtttctggaaaattttagggggccaacactcagcttccaactcatggactgtgtgctgtaactctggggtacttgtattgttttaattttaaaacaggaaatggcattgctttattttcactaagtctattattactttctatttatggtcagtaatgctgctcttacattcatggtgagagtctgcaaattctgtttgatatgtgaatataagtaaataaaagtgagtgacttttttaaattaaaataataataataaaaaaaaagtggtctgcatatttggcccaaagcaaaaaagtctgggatcaactctccctgaaccccagctcttcccatcccaaccacctatttttcctcaaaagcctggatttgggtgtgaaggtttttagattctcctttcttctttacccttatactcacttgggatccttcacaaccagcctatcaacataatttgggaaaagttatttgtgcagaaaaggtctggttctttcctactggagaattgcagaataaacaaaacaaatgaatcaattcaaagacgctttcagcctccagcaactgttgcatttttacaatggtaaaaggcagccaaacctctcatttgcccagaagttctttctttttccaatggttttaaatggctctaaagagaatgatccaacttagcagataaaaggccaagcctcctgtatagagaggtcttaatgttttcttttcagctttggaaccccctgattattagcattgtatccttggacaagtcactgagagcctgaatttctacacttgacaaacaaggacctacttcacaagggagataatgagcatcaggcacttagttgagggtcaggcacatataagggctttaaagagctattacaattattattattttgtttgtttgttttaatatatgtatacattgtgaaatgattgccacaatcaaattaattatcatgtccattactgcccagttatgatttgtgtgtgtggtgagaacacttaagatctattctcttagcaatttcaagtgtacaatgcattattattattaactgtagttaccatgctataaaatagatctccagaacttcctccgctctaattaaaactgtatgttttaccagcatctccctattcccccacctcctcccagcccttggcaacaaccatcattctactctctgcttctatgagcttggcttttttaattaattaattttttaatagacaaataaaaattgtatatatttatcaggtacaacatattttaaaatatgtatgcattgttaaatggctacattgagtgaattaacatatgcattcatcacatctttttgtttgtttgtttgtttgttttttgagatggagtctcgctctgtcgcccaggctggagtgaagtggcgcatgtcagctcactgcaacctccacctcctgggtccaagtgattcttctgcctcagccttctgaatagctgggactaccggcatgagccaccacgcctggctaatttttgtatttttagtagagatagggtttcatcatatcggacaggctggtctcaaactcctgaccttgtgatctgcccacctcggcctcccaaagtgctgggattacaggcatgaaccaccatgcctggcccatcacatcattttttatagtgagaacacttaaaatttattctgtagtgcttttcaagaaaataatacatggttattaaccatagtcattatgttgtacaatagatctctttaattcattcctcccataactgaaattttgtatcctttgaccaacaattctccaactgcccaccctccgcgccaactcctggtaaccaccattttattctctgcctctatgagtttgactgtttaaaatttcgcatgtaagtgagatcatgcagtatttgtctttctgtgcctggcttatttcacttagtataatgtcctccagtttcaccagtttgtctccaataacaggattcccttcttttattaaggctgaataattttccagggtgtatgtatatcacattttctttatccatcatatattgatggacacttaggttgattctgaatcttagctattatgaataatgctacaataaacatgggagtgcagatatccttagaagacttattttatttcctttggataactacacactagtgggattctggaatcatatggtggttctaattttttgaggaagttcatactgttttctataatggctgtactaatgtacattctcaccaacagtgtacatgggttgctttttctctacagctcagcaacacttattatcttttgtctttctgataatagcctgataaagaaaaacttcagccaaattaaatttaaaggagtttaattgagcaatgaacagtttgtgaatcgggcagccttctgagccagagcaggctcagagactccagtgcagctgcgtggtagaagaagatttatggacagaaaaaggaaagtgatgtacagaaaatggaagtaaaatacagaaacagctggattggttgcagctgggcgcttgccttatttgaacagagttcaaacagttggctacatttgattggccaaaagtcagtgattggcacaagggtaggctatggtttgtttatacctccgcttgttatagttcacgatgtacggaaaaacctttaggctgaacttaaaatatgtaaggaggcagcttaggctaaacttgatctaacaaaccattctaacaagtgtgaggtgacattttattgtgacttgaatttatagtcccctgataattagggatattaagcatttttttcatatacttggccattcatatctcttcttttgagaaatctcttattattatcatcttcattatcactctaattattaataatgttcactaacccatacagctacagtgatttttgttacaacaggagctttctgctttcaaaaaaaagtgctgctaccttaagtaatcatttatcctaactctaggctgcaacttactattattattattcattcaacattcactcaacacttacttcctagagccactgtttgggcactggggaaatagcactgaacaacacagagcaaagtctttgccctgtggctcacattctggtgaagcagagaaacagtacacataataaatgaatgttaattacagtatgtttggcagtgatgaatgctagagaaaaaatagcctatgacctggcaaaggcattacccattaaggtaaaggacctatctcctagagcacttgagttttgtatcacataattcatcaaggcctttagatattacagtctgatctttgggccagtggtctccctgtgtcacaaggcaagcgggcctcaagaaagtaaaaaaggaaaatatttcctctatttgctattgccaaaacttcctccaagagggaaaggataggacaaaaagtattttgtgtgggtgtggcagccatagctaggctatcaaatactatgcacatatgatatgccactctcagtccctataatggcagatatgattaaggtttcctctttcctgctgagcccagaaccagcttcacaaactttttcagcacagttctctgggcaagcaactttagtgattaaagttagcctaaaagactaaatctatgtgccatcatagagtgcaaagttaggtttaaatgtaaatatatctagcaaaggtatcatactgacttaaaatcacactaagtcctaaatgactggtcttcttccaagtgaacattttattggaggtagggaatggctaagaagaaatgctgttaagtgtatagaggggaggggcagaaggcatgtatgaagaaaaggacaggttttataatcccacccacatttgtatctgaacatgtgtgtatggcaaacacacctgatagcaataacttaagcataccctaagaataaccctgtatggcagatgcacttgaatgtggttaggtgtcccaagctaagaatccaagaatggccaacccagagagttgttcctaatctataaggaacatctgagcccctggcctgtccaatggaacatggctgtatagggaatcaaggccctttgtttggggttaagtgaaggttgccaggtagagactgtcacagggagagtgctaagtaaatatgccatataaactgcatgttttttgcaagttgcctggttctcctgtccagcccactgccactggactctctcccctgtatgtaagcccccagtaaaagcccatgtcacgtttcctgtctctgggtctcttcttcagcctcttgaacctggtgccatccccactgaagttgataggtgttcagcacaacagtgtcattaggaatttctacaatgtcataagcaatgtcataaggcatttctacacactctcacttgaaggaaccacctccattagtgtaccttagtctttcacacaaacacatacctgagcccacaaataaagtgctcaaaaatagtggctctcttcttctagttgttcaggccaaacaccttggagtccaccaccaaatccttttaggacaaccttcaaaagattaacagccacttcttgccatccaaccataccatccatgataatccaaccatttcttgccagctctaccctgacctccaaaatcaagccaccaccaagtcttggcaagaagggctacaataattccccaacagtctcagcttctgcctgtgatcctggactgtctatctctacttaggagcctgctaaaacctaagtcaggtaacatccctcctctggccaaaaacctctagtaccttcctatctcacccagagtaaagtcccacaaggtccctcacgctcttgttcccaactgtctctcaggccgcttttctcttgccctgctttgtactcttccttccagcccacaggcctccatgctttcctcaaacaggcctgctatgtttccatcccaagaccttttcccttgctgctgcctttgcctgggagacttttactccaaggtgccatatggcttcttccttactccagtcacatcttcaatgtggccatgagaggccctgctagatcacttgatctaaggcagcacacaagccagcccccacctccaccctctccctctaattctccttaccttgtttgataattcctcatggcatttatcactttctaacccaatatccttccttcctttcctccctccattccttttttccttcttttcgtcactatctgtcttccaatagaaaataagctccatttgcataggggcatggtctgttctactcattcttctgcctagaataggatctggcccagagcaggctgaccaactctttactaaaaactcatccgtcactgagaactagcaccacaccacagaaggaagaaggctctgcatctacaaaatacagctgctttgtttgagtgctttgagctctgtctcctgtaactgggtgacaaaggtctaaacacataatgatagtgctggtgtgatagaaagtgaaagttctttactcttgaaaaaaagctagattttatcaagtgctggatttgctcagtggcatttaggttttaccgctataaaacaatattcctatttcttaagttcttgctaggaaaacaagtaactttgatttttcagtctgaaactctccagcgccccttaactatggcccccgaaacaaacattttatactgaatttttgataacacacaatttattaaaatgcagctattacattagtgcagaataagctatatacattctaagatttagcatgctgtcaaaaggtttcctcattggaactgatagctacccctaaagcagagatggtcttgagcatatcatttacccactttaagcctcggtgcctttaatctgtaaaatgaatggctacaccaggctctctctagcatttattccaaatgatacattcaggcaggcaggcatgggatccagtggaaaagacttgggatttggagcttgagatctggctctgtcacttacaagccacactgaatctcattttttttcatctataaaacattaatcactggaaataactaccttgtctataccaccttttggtatcttaggacatacatttggaggatcaccaagacagggctgtgaggacatctatttggtttcccaggatgagcagagtacctgacacatcacaggcactcacgtgcatttgctgcgtggaggaaagaatatatggacaaataaaaaaacacttccacacctccccagctgttgtaaggacttactaaagcaatgcatgttgaaagagctttttaaattctaaagtaatacaaatgataataattactgtgatagatctatttcacatttgcccagttcagccttggttgtcatactaatttaataccaacatgactggaactggaaagaaactaatattgattgaggtcttactatatcctaagcagatacatatgtacgtatgtgcacgtatataatttgagtcttctacctttttaaccaggtgggtgtcttaatgtagttataagttctagccagcagaagtcagaaactgagtcaaaactgaactcacaaatcagtcaacagttacttagcactcagtacttgccagcctctatgcgtggtgctttgcaggcatgggcacattcagtttttcaacagcctttgaggtaaccacagatacccctttttatagatcaggaaacacagactcagagcagttaagtaacttgcttcaagttaacagctaggaggtggcggggccaaaatttcactgtctgacttcaaagtccatgcccttaagcagtatatattatgcagtacattcatgtaagcttatcactgaaggtatgcggaataattcgggtgcttttatttttgttcaataaaaagctgctttagcactctatcaccactgccttaatttttttttttttttctaaaatgaaaatctgtgcctgggaatatgggtataactaaaaatgggacaggagaccacccccagaaagacaggcggccccagtttcaagttcttatttctcacattggcccttctggtgtgtcccagctgtattgtcataacctatagggaagttccgcagtcaggaaggccaatgacaatatatttcccctgacaacaccctggtccctttctgagttattcaatgacaattgaaatgtcttttcaatattttcttttccttttcagggcaaacatgtccacttgagtcattatgatcatcagctgttctgatttgcaagcagttcctaattgagtaggactagtgaatgctgtgagatatgaaatatcttgctgctaaattgcacacaggctgaaggcaataagaatttgtttagctatgcatagcgctttatattcagggaccagtggttatggagacactaaaaccagtcatcattaggacaatcctatcttggctaccagagaatgaagatccccacacagagctacctgaacagactaacggtcaagaggctgatgaggcattaatgagaccatgaatcaaaatttaccaaacaaacagtgcctccaaggcttctagttgtttctgtttgactttatcttggaactaactatggaacaagatggctgtgtttagatgtcttcattcatggcctatctttgaacactgtgtgtgtttatttgtttgtttgtttgtttgagacagagtctttctctcttatctgggctggagtgcagtggtatgatcatggcttactgctgccttgacttcccaagctcaagagatcctcccatctcagcaccccaagtaactgggactacaggcgtgcaccaccaagactgactaatgtttttatttttaatttttgtagagatggggtctcactgtgttgcccaggctgctctcaaactcctgggctcaagtgatcttgccacctgggcatcccaaagtgctggaattataggtatgagccaccatgtctggcatctttgaacaattcttccaagcaactattttgacttcatttctttctaggaaaaataaataaacaagatcatagagttatattatacaatataaaatccaaatactgacaaaagtcaaccatattagtcactttccactaaataaagttgtgtctatggttctttctctgggaaaatttaccatgtagtaactatcatttacttagtatgtgctaagcaccatgctgagagctttgttcctaactcttagttaggttaccttagaaagccccccacacctgggttatttcctagttctatgttctaggtacctctctgtcattaagcttaccacaaactcatttgtttatttgacatctctcttgaattgaactgtaagagtcactagagccaggaccatgtctatctttgcccccattgtaaccccagcctctaacataacacatgatatacagcggatgctcgataaacatttgaggaataaatgaaggaagcaagtcgaagaaacatccctgggttgctatcgctgtaagcagtagaagttgcatttgaattcagactccaaagcctgtgttcctcacctgcagcacacggtctctgtctgagctgaatagtctgttgcatcaaaacacatcaaacaggaaataaacaagagcaactattattaccacggtcccatacagccactagagagcaaaaggggtttctctatgactattgaggtatattaaggactcattacagaataaacactactgggcacaaaagcatatgagaaaagttttaggagtacaatgaaatcatgcccaatctttcctcagggtccctttccattctctatttatattgtttccagtttattattattataactgaacatttaggacccaagggatgttggccagtggagctacagaattctcagtcctctgaggaacctagcaactagtgttttcttacctggctcttaggagcaaaaggagaaaacaaatgtgcatccctgagctgttgtctagcatataaaaaagatgctattattaataacattttgtcttattaacatttgtcctactgtgatttattggcagccagaagcccaagctttaggattagtcagacctgaattgagccacttagttcttgtagggcctccaccaagttatgtaacctcaacctctttcttcatgcataaaataggattagtaatactatctacttcacataagtgcttggcatagaatctggcacagaggggaaaaaaaaacaatcattggtgcttattttcatcagcttcctcctaattattatttagtcagctgtgagtaaaaagaacctagcgttggccatggaacctggaaatatgacctttgaccctgtcctgttaatgcaattgtagtgagtgaatttttttttacgtgttcccatccccgagcagtccctccctctctcaaggacccggtggacttcctggtcttggcaaagtatgcaacacacatttacctttatcctgccagggaagtgaaggtttgagaccattaagctgggggcttcccacctacagtagctccccaatgcttccagtacaaagtttaaactccttagcttgccactcaatacccaacatcatttgatccaagcaactttgagcttgacatcagggccaaaagatgctttttccacttaagaacagaaattcagtccagtagactagtggaggatatgctaatattttacttccctttccatccggaacagataatatggtaaatcatctgttcatttagtcagaaataactgttgttctaggtgttggggctataactgtgaaaaagaagacttgattttatggaatccacagcctagtgaaagaaagagacaataattaaatggtgccattgtgtataatcagtggataattataattggaaataagtgaaaagcaagataaccatccttggactggaagagaaaatgccaaaagcccagaggagggctaagagttcaccatgtgaaggaggtatcactgtgtctagagagagcctggcatagaatggatctgaaagcctgataagaggcaggagcgccaagagtaaaggccaagcacaaggaggctggagcaataggtagagcccaactgtccagtgggaggaaggggaggaaatgatgggagataggcaaggaggggtgacagcaggaaggaaggaaaatgaacaaatgccagatatattcagcagataaaatagaaataagctgctgataaaatggatgacagggaagggaagtcctgagggtgtggcaggtagccagaatgactctgagatttgtggagtgtggaaataaaaggatggaagtgccatttattaattttattcttaaagataccttgagacagttgagaggatatgatgagacaactgcatgtatacagttgtgcataaggttcagagaaacactccggctggccattgcagcttgtaggaaagtatagggcctgggaagaagagtattgaaaaaagaaaaaggtgacacgctgttcatatgagagatgcaagaatgaagcaatagtggcattccacaagccaggactgagaccgtctcccaaacagccagatgactctgaacctcaaaccaacttgcagtcaccttagaattttattagctgcaccagatggcttacataatatcattaactcctccaccctcactacctaaaaatgctagaagataaaagggacggctgaggaaaatcctggaattttcttacagaaacaacatttacaacaggtaactagcccatcagtttctctagtatttctcagacatttccagttaagtctctagaatgacaaaagcaaatgatcctcgggtcttggtggtgccatcttaagtttccctctgtaaatgtaaatgatttttaaagcctcgtctagtactttaaaaattcatgcaaattttgcatgttactgcataatatcattatgctgcttttaatacgtacacacacttttaattctcccaaatactgaagcaaaaatgatgtgccacaaatgtgcctccattattagcctgtgactttgggaatgcccttgtccacagctttgcatgcagggttgaactcattaactaagttgagaaccatgaaattaatcagaaatggactagggaagtttttccttagagcagaagactagagtcatgacctctaaaaatcactcttcgttcctacaaattctaaaataagtggtaataataacattaatattaaaatcacactaagtggattttaaattcattctctcacactagaggtagttactatggtacatagtatgagagaggtatcaatttaaagataaagatgaggatacaaacacagaaagttaaagtatctttcaaagcaccataatttgaagccagacagttctagtccaagccaaactactattgtcctctctgctacatattagcagcaaactcatcttactactcttgctgatggcttatatttggtgataatcaagaacaatactgaaaagcatgcttcaaaaatagaaaaaaagcttcatcttccccaaacataattttatttaactgaaaaatatcagtgtgcaaattgaacatttttggtacataaagtcaagtgttactaattaagtaaatgagtgatgaatcataatatcaacccagtcattaaacaaaattataatgaaattacatttaccaactagtttacagtacaaaaaatataatgagccaactttaaagaaagcttccaataattttattaaggccttccaataattttatttagttaaggattctgttgtattatcttaaaagattaatacaaatagaaaatggaagagtaaactgtgcaatgacttctgtccctctcaacctttctctagagtcacatcttttaagcaacatgagacatgatttaattcacccaagagaggtcaccttgcttgccgggcaggtgccttctgtttaaattcagtttactcaatcaaatgtaccacggaatagaaaatggggcatattcctgtcctgaaattcttcctatgttaactaaaatcaccttacttttgtagcaaatgagccatgagatacggtgccagaaattgatttggaagagtaagtacacagtctgaaaacagtgtctgtatgttttgtaataaaaaggctctggatggccctagatgccaaagagaggctataaaaggacaaaggaatgcaaacaggggcagaactatacaaaaagattaaatgcatcaccactaaaagcgatacttactcttctataaacatatacatttactgattgctaatttttatctgacgagtggttttgaggtggcctcagtgcaatgtcatctcccctgagcttgtgtcttggacctagctagagtagatcattactccccaatacagctcccattattttcttcctagcactttaaaaaggctctaattattttctctttagttttccacttgctaattgcctatgttccctttgtcattaccagtgcctagctcagtgtctggcccatagtgagaagatactataatatatttaccgaacgaatgaacaaagctgcgagtggcaaacaggatggggcactcttttgagttcatttatacaaatcagattctatttcattttattaaatacttttatttactcattgtcttctgaaattactctgggttctcattaataaggagaaactgattctatcttcaggaaggaggggaaaaaacactttcagtcacttgttccaaaggtctttcaaaataatgttgtagtataatttggtttgaaagcaaggtccaacattttattacctccaaatttattcagaaaagctgaaggcccgtgataaggctcattaagtcgctgaaaggcctatcttcacgtgcctttcacacaaaaggtctcaacttaatgccaggtaattactgttcattttcccctggttatctctatttcctgaagattcccagagtagttggcctcagtggacactacccgcagtctgagatgtgagcagagcaagaaggacccatgttcactggaggatctttttggagctgtaacgaaagacaatcctaacactggggtctagaatttaaacttagatcatctacaagttaccctctatccagaattaaagccaagagggaaaagtttctggcatacaaactggtttgtatttccatttcaaagacatcatttttcatagcacctggacctcattccacacctgtagggttacagatgtgggccctggctccagattacctgggctcaaccctcaacttcatcactttccactttgtaactttgagcatgtaacttagattgtcagtgtgtcagttcccttatttgtgaaatagggctcattgtacctactggagtgttgttgtaagaattgaatgtaaagtagaaggaactttatctcacacatggtaagttctccataaagttatttatttattaatattaattagcattatcatgatcgtctctgatatcccatttgcaagcaggacttatccctgttatttataactttgatcctagtcccactggacccatcatggcattgagggagatcaaatttcactatttgtgaaacaagccaacagaaggtgaatgatgatcagggaagacattttactgggcaccatcatttcagttttgcacggaagagtggtatagccccttagaggtcactgaagtcaccatccccaagcatacacctgtttttatatttaatcaattgatggctgcaatttactaatctgcactgcagtgatcctacaatagccttccctcacagtgggctctcctcacttcagccaggtcattcataagagcttagcttcatagatactgtgatagtaattttttttttttcgagatggagtctagctctgtcgcccaggctggagtgcactggtgtgatctcagctcactgcaacctccacctcccagggtcaagcgattccctgcttcagcctcctgagcagctgggattacagccaccatgcccagctaattttttttgtatttttagtagagacggggtttcaacatgttggccaggcttgtcttgaactcctaacctcaagtgatctgcccacattagtctcccaaagtgctgggattacaggcacaagccaccgtgcccagcctgttatagttaattttactgtcaacttgactgagctaagagattcccaggtagctggtaaaacattgcttctgggtgtgtctgtgaaacaccctgtgagggtgtttttggaagagattagtatttgaacctcagtagattgagtaaagataactgtcctcacaaatgcatgtggccatcatccaatccactgagggcgcaaataaaacaaaaggcagaggaagggtgaatttgctctctcttatggagcagggacatcagccttctcccgcccttgggctgggacttacaccttcagttctctggttttcaggctttcagactttaactagaactcacatcatcaggtctcctggttttcagcccttcagactcaggctgagactataccgccagcttttctgaatctccagcttgcagacggcagatcatgggacttctccacctccataatcaaatgagttaattcctcataataaatctctttttattgattctttttctctggataaccttgattaacacaacctctgagttacaagagataattaaatatagcagctgagagcatgagctcaaaacttgaatgacctgggttcaattcttcactgtcactagtgaaccagggcatgttactttatacactaaggctaagttcaccatctagatatagggttaatagagtggtaacaaatccaaaggactaaggactatgataaggattatataagatcactatgggtgactctgtaaaactcttagcatgttgtcacttatataacaaacattcaataaacattagctactatatttagacatgtcttgggcatgtatgttccagaaatctttttatattagatggtcactacagaaaggcaatctatatgccaagcttttcaatgaagcaaacattatatttgaatactgagtcttaacctcaaaaggttacagaacaattttcattcaagaacaaatcagaaatcacaggttggagtgtacatcatcccttggcagtctcagcaagctaaccctacctaaagtgtcagaagacttttctcgtttacagaaatgcctttagaaatccccaaccaaccactggtaggtccccaagcttcagtcttcaaaggtggcacttttgcaggctaaaaaatccaaaaaccagaatgtctcttctcctccaaaggatcacaactcctccccagcaagggaacaaaactggaccaagaatgagtttgacgaattgacagaagtaggcttcagaaggtgggtaatgacaaactcctctgagctaaaggagcatgttctaatccaatgcaaggaagctaagaaacttgaaaaaaggttagaggaattgctaactagaataaccagtttagagaaaaacataaatgacctgatggagctgaaaaacacagcatgagaacttcgtaaagcatacacaagtatcatagtcaaatcaatcaagcagaagaaagggtatcagagattgaagatcaacttaatgaaataaagtgtgaagacaagattagagaaaaaagaatgaaaagggaggaacaaagcctccaaggaatatggaactatgtgaaaagaccaaacctacaactgattggtgtacctgaaagtgacaggagaatggaaccaagttgaaaaacactcttcaggatattatccaggagaacttcctcaacctagcaaggcaggtcaacattcaaattcaggaaatacagagaacgccacaaatatattcctcgagaagagcaaacccaagacacataatcgtcagattcaccaaagttgaaatgaaagaaaaatgttaagggcagtcagagagaaaggtcgggttatccacaaagggaagcccatcagaccaacagcagatctttctgcagaaaccctacaagccagaagagaatgggggccaacatttaacattcttaaagaattttctacccagaatttcatatccagccaaactatgtttcataagcacaggagaaataaaatcctttatggacaagcaaatgctgagaaatgttgtcaccaccaggcctaccttacaagagctcctgaaggaagcactaaatatggaaaggaaaaactgttaccaggagctactgcaaaaacataccaaattgtaaagaccattgacactatgaagaatccgcatcaactaacgggcaaaataaccagcttgcatcataaagacaggatcaaattcacacacaacaatattaaacttaactgtaaacaggctaaatgccacaattaaaagacacagactggcaaattggaaaaacagttaagactcagaggtgtgagacccatctcacatgcaaagagacacataggctcaaaataaacgtatggaggaatatttaccaagcaaatggaaagcaaaaaaaagcaggggttgcaatcctagtctctgataaaacagactttaaaccaacaaagattaaaaaagacaaagaagggcattacataatggtaaagggatcgatgcaacaagaaaagctaactatgacactgaccaagacaatcctaagccaaaagaacaaagctggaggcatcacgctacctgacttcaaactatactacaaggctacagtaaccaaaacagcatggtactggtaccaaaacagagatatagaccaatggaacagaacagagccctcagaaataataccacacatctacaaccatcagatctttgacaaccctgacaaaaacaagcaatggggaaaggattctctatttaataaatggtgttggaaaaactggctagccatatgcagcaaactgaaactggaccccttccttacaccttatacaaaaattaactcaagatggattacagacttaaatgttagacctaaaaccatagaaaccctagaagaaaacctaggcaataccattcaggacataaacatgggcaaagacttcatgactaaaacactaaaagcaatggcaacaaaagccaaaattgacaattgggatccaattaaactaaagagcttctgcacagcaaaagaaactacgatcagagtgaacaggcaacctacagaatgggagaaagtttttgcaatctatccatctgacaatgggctaatatccagaatctacaaagaacttaaacaaatttacaagaagaaaacaaccccatcaaaaagtgggcgaaggatatgaacagtcacttctcaaaagaagacatttatgtggacaacaaacatatgaaaaaaaacctcatcatcactcgtcattagaaaaatgcaaaccaaaaccacaatgagataccatctcacaccagttagaatggctatcattaaaaagtcaggaaacaacaaatgctggagaggatgtggagaaataggaatgcttttacactgttcgtgggagtgtaaattagttcaaccattgtggaagacagtgtggcgattcctcaaggatctagaaccagaaataccatctgacccagcaatcccattactgggtatatacccaaaggattataaatcattctactataaagacatatgcacatgtatgttcaattgcagctgttcacaatagcaagacttggaaccaacccaaacgcccattaatgatagactggataaagaaaatgtggcacatatacaccatggaatacgatgcagccataaaaaaggatgagtttatgtcctttgcagggacatggatgaagctaaaaaccatcattctcagcaaactaacacaggaacagaaaaccaaacactgcaaattttcactcataagtgggaattgaacaatgagaacacatggacacagggaggggaacatcacacactggggcctttcagtggctggggcgctagggtaaggatagcattaggagaaatacctaatgtagatgacaggttgatgggtgcagcaaaccaccatggcacatgtatacctatgtaacaaacctgcacattctgcacatgtatcccagagcttaaagtataataaaaaaaaaggagaagaacaaaaaaaggtggcattttttcaaaaattgtattaagtgataagatgttaacataaaaattattaagatgaccaaaatacattagaagaagcagaaatcaaaggtaggcatgcagtagggtctctttaacctacttcttcttgttctatcccccacattatgcttgctctgttaatggcaacatttactcccttagtgtagtaataaatgttcagcaactgggtggtgggggtgttctaattgtagtgtttgccaattttcatggtgtaaatacatactctcaccatggctggcttcaagataccaacatgatatcactgaaaagggagttgggaagagaagcttataatcagctcttacaaatacgtacaacatggatactcttgagcccaggaaaagaaaaggtatgtgaataacatagtatcaaaagcatctagtctcttcttgagccatcagcccattcttgtcaggttcactattgggagcatggagaaatatatgaactgaaagcaaaagttatgaaggcaggggatagaaaatagtatcattaccactgaagagaaagaattgtattttttcctgtacgataggcaacatggcacacagacataacaagtctgggttgaggacggctattagagcaaaacgtgttttagaatcagaattttatattttaaaaccaattggcatgattcttgcatatgtatcatgagtgtatgattgcctatgcatgagttcagtattaagaaatagccaaaactctctgtggtgtaggacttccatcacaccaaccaggcagagaggctttctttgaatgcccgaactctgctcattctccatcatcctccattaacggagggcagttaatgcacatatctgcctgtgtggtggtaaatgcttaacaacggctggtggtgggatgggggtgttctaattgtagtgtttgtcagttttcatggtgtaaatattaatacatattctcatggtggctggtttcaggctaccaacatgatatcactgattagggagttgggaagagaagcttataatcagctcttaaaaataagtacaagctagctccaaaaatgtctatactatgtttccaagagatgaaaacctcatggacaaatactctttcgcgatatatatggttgctgtaaagtaatttttatatggttcattgtgagagtttaagtattacttcttttaagtactagaaatggaaatataatctctaatcccttttctaactgaatgaaatgttaacttcgatcatccatctgtgcagttactcttctagtaaatgtgattttttaaactttctctcctcttttcagggctacatctgctagtgttttccatttgccagctcccaacatgtccccaattacttcttttttattttatagcctccatgctgatgtttcatcagttacaactgctgggttccactgagcattaacagtctgcagtgcctctaggaggttacataattcactaagtataccaaatcattttttctccaaagaatattatttaatgtaaatacagtgtgaggttaatgtagtacaaaagaaaggtttttcccttagaatcatcaaaaaactgaaaaaaatgattcacggaagaatggtttacacgcaggaacaagaaatcacttgtatttaaggattatttcaactggcacttttttactaaacacaaagcaaaaaattaatacatttgagtacatgaacaagtttgtgttttacctattgaatcaaaatatttttaccacaagagaaggaagctaaaactaccttatgttaggcatatgcatacttgaaaacttatgatagaatagatatttgaaatcattttagtcaatagcaaagcaaaaggaaggatcaagaaaaagttctttgttttgtttttaactcaatttttcttataaatacctaattgttctccataaaaagttcataaataacctgatggatgatctgaaaatttccaggcaggtagcaggaactctctagaagtaaatgtcccagaaactttgcaaatcaaatcactcaattcttaatagatggcttaaaactgggtattacattgcaaagttttatgaaaatcatctggcaaacaactgtcttttcttcaagatgtaaacaatgaaacaattaggtttaaactgtctaaaactatgtgctcaagtgtccccttttacatcagagtctaagtgggacaatgatggagcagttagaattttctcaggtagtcagatggggaaacaggaaaaggatgggaggaggagtaatcattcaaggaaatttttttaaatgacagtatcaatattgaatatttctggagtatcaatcattatagtatgcccttgacatatagaatcttctccagtccatatacactgtgaagtaggtattacctatccaattttatagataggtaacaggatggtgagttgctgctcagggtattaagtaagtgaccaagatccagtgcttagctaagtcttgtcttcaacagtgtggagctggggctgggttgggacctctgtggtccaaagccccagccacttgacttcatactgcagcttctggttggtatctatggcatctatgagtctgacagctatattttcactcattttcagtcaaatatttatcaggcatctacttgagccagacaccatcctaggcagcagggcccaataggaaacaagacagaaaacaaaagtaaaaaaaaaacttgtcttcatgcctttggggtcttctttgtagttgagagagaaagacaattgtattagtccattttcatactgctataaataaatgcctgacactgggtaatttataaagaaaagaggtttaattgactcacagttccacatggttggggaggcctcaggaaaattacagtcatggcggaaggggaagaggcacatcttacatggtggcaggctagagagagcaggtaagggcagggaaaactgccttataaaaccatcagatcttgtgagaactcactccctatcaggaaaatggcatgggggaaccactcccatgatccaatcccctcccaactggtatctccctcaacacatggggattataaggattacaattcaagatcagatttaggtgggaacacagagccgaaccatatcaacaataaaacaaaataaactagtaaagtatttagcatgttagctggtgataggtgctgtagagaaaacaaagcccggaaggagcgtggggagagtaccagggtgggtggtggaggaggttccaacttgaatggtgtgggcctcatggaaatcttgtaaaaaccccaagaagatgagagagcaagccctactgtacaagttcctggaagtaaagcacatagggctgagggaaatgaagggcagagcaaccctaaaaggctagaagaaaagtagagagcctggagtggaatgaccaagaaaaaagcaggaggaagggaggtcagagaaccacaagcgcggtggcagatgatgcagggccttgtaagccaccatcatagttgccatctcttctccaaggcaagtgagcaggttgtgaaccaaggagggatctctccccaacttacgctgtaacagaatcatttgacttcggtactgagaatcaaccaaaagatgtgaagaaagaccccttatgagcctgccacaataatccaagtgacaggtgacagtagcttgggcccaagccatagtggtggaggtgatgaggcatggttggatgctggatgtaagactagacactgccatggctatgcagtttgttctgccactcagttgtttggcatgacacaaactcacaggaggaattttatataaaagatcgatacaggtgagataagatctccaattcttaaacagcagagaaaatcaaatgttaattggcaaataaaatgccaagaagatgtgcttgaaataattaaaataggcaaaggattgatcacctaaaaatagaagcagaaaacaaaccccccctgacagttttcatctctcacagttaaatattaagctttcctcttaagagtaacttggccaggtgtgatggctcacacctgtaatcccagcactttgggaggccgaggtgggtagatcacctgaggtcaggagttcgagaccagcctgaccaatatggtgaaaccccatctctactaaagatacaaaaaatatttttttttgtattacagggtgtggcctgtaatcccagatactcaggaggctgagacaggagaatcacttgaaaccaggaggcggagactgcagtgagtcgagatcatgccactgcactccagtctgggcaacagagcaagactctgtctgaaaaaaaaagaagaagaagaactttgtatttcctactttgctctacacatctacacatagaaggtattttaaatatttatggtttgttgattttaaaagaggctttgttaaaacgaaagtattaaacgggtaaaaaatagaaccaagtctgtgtgacaatacactagatttcaaattctcttttgcaagtatttattgaacactttctacagacaaggtacaatgccagatattagggatctgaagagaaaaatcagtaaacaaagttatttagtgcaaggacaacataaacaataatgaaaaaagaaagagataaactccagctgaaaacataaagaccacataggacctgtttgttaaatataagattcacagaatacagtgcaaggccagggaataaatgaaaaacctacaactttgatgacttattgtaggaccaggcatattacttaacatccccgatcctctatttcttcaattacaaatgaaatataaaagtatctcttaaaacatgtcagcagggtcaaattatataacttagaagataatagggattcaatatagcttagcattcttccctaattttttttaatctaacctgcaattacaatataggcgacaacattttcagagctgaaatgcgcttccgtcagctacacagtcttcatgatgatgtcccatccacaggggttatatgtgggcccgtcctagtttggtgttctctttgtgtgccaaagaaatgattatcccccaaaagcagcagccatcatttgagacctctctagttcgttgatttcaaactctgttactactgggatttaaactaaagctttaagattgaaaagaataataaatacagcaggctctcaaaagggaaacacttatcttgtgaaaaaacaaggttgtttttttttttcttaattctcaatgttcattctggaagattcaaggttatctactacctgtttttcttcctctccaatgctcaactcgaaagttgttcaaaaggttcactggcatacataagcctggaccctatacatgcttcctacgtgaaatatgttcttacttaggaaaaatgccaagctccagtaactgtgacctacataaattctaaggtgcaacgtaaggagggcaagcaaggcattactgaattgtatatgtcacgccatacaagctgatgtgcagctccctcaaagtctcaaaggcctcaataattgtaaataaacaatgtccttgagtccaaaaagactatgacatcccacaatcaaagtattaacttggaaagcattgcctactttgtattttctagaaatgtttcatgtgttcatcaacagcatgccagtcccaatgtaagacacaaacacagagacattcagtccatatgacataaggttgaaatcatcctaattgtcgacatgagaaaatgagaaagcaatttgtggcatctaaatacatgcataatttttatcccgtctggtttttgctctggttctgtgcaacctgaaataaggagagtgtgcaactgcttggtgacagattgcacagggatggaggactgtaaatggatgaatagttggaacatggttgaactcaggaatgaatgaaccagactctcctgatgaaatggctccactctggagatggagcccaggagagatgctgaattcactttttcacaccccagggatcaatttggttaataacctctctgctgccttaaaatcacttgggaacacctgaacaaaatacaaattcaaagcaagatcttcgaagcttagagaaactgaattgaatcaggaggtgaaaatcttgaacattgactatttcagctactatacacctatgtccatccaatttcatcaagatgctgaaaaagtacttagggtaataagtatgaaaaatgttacacttcttggaaaaccagtgcttaaatgttcagtaaatgataccttgtttctgaatttccctagcagcactgaattcttaatcattcacttatccatttaatcattcaaaagaaatttatatcttcactttttctcctgattgcatggtaatacctgcttactgtaaaatattcaaatgagatagtatcacatcaaggagaaagtataagtctctagaaattccagaaaatgtgtatttgttaaccactacattctaggctgtgtgctagaggtgccacagagttggcaaagtaaatctgaaaacattcctgtcctcaaaaagaccagagtctagtaagagagatgataacaataaaagtactaaaatatagtacaagaagtaatgcaagtcataaaaaaggtctgaataaatgctataggaggtccaagaaaaagaaacgtctgctacctaagaatgtccagggaaaacttcctttgcaaaaagaacctgtttctgccatttccttgaccatacaactccacgtgttgtgttacttatgagtcctctgctcagtgccgaaaagatttccctatactaagatctcagtgcttcgtttaacttgtacaaaattcccaaatccacattcttacaatttccccaaagattcagcaattctgaattccggtacacctcctaacagggtaaacataaagaaatcatttgatcattagttacttaccattatcattgttcacagaaattggggaaatggaaaactataagactggaaaaagataaatgttcccccaggccctctcaaaaaaataaaaattttggacaaaataaagaagctctaggttaggaagaaggataagaggcacacgaacacaggagcatgccacacacatttaacactcaatacacaagagctaaagagaaggctgtgtagggtcaaagtgagtttgaaatacataaaagctgaggctatataaaaatctgcatttacgataactcttctaggcagggaggttgttgagtacagacgaaaagaaccaggagaccagtggtgacagaggattctgtctttgagaagctgggagaactggaataagacacttaaccctttgggtttcatgattctcattattaaaataaaataatgatcctaggcctgtatgaaattcaaatgagataatatatttgaaagcattttacaaaacagttcataatgtattttataaaacacatagggttaaagtagttggccaaagttctaatgaaagattagttgactcaggacataaatctgaattttccaaatgaccaatcccaaattgttacctctactatcccttagaagtaaaaaaggatttaaacaactcaacaggtaaaaataatacttcctccacaataaataccatatcatattcccctttgttcctccagcatctacacagtgctttgcacagagtgagtactcagtactctagaagcaaaactcatctttctcctactctaccttcctatctcttagcaactactaattttctgctgcatttttagtggacatcagcatcagtaagttgccatcccaaggaacaaagtcaaattggcaaaaaggtggatgggctagcatccatctttggttgttatcaaaatattctccttcctcagcacactcaagtgaaggccataagtggactgtctgggccgaaagtctccccatacttccaccactcttgtatcattaaacattcttcgcagccttggtcaggagaggactgcgtggatgggcactggacatgcaaagtggcccaggtacatagcagtcttgtcaagcttggagagtagtggcccactcttggccccaggccactgccatttgcctgtcatttgtaagagcacagaccagaacatgagcccagtctgctgtgcacctcacagcaacatcctgacaattctgaaactcaaaaaaggtttcgttgtttattgggtataagccaggcaggactgaaaaggaattctttaaaggttagtggtgcaatactggataagagctttacacatcccagtcttccttccttggtgtcagaacgggattaacaggaagactggccaacagatgcccagggtaccaatctaagagggtactaaaatagccccagaaaactaacacaatgaagaaaacagcatttatcagaactttcttcaagaagggaactgggtttcattgtaagaaatacttcgataaaacaattgaggtagaatagggatgatatgctttgaaaaaactaaaaacaaggccaatataatgctttcatgtagggtggttccaacaatcaaagggctttcattttgctaagctgagtatggaggccaggacactgtaatctgttgtcatcttcctccacaagcagcactactcaaatctgttacttcacttgattgctgaaggaatactgaattagtctgcatgggccacccacatgtcttagttgagccctacatgagatcaccagttctcagaaaaggtctggctgttctgtttcagttccccagtttccatttcttgtctcccttaccttattcatccatagacaattcaattacaaatatttactgaacacctgctgtatttcaagccctgggaaggaagagatgagcacaacataatcttggtgccagataaacacatgtcctagacagacaactaagttaatataaggcaaatggatgggagctctatgagagaaacatacaaatgcaaacatggggatgccgataaggagtgagggaatgccttatggaaaatgtgacatttacatagggcctcttaggattaggaggagctgacaagtgcaaaagaaggatagagaaacccaagggtgttgaatgaagggcacagtgacttgagcaaactgtaaagagtccacagtgaccacagcacaggcaacatggttaagagtgcagaagatgaggctactgataaatgtcagagccaaaatttgaaaagtctttgaagccattccagaacgttaagatcttactctggaagcacaagggagctatcgatggttttaagccagaagtaaaagaaaaaaaaatgtggtagatttgtgttcagtgaaagaactctggcagaaattgaaaactaatggatagaaatggggtgtagggagtagaagcagaaattgcagtggcccaggatgagaacagaatatagaaaacaggcatttcacaggcaaaaatcaatggtagttggcgactatagtgcatagtgatgaagaggaaagagttcctgtctcctaattcattcatattcatcctttacatctcagatcaaatgccactttctaaaggaagacgtctcaaaccccaagaataaattaggtccttctggacatgctcacaaagcacattggacttttcctccacagcattgacctcagtttataatgctatatttctgtaataaataaaattaatctctgtatctgctaccagattgtgaacctcttgagggtacaaccatgtctgttttgtggttcctgtattcctagtatctagcttttagtaggaactcaaaaactatattttggaagcaataagggaaggcacttaaggatcacataaagacttctatactgcaatgccaggtagctggtgatcccattaactaagacagaacatagaaaaagaggaaaaggggaaaatagggagaagaaaatgaattccagaataaacaaggtaaattggaaaaatcttcaagaattccagatggagatttcaaatagcttgaaactcagcagtcaatccagagattatagatttaggaatcatctatgtagtggaagagaggagagtcactgctttactcgggttaagtatatgactccagaagaaaagaggctcaaagatggagccctgaagaaagccagaggtagaatccaagcaaactaaataatacagcaaaaatactgggaaagaaagtctgagagccaggagaacaaccatgagagggttgtattttaagaggtcaaggagccaggcacagtggctcatgcctgtaataatgccagcactttgggaggccgagataggtggattaactgaggtcaggagttcaagaccagcctagctaacacggtgaaaccccatctctactaaaagtacaaaaatttagccaggcgtggtggcaggcacctgtaatcccagctactcaggaggctgaggcaggagaattgctttgaactcgggaggcggaggttgcagtgagctgagatcgcgccactgcactccagcctgggcgacagagtgagactctgtctcacacacacacatacacacacacacacacacacacacacacacaaagaggtcaagggaggtagagctcaagaaagagaaagtgcttagtggggcccaatattaccaagggtagggggttggctcataagcctcagaaagtggtgggcactgggattcaggcagtgtctatttctaaagcaagagatcccaaactcccaaagaaaagctgaaaacagtgatgaaaacagcaggtgtgcacagaaggaaactaaaaaacatgcaagaaaataattattcattcaataagtatttgttgagcttctactatggtccaagcattctatattggaagtatagcagtaaacaggatataatggtctgtgggcccacaggatttaagagcagataggatcaagatcaaagaaaaagagtctgacttcaaaaagctatgagacatctcttcaaaggaaggagaaatgatctggggctaaagattatatgggcagagtcctagaagtatcaagaagacagaaaattttagggttgtcatgagttgggttgccctgaaggcaaaacctgagacaaggacttaggtgcaggagtttatgtgagagatgactccaggaagcagagatgaggaaatagggtgtaaaaagggaagagcaaaagccaactaagggtacattatcaagtttaccacttgccaaaccagcaagaggctggtttggccagaacctccagagaagtacacagcttgcctccagaactgttcacctgaatcgcaaaggccggagcacttattcacatgttcaaatgcccagtggctgagagtagcctctgagggcatttattcccacagacgtccaggctcctcttcagcccaggccatgcagactcccagcataagagatgcccttggggaagaaagcagaaaagcagaaaagtaggggctagaggtgggaagctgacttggacaaaactggtcaccacagttgttgctgaaatcagagataatttcacagagggactgtgaaaatggccacaggggcatctgccacaaaggtagtgttggtgagaactaggtggaaatggctaatcattcagcccaggctagttaaggagaaaaaaaaagaatgctaagagaaagtggcttgggaagttttctaaggtctaagctttctttcaatgatttttggcctctgcataaaaatatgaacttagggacttactaatagctcaaagttaagatcatagagaaggcgttgtactcctctaggtcaagggcatattaaccactgatatttattgagcacttactatgtgccaggcactttatagtcatcatcaaataaatcatccctgcaactgtatatactcattagtattgttgttcccattttataaaggaaggaactgaggcttagagagtttttaaagcttttaagatctatgaggtaacaacctatttcattttaagtgtatgtcaataacccacacttgcatccttgtgttcgaacacacacacacacacatacacacacacacacatacacacagtaaaatcagatatgaggaatttctggttttactagagaatttagtttatttatcttccctgtctatttcttcattacatggataatgaagcacttctagactctttaatgaatacatttatttaaattttaaaaaatttataccaattgatcaatgtgttttcatcaaatacgtggactagaaatacagaaaataaagatgtttagatatagaaaactgagcaaaaaccagctacaaaataccaccaaaagcacagagctagttgaagtcaaaaaaagcatcataaagggaaaaactaaaagcatctaaatacagaacaaaaggcaaatctgattgaaaacttgtctgcatctttaatttggaggctcatgatcatgctggaggtaggaggcaaaatttaatttaaggagaattttggccaaccatcgctattttctttaacacaagaacaaggagggagagggaatgaggtagacaacatccacggaggaccaggtgaaggaaaagcagagagtgatcatatcccatatccccagacacttggattagcctcagggaggctggttaggcaatgccaccaccaccaccgtcaccacgcccccacccccctcacccgacccacccgccactcccagaataaagctggtttgtaattagtttaggctgtagaggcttgtatcattaaaataatgaccactgggcatttgccacaaccaagataatgtttcataatcaaattaacttggctcaaaaacttgatttggaacctgtttatggttagtcatcaaacagctttcggggtgcttgaagcataagatatgcaaaaaactaggtaagtagtgcatgaacacagaatcagaggaaaatgtggctatgttttagtcacagagtacttacaatgggggttggaggtaggaggacagtgactatacaagaaaaggatttgaaattgaccctcaaagaactgaatatctttttaaataaaatgacaatattaaaaccacatgcttaaaatacgtacggctaagtgcttcagcagagactgggataccagatcctgagttcctcaaaggcaggagtgtccaagtcattcacttttgcttcaccggagcctaacacattgcctggagcagtgttggtactcaggaaaaccttctgtcgaatgaaggactatcatgctgttataataattaggagaggacaacatagaaacatggaaaacctttttaatctactggaaagtgaaaatgatatgtcaatggattgcaaccatgtgcaaaaacaggtgtgtttgaggacaactagaagataaggtggcaaaaatgaaaacactggtgtcaggtgttaggattctgcatgtattgttgttgtttctaaaactgcatttaatgttgtcagaatataatctttgtaatttcagaatctagagatgcttccatgttggagggagggaaggaactggatactcaatgaactgatagcttacaggcaaaggttcaaactccattgcttagcactgcagactctttgtggcacagtccccaagaactccagttttatatcatatccctgctccttccttcttccccatcacactgaatagtttgccttttctaaaacgtatcataggtttcactctttttttttttttttttttttttggtacacactcttctcactatttgtaatgcccttgtttccgtcccttcttcatatggctaaatcctacccattcttcaaaacacaactcaaatatttcccctctgagaagctgacctgattccccacaccctatcccagtctcaatttttggccacgtctctaagtttctatagcaacttatgcgcttacctctttcagagccctgtctcactatgctgcaatcactggtgtacttgcctttctcctctactagcctggatgctacctacagataatgtaaagatacctggggctacaaaggccagtggatgacccactgtcttttttaccaaactgtgacagtgtggtcacttagtcaagactcttttggttgcaagtaacagacatccattgaaactgctttgagcacaaaagggaaatttatttataaggacatagagatacttctcagagcccaaggttagaaagtgcagacactgaggtctggatcctggagctagaaagcctacagaatcaaggcagctactctcttagtcaatcagtcttactctctccccatacccacctctctccctgcagcctcacacagtcttttaatctgcatatctccagaggcctgttgtattcctctctctttctttctccctctctcttgctccgaaagacagttatacagtggctacaagtatgagctcatactacctgtgttcatgcctggctctgccattaaccaactatatgaccttggataaattacttaaccgctctgtgactcagtttcctcttctacaaaatgggaataagaagaggtcccacctcataggagtattacaaggattattgaattaatctaagacatggcttcccactgctcccaagtttacacatctacctagtctatctacaaatatgtcttagtccaagaccacacttctgagaaagacaacctggctggtccagcttgagtcagctgtggatctttgatctactgagccacagcctgggagccaagttaaaaacctgatcaccagggcccatccttgaagataaagtgacagttcttagagaaaggggccatgggctgagcagacaccagaaacaaaaacctgctacagccactaactaaccatgcagccatgcttgtgggcctgcctaggattacagctgggccttttcacctcatggccctgagcaaggctcgtatttaaaacacacagctgcctgtcagactgcaatgacacctaagggagctccacacactggcacttaataaaggcttaatggtgatgatggtggcgctgacaaaaatgacggtggcacaacaggccatgctattgcttcccagcagttctctgctgggccccgtggcttgaagttgaaatcagcacatccttctaactcggctaatgtggcttggctctggggccaaccctcatcagatcccatccaactgctagttaggtagatttataccccactaaatccattgtcacacaagggcttcctcctcactgccagagtgtaaagaacatagacacagcatccaataaccaaaggaggaaaggcctccaaagaaaattaaccatttgacttcaaaatgttatgctgctgctctagaatttccaaccaaatgaaatcagctgaaggtcctgcatctttaaataataaaaaaataaagaagaaccacagctgtgggcccttactagcccataaataaagccccgtatgcaactctatatcaaactttttttttttttttttgagacagagtctcactctgtcaccaaggctggagtgcagtggtgcgatctcggctcactgcaacctccgcctcctgggttcacgccattctcctgcctcagcctcctgagtagctgggactataggcatgtgccaccatgcctggctaattttttgtatttttagtagagacgggatttcactgtgttagccaggatggtctccatctcctgacctcgtgatctgcccgcctcggcctcctaaagatcaaacttattttttattgcagtataatctctttaacaaaaaacaagaattgtagaccagtacatctttgctatgaactgaatgtctgtgtcccctcaaaattcatatgcagaaatcctaacccccaatgtgatggaattaggaagtgggaccttgtttttagagatgggacatcaattccaggaccagtatcaagatctcacatcattctctttcacaaaaatagtctgcctttgaatttttagctctcggtgataagtaaactacacttattgtagttttttgcttgcctcaaatcctttgtagaagtaggctggaaaataaataaataaatagaatttcctctatgaatttgaatagcagagtatgcatgtaatagacgcttcaataaattttgctgtagcatgaagaccaatctcattttcaaatggtgaatcttggctcatgtatatgtggtactataatcttacaagtagggtttgcggtacacatcactttaaggaatgctggtactttaagtgaatttgaatagcaagagcggtctaaaatcagtcaccatcactgagcacagtcatttgaaagcctgaaattcacttttagaaaattcatcagaaaaaaagattcaaaaactggcaacgttcactcacagatcaaagacaacctaagtatttaactcatcatcatctatgaggataacgacttttaacagctgtccatgcaagagaaagcaaaaaaaaaaaaaaaataagaaacaatgagaggcattaaagcataaaggtcaagagcactttgggggcagccagccctaggtcaagaagtcctgactgtgtcatttaccagctctgtagctttgggcaagttgcctaaacactctgaacttattcagtcttccataaaacatttaaataatagtgatacctatcttattggatttctatacttaataaacaatgaatatgatgatgacgatgatgtctgcttttactatgaggaaaatgcattcagtaacaaatataaggaaaaaaatatagaataagtaaggagactctttagctatccttatccactaagaatacctaagagtttgtagtaactggcaagggtgtatatataaccagcactgaacatatcatcctttttgctattagagagtatgcaaaagaggaaatataaagaacggctttgctttgatcataatcaaagggcgtgggtaatctccttgagggcaggaactatctgggtcctattaacctagcacagacagtatcaagtagcaagcatacagtcaaagcaccaaatgaatgcaagaatgcctggatacaccctgaatatgactacaatcaaagcccgaagctcttggtaggtttcactggcctctttccttatatctagaagaacgtcctaccttcctggtcatagccaccactgaaataatgaaaacaaaataacaaaataatattttaaacatacatagcataccagttcattaaaaatagactagggagtattttacattgagacactagggagcatcattactttgaaatgtcactttctgctttaattagtatgctctaatgataagtatatgccattcttatctaatgaaagtcttgaatacatacggaatctggttcacagtcctcgctgggaggtacacggatgtacaaagaagaaacagaatgcatgtgttgatgtcaactagtttgcttacctttattaacataattgccaaagtttcaagttttacaatttgaggatacatatgttcaacacacccagaacacttggcacagtcatctgatcacctttcacatttctcaagacagcctaagctgttttagggagatgtgaagtttccggtgatttctttcaagccgactctcgggggtatcactcagaacaggaccacctgcttggtggcatctttttaataaagacagcaataggtctgcttgctcacagggaaatttataaggctgtctttgcttccttccacctattgtggtgctttatccaagtagaatgtactcagtcttcggagcttcaaagacactgataatggacttcttttcaaagagaagtcttagtcatccgctcctttcattcaacagtcagaataagaaaggcccagagggatacagacaaatacctctgagctgcctgttgtggcaatatcagataaagaaattctgtagcccagagagatatttgatccgttcatttgaaagtcaatactaaacatccttcccagccactccacccaagcaatgagaatgtgtctcagaaacaggacacagaaactatctcttacgatgtagcttccacttcttttttctagcctgagtgggttgggttgaggaaggagagaaagaaagaaatcaagaaccaatgttctctgctttgtgtttccctgattcagtgaaaaacggaggtcatttatagcttcttcaattggctgacccagaggaggctccagctttctcaggattgtaatggcaatgacatttctcaaaatcagttaccaagttcgtaccagttcccagcaatagaatacttggttactcagggcttctttctttgggaaatctgcatcaccgggatgactgcagttcacccaggccctacaatgggttctcatttactactcaagtttcatgcagatcatctcattcacacaagcctacaggaccaatctgcctcccagagccatggctctgcaccttcacaattgcaaagcaatttctcagggggagtcaaagcttcacttgctttttacagaaatggctcatggagatattatcttaaaatgctttctcttaaaaaaaattttttttttatctgagaattgcatgctgtgctgaaataggatggtggtgggttctgattatatcttttttccaattttggtttcactcttaagtatagaaaatatcaggttgctctctcctctgattcccttttctcccagggactaaaactttagtctgctgagtcaaaagtaagctttggtattaaattccatcttttatcttttttctcccaatatctaagaacaatgtgattatgcatcattttgtactacagaagtgctgctgagaactgcatgcaaaataaatcaagtcaatgatgtatttgaatgtgactctaatcactgaggtgggaaaaagataccagggttctactttagactgctaacctgctgtgatcaccttacctcctcttttaaatgagtgggctggaagtgctccagctcatgtctaaaatttagtgtgcttcgctacctcatggcataacaataggatggaaaaccatgcaaccattaaaagtgatcattacaaaaatgacatagaaaaagaaaaaataattgttataatatttaataaaaaattattccacaaattatctgtacattaacatttttcattaggacctcttaagccatgccattatcaaaaggggcaattcaaacatatcaagagtatctgttaatatttaaaattaggctgttagcctgtaatgaacatattttaggggaaaagctagaagtctgacacatagaaagaaagaaagggaaaatattaacctacaaaatcctttaaaaaggtagacttaaagctttttttcactatcttagtgaagatcgttaatatgtaccttacagtgtattttaaaattgtgtttctttaccagggaatttttttttatctttagtaaatttcagatttgtttcttacctgcatggaatgttacccttcccttaccacaatatgacaaaattaataatagccttacaaattgtgaagatacaagtttgagggaaaagataccaactgctttttaaattacaataatacatgatatcaccatttcattttatttaaaagaaatgttttacaacagaaatcatccaaccaattaacagggaaaaataagatggtgacataatccttaggaaggattactgggaaagaaaaaaacagtcatgagtacaacttggtataagtttctaatgtttatgtatagtgtatgtttatatgtatgtataatacattataatatacatagcatataatatttagagtgcatgcatattatgtgttttgtgttacgtgattgtttttgagagatagttgcttacactattggaaaaccactggtcatttggcatttctaaacagttatggtgctgcagaggaaagcttttgaccagcctttgactagccttggtcttgtcgttatttagcattcagatgtgtcaagaaaattaatacctaaaaaaaattttctggctgggcacagtggctcacgcctgtaatcccaacgctctgggaggccgaggcgggtggatcacctgaggtcaggagttcaagaccagcctcaccaataaggtgaaaccccatctctactaaaaatacaaaaattagccgggcatggtggcaggcgcctgtagtcccaactactcgggagactgagacaggagaattgcttgaacccaggaggcagaggttgcagtgtgctgagattgtgccactacactccagattgggtgacagagcaagactctgtctaaaacaaacaaacaaacaaacaaaactgcagatctgtttttggagttttaaagtgaaaaattgcattcttttgtctctagtagtgtaatattgacagtccaggcaattattgtcatgctaacataataaatgaattacctttactattctattgccaatgtgcttttttatagctttatttagatacatttacaaaccataaaattcacccatttaaactgtacgattcattcatttttagtatattcagagttgtgcaaccaagaacacaatcaattttataacatttcctcatcccaaaaagaaagcccatgtgcattagcagtcactccaatttccccgctacccctgcagccctattaatccactaatctactatgcatatggatttgtctctgttggaaatgtcacataaatggaatcatacagtatgtgtccttttgcgactagcttctttcacttaacataatgttttcaaggttcattcacattgtagcatgtttcagcacttcattactaattatggccaagtaacattccattataggaatatgccatttttgtttatccattcattgtagatagatatttgaactgtttccactttttggcaattatgaataatgctactatgaacattcatgtacaagtttttgtgtggatatgtttttaattctcttgggtacatacctaggaaggtatagaattgctgggttatatggtaactctatatttaacattttgaagaactgtcaaactttttccccaagtggttgcaccatcctacaatcccaccaaaacatatgagggttttaatttctccttatcctcaccaacgcttgttattgtcttttctattttagccattctagtgtgcatgaagtggtatctcactgtggttttggtttgatctaatttgacttccctagtaatgagtgatactaagcatctcttcgtgtgctattaaccatttgtatatcttctttgggaaaatgcctattcagatactttgcacatttttaaattgtgttatttgttgttttacagttgagttgcagaagttcttaatatagtctagatactagtccatcaacagatgcaaaattttctcccatctttgggtatatctttttacttttgtgatggtgtcatttgacacacaaaagttttaagttttaacaaagtctaaattatctattttttaaattttgtcacctgtgcttttggtattgtatctaagaaacctaactcaagatgacaaagattaattcatatggttttgccaagggattttatactgttaccttttaaatttaggtctatgatccatattgagctaattgttgtgtatggtgtgaggtacaagtcctaattcattctttgcatgtagacatccccagttgtcctaacaacatttattgaaaagactaatatttctcctattgaattgtcttggttctttagttaaaaatcaattgaccataaatgcgagggtttatgtctattctattgatctaccttttttgttagtaccacacagccttaattgctatagctttgtagtaagttttgaaactagtaagtgtgagtcttcaaacttctttcttctttttcaagattgttttggctattctggatatttgcagttccacatgcaatttaggatcagcttgtcactttctggggaaaaaaataaaaaaacagctgggatttttaaagggattccattaaatacatagatcattttggccagtattgcaatcttaaaaatgttaagttttctgatccaataacatggcatatctttccatttatttattctttaatatctttcaactactttctagttttcacatcttatacttctgttaagtttattcttagatattttattttttggctgctattataaataagattattttcttaatctcttttccagactgttcattgctagtatatagaaataagatttatttttgtatattgatcttgtatcttgccacattgctgaactcgtttagtagttccaatagttttttagtgaatttgccagtgcacttttaacttaaacttttaaattattttgtccccatcatacttataaacatcagtgtatgctactactgtaccacaattatccacaatattgagcaattaaatcctgtctgccctaagctctcattcagtcccttcaattaacccttcaggctgatgatcactctccacaggaaaggagaaagcacgacataaaacaaattacttctttcttaatcctttctatttctagtggttagtaaaaccatacagagtagtaaaatgaaacatatgctgagctactgaaactcttctgcctagcattaccttgctaaaatgaaatcaagcaaaatggaaccaaaagtggattttgacatttcatattttgctgaatactgttagggctctggcaatcactgtctcttacatacaaattaacagcctaccatctgtcaagtgttgggataatcacagggtttagtgcacaatatggttattagaatatgacctgacaaaaaggaaaagaacacaacctaatttggactataaaatctatgatctcacttgcaaacgacagtttgacaagctattattctgcattttggcttctacagtaaaagcagttttatgcatacgtaattctgttatacaggcaacagcccatagaagattgctttaaactacagaatctgcttggtcatacaatattttttaactaattcttagacaaatatttgcaccatgaataagtaggaatgtaatgatctgagccttcacatttccaagtgaagcaccaatcattaggcaaaaaatgtctttgtgatattgctgccagcagttccatagaattcctcagggtatatgcaaagaaactactgtaggaacttattaaaactattcacatggacatacatcaaagtcaaaaagttgacagttttgaaaagtgtaatatatgaaacactttggtgtggaatttacttcatccccaacagtgacatctgctaatgagcatcattaatattgcccacttttatttatccaaatgcctcatgggtgatatctttatgtacattcctctgtagcaccttttgtttccacccagtggaaataaatcccatactgacagctgcctctaataaagatgcttccaacaaaactcttctggttacagagagaacacagagtaccaagttctttttgttgttgttttctacctctcaaaacagtgcagaaatgagtattgttcctgaaggttatttaagggtacacccagtgtgtctaaaatacatgcctaagacagaaatgtattaattaagtctcaaggcaaaacgttctgttgaggcgacaaaacaaaacagatttttaatattagcagttatattacctagggagcttaggcgagataataactatataatacattaggcaactcacactgcaaattatgttgctttgttttagactacacgtttttccattattttcatacttgtttcctttgacggtagaaaaaaatgatgtatttttctgtcatgttggctcactataaggtgagtcagagtgccaaggttcttctgcaaggaatcttgggatccaattttaatatgctgcaatatgaattttaagaacagtgtgtgatgaattgtcaggctgcatgatatccccaaatttcccagtattgagaccttcatggctattccccgaagataacaaaaaaaattcgatcaagatttatagaagacttataaatgtatgaaaatataaaaaaataatagttacatccatgggtttaaaatgattcccctacagtggcaaccctgtatgaaaatacaatatgagatcagggagcagaaaaataaatgaagtaaagatttagggagaatcatggcaacttattcatttacaggaaagccagttcctttttcacccttggaaaaaactacaaacaaattccaagttctttctagctacaattgacattatcatttggccagtatattcatgataaatgttctaatgtgaaggcgatccatcataaatgtaatttcaaaaatgaacttcttattttaacttcagaaagaattattctaggattcaaaagtccagttaaatacatatagaaagaaggatagaagggagaaaagtttaaaaaaaaaaacaaaaaactatgcccagacaaaagactggaagaaagttatttatgtgatgagactatcgatgatttattttcttttaatttttattaatgttcgaaacaaacacacatcatcttttaatgaaaaagaaattctatatgaattattttctctctatggtatatttagagggataacttatatatagtaaaatacacaaatcttaagtatatggctccatggcatttcatatgtataaacccaagaatcttccacctaaaacaaagtatgcagttatttccagaaaattacctcctgatcctttctagcaatagtctcctagctccctatttttctggcttctagtatcattgattccttttgtcagctattgaattttacacaaatggaagcatacagtatgcattcttttgtttgtggcttcttttggcaacataatgctttcaagatgcatccatattgtatatatttgttgtttgttcctttttgttggtgagtaccacctcattgtatgactatgtcacaatttgtttacaatgatgtctaaggatagacatttggattttctcaagtgcttggctattataaataaaacttccatgaacattcttgtatatgtctttttcatgagcatatgcaataatttctcttgaattaatacaagggaaaatatacgacatacagtttttaactttaaggcaaggtctaatatttccttttatggttattttattttaacagtatatttaaaaattcataacttattggtttcaatctaaggaaaatgtaatgaacaaaattcagagcataaatttgtaaaatctcatactcctagatgaagagttcaaaagaagagaaagaagttatatgccccagtggggactgcttcttctggatcttcatgccacaatggaaagattctcaaaggcataaagttttccatagaaacactctcaatctgttagttttaacaattaaaacttacgtttaactgaaagtatagtagagaaagaaaactaattgatgaaactaaaagtaaacctctcaaataattaagaggcaaatatttcagggctgaaaggtcatcaccagtcacagaaaacattcagagaagtgagaaaccattgaaattggaccagtggatggcagagtaatagatggtatttccatgacatctaccccatgccaggggaaaagaagagaagggtttactttgggtacaatgacaaggacaaccttctgatatgttgctaaggatcatgcctagggtgactataaataatttattatccaaaatgagacacttctgagactgaagcagggtaataaaattaaataaaagtaataaataaaaattaataagtttaataaataaaaattgttttatttatattattaaaaataatttaattttttaaatatccacctgttgactgaaaaattggttttattttactggttgacagttgaaatacagtcctattctaaaatgatttcccaaagtaaaattatttttatttttaaaaaatgcttaactgggccaggtgccatgactcacacctgtaatcccatcattttgggaggcacagatgggaggatggcttgagcccaggagtttgagaccagcctcagcaacatagtgagatccagtctctacaaaaaatacaaaaatattagccatatgtggtggtgcgcacctgtagcctcagctactcgggaggctgatgggggaggattgcttgagcccaggagttagaggctgcaatgggccatgattgtgccactgcactgcagcctgagaccctatctcaaaaaaatgtatatataaaaaaatgctaaactggacaagatgcagagaaaactggtaaaaactagggctatcctgagcaaactcagatgcatgggtacactagtcaagtgtcacctccaaccctctccagttaatttaccaaggtacctataaatggagcctaaggcactgcccctgtccttttcttcattcaacaagtaattgttgaaaatcttccatatgtttggcactgtcccaggcagagagatataatgataaatgagtccaactttccttggactcatggaaccttcaaactgtcagagaagacagccaaagaacaagttactaaaagtgtgctaaatgtgaaggaagatacagagcccactgagaggcttttacatggtagtgatcaatggggtttgtattgtcccctagagagatttttttttggaaatgtgaggagcggtggggagctctctatgttccttcttttttaagagatggagtctccctatattgcccaggctggtctggtctccacctcctcttgagctcaagtgatcctcccacctcagcctcccaaagtgctaggattacaggtgtgagccaccatgcccagccatttaactcatattttctgaggggcaacaaggccaccaaatgttcttatgtaggacaggcccacatgatgaaaaatgatcctgtatccctcataactttcaaatgttccaccagacattcacttaggtaaagaaaaaaaatattattgtctattttacataatagcttaaagtatcttttgcacattttaattttcactgaatttttcagaaatgcaactagcatttaaactgaaggaataatgtattttgttttgttcaacactttaccagttgttcactatttcagaaaatcccaccaccgacagcaatggggcttttggtacccagtctaccaatataacacaactgtattagtttgcattcttatctgtcaaatgcaaatacgtaagagagaaataggcctagcaccaaatattattaaattggccatgggacatgaaagtcaaggataccaccaaattgcattcatggaaagcattttttttatatttcattttactgccacagtacatacctttaaaaaaaatctgtagcacaatgatgagaaatctacactgtgaaaattactgattaaaattatttacttactttggatttgcttcttgtttctcagtcttacagtgaaactgtccctagaggtctcccacacaacttctttatggcttcttatattactgcttctttttccaatccattccctattccctgtggcctaccgaagtgctttttaagaactagagaccaaatgtatgcatcaacataagacatgatttcaagatgagaggtattcttcctgtgattcttcaacaccactcagtcccttttcataatatagggaatgactctgcagctacccttttaagtaagtcccactcatttccaggaatggcatacttgcctatgttctctacctcaaaactgcattatttatcttagcatgttagctctacttcaactaaggttatttccctctttttctcatcatgtatattactattaatatgtatccaaaggttagcttttattctagtatccctcaaacctctcatctttcatttcttgtactcatttcacagaatggcttgtgatattcttttcttttcttttttttttttttttgagatggagtctcactctgccacccaggctggagtgcagtgacgtgatcttggctcattgcaacctctccctcctgggttcaagtgattctcctgctttagccatagctgggattacaggcacatgcggccaagcttggctgatttttgtattttcagtagagacgggttttcaccatgttggccaggctggtctcgagctcctgagctcaactgtgaggagaaaataaaacccgcccacctaggcctcccaaagtactgggattataggcataaaccaccactctcggcctgatattcttttcttaaatccaatttcactcatatcaagtagatataagcatttgattaattcattatgtcttcaagtagagttgtgcccaagcctttacattggaatacttagcttattgtaagccacttcccttttctttcttctttatattgtagttaaccatcataccatttttttaagtatatgggtgggtaggtaatttctataaagttcaaaagagggcagttaatctgataggattaaacagttgactggaatctaatttggggcagagactctttaggctgaaacttaacgaatgggtaagagttagctaagtgaagggaaagtagatcagggagatagaaaaagaggccaaacccttgaaggcagaagaatcctcagagataacagagcagagagcttcagctagagaactggttgccaaaaagtggtaagtgaacccctggaagcacacagctgaacttttgctgataaaaaggctaactttttaattttaatagattcaagtgttttgaaatacatattagaagaacagtagtttccatttaaggtggcaaaacaatttccttgtacaattaacttaaatattagcaaaaataagctttttttaatagtaagtgttggtacaaataggacatgaatatggtaaatacatggcttctgaatgactgaagttggggtgctctgacctattagcatggaggttggagaaagaggtagagctagagatgagatgagaaagcaagggcttggtcaggcaaagtcctacaaaccactgtaattattcaggtctttgtcttaaaagcaatgaaaagccacgaaaggacttcaaacagaggaatgagaagatcatagctgtgttttataagatcagtatggcatctaatgagaaatggattggaggtaggaaagatggctgtgggtagacgagttagccaacttttccaaatgtttaattcaaagacaatggtggggctgggtgcggtggctcacacctgtaatcccagcactttgggaggctgagatgggaggatcacaagatcaggagatcgagaccatcctggctaacacggtgaaatcccatctctactaaaaatacaaaaaatcagccgggcgtggtgacacgcacctgtagtctcaactactcaggaggctgaggcaggtgaattgcttgaacctgggaggcggaggctgcagtgagccaagatcacgctactgtactccagcctgggtgccagagcaagactccatctcaaaaaaaaaaaaaaaaaaagacaatagtggtccaagttcaagtgatagcagcagagatgaagaaaggaagaggaaattgagagataacatctcctgaaatccaagttgccataaattgaaaaatagttggcttaatgatagcttggctgataacatgaagaaatagatgctaagtgagcatatcaattgtaagatattgcttcagaaacattaaaatatggaaaatccatgcttctttaaatagaggaaatacaatttttaaagggtagaaaagagtgtgtagacactaaacaaatgactgatgatagtgaacccccagttggaaaaagtcaaaattgccagatttctttggcctcaaactgctaaacatctaatgtcttgggctttattcactttttgtctttgagtgacatgacagatcattttggtgatatagatggagctcaaattgacaaggttactggagaaagtaaaatcaaaaatcctttctcaggtaaagatatacctgagtaaggaatgctgaccttctaatatcagaggcctaaaacttgtaagtggaagtttgcttacagaagacaatgttcacagcattctgaaagtcatggccaggttgttgctgttattatgaaaatggtgatttatagccaatgtccatagcctaggcctcgaggtatgtttacaatttacagtaagaggggcccagccttaaattattgttagcaagtcttgatattattttgtaaaaaatgaaatatgtaaacacatacatatcaccttttaattttatttcttaggggacaagggaaaaaacacagtttgcaactatgtatatctcctcacatcaaagtttaactcctcaagatgaatacattctgtgcctctgctcccaacttgaagaaatttcaactgctctattctttccacaactgcccattgtcttaaaaaaccccaaatcgctggcattttaaaaattaaatacagtatattttctagaaagaaaaaataattaccaggctcgcacgtggcagattcctctagccatgcaagcctggatattcatgaaagccatttctcacttggctcagggaaacctcccagaatgataggaccatttacactaaatgaaccgaacatattactggagtaacaattgacattaagtatattacagctgccaggggcagtatcaggaagaatccctggatgacagaaaacatgataatgtagaaggaagaacctgcagaatcagaaaggggggaaaaacccctcataaaacaattttaaaaatatataaagaggaaatcatatttaaaggaaaaacagagaaattttgttattttttttccttctgcctgcagtagccttctggtattagacctgcaatgcatttgctaccccctaaaatattctcaacactaacaagatcagaggaaatgatttattccaccccctctcctgctacttctgaacggcagcgcgtgtccttggggacatgggatttctgcattgctttcggccatctgatattgcagctctgcagccttccctggaatgagccagaaaaatcaaaataattacattaatgctgggaatcaaagtttattgactctcccttgaggtggaaaaccaaaatgctggttacaaaagttgccagcttatttaatgataccactgcctcctccctgttcttgtcaaaacagcttttgaaagcattttcaaataaagccctcagatgcgctccaattcaatagcttatctattcccttttaaataaaagctagttcacatcatctcaccccctcaaagggaggacccgacaggccctcttcccctgccaaggcactgccaaaggcaatactcccaggcaatatccctgccatcatttccgctctcttcaggaaggttctgcctcattgaatattcttccaagccagtaagagaatctcatgcctccccaaggcagcaatctacatttattataacattcatggctgctaatgaaacttggagcagctggtttctttcactttccaacaattctttggatattcaaagtcccctcataagagaggggaacttatgagcacacccatttcatggatgagcccgcagacacagagattcaatgtggtgctgacctttgtaactttcacaggactttgctacagccctaaaaaaacagatgctaaataataattgattgaattaaactgaaggaggtagattaatttttttaattaaactgaatcaaatagaacagaaataaacaaactctagccctctccatgcctagtcaacacctactattctttcttgtttcttttttttcctttttattataaaagttttcaaataaaatgagagaccagtataatgaagctccaagtacctatccacccaggttgaacaatgatcaagattttcccacatttgcttcattcatcttctcctttttttcttcttcgttgaaatattttaaagcaagactaagacagcatgctacttcattcctacttttgtcagtgattatgctgtgcagaaaagagttaccatagaaggcctgaggttgctatttttagaatttaaaaaagtttgcaggtaggtaggtaatatctacagacttcactttatgatgataaaagagacataagagaaatagacctgcttgcaaagttgactcttggctggcatctgggaacatggatttgggaaggttgccatcattcccagaactgataagagtggctcactgtgcccgaactgtttgttcaaataatgaaatgctaaatgcctgctttccttctgggagtctaaaatgttggtatgtgctagccagagagtatctacgtgaccagcccccaataacagccttgggtgctgatgccctaacaagcttctctgttggacaacatttcacatgtgttgtcacaactcattgctgaaggaattaggcatgtcctatgtgactccactcaaagaggtctctcagaaccttgcatcaagtttcctctgaagttcaccccatacgctttttccctttgctgattttgctttttatcctgctgtaataaatcatggctgcaagtacaactatatgttgagtcctgtgagtattcctagcaaatcattgaacctggtaatggtcttggaacccctaactcatatacctaccattttttaagtctacttaaacctcactttttcacagaaacattggtgaccttggggagatgccaaactaagggaggccccggttatccattctcacagcaccctgaacttcctcttcataacatttatcgaaacggtccctaaataatgttgaaatcatttgtttgtggtctatctctccaccaagaacccaaagtccctgagacaggaattttgtctgtttggtttgccatgtatacctagcatggtacacatggtatacatttaaaattttaaatagattcaagaaaataccatacccctcctccaagtttaagaggtaaagtttatataatttcccttgcattacactcattcattcaccaaataccactcacttatggtataatctatactgtgtcccagttcagtttaatatccacttcattaacatctttctgtaattagcaacatcatgccaatgcttcaccttttaggtgagacaaagcatgactctgcaagggggctttcctcttgacactggtgactaattcatctatttgcatcacattataggaccctctttccaccttacaatcctctagagattctcctgcaaatacagactcttgagatgattcttacatgcctactaaagtttggaaaaccactgttttgggtcactcaaaaaatgaaaaggcagctataattaaagaaaacctcatggatatgattcttcacctgaatttttaaaaagataaataaaccacagactaaacataaattttgctaagcatattcaactactgaaaataccatacgacaacagagagaataaacatatattcctttaaagaaaagaagtgagttgtccatatgttgtaagggatacatctatatatatatacagattgtcttgcacatttaatgtgtgcgcagaaatgggtcaagtagattatttttttcatggtggatgaaagtaagatgtgatgagacacacttgaatggggattggcaagatttttaaagattataagctttgcgttttcatataatctaccatcctgcaaattcacttctgagtatatattaatacccaagagaaacttgagcacatatgtcaaactccatcagtgaaaggccaccaggaacaccctggtagtcaaagttaagtggttcaccttactgtagcaaaggagaaagtaccccagaggaaccttgggagcatcttagtaaaggggaattatcagtggcttcctctagggtttggggaattgaaacaaactgaagtttgcccagaagcagcagtcactctgagaaagacagtgatagtcagaagaaaggggtgtttagtcatttgtagggtcacagaatggctttgtttatgccttgttctgagtattgtttatgttctagttgccagtagagccatgttttactttctcacatatgtaccaggaaatgtgtataagaacattcatagcagcaccattcatagaagaaaatttaaaaatttaactaaatggctattgataggagtacatataaaacttaaaaaggacagggaatgatgaacatgaggttagtagttggttacctcttacgaagaggtagagatgggataaaagggggcacaaatttgtaagttattggtaatatttacttgttgggtttatgcctgttatattatgaaataaatattataaaataaaacagaatttaccatggatgacagtgagtcatgaaccaaacttataattaatctacctctgtgacctgaggtccacattattttaaaacaaacaaaaaataacaataatcattcatatttacgtttccttctcagccatacattttcttttctacttagcattttccactgtgacacagtaggtgccagttgtgtttatacagaagctacaataaacaagactttttattaaatgcaaatgtcaccacgcagtagaatcaactattgactttgtgcaacctctcatcaacagaaccatcaatacgtctagcaaggcacaggatttattgtctatgcacacctttcagagggcttcctgaaacacaactagcttccataattggtaaccaaataaaaccgcaggccaccagaagcagaatataactctctctaggaagctgtaaattaaagggagatttgtctaactaaatgtacagtgctgcactcacatgggcatttcatctcttgctctttaatggaggcagtccttgtacccctacttcacattacgaatatggtttcatctctgacagaaaggccagagcacctggcagagtcctcacatgctccctccttttaccttttccattgcattaattaattagaactgtctttatattcagtgacatttgattttgaggacatttttacaaaataacaacaccaggtccaagttcactacagcaataggatctacaagaacccaaagaatgaatgctttttagcaaatgagaacacaaagtcacatgatctttatttttaaaaagctcataaactatgtcaggcaggggaatcacattgccagacaccataaaacaacatataattaaactctagcagtccattagaagacctagtgacaagcccttctccactgctgcaacaaaggtgggatgatttacatgtagactgggaaaagtcccatgatattagaccaaaatccagcactgctgctaatttttttagactgaaatgtgattgcccaatattaaattgttaccattagtggggaaaaaatagcttattctaacaaatacttaatttctctctagctttggtgcagtcctgacttgtagtttattctaataaataatttaaaaataattttggtcacctcccatatgatccaaagtaatgctatttgagatcaataggactaacattttctatctggtatccatggagttttttatccaatgagagagaacattcaggaacttagcctgtctcatggctgaaaataggtagaatatgttaggtgtgcgtttgatacaatctgtaaataaaaggcaaattataaaagttcccctccctgcagagacgaagtcccacaatagggtgcacaagctgcatttcaacccccacccacacctcagatatgcatcttcattcagtgcacagaagactcaactgtaggggcggcctggatacacatgccatgtttcttccttgcccacttggtgtcttcacatccccttccccttaaaataatcccattagttgaaaagttcctggatacaaggagcagccatcaaagtccatggatggatttcaaggggatgaattcatttaacattattaaatgtttactttgctaattctcaatacttgtacacaatataagacatgatttcttctgtctataatatgaagtctgtgattagagtaatatttcaatttttggtttgtttgttttgacttggaattagcagtaggataccaacttaagtcaaatttactagttctcattttccctaattcagcatttgttttcatctatagaattccttttcttaagtcaggctctttggggtcatcagccccctgaaatcatgtgcaaaatgggatgcctatgtgcacatgcctctttctgtgaggatcggtacctgagaactttgatgccaagttaaaaagactgtgccttgagtttttgacactagggaatgaaggaaagtatgagataaagaatatacaacatctgccacaactactgcatattttctttctatatcacattcaacagtttattacaatcaccaggcttttcattcccataaagcaatgttcagacttcaaatgtgctaataatttagctggagaatttgagaaaactacacattcctctccaacacccccacccccacctccttagccccaagaatcagatttcatcactctggaagagaactcagatatctgcactttttacaagtgcctcatgtgattctgaggcaatggtgagagacccaagctttgaaaaacgtgccatgatctaccatcaagtaggaatcatgtacataagttcttccattagaggaaaaaataaatgtatttgtttctttgtaaagataggacgttggaaattttcacttagattactctgtaagcgacaaggaaattagaaagctcgttttttacaataatcactgttacttgacagttcctgcagcatgttaagatggctgttattgatgacacttattaccttttcccatgcaataaaacacaggaacatacagtggaagagataagtatattttaaaacaacagaaggaagaaaaataatggtagtcatgtcctctcattatttgtgtagactgactaccatggggaacagtgaaatgccttttttaaagttacactgtggctttaaattgggttaactcagtgaggatagccatgaaacaagtggctatagagatgtaaagaatgggctatttctctacatttctcttttgccttttattttccctatggtctttaatgcatttctctttggaatggatgaagttataaagttgccttacataaaagctttgcttgaaagattggtaatcacgcactttgctactgaattgtccagtctattcaatctaaaaaaggctcttctcttttgttcagctcagattatctcctttgcagagtgtaatagaaatatctgggtataaaattgagaaattgttcataaatattatggaaggctttttgagctgtttactattagaggcctgatttagcaaacagtaagcctgcttttgctgggttgggattttttattttttaactttttccttttaactgaatcatccacagttaaaaaaaaaaaaaaaagatacagatttcacagcactttcacccatgattagagcagaagaaaacaaattgctttttttttttttagatggaggtttgctttgtcgcccaggctggagtgcagtggcgcaatctcggctcactgcaacctccacctccagatccaagtgattctcttgcctcagcctcccaggtagctgggactacaggtgcatgccaccacgcccggctcattttttgtatttttagtagagacgggggtttcaccatgttagccaggatggtctcgatctcctgatttcgtgatccgcccaccttggcctcccaaagtgctgggattacaggcatgagccactgcacccagccacaaattgctatttttaagagacagttttaatatcttgtactacatttggagaagaaaaaaacatcagcactgctatcgcctataggcaactttcttatcttgccatttctttatttaaagtctttgcactgaaccagccaatgaaatgcattattctactggccagcgttctctagcagaaacaagagacagcatgcattactgagaagtcagacacatttgcactaaatcaaaaaataaaaataaaaagactctctagctagaggttaataacacaactcaatcaaaaccagtgacattttttatcaaacagtcgtgaaattgccatttggaactctaacttgctacaaatagaattaaaagtgccattctaattctgtctccttgtacaatacgaccctgatatggaaaacaaggtgtctacactgaacacatccagtttacaagagaaaaaacgggatgattttttgattctctcaaatattaggtaagtgtttaacacatgactcctgagtgggagtgccagttaaagagttgtagtacctgtcaacgctggtttaacatttcaacaaagcaaatcatcaattaaaactcatcagcaacagtcatcctgttaattgaccaaatgattatccttcttttagttaagactctacctgacacacttgaagaaatttttttctctgttgtaaaccctctggagtctgtggcacacctcaccttggcaaaccactttggttttcagattcactggaaagcccctctttgttctaagaggggctcctgaatgaaagccaagttctagtctgactttctgattgcttcttctcaggtttttttcttgcttcctaccaggagaaggaaaaaggtagtcataggccatctgttaaacttgtgtttaaagggaagtaccaaggtatggccagctggatattttactcaacatggtggatcatactcaaggtagtgtataaatggtttagcagtgaattccaccccatacttcttggggtaacatctatgctatcaagcccttaaaaccaaatccaactagctctaaaccataaacatatattatgattcaagcatttgcaggaaaaaaattgtgcttcagtataaaactttgcttcatctagaatataaaggatcccatttcccaattaccatattatcagattctgattctatgaggactaattttcaactctgtaaattatagataaatgataacaatgcaaaataattcttgcctataggcaagcaaattgtgttctgttctctggaggttcaattaatccccctaccccaccctcagaaaccagttttgccctccatttgtaacattcttttcagtattcctgatatataaatgtgtctgggctttttggattctctttagactagttataatatttggctggttctctcattataagttgacctaatctttaacatgttttcattttatatcagtatgagagtcatgatttcacctttatttgagaattattctttaatacatgtatagatcttggactaaggctatcaatttcgagacttcacttgtaggactgtgctgtactcctgtctctcacactctctgcacatgccatttcccagcctggaatgttcttccctcctccccactccagcttctggacctagttaattcctaatcttcactcagatttgggcacaattatagcctccataaacaagcattgcctaactacccctcctctctgccaagaagtttagatctccctgttatagttcttgcacttaacaccattgacatttatctgtctggattttctgactaatgtctcttttcctcactagaataatgctcgctgatggtagggaccatatccggttttacataccattgcacccagttaggtgtctggcacacagaaggctgaaacaatatttgttgtgatggggttcttgacacactaccccaaaatatggcatgtcggcatttgacaaaacagtggaagcaggaaagtctctctgaccttctcccacacttttcccctgaagcaggccataaaagaaatctctagccttcctctaaagtgggtcataggccttattcaagaggcacccttcctatgcctggaggaaaggaatgtcattatctctgaaggcacagagataaagagaaaaatctgaataaagaaggcttgctaagttccccccagtttattatctttagatcacaccccctatgtccaatcatacttctacacaactgtctgctcttcatcaaatttagcataaaaatatacaagtttccctgtttctttgagtcttcctttctccatgtcacataaaacttatactaaataaatttatgtccctttctcttattaatctttcttttgttataggggcctcagccattaacctggcaatggaaaagaaaaatattttcttctcccttgcagttgcgtacatcagcaacacagtagatccatggatcagtgaacaaattgggctatgaatattcctattataaatcagaaaaacagatctagaccaaagctgaccaaaggagaaggaaaaggagagactgcattttgatgtaagtgttactgatttgaaaaaccatggagatcgatcacctactacaaggtccaatggtattccagattctagaaaagacctagataaaaatataaagtctctgaaagtcctctcatcttctccaaagagtcctaaaatccaaaagaacctaggatttctgggtattttgaacctgaacaaaggcaaagcacaaaaagcatggtatagaagaaggcttctcaaagtgtggttcccagaccagcagtacctcttggaaactctcaggcctcatctcagacctactgatgaaatcagaaactctggaagagggaccagccatctaggtatcaacaatcgcttcaggtgaaactgatgcttgttagagactcattggcatagaacaaagatgggcctcaacaaagatggaatcaccagactccactgtaaatagctgtgaaacactgagcaagttatttaagttctctaagcctgagtttacttatgaggaaaaatggggataataacaacaaaaactatcccacagaaatgtggtaagaattttttttttttgtttcaacttttattttagattcagggggtatataggcaagtttgttacctgagtatattgtatgatgctgaggtttggagtacaaatgatcctgtcatccaggtactgagaatagtactcaacagttagcttttcaacccttgcttccctccctcactcactcctccagtagtccccagtatcaattgttgccatctttatgtctatgagtacccaacatttagctcccacttacaagtaagaacatttggttttctgttcctgcattaatgcacttaggataatggcctccagttgcatccatgttgccacaaaggacatgcttttgttctttttttatgactgtattgtattccatggtatatatgtaccacattttctatatccaatccaccattcataggcacctaggttgattccatgtctttgctattgtgaatagtgctgcatgaacatatacatgcatgtgtctttttgataaaatgatttgttttcttttgcatatatcctcagtaatgtgattgctaggttgaatagtagtcctgttttaagttctttgagaaatctccaaactgctttccacagtggctgacctaatttacattctcgacaacagtttataagcatcctttttccccacagcctcaccaacatgtgttgtttttagactttttaataatagccattctgacagtgtgagatggtatctcactgtggttttgatttgcatttctctgatgattagtgatgatgagcattttctcatatgtttgttggccacttgtatgtcttcttttgggaagtgtctgttcatatcttttgcccatcttttaatagagttacttgttttttgcctgttcaaaaaattttgagtaatgtctataaattgcctagaaaattgactgacaggctgggcacagtggctcatacctgtaatcccagcactttgggaggctgaggtggacagatcacccaaggtcagcagttcaagaccagcctggccaacatggtgaatctctgtctctactaaaaatacaaaaattagccaggtgtggtggcgcatgcctgtaataccagctactcgggagactgaggcaggagaatatcttgaacccaggagtcagaggttgcagtgagctgagatcgagccattgcactccagcctgggtgacaagagtgagactctgaaaaaaaaagagaaagaaagaagaagagagagaaaattggttgacaaagaatggatactaatgaaataatagctgctattgaatttatcattcatgtcagtagcagcagcagcagcaccatcatcaccattaccatcaccttgtctagattcttaaggcctggaacccagggttggaagaaactgttgtccttttgcctcatacatcagcaaagcgtgcatagggctcttaggaattgggcaggaggaatccaaatttgtgcaccattactgtcttctagctgatgccaccgttttttgtcagtcatttatactaaaatatactaacttagataggtacagaatttaagaggttacacaagcacttagcacacatgctatctgatcttcacaaacaacctgagagtagttatttaattcagagaagttagtggacttgcccaaagtcacattgccagtcctcacagtcatctgaagagccagacttgaatccaggtattttgattccaaacctagtgctttcttctctactcctcgtctatacttctgttttcattataccaccttgccaaggaaacaaacactcaccagacacactgtagagtaaaatagacctgacatcctttagagttcttcttggatcctggaatgtggttcttattgtctctacttacaaacctcacatttacagaagcaggctgtatttttttaacaccttccttattagcaataattggtcccttctgctgtatgtttgtttgatttttaatacacacagttcaagattaactcaaatctgttcaacaccaatctttctaaaaaccaactttccaaatatccacttgtaacacagaaaactgcagatcgtctttcctgcttccaaaatacagtcactttcataaatgttgtccattcattctagcactgagtgttcataaagcacctactcattgctaggcactatgtgaggcaatgggcacacaggtgtggtgtcttaagtaagacaggtgtggtgctttccatcctggaagtgtgagggagtctggcaataaaaaaatcaacaaataaaagaaaatagccacaggttagagtaagtgccattgcaaagcctcaacaggtaaaatgatgaagtagtcactcacattttcttcaggggctggagaagcccagggaatgactccagacagggtggtccaaggtccacttctcactcttcagataaaaacacaaacaagcatatcttgacacagaaaatctaatgtgaaaatccggtaagtggaaatatgagttgacagaatgggtgatttagaaacggattatctactttaacatgagaattcgatacaggatttttcttgagcactttcctaatacaaatacattttatatttatatccctattaaatatatactatatttaatataaatataaaagttggatgccatttataaaaattcaattaataacaaaatgaaacagctactgccaaaaacttgcatatacagacgttaaaagaaatacggggctgggtgctgtggctcatgcctgtaatcccaacacttagggaggctgaggcgggcagatcaattgaggtcaggagttcgagaccagcctggccaacatggcaaaactccatctctactaaaaatacaaaaattagtcgggcatgtgcctgtagtcccagatacttggaaggctgaggcaggagaatcacttgaacctgggaggcagaggttgcagtgagctgagactgcaccactgcactccagcctgggcagcagagtgaaactgtgtctcaaaaaaaaaaaaaaaaaagaaagaaaagaaaagagaaaagagaataaaagaaaaggaaaagaaaggacaggacaggaaaggaaaggaaaagaaaagaaaaaagaaaagaaggtaccaagaggtggaaaggaacagggagaaagaaaacagttattcaatgtttttggaggcccaagcacagggttttggcataatttatttagtccataaaacaactctgtatttagggatcatccacattttacaacaaaggaaacccaatttcagtgaggtgagattatttgtccaagatctctcagctggtaagtgacaaaaccacaacataaaaatctgatctatatccagtaactatatcccatccattctataaagcaagaattggcacaccacagcccacagggccagacttggacagcagcctcttgataccaccacaaattaagaatgatttttacattttaaaagcactgaaaaaattcaaaagaattatgtttcatgacacatgaaagttttataaaactcagatttccataccaataaataaaatgccattggtacacagccacatttacctactgtctagagctgctttcaaattgcaagatggtgttgagcagttgtgaaagaatcagtagggtcccaaggcctaaaatacttactgtctggccctttacaaaagaagtttgctaacccctgaggtagagaaaaggatccatagaaataaaagtaacaaacactctcagaaatgtgacttcaaaaatgagtgacaaaagtatgcaaaaaatggctataaaatgcacctgaaagaatttaacctaatggcagttgcctgaggcacaactttctcaatttcacctgaaggtttcatttttctggccctgtgtcccagtgaggaagacccaagtcaaccttgtgacagggatttatcacgtcttaacttgagcaatgctgtgttcccaccagcactctcagaatggaggccacacaatgtctccactcctgcattcactggctcaacttggtttctgaagaatgcgaatttagttcaaggcacggtttcaagctgtttttgttgatttcccactatattgtcttctctaaatattttctggttcaagtgcatacgctcaattatgaaaatgaattcttacaaacaacctgatctgggcggatagttaactcacaccatgaagctcaaatttgccagtacagggaaaggtatttctttttcttttcagtcttcaggctacaaggttgaaagccagaagctatgtgttataaaatgtccctagtttttcccatgttttgtagcacacatattgatctctatgtctttgccatttacttgtgtgtggtcatccccaattagtgggttattttgtacttttcaaagttaaattctaagtcaatacttagggcgtacacctaagtcaaagatggcctccaccttgaaggaaaaaaattattacatttcaacgaaaacctacacatcatctataaacacactctttccagctgtctgactctagccttgtacaatgtctttgagctattttgcaccacttcgtaagttgtagataactgatagatatatataaattctgtcttacaggctgtgattttaattgacttcctactgtggagaaaacagttttatctcaatttgcaactcatcttaactctcttttagtccatataaatttgtgccattttgacttttcctttgagccagttataacatctgcctggttctctcaaatcatataagtaaaataaaatctttagcatgtgttcatttttatacctatatgagtcataactttaccttttactgaaaattatattttaatgacccaaaagattagtaagaattcagatttatttcaaaatctatctttaaaaactttaaattttgagtgatttcacctttaatatgaatttagttggaagtaatattaagttagtttaaatcatatagaaaaatgaaatgtgatgagaagtgaacttctttgttcccttttattgcttttaaaatgatacaagacaaaaattgtgcagaggggcaagaaacaaatgttaaacaaaaattattctgacatgtgttaaaatggtaaggaagactttattaaggactattgcaatagcagtattgcaacaggggagagagatcaggttcaactccaaatacaacaaagatagatagtcagggatttatagccagtgttagagcagataaggggttcagtgggtagaaaactactaagaggagtaagggaattcttgctaaattaattcctaacaggattcttgctaaaggcaggccaatgacttagacatcaagggtggggtgagaaacttgattagacatcacggtgaccagctatcacttaaaaagattattgctaaagccaggctagaaagatcaaatacaggaatgaggtctggggccaaggtcgctagttgagaaaagggctcagaggagtataattaaagtttgggcaaggagaaaatcttcatcataggtaatagcaaatttataaaaggacaattcaattcaataaatcttgtcctcaaggaatttacaatccactgaaaagagataattaagtcaccacaacctggtcaaattaccttggttttactttgcaattaaattttattcccatatgaatctatatgtaaataatctctttaaagaaaacaaataaaatgagaagttaaagttatttctatctctgtaatctttattttaacctttattttaacttcaggggtacatatgcaggcttgttacagaggtaaacatgtgtcatgagggtttgttgtacagattatttcattacccacatgttaaacctagtacccattagttatttttcctgatcctctccctcctctctcccaccctccaataggccctagtgtgtgttgttcccctctatgtgtccatgtgttctcatcattttgctcccacttataaatgagaatatgcagcatttggttttctgttcatgtgttagtttgctaaggataatggcctccatctccatccgtgttcctgcaaaggacatgatcttgttctttttttggctgcatagtatttaatggtgtatatgtaccaccttttctttacccagtctatcattgataggcatttaggttgattccatatctttgctattgtgaatagtgttgcaatgaacatatgcatgcatgtgtgtttataacacaatgatttatactccttcaggtatatagccaagatttttccataatcccactggtattagatacccaaaaaaatcccattggtattatatacccaaaaaataccaatgggattatcagattactggaccaaatgatatttctgtctttaggtctttgaggaatcactacactatcttccataatggttgaactaatttacactcccaccaaaggtgtataaacattcttttttctccacaacctcactagcgtctgttacttttttagcttgttaatagtagccattctgactggtgtgagatggtatctcattgcggtgttgatttgcatttctctaatgatcagtgatgttgagcttttttgcacacgatttttggccgcatgtatgtcttcttttgaaaagtgtctatcaagtcctttgcccacttttttatggggttcattttttccttgtaaatttgttaagttccttatagatgctggatattagacttctgtcaaatgcatagttcgcaaaaatgttcttccattctataggttgtctgtttagtctgctgatagttccttttgttatgcagaagctctttcattatctctataatcttaatttatagactaaaatattaatttgaaaatataccaactaaagtgtatcacacacctaaatcaaggattttataaaatacactaaaacagaaactaaacatagactatttattcaactttcatataagcaaaagacaccactattggccaccaacctcactactcccagcctgtgaaacaggatgattatgggtatttgtgaaatctaaacatcaccactcactacattaaaatgaaatggcaacaaatttccacaagtctttttactcaaagtgtggtggcccaacccagcaatctgggcatcacctggcacttgttataaatgcagaccctcaggccccacctgctgaatctacattgtaccaagatccccagaaaattcttatgtacatgaaagtttgaaaaccatggatccagaagtgtgtgaaaacataactactgccagaatttttagcatattcccttattcatctcttttttatgaaactaaacgtagtggttttgctgatagagatggacgggggaaaagaaattttgttgtgaccaaagttgctgcattttttgcctaggggtggacctaaagtttcatgtcaatcattttgttttgtgagcaaaatcaaagtcatggggaaaaaggagagggtgcagaaagaagaaaattgtgaatacatagaattttatcactggaagacagaaaacaatctcaattatatatatagtatatgtactcaatacagtaatggttaaataaaccatgacacaactatgcaagagcatatataaagacattaaaaataacaaggtcatttttcatgtaccaagatgcagtgatctctaatgtaaacttagcttaaaatatgcaaggggaaaaatgcaagggcagcacagcatatataatgacttattattcatgtaaggaaaaggacataagtgtgcatatgcatagaacatctctggaatgacacacaagaaagacacacaatggttactgcccagaggggagctgaggcacgagggacagaaatggaaggagactgacatcccactgtgcatcttttaacatcttttgaattatgtgatagtattatccaattaaaacaatattttaatctaagcattgaagaattcctaaaaagtagataaaatacagttactaagataataaaggaatcccttcttcattttccctcatagatggttatgtgactatgtccaaacactttctgtgagttacagatctgagaagttgtgtctaaaattcactgacactggagcttaaatccacgtgcctagaatgctcctcactgcccccacacaacccctgagagcccccactgatgccagttctctctgcaacacaaactaagcctcttcctgtctcagctgtgaacacatttgcagaaggctattgtggttttccttagtcaggggtcagaatggccagcaggggcaggcaggtatcctaaacgagtaaagcaggcctagccaaaacaaagtgagcctttacccctccacctgcaatgaaacagggcagcaactattctgctccaaggaaatactaccatggaggagacagggccagatgttgccatgtcttcccagggatgtcagaagctgctaaatttattttaaataccttgatttaaaaatgttaatattttaattttttaaaaacagtttacagaccaaataaaatacatgtgcagctagatgtaacctagaagttcataatccatcctgtcatctttcgtgtgtggaaccatgaacatttctctttttgttattttctcattggagctgctgaaaagaaaaaaaaaatctctttttaaaaaactcaaacagctatattttggagattcgacaatttactaatctatcactccaaaatgtgctgtataatttatttgacagtcactgtgcttgcctaagaactaaaaataacctcattgtatgtgtgtgtgttgtttctaaagacctgtggtatttattattgttagaatgctttcgatgtctttggtggtatgaactgtgaggtatctctgaaggatagcatttcactgtatttcacagaatatacatatacagtccatcaaaactctgggggttatttgcaaaacatagttctcattttccaacaagctttcagcggaagaaagtttcatagaaaaaaatacaaatttcctaccactctactttgtgagaacctaaagagactgttaggttataaaaaagaaaattgagggataaatttaacacttaaaagtgactcttctagcaggaggtttgggcacccagccagattaaggagaagtagctttatacacacatcttaacagcagtctgaatatcaaatcttcactactctttgcttaaagcccagtacctactgagtcatcccagccagcatgtcccttctaacttgtcatcctgtttgttatcactctatgccctctgcagtactctggactttgaatgtgagattactttatttaagtgaactgcaattgaaaaaagaactcttttgattgaatcttgacctgcagtaattgggaacttatgtaaggaccccatgatactcatattaaggggagtgtgggaggatcccactactaaagcctggctgcagaagagggataatggaaactgcaggtgttagaaaggtaccaacatacatcttccccctatagtacatggactcagtttttacatatggctatgctttctattctgcttaagtaacataaaaactgattaggaaactcaagatcttgcactacatataaaatctgcatccattgcttatggtctaaagtaaatgcaacaactgacaattcttacagagtctcaaaaccaagaaccaccatgataaaacaattatactgcaatgctgaggaaagagacatttaattacagatataatttatgtgagtaagcataatcattttaaatttctaaataaataggcatgtcattaaatataaagcatcaggaaaggatttcaaaatctgtatggttcatctgcgttggcaaatttgatctattcagagtttactctgggcgggggggacctcatgattccatctttatggcccaactgttgattaacttccaaatgaaaatgcttgattcagcatgtattttctgtaagaaaggtatttttcacatgctatagccaggccaatctgtgtcttcaattgttgttaagacactagtatatctttaaatcttttccacttattaatttcagcagattatttgtacacatttctcaggctattctgatatttcaaatgccttgaaaatgttgtagctacataaattaaatgggcaattaagatgtcaccatgcaattctatacaatacatacttgcaatgggatacttgtgagggtaccattatccaaactgtcctattcatcagcctttctagaactttagagatgggagtcagtcagctgggttccagtcatggtgaatggcatgcaatgatctcgaggaaaccacaaagcacatcttcctatgtttgcatttcctcatctattaaatgaagagaagacctggatcctaacaggacgtctgcgaaaccctcacgaaaggttaagaaaagaataaagaacatgacaaaggtaaggtttacatgctcttattgtggcagaagggaaaaaaaagcagaaatgcatataaatacctcacagtttgtcacacaaagcacacatttaaaaaacaataacaaaaaacaacaaaaataagcaaccaaaaataattaacagtagttcaagtaatttaaacctgtattctctcctgaagaaataccagataggtaaaatatactcccgagccaccacaaactctcctaaaatccctttgtccatttctgccactttcaacatccatcttccacccagatgccagcttgaccacctcccccatcaaagtcaccagactgagctctaggaaagtcttcattaaatagtgaacacatgacatatactatcaactcagcttgaccttacaacataggtgctatggtttgaatgatggtgtcccttccaaacttaaatttaattaattaataattaattaaattgttgaaacttaagccccagtgcaacagtattgggagatgtggcccttgggtagcgattaagtcatgagggcgaggctctcatgactgggattagcacccttataaaagggcttgaggtcaaaaggagtactctcttgcccatgtgtccctcctgccatgtgaggacatggtgtacttccctccagaggatgcagcaacaaagcaccatcttggaattagagagcagccctcaacagacaccagtcctactggtgcattgatcttggacttctcagcctccagaactgtgacaaatttctgtggtttacaaatgaccaagtctgtgatattttgctacagcagcacaaacagcttaagacaatggataactaatctaagttccaaaactagtgggcttttgacatgccttggaagtagacagataaagcagtagccaagatcttttctcatctttgcataagcaaatcgtaattgacaaacatcagtatctcagagcattcaacaaagtggcaataagtaaatagataactgatgaacatacagaatcgaaaggctgacgtgggtttcaggtttctctgggttgtggggcatcccatggccaagtactgaaactcttccttgaataactatctccagagtttgagccattgaggctcttggtgacaaagacaactgatatgcttggatccatcaaataacatatcagcaattcatgccccactgatagtagaaaagtgctgcaatcattttattctgaagagagcataaagatttacaccacatgtcaaggctagatgttgttctgccaccaggaaacttgctgtgtgagacacacaaaaaattaaacacctcaagaaatacagctttctggaaaacatcaatacctcttctttttattgttacatttttctaatgaatctttcactgcaacaacttatgcagagaagttatgtatcctggaattattctactttttgataaccatttttaaagctttatactttataaagctttttttattctcccaattcacttaagaatttgcaatatccacctcgaggttaacctgaaactcaatttcacagctaattccaactaaacgtcttctccagctttccagatgccatctaaccagttatattctcactgattcagcagcatattcaaagagacagagaagaactgacatgatgctgatgaagcttaaacttcagggtccctgttgcatgggccctcagagtgccaagagtccttgggagtccgtgttctagctgagaggaaacatgaagaggcatttctctgtaagcatttgtggcaaagagatcttgaaagaaagggaaccggccgggcgtggtggctcacgcctgtaaccccagaactttgggaggccgaggcgggcagatcacgaggtaaggagatcgagaccatcctggctaacacggtgaaaccccgtctctactaaaaatacaaaataaattagccaggcatggcggcgggcgcctgtagtcccagctacttgggaggctgaggcaggagaatggtgtgaacctgggaggcggagcttgcagtgagccgagattgcacccctgcacttcagcctgggcgacagagtaagactccatctcaaaaaaaaaaaaaagaaaaagaaagagaaccaaatcatttcactgaatcattttgaaataaatactcacctttgcatctaattttgtattcataatcttttcctctttttcttaaagaggacctcccaaattgtatgagcttccaactccactaaacctgagtctgcctgatacaagggaaggcatgtaaaaatacttcttagtttatactctccactgcgcaagttttcaatctataaaaaaactcctgatctttaaaaataaaaaataaaggttggggagagggtagtaaaaagttactttaaatgtatatttttaagaatgctgatttcattatgtattttccaataccaaaatataaaataaaatagaacctgcagaacttttggctctctgacatttctccccagtgacttaaaactttcagatgaatgggacatctgggttctgagaagaatggtgtattattactgctctccacaatagcaggcctaaatggatttttcatgtttagactagtaaacataaaaagcaaacctatctcacatgactgatacgtttgcctttaacaaaacaaccccggccaaaaattattagaaaacagatcagcagccccactggactctgaagcaatgtaattaggtagtccaacactacattttgtcaaaaaattctgacaacctaataaccagattgtcatcagatagacattaaaaaatgataccaggtttgctccagcattaaaataccaccactttctgggttttttttccttctgtaaaaataaaaattaaaaatctatcagtgatgcatcccattggtctggatggtgtttaaatgagtctgtgccacttgaaggatggcaaaggaagttttgttttgatttaaagtttaagaaagaattcttcttaggaccacctgcttaacgttaatcacgaaatccctatgtgttaagaggggtaattataaaatggaatgataataacaatagtaaccggcagttattgagtgtttagattgtgccaggcactgggtttcattctgttgaatgaaaccattactggactcccaacaaccttgatgagaggtgctactctcaccctcattttcagaggtggaagggaggcttatcaaggctaaagaatccacttgcacacccaacagaggccacctcatgctcttaacctctgcaatgtgttgctgagaaggtggttagtttggatttgacagggtgaggtggtgggcattggggataagaggtgttattttcaagaaaaccattacgtatgtggccttccagaatatagtaatctagtatgtagtctggcctgtaagccaaattttatgtatagtgtgacactgaagaaaaaaacgttgtaattataggttaattcacacagttaatgcaattaaatagaaaaaggtagaaaccttaagatatagccttaggttcaaatatactctagcctccatttaattagtcaattataaaaaattgtccactaacctgtacaagaataaacctcagggagtacatttctaagatgacctttggaaccctagtatctgaaaatcttaccattttatctattaggatataaatgagttatctggtataaatcactgtcaaatttgcacaaacaaatggtgtggctgacagtcagtaataattcaatgacaccaattttttccccaacatgaaaacaccccagattactcagtcagccatgccatggctagatttgcaaggcactataaagtttccaaagtatttgtccaccacgtgattttgtttgacatccacaagcctacattatttctttttctttttcttttttttttttttttttttgagacagagtctcactctgttgcccaggatggaatgcagcagtgcgatcttggctcactgcagcctctgcctccttgttcaagcaattctcctgtctcagcctcccaagtagctgggactacacacatgtgccaccatgcctggctaatttttgtatttttagtagagacggggtttcaccatgttggccagaatggtcttgatcccctaacctcgttatctgcccacctcggcctcccgaagtgctgggattacaggcatgagccaccatgcccagccaagcctacattatttcttaaacacaaaaagatcattccgaatttcacaaacaatgttgagcaaaatatgccacacacaaagaagcccataccgtatgattctatttattatataaaattagtccaggcacagtgacccacatctgtaatcccaacactttggtggctaaggtgagaggattgctcgagggcaggggttcaagaccagcctgggcaacaataatgagactctgtctcttataaaaaactaaattaaccaggtgtggtggtgcatacctgtggccctagctacttgggaggctaagacgggaggatcacctgagcccaggaagtcaaggctgctgtgagctataattgtgccactgcactccagtctgggtgacagagcaagaccctatctcaaaaaaaaaaaaaaaaaaaaaaaaaaccacccaaaaacacacacaaattcaaaaacatggtaaaaccaatcgcagatgagtcaagatagtgacagcctcagtggaagcaagcatggtagtgagtggaagatggcatcagagtgtcatgttctacctcttattctagatgctggttccttaggcatgatgactttgggaaaattcatcaagatgtacaacttggatttacaagtatacaaatcctatagcatgttatgcttctacagaaaattgacataaaacaaccattctctccctttcagtttgctaactagaccaagaagaaaagatacactgagaaagagggtgggcactctgaaaacactgagaagtttgactttacaaactattgagctactgacagtcttgttaaaacctcttagcgtgcctttccctcacggcatcaatttatatagcaattcactacattaattcttgtaatgaaagtgtgaggagatctgtagtcaatcataattgtgccctgcaaattccagaaaatgtttgctgggatgtaagcctctgatggctggctcagcaagtgatttagagcaatgtggtgaactttcataataacagctcattaacaattgcgtttaaaatgtaaacaattgatatgtttttagaaacaccagtactgattaggtttatttcactttacaggaagtcagaagataatatgctaagcagattttcctttcttccctctcaacgataaattcaataatagttaggttagacctagttttgttttcagtttccatgaatgagaaatgtgaagaccatgggggttccaactcagtctctcttctccagttttgtgtttaggaagcacagacttgaaatgtattttgcatgtcttccaagactaaataccgaggttatgtttgtgcagctgtctgaataaaactgatgctacctcaaaaaataagttgattcagtcacaaaaaagtaccaagcaaagtattaattgatttaattgccctgcttttatttaaagctagacaagaactatgggggagggaccttatcaatgatgttaacagatatatatgtatatgcccagcacctagccaaattatagaaagagcatgggaactgcttaatgatttgctttaccagtcaatctttatgtggagtggggcatagttaatgatagtaatcattttaggcctgagttcctttaaattatcaatttaatatttttattaaatatatgcatttcaagtacatttatctccgttgctttttcgactaaaaaataaagacaaggaattcaaatgtttggattattttccctcactcataccaaatacaaggaaagtaaacataatgaagttaaagtaatattcttagcttgacaaatcacatattggggacatgagaagcctaaattatctgaagtcaattaattgttctttgtcaacggaaagaagaatttagctcccaaactggataaaatcccagccaagtaatgaccaataatggcaataatagtaacattatatttttcctgtctcttgattatcaacaatcaagaggctatagcaaataaatatacaaatatatactgtgaaaacatcaatatttgtatctacaagaaggatgaaaaattaactttgtgtagtaatatccctccactgtatttaggaaaagacaatacaacagacctctaagaatgggtgttccttctggtacttgaaggaagcacacaaacaaatatattatggaactggtggggaaaaaaacagtcatccagaatcacagggctgaagagagcccaggatgtcacctggcctgtcatgtccagaatactaacaagtttcatttaattccagcatcacaggctgctctgatattccctgggttccctctcctggctctgcctaaagacagacccaaagaccaaaaaaatctaccatgtagtccaagtcgtctaatgctagcaagcccctgaatcttgccacatagggcccacttataattgcagtaacatgtctctttcctagcctaattactattcttggagaaaaatctctctttgttttgacaatttttcctatcccttagaaaaaatggttcaggaatagattctagtattatttttcatacatgaaataaatattctatttattctattacatttctgttctataagtgtatggttagatgactgttactattctttctggctactggacataccaagtctggtttaaatactctaaccagaattagtccatgccaacataagcatttaatgagaaaggatcctggggctacatgctccatagtcatgtgaaatcggatactctgaaggggaaataactttctctgaagtgtaaccattaactgaaagagaaagcttggtgtggtatgagtcatgggtaacatgggtgaatcacagtcctgatgggcaggtggccatctctgaagaggatttcagaaatgctctccccaccttgatcaattaaattctcttattaggatagaaaacattgtattccacggttaaagtatgaaatgcctacataaccagataaaatgacacaactgttccaaaagttcagttatttacatactcctttcatgatttgtataatatctatgagccagtgttctatattaatacaacatttctctttaaatcaactcaattctgccagtctaaattacctttttgaagaagacaattttatatccccactgtaaatatccaatgtcactggtatacatattgtatatagccaatatcacttgccataaatagaaggaaactgaaaagatttcatgtgactaaccaaaaatgtattcattcatctcatctcatgtaccacatggaatactgtaacaaactggtttaaattcatactagagagtaaatgaatgatagaattctcaacacccctccatcctgtcctattaatgagattaaaggttgagggaccaccaaaagaggtaggcagggccctgagaacctgaaggagcatgtattcaggatagggggtatggggggtggggttggatgtcacaagctatgagaagtaagggtacaaaagagcagacagtagcccacttcatgattatttatatctggggctgtccctgaatgtgtcatagaggaagtcctctgtactgtttgatttgaaggcccttctacttctatgcaccatctcttttagacatccacatctgagctcacaaattatccatcacaaagaaatcacatgctgttaataggtctcttcattgtggctgacagtgcaaaacaaatgccagtccctgtgctgagatacagatttctggaatactaactgggattcccaatgtggggagacacagtagtagaggtcactccaaggactcctggaacatgctcctgaattctgttgcttcttgccatacttgccacagagtgccgttatgttctagctctctctgggtatccttctctccaatcagattctcaattctctcatcatctttctattgctcttaatacctagctctcagcaaaacaagtgcccaatttatagaaaaagcgagtaagtgactctgaatgaatcaaccacaagtgaatgaatgaatgaaaacagatcagctttgcagaaagaagcacctgcttacctaaggtatatccccaaattatcccaacctcatctaaagttatcagggaacacagcacaaattcattagcatcctgctgccttttcagagaaatgacaggttcttctccccttgcctgatcaaaagatttgctgcactctctctcttaaaatgcctccttgttacaaactgtgcaatcttggtcaacttacctaacctctctgaacatctgttcccttacttgttaaatattgaagaacaatatctgccccatgaattgtgataaagattaaatgagagatttcaagaaaagtgactgtagtatatcaaaagccaaaaagccagctacatttttggaccagatcacaatgccatgataaatatcaatggaataatggtccacaatgtcacaccacatgctttcattctgctgtcctcatgacttccctgtttgccagcatcagggtttttcacgtttacaaagaaaatggagcaggttagcaggtctcggtggcattaatgggcaaagcatcatgggcaactgttgttcataaatgctccttctcaaatgtatcctgggttggtgatgaccacaattcatttccattttgaagcgccctccattttttacttctttctcagtctgaatctcctatacttgtaatactgacggagcttcgctagtttctaaatcagaaagatgagcacgtgcagccacaggaagagaaatctgggacctgatgcctataatatttttcagacagagaatattcccccagtgtctctacccaggagatagtaaactactctgacatttcagctgttgcccctccaagcagattcacacacctcttcggctaacatcccctttgggcaggcatctactcatgtttacagttattcattatgactggctatacacagacagtgcctctggtgtcaaactgaatggccccttagacccccattccaagacagccagaggatacagacatatattaaataagacacaggcaggaaaactgcactgacttccttgagatggggaggctgaagccaaccaaagctgacctgctagagagtcctccagagctccagtgtgggatgactcacagcaaggagcacgggatcaaaatttttgaggtgcttcagggtcagaaagttttccagaacagcttctgcggatgtctgtgaacaaatatgccagcaaggaaaaagaccaactattttgcaggggaatcatcttgaaccagaagggccagcatgcattctaagtgccagggcaagttcccaaccctctgagctagctcacatctattgtgattccacacatctctccatggaataatctgtccaagaacacacaagcagagaagtgcccttctccatctacaagcatctaaatgtagagtcatgagagaaggtgagaggcagtgacttcaagaggtggcctctagacctcagaatccactctaatgaacacgctgtgtttaaacaagggatctcacattttctcaaaaggcagttagacacattcacatacttaggagtgaatctaagaactctagaaagaacggcacatttccctactgacacagttgtattgaaaaatcaatctgtggctctaagggaaatgagaaaacacaactggtgatttctagcacggcatccaatcttcacttttgtgatccctcaattctcagttcaagtataaatagactttttcccccccacgaagtaggaaaaggattaagtaggcaggacattttctaagttctgtgtagcatatgttcataagctttccttttgtagcatttatggattcattctggagtagggttaagccggagcaaagcaatttggcatgcttgcaatttgctttatcaggagaagcaagcacagactgcagaggccacctcgacctgagcagcaaagaagcttcccagaaccctgagggagacactgattattttccttacagggatgctcaagctgagccaacctccttgcaaaatagtcaatgagcttcattcagattatcctcaggaaagcagtggccaagcagacacaagtgatcatcatcatacgaacttaatttctgaccaaattccacaatcacactgctcttcctgaagtcagtcaggcagtatctatactgctacacaaacctcagggtcagcattccaatccatcccagcctaaggatcccattcagcagcagaggtgcttttcaaatctgtacatccacttcggtactttctatccacatgagagaacacactgcagcaggagatgaggatgcagtaggataattcttaatgttcacaatataatgttgaatggaaaaagcagtatgtgccattttcttaaaatacatgcccacataaagaactaactgggaaaaaaacacccagaaatgtcacttggagtcatctctgggctgtaggattatacacaatttctattttcttctcttagctgaactggtttccaaatattctaaaatgcaaatgcattacttttataatagtaataaagtaattctaaagtgatttaaatatatagactgtgattctcaaaatgcaggagttaaagaaaaaaataaagacatagactgaaccttacaaaaaagatttttatccacaaaacaaagaagcattttcattaaaacaatataattaacctgcaccattaggaaagaactacatcatatttcacattcaattttgttattatcaccatcactacttcttaagcatctgctgtacacaatgccctgtagcgggtataagtactcaaaaataaaccaggtggtaactaagttatttacatcactgggactcttccagtgttattaaagttgaagaacttgaaaagcagcatttattaataacaggggcattaatccagctgcctgccctgtactccacttacccagagagtctctcccagtcctgccaagcaagattaagtagaattaagacggcagctaaccaggtagaccttgtgccctgggccacaggtgactctggcaagggtgggcgcctgacctacatcaaaccattcagattctttcccccaggaaggaggaatacagttagtctctatcatccccttgaatgaggcacagggagttgcacgggtagccatagctggctggatatgcaaagaagccagtctgcagacagaagaggtgagaggctatgaggatcctgagacagtctcctgctctttaggatgggatgctgagagatatgtttgtccatttacccatcccactctggttagtttttgagggtcaaccacttcctggcctaaggcttcaggaagctcaccatctaaccttttgtcaaatgagtaagctatcctgtggccttgtagaagcctcacctttcatcgtttttgtcactgtttcttttgtattggttcttgaaaacaaattatctctaagacatagttgcaagattcagaactctgaactctcttcacccactccttacaagctgaatccctcctcctgtccttcttttcagatcttaacttaaacgtcattaactctgaccgctccaaatgaggaggcctgctatgttttgcctcttgatgtttcctaaataagatttacataacttttaattgtatatgctttgttggtttactagttctgatctgtctccttccctagggcataaaataatctgcccgacccatgttccttgtacctcacacagcacattcctagcatattacagaagatcaatagtattgaatgcatcagtcagtcatgtaggtgagtgcatattcattcactcaatatacaaataatgattgagcacttgaaatctgcaaggcttagtcctttcttgataaggaactaaggaactaatgattcaaaaaggagattaggtacatatgcaaagacaagaacatagacacagcagacactgctgagggcctgtcacacagaaatttccctctttgacaaagaaggccattacaccatggtaaagggatgaattcaacaagaagagctaactatcctaaatatatatgcacccaatacaggagcacccagattcataaagcaagcccttagagacctataaagagatttagactcccacacaataataatgggagactttaaaaacccactgtcaacatcacacagatcaacgagacagaaagttaacaaggatatccaggaattgaactcagctctgcagcaagcggacctaatagacatctacagaactctccatcccaaatcaacagaatatacattcttttcagaaccacaccacacctattccaaaattgaccacatagttggaagtaaagctctcctcagcaaatgtaaaagaacagaaattagaagaaactgtctctcagaccacagtgcaatcaaactagaactgaggattaagaaactcactcaaaaccgctcaattacatggaaactgaacaacctgctcctgagtgactactgagtacatcacgaaatgaaggtagaaataaagatgttctttgaaaccaatgagaacaaagacacaacataccagaatctctgggacacattcaaagcagtgtggagagggaaatttacagcactaaatgcccataagacaaagcagaaaagatctaaaattgacaccctaacatcacaaattaaagaactagagaagcaagagcaaacacattcaaaagctagcagaaggcaagcaataactaagaccagagcagaactgaaggaaatagagacacaaaaaacccttcgaaaaattaatgaatccaggagctggttttttgaaaagatcaacaaaattgatagaccgctagcaagactaataaagaagaaaagagagaagaatcaaatagatgcagtaaaaaatgataaaggggatatcaccaccgatcccacggaaatacaaactaccatcagagaatactataaacacctctatgcaaataaactagaaaatctagaagaatttgataaattcccggacacatacaacctcccaagactaaaccagaaagaagttgaatctctgaatagaccaaaaacaggctctgaaattgaggcaataagtaatagcttaccaaccaaaaaaagtccaggaccagagggattcacagctgaattctaccagaggtacaaggaggagctagtaccagtccttctgaaactattccaatcaatagaaaaagagggaatcctccctaactcattttatgaggccagcatcatcctgataccaaagctgggcagagacacaacaaaaaaagagaattttagaccaatatccttgatgaacattgatgcaaaaatcctcaataaaatactggcaaaccgaatccagcagcacatcaaaaagcttatccaccatgatcaagtgggcttcatccctgggatacaaggctggttcaatacactcaaatcaataaatgtaatccagcatataaacagaaccaaagacaaaaaccacatgattatctcaatagatgcagaaaaggcctttgacaaaattcaacaacccttcatgctaaaaactctcaaaaaatgaggtattgatgggacatatctcaaaataataagagctatctatgacaaacccacagtcaatatcatactgaatgggcaaaaactggaagcattccctttgaaaactggcacaagacagggatgccctctcttaccactcctattcaacacagtgttggaatttctggccagggcgatcaggcaggagaaggaaataaagggtattgaattaggaaaagaggaagtcaaactgtccctgtttgccgatgacatgaatgtatatctagaaaatcccaacgtctcagcccaaaatctccttaagctgataggtaacttcggctaagtctcaggatacaaaatcaacgtgcaaaaatcacaagcattcttatacaccaataacagacaaacagagagccaaatcatgagtgaactcccattcacaattgcttcaaagagaataaaatacctaggaatccaacttacaagagatgggaaggacctcttgaaggagaactacaaaccactgctcagtgaaataaaagaggatacaaacaaatggaagaacattccatgcccatgggtaggaagaatcaatatggtgaaaatggccatactgcccaaggtaatttgtagattcaatgccatccccatcaagctaccaatgactttcttcacagaattggaataaactactttaaagttcatatggaaccaaaaacgaccccgcatcaccaagtcaatcctaagccaaaagaacaaagctggaggcatcacgctacctgacttcaaactatactacaaggctacagtaaccaaaacagcatggtactggtaccaaaacagagacatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaagttaattcaagatggattaaagacttaaatgttagacctaaaaccataaaaaccctagaagaaaacctaggcaataccattcaggacataggcatgggcaaggacttcatgtctaaaacaccaaaagcaatggcaacaaaagacaaaattgacaaatgggatctaattaaactaaagcacttctgcacagcaaaagaaactaccatcagagtgaacaggcaacctacagaatgggagaaaatttttgcaatctactcatctgacaaagggctaatatgccaaatctacaatgaactcaaacaaatttacaagaaaaaaacaaccccatcaacaagtgggtgaaggatatgaacagacacttctcaaaagaagacatttatgcagccaaaagacacatgaaaaaatgctcatcatcactggccatcagagacatgcaaatcaaaaccacaatgagataccatctcacaccaggtagcatggcgatcattaaaaagtcaggaaacaacaggtgctagagaggatgtggagaaataggaacactgttacactgttggtgggactgtaaactagttcaaccattgtggaagtcagtgtggtgattcctcagggatctagaactagaattaccatttgacccagccatctcattactgggtatatactaaaaggattataaatcatgctgctataaagacacatgcatacgtatgtttattgtggcactattcacaatagcaaagacttggaaccgacccaaatgcccaacaatgattgactggattaagaaaatgtggcatatatacaccatggaatactatgcagccataaaaaatgatgagttcatgtcctttgtagggacatggatgaagctggaaaccatcattctcagcaaactatcacaaggacaaaacaccaaacaccgcatgttctcattcatagctgggaattgaacaatgagaacacatggacacaggaaggggaacatcacccactggggcttgttgtggggtggggggagggaagagggatagcattaggagatacacctaatgctaaatgacgagttaatgggggcagcacaccaacatggcacatgtatacatatgtaacaaacctgcacattgcgtacatgtaccctaaaacttaaagtataataaaaaaaaaataaaataaaaaaagaaattttcctgtttcacctcacaggtaaagccctgtgctggttaattttctgtgtcaactcaactgggccatggggtgcccaaactaaatattatttctggatgtgtctgtgagggtgtttctgggtgagattagcatttaaacagaaggccatcacccagtttgttgaacagaagaaaaggaggagaatggagaaatttgccctgtttctgcttcactgtgtgagctgggatacatgatctcatctttgccggccctcagactgggattatgccattggctcccttggttctcaggccttaggacttggactgaattacaccaccggctttcctgggtctccagcttgcagacagcacatcatggaacttctcagcttccagaatcacataagccaatacctcacaataagtaaataaaccaataaataaccttttggttctgtttctctgaagaatcctgactagtataagccccagttttattagggtggcctccctccataaagctatgtactcaagggaaggtgagattatcccagaaaagagataaaacccgattagtttaaaacagggaaagggttaacagctgctctgatatccctttagctccaagggcagctgggcagacccagagcagccagagaccccacacccatgccctacacacacacatcagccactccagctgtgagcagcctcttctgattgcttaacatgccggccaaattgtattttctatgtgcaccataacaagaacaaagttgggaagcaccaatctaagccaccagggatgagccccattccgcgtgccagtgtctgatttaggaaggagcatgggactgcaatcaactaaatgagacttaaggggaagtcagctcaggggttacaggaacagttccttgcttttaaaaagggacatataagaacagatattttattttgccagtggatgttgccatgtctgcctgtagctcccaaaaaggaaccagccatcttagaactatgaaggcagccagtctaagaactaagtcaacacactgaagatggcacaggaaaaagagcaagaaatagacactttggtaacaatgttgagccactgaattaacaaaacttgaaactgcacccctcccaggaggtcttattccctgagataattcatttctcttattctgatgggtttttatttggtggattttcaaatgtaacttggtagagcaattcacaaaataattgacagtgcttagcaatctgtcaatagctgagtgctcaaaatcctctccctgctacacagtgacaaccatcaaaggcaccctggtgggtccccagttgcttggcaaaagtggattgcagttagattccagacatttggagccaggattctataatgccttcccatcaatcatgacatccctggggcagcaggtagacttgcagagggcagggagcttttttcttttaattcccctattgtttgaaccatttcaagttgactttttgattatttgcagccaaaggcatcttcggtgataaatccatcttcacataattagcagcaaatttatgtggcctcctttgagcaaagactcaggagaaaatgatgcagagattcataattccacccacattccccaaaatctttagatgatgggtcttcagtgaattctctctacaaaaaaaaagacaactgagatgccagaaaaaggattaatcatgtgatcatctgacacttatcatgggagtcataaagtaccacacaaatggtgaggcatcaccttgtctcagtgttgaattaggggcagcataattttaaaatatcaatttgtactctttgttatccctcctgtgtatactgttccctttcgcatctcaaaaacttcaagactttgccttcttccctttgtctcccagacatattcaaacgcaaaagatgctaaaagacaaccaccaatcccctaaatccagtctccattaaagacttttctttttcaaaaaagcctaaattcattgaagggaatgtgttacatcccagcagaaaggtccaaaataaagacaatttgggttgttttgttttgcttaaaagtgttgttctttgatctgtttaggtgggcacttggagtacagtaaggattgggctttcctggtattggagagaagctggagcagttccttaaagtagtggacgctggcaccctgcttcctggcagaactctagagaggtgacaggacttttgatcgggatagtgatgggatactgggaaaatgactaccaaggccttgaagccacagcgaaaatcccagccttctttgcacagatacaacaggactacccaacaatgcatggacaagaagcctctcatggtgaccagagtggactaaagttcagggggcctttttaaaaatgttttatgctataacagacctgcagcatttttgcatcaatgaccttaagtgagcagacactccaaacaccacttagaacttcccaacatttagagaaaaaaaaagtaaccagttatgcatgtatgcatgcttgcaattcatgcagcattcaaaacaatttttcagaatgaaatctttaaatcagagtgcacactcagtttgtatttttagttgatttgacacatcatgagcaaccacaggattccacaataccaggccaagttcccactgtagggatggaaaggtgtgatacctttcctcacctctcacaagagtcacagccaacattcctataacaaaagacaggtcagcaagagaaaagcataacaaatgtatttaatcaaagttttatgtgacatagcagccttccgaaatgaagacccaaagactaaaggaaaatagtttttatgcttaggttcagtgaagaatgcacagctgtgtagaaatgtggtagaacaaaaggggtgtgttctactggaaatagaaaatagattggcggtggtgggggtggtggtggggatcagcaaggcctgactattcagattcttattggcctctctgtgtaacgttctttcttcccagtatggagcagggcctctatggaatgaggatcttcaaaggagaaggaagagagtgacttttctaggtttaatggcttgctgtggggaagagacattctagtttctatgacccaccttagggaagaggaattctggtttatacgacttgcttaaggggaggaagagaagtaggagacagtattatgggagactgccacaaagaccttggttctgagggctttccaatgtatttccttcagttcaaagtactcaggatgctaaggtaccatactttgggggattgggttctaagacccgacaccactagttatttaatattttccttcctgcaaatcctgctaccttaaaaaaaaggaaaactaactgtacaacaggtagttctgtagctaatgagcattattaaatattttcaaaacattccaataaaaggcaataccaaacggcttttatcctaatactttctaaataacgccacattcatttatgaggaattgcatttccctcaatgttctgggcattaatgaagattgaatataaataaaagaattgccttatatgtatagcactttaaagagttgagattcccaaataatacaaaagcattttcaagtcacacatggtatgtaaagtgaaaatgttcttgaaggaaatatcctctaataatacttacctacttcagagggtgatgggaagctctattaacaccaaaagaacacttttagatcttcaaataaaagcactatacaaatgcaaagtattattattatagttctgaaataatttcacacctagggatgagaaaaccccaggccaaattttattgcttctctcatacgtgataaacaagaaatgccataagcaaggggcgaggggggtggttagtggggggtgtgatagtgggggaagtggaaatcaaacagaacaaagacttcaaagtttctctttcactaggactttgtatttgcccagatgtcatttagggaactctcagggaagaaagaaaaaaaaaagtcccttaaaggtcagagttaagtacagggacaaagttctcattgcttttgtaccagataaagcaacaaccggctgagctgaaaaaaaataagcttgtctacttctatgggacataatttctcccaaagcacttctcaaaaaaaaagaaaaaaaaatggccagatgaattattactgaatcacccactagtgtgatgatctcacctatgaagtcaaaaggtagctgctttaacagacaccaggatttctagtcaattactgagagcactgagcaagacatgttattgctgatggtagtggtggtgatgatgatgaagatgataatgatgttgatgatcatgattgtgatgatggtaattacggtaatgataggatatggaacagaagttctcaaacctgctgatcaatggaatcacccctagagctttttacaatacagatttttggttctccacctcagccccactgattttgaatctctgaagatagaactcagaaattttttttaagtagccatcaggataactgaagtgacagtatttgtaagtaatataatgattaagaatgcaggctctgtgaacagactggctggtgtcttctcccagttctaacacttactagctatgtgaccttggaaaaaatacttagccttaagtctcaatttctacaactataaaatggaaatactaatatgacccacctatgaaattgacatgctattactacctaccttataaggtagatgcctaaagtaggcaaatttttttaaaagcacatattaattccaagaaagacaaaaaattttatattaaagaaaacataacaaataccattcggcttagcaacagaaaaaaattacgtaatcatgataatgtaaatattacctgttgatttaaataaaaattgtaatataactatgtcaggaggctgtggggaccagaagtggtaagagtggaaaggatcagagagctattgctaaaattgataaattaggaaaaaataatataagtacattatttagaaagagagaggtgaacaccagaaatatcagaatagaaagttgctaattctgggaagcaatccagagagaggtagaaagaaggcatagatgttgcagtttttaaatatttgctatttaatgctgttttatttaaacaatgtagatacactgctttgataaaaataaaaataaaatgtaaaaggtaatttgtaatgcatataagtacaatatggtatttctttatacactgaggctactataaagcttttcaatttaccaaaacttgcttttaaaaaaaaaagatataatatctccaactatgcaatcaaaatgtccatttcttaaaagtgtacaataaagacttactttttacctggcacactctaaatcctaaaaagatatttgctgaattgggctgaggatggtggaaaaatatataaagaacaaagttcctttgtacaatcaaggtcacagcaggaaggagatgacatcttcacctggggtgaaggcagggttaagggaagaccactaagggatggtctagtgtgctggacttagcaaaaattccattaacactccagactcaaaggggaaaagggaagaggcagttaccagacagtagaaaaagctgtagccgctgaagagaggcccccaaccggaactgtggccttccttagagggatacagccattgccaacccacaatgctgcagggaagaaagtagggaagaatatttcaacctcgtgttcccaggtcttcatccagttccttcccctggctaatacaacagaaagccagcaaacaagggagcccagagaatgcctgcgatagaggttaggcccatggtgcagagccatttagaagagagaggagctggaagcacaaatgtgaatacccagcacaagcactatacaaggtggttgttgctgttgtcgttgttgttgttgtttaatctgtctctttttcctactcagcctcctaaaacaagcccctcaaattttcatctgtttaagaaatattcatggcatgatagtaataaactgatgttatgcatttgttaaaatttactaagcactttcatatatattgtcttcatgtgatcctcaaaacagccctgtgcaataaatagggcaaaagttatcctcattttacaggtgaggaacctcagatcttaaagaaagttaggaatcttgcacagagtcacaaagctagcaaatggcagagccaaaactagaaggaatgtttcctaataccccagctaaggctcttccttccatataatactgtcatgctatttattcacagtaggagtgcaaaattgatatacctgttaaaaaaaaattaacaagttttgttctaggcactgcacagagcacagaagtagtcaacaaataagacacaaggggaaatagagaaaacttgcccattccattctcattctacattccacaagcaatgccagaactggaagtaattgagttttcaatcacattttacacatcattgaaaagaaggtgctcagtagggtaagaacagtgttcaaatgagaaataaaaattcagggaaaagtagacaaatgtctaaagaatatacctgttgtgtttggggttgctgggggtaaaccgaagaaaatctcagtcccttaacaatccccatgacacaaagagaccagggccccagaaattgggagggatgacttctccgcttctcttctcatttccagctctacgcccacatacatacaccttctttgagagctaagagaagcagccaagagtgacttttctgtaccaaacacaggagtactgggaagttcagcaaaataacccatttttgagagtctaataaagaactctgtactttttgtaatctactgcaaaacactgagctacttacacatgatgaaagaaagtaatgagtggcattttaattgtaaacctccaaacataccatatttattccagatctagctcactaatgaatagactatactatcaatgagggttctgtagttgcaagcagaagaaacaaattggctaatttaagaattattggaaggatactggagtctcagccaatccatggcagaatggaaaataaggtttggaggccatgactactagccaagacagacatggaggcaacagtggtctcatagtacatgttggcagatcagaatgcccacctaggacaagggagaatcctttagctaaagaatcaaattccaaagaaggagcatttacttagccaagcttgtggtcatacacccatccataggcagggtgcaggcccctgagtagggcccctggttacagttccactagcctaattacctcaaaaagaaataaagatgctgttaggaaggaaaaacatacacgacagaaaaaaaaaattggtgggggggttccctctatactaccaaggctttctttaaaaattcttgaagaagctaactagcagtagactcttaatttctcaagactattaactagtaattgatgacaaccaaggaaggtagttttcctaatacctacaaaacttcagcctaataacttttcacttccagaggcctcacttcctgtattacctgaaagttaccttttcatttgattcctaaggaccaagcagaattttcccttctttggtagcaacatgcttattttagaaatattatcctgaagcttctaaaaagaatagacttataaaaatgtataatgaataaattcataaagatgctgttgctgctgctgccgccgccgatgatgatgatgatgatgatgatgatgatgatgatgatgatattaataagagcagtggcagctcacatctactgagcacttatcatgggccaggacttctaagtccttgacacagaatacttcatttaattctccacacctacatgaagccaaaaacagtattatccccacttcacagatcaggaaactgagactctaagagggtgaataagttgtccgcagtccaacagctagtaaaagccaaatcatgactaaacccatgtctgattccagagtaccaattcaacaaaagattttcattgagaataaagaaaatggactgtgcctgtgtggaaacattccccaagaggaaaggaagcaccatatctgtgccaaaagattacaaagttgttaagatggctacatcaccaccaaatccaattattcatgagcatttatttctaaaagctatcaagtatttctttattccaagatgtggctcaatggtccagagacatgtagttgtatggccaaaaataagaattatctactgcttaagatagtaatttcttcactgatgttcaacaattatggcaaaattccaagccaaccagttttcatgcaccagagtttagttgccccaaagcaaatcctaagaaaagaggatttttttataactcatatttttattatctaaaaggggttttctccaatatccctgtaaaattcttctttgccctccaaataaacatgaaaaattcagccccagaaatagatttgtcaagaagttaggaagaacttaaagtacatggtaaatcaaaatggcttttcaactttaactaaagtggtcatagtaataattgctgcaataaaaatgacagaaaaaaaccctaaaagtatcaaaaatgtaatttatgatgaaaacaaatgtaaaattatagcatatttcaccctggccaccaaagactcttgatgaaaccgcagccctataattgcccagaatgaattctttaaattaaaatacttcatgcagaacagaaattaaacaatgaatcaaagaacaaagctgtacagaggtatgctcataaatatacctagcaaagaggaaacaattacatttttccatgtaaaaaccaacttgattgtaatgtttcacaagagaccgagtaggtacttttcccattgcttcaagcttggaagttcatttcctgtaattcatttagggctcagagtgactgggtggaatgaaattagatacaccaaattcagtggctcttttctttctacaaaactggctcttccatgcaactgcacaactgactttcacaataaatttcattcaacccaattgaaatgccactctgcattttattttaaatgctttatttggccagctagttttatttaactattggccagaagtggtacaagtgcattctttttccatctagcattaatcttagtaaacttagctccattggaatgtcttagctgctgagaagaaagcaaaagtcagcaagcatacaattgcatttgtctactctcaacacatcattttatttcctcctgctctctgctaactattgctcagcacttttgcctaagagggaggacaagcaggtggttaaggaagttgtcctgtcagctatatctttagtccaagtgtttaaatctctgaataaaagaaaaatcaatgttgtaaaggcaatgtttgtcaaggccatgtaataaatacacttacctttacagactgttctcagtggatttctcttctttcctgagcttcaaagctacaaagacataaaaatgaaagacagagttgtctgtgagtacaacaacaaacattttctccccatgtctctaaatagaatttccatatgccatggtatatggtgctagccaaataaaccattgataaaacttgtgcctcatacctcccgcacaagaggccaaaaaaagacagtcagaaactgaaaatggtgcacacatctacccagaattgaagcacacaaaccttggccaaatctacagtcaaatcttttggagtgtgtactcctcaacagaatgggaacggcttatagcgagatgaaaatcaaattaaacatgagtgtgacatactcagtctgactaagcattttattttcttatttctttttgtcatctttcttgcatgctctatttccatttctctgaaaaagtttcacttagggatgcctattccatttatatgacatgcatggtccttctaatataaacctcaccacttgctccgtaagtatatgtgtgcatgattacagggacaatcacccttcctgtatgtagactgcagccttctctcggaagaaactcacaaaacagaggaagccacaacttgacatttcaaatcaaatcttgttaacttcagctctctgtgatcaaaacataaatactatgcactgaccacacacaaatcaatgtgacaaaagatctgcaaaagcaacagtaataacttacagtatcgtgaagctggttctttaatcatccaatcttactcataaggtgcctctacagtcaccagtaatgggaatatgattctttctctcatttttggctaggtcctaacatctccgaaaggtgcagtagttggggatagacagctacaccacagcttttccatggttctttttttttccttcaatatctgaagggattgttttagcttttactgggctgtttccctccacatccctctattccatcaaagaatgcattaccactgatgcatgaccaccaaagaacaggtcagacttacgggctaagatgtaaatttcagactattaatgcaggaggtaggtcccttctatgggacagcatcagaaatttctccttccccctgagctacaccgtttaccaatgagtttagaacaagcagagtttggagaatattagataaaatagtgtaatattgcatttgtgaaatctaagagatgaataatctgataacatggagattgagctgaatccctttccacttcaaacacagaaatgctaaacaaaatacaataatgacttaaaatacatatatgtgtgtgtatgtgtgtatatatatgtgtgtgtatgtatatacatatgtgcatatatatacacacacatgtacaaatatacatacacatgtgtatatatatacctacatatatatacacgcacatagatacacacacacacacacacacacacgcacatacacacacatatatagccaagcccaaaagaaagagaaaaagccgtctgggaagtgagaagcgcctctgctcagccgccaaccatctgggaagtgaggagcccctctgcccggctggccaactgactgggagtgaggagcgcctctgcccggccgcccaactatctgggaagtgaggggcccctctgcctggccgctgccctgtccgggaagtgaggagcgcctctgctcggcagccgccctgtctgggaagtgaggagtgcctctgcccggctgcccaaccatctgggaagtgaggagcgcctctgcccggacgctgtgcaaccttccaagtgtgaagtgacagccttgtgtgtgatcttttctgttcttccccaagtttgcatttttgacattaaagtttactttttcgttaaaaaaaaaaaaagagagagagaaagccaatataaaaatatatggatgtagagtttctagaatgaaagacatgagtcctctggaaaaagtataacaatatctcaaaaagataaataaaagcaaatgcatactttcatatatcagaatgaaaccacagaacgcagagataaaaataaaatcttaaagtcaaccagagagggaaaaaaaagagacttctagcaaaagaacatgtcattagcaaaaatgaaagtaaagcaacagtgcggacactgtgtctcacgcctgtaatcccagcactttgggacaccaaggcaggcagataacctgaagtcaggagtttgagaccagcctggccaacgtggtgaaaccttgtctctactaaaaatacaggccgggcgcggtggctcactcctgtaatcccagcactttgggaggccgaggcaggcagatcacgaggtcaggagatcgagaccatcctggctaatatggtgaaaccccatctctactaaaaatacaaaaaattagatgggtgtggtaccaggcgcctgtagtcccagctacttgggaggctgaggcaggagaatggtgtgaacctgggaggcggggcttgcagtgagcagagatcgcaccactgcactccagcctgggcaacagagcgagactccgtctcaaaaaaaaaaaaaaaaaaaattagctgggcgtggtggtgggcacctgtaatcccagctactcaggaggctgaggcaggagaatagcttgaacccaggaggcagaggttgcagtgagctgaaattgcaccattgcactccagcctgggcaacaagagagaaactttttctcaaaaaaaaaaaaagaaaaattatatgcccatgctaaacctaacattcaagaatgatagagaacaatagataaatcagaacatttttcaaaaaaaaaattgtttagtgctcacagtagtttacttttgccaaaagaaatactaaaataagatatgcttgaataagcgggaatttatcccagaaggaagcagtgagaaacaagaagcaatagtaaacagagaaattagtaagcatgatggtaaatctggtaactttaataataagtaatgggtattgattaataattattaagctctacttgtaaaaaaacaaaacaaaacaatttttagcatttgccaataaagtgaaactgagtggtttatcacaatcatatggaataaagaagggggtaataaattgtttacaaggaggagagaaatactacttaaggcattaaagatatgcactaaaactactgattaacttgttaaggataaccagcatttctttctctgtctatataagcaaagaggcccttacacatgtactcacagagatttgtacaatgtttacattctacaaatgtattgccaggatggcaaaaaatacagaaaacaacccaaacatctatcagcaatacgataaacactttttttacatattcttagaatggagtattatataactttggaaaatcagtgaaagttacccacatcaacatagatacctctcaaaatataatgtaaaacaaaagaagcaagtcacagaaagctatacatattattctatttgtataacattcaaaaaggcaaaaataaatactgtgttgtttttgaatataaagtataagtggtacaaaacaaaataaagaaagggaagaaatttacacagaattcaggctatctttatcttgagagtgggagaggagatggaatacgtgagaggaatgggggggcttctggaatatggtaatgatctgtttcttggcctagaaagaggtatctggacaatcagtttattattttctttaaactgtatatgtacacttgcacaaattattttgcatgtaggctctatttccgaattttaaaacatacaagagtaaccaccaaaagaacagaaatttccaaatcaatagaggaaacaacatagagtaaacgcaatcgattctctatacaacattgaaatggaagggagaaagaagcaaaggaaaacacgctgaatagaatataaaaaagaaaatattttaactaagtccagctgtgtcaggaatcagggtaagtacatctgttaaaattttatcaaaacgaatgttttaaaatcttgctatgtgttgtttataagaaacaaatttaaacataagttttgaaaagaaaagtgtggataagtacacaccacggaaataggaaccaaaaaaaagctgacggaataagttattgttaggcatgacgaaagttagcaataatagaagagaaagtatttatattctttttttaaaattttattattattatactttaagttttagggtacatgtgcacaacgtgcaagtttgttacatatgtatacatgtgccatgttggtgtgctgcacccattaactcatcatctagcattaggtatatctcctaatgccatcccacccaccccccgccccacaacaatccccagtgtgtgatgttctccttcctgtgtccatgtgttctcattgttcaattcccacctatgagtgagaacatgcgctgtttggtgttttgtccttgtgatagtttgcagagaatgatggtttccagcttcatccatgtccctacaaaggacatgaactcatcattttttatggctgcatagtattccatggtgtatatgtgccacattttcttaatccagtctatcattgttggacatttgggtcggttccaagtctttgctattgtgaatagtgccacaataaacatacgtgtgcatgtgtctttatagcagcatgatttataatccttttagtatatacccagtaatgagatggctgagtcaaatggtatatctagttctagatccctgaggaatcgccacactgacttccacaatggttgaactagtttacagtcccaccaacagggtaaaagtgttcctatttctccacatcctctccagcacctgttgtttcctgacattttaatgattgccattctaactggtgtgagatggtatctcattgtggttttgatttgcatgtctctgatggccagtgatggtgagcattttttcatgtgtcttttggctgcgtaaatgtcttcttttgagaagtgtctgttcttatccttttcccactttttgatggggttgtttttgtcttgtaaatttatttgagttcattgtagattcgggatattagccctttgtcagatgagtagattgcaaaaattttctcccattctgtaggttgcctgttcactctgatggtagtttcttttgctgtgcagaagtgctttagtttaattagatcccatttgtcaattttgtcttttaatgccattgcttttggtgttttagacatgaagtccttgcccatgcctatgtcctgaatggtattgcctaggttttcttctagggtttttatggttttaggtctaacatttaagtctttaatccatcttgaattaacttttgtataaggtgtaaggaagggatccagtttcagctttctacatatggctgccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctctgttcttttggcttaggattgacttggtgatgcaggctcttttttggttccatatgaactttaaagtagttttttccaattctgtgaagaaagtcattggtagcttcatggggatggcattgaatctataaattaccttgggcattatggccattttgacaatattgattcttcctacccatgggcatggaatgttcttccatttgtttgtatcctcttttatttcattgagcagtggtttgtagttctccttgaagaggtccttcccctcccttgtaagatggattcctaggtattttattctctttgaagcagttgtgaatgggagttcactcatgatttcactctctgtttgtctgttattggtgtaaaggaatgcttgtgatttttgcacattgattttgtatcctgagactttcctgaagttgcttatcagcttaaggagattttgggctgagacgatggggttttctagatatacaatcatgtcatctgcaaacagggacaatttgacttcctcttttcctaattcaataccctttattttcttctcctgcctgattgccctggacagaacttccaacactatattgaataggagtggtgagagagggcatccctgtcttgtgccagttttcaaagggaatgcctctagtttttgtccattcagtatgatattggctgtgggtttgtcatagatagctcttattattttgagatatgacccatcaatacctaatttattgagagtttttagcatgaagagttgttgaattttgtcaaaggccttttctgcatctattgagataatcatgtggtttttgtctttggttctgtttatatgctggattacgttaattgatttgcatatgttcaaccagccttgcatcccagggatgaaacccacttgatcatggtggataagctttttgatgtgctgctggattcggtttgccagtattttattgagggtttctgcattgatgttcatcagggatattgatctaaaattctctttttttgttgtgtctctgcccagctttggtatcaggatgatgctggcctcataaaatgagttagggaggatttcctctttttctattgactggaatagtttcagaagaactggtaccagctcctccttgtacctctggtagaattcagctgtgaatccatctggtcctggactttttttggttggtaagctattacttattgcctcaatttcagagcctgttattggtctattcagagattcaacttctttctggtttagtcttgggagggtgtatgtgtctgggaatttatcaaattcttctagattttctagtttatttgcatagaggtgttcctagtattctctgatggtagtttgtatttctgtgggatcggtgttgatatcccctttatcatttttattgtgtctatttgattcttctctcttttcttcttcattagtcttgctagaggtctatcaattttgttgatcttttcaaaaaaccagctcctggattcattaattttttgaagggttttttgtgtctctatttccttcagttctgctctgattttcattatttcttgccttctgctagtgttgagtgttgctcttgcttctctagttcttttaattgtgatgttagggtggcacttttagatctttcctgctttcttttgtgggcatttagtgctataaatttccctctatacactgctttgaatgggtccaagagattctggtatgttgtgtctttgttctcgttggtttcaaagaacatctttatttctgccttcatttcgttatgtaccccatagtcactcaggagcaggttgttcagtttccatgtaattgagtggttttgagtgagtttcttaatcctgagttctagtttgattgcactgtggtctgagagacagtttcttctaatttctgttcttttacatttgctgaggagtgctttacttccaactatgtggtcaatttcagaataggtgtggtgtggtgctgaaaaaaatgtatattctgttgatatggggtggagagttctctagatgtctattaggtccgcttggtgcagagctgagttcaattcctggatatccttgttaactttctgtcttgttgatctgctaatgttgacagtggggtattaaagtctcccattattattgtgtgggagtctaagtctctttgtaggtcactcaggacttgctttatgaatctgggtgctcctgtattgggtgcatatatatttaggatagttagctcttctcattgaattgatccctttaccattatgcaatggccttctttgtctcttttgatctttgttggtttaaagactgttttatcagtgactaggattgcaaaccctgcctttttttttgttttccatttgcttggtagatcttcctccatccctttattttgagcctatgtgtgtctctgtacatgacatgggtttcctgaatacagcacactgatgggtcttgactctttatccaatttgccaatctgtgtcttttaattggagcatttagtccatttacatttaaggttaatattcttatgtgtgaatctgatcctgtcattatgatgttagctggttatttcgctcattagttgatgtggtttcttcctagccttgatggtctttaaaatttggcatgtttttgcagtggctggtactggttgttcctttccatgtttagtgcttccttcaggggctcttttagggctggcctggtggtgagaaaatctctcagcatttgcttgtctgtaaaggattttatttctccttcacttatgaagcttagtttggctggatatgaaatgctgggttgaaaattctttcctttaagaatgttgaatattggcccccactctcttctggcttgtagagtttctgccgagagatccgctgttagtctgatgggcttccctttgtgggtaacccgacctttctctctggctgcccttaaaattttttacttcatttcaactttggtgaatctgacaatgaagtgtcttggagttgctcttcttgaggagtatctttctggcattctctgtatttcctaaatctgaatgttggcctgccttgctagattggggaagttctcctgaatgatatcctgcagagtgttttccaacttggttccattctccccgtcactttcaggtacaccaatcagacatagatttggtcttttcacatagtcccatatttcttggaggctttgtttgtttctttttattattttttttctaaacttctcttctcgcttcatttcattcgtcttccatcattgataccctttcttccagttgatcgcatcggctactgaggcttgtgcgttcgtcacgtggttctcgtgccttggttttcagctccatcaagtcctttaaggacttctgtgcattggttattctagttagccattcatctaattttttttcaaggtttttaacttctttgccattggttcgaacttcctcctttagctcggagtagtttgatcatctgaagccttctactcttgactcatcaaagtcattctccatccagctttgttccattgctggtgaggagctgcgttcctttggaggaggagaggcactctgatttttagagtttccagtttttctgctctgttttttccccatctttgtggttttatctacctttggtctttgatgatggtgacgtacagatgggtttttggtgtggatgtcctttctgtttgttagttttccttctaacagtcaggatgctcagctgcaggtctgttggagtttcctgggggtccactccagactctgtgtgcctgggtatcagcagccgtggctgcagaacagcggatattgatgaaccgcaaatgctactgcttgatcgttcaagttttgtctcagaggagtacccggccgtgtgaggtgttagaacgcccctagtgcggggtacctcccagttaggctactcgggggtcagggacccacttgaggaggcagtctgcccattctcagatctcaagctgcgtgctgggagaaccactactctcttcaaagctgtcagacagggacatttaagtctgcagaggttactgctgccttttgtttgtctgtgcccggcccccagaggtggagcctacagaggcagacaggcctccttgagctgtggtgggatccacccagagcgagcttcctggtctctttgtttacctactcaagccttggcaatggcaggcgcccctcccccagcctcgctgccgccttgcagtttgatctcagactgctgtgctagcaatgagtgaggctccgtgggcgtagggccctccgagccatgtgcggtatataatctcctggtgtgccgtttgttaatcctgctggaaaagtgcagtattacggtgggagtgacctgattttccaggtgccatctgtcacccctctcttttactaggaaagggaattcactgaccccttgcgcttcccggataaggcaatgcctcgccctgcttcggctcacacacagtgcgctgcacccactgtcctgcacccactgtattgcactccccagtgagatgaacctggtacctcagttggaaatgcagaaatcacccatcttctgtgtcgctcacactgggagctgtagactggaactgttcctattcggtcatcttggctccatcccccgttttttattgacatataacaaattatccaaaaactagatatttaaaaataaaagtggtggctggcagccaagatggccgaatagaaacagctccggtctacagctcccagcatgagcaatgcagaagaagggtgatttctgcatttccatctgaggtaccaggttcatctcactagggagtgccagacagtgggcgcaggacagtggttgcagagcaccgtgcacaagccgaagcagggtgaggcattgcctcactcgggaagtgcaaggggtcagagatctccctttcctagtcaaagaaaggggtgacagacggcacctggaaaatagggtcactcccaccctaatactgcacttttccgatgggcttaagaaacggcgcaccagaagattatatcccacacctggctcgaagggtcctatgcccacggagtctcgctgattgctagcacagcagtctgagatcaaactgcaaggcagcagcgaggctgggggaggggcgcccgccattgcccaggcttgcttaggtaaacaaagctgccaggaagcatgaactgggtagagcccaccacatctcaaggaggcctgcctgcctctgtgggctccacctctgggggcagggcacagacaaacaaaaagacagcagtaacctctgcagacttcaatgtccctgtctgacagctttgaagagagcagtggttctcccagcacgcagccagagatctgagaatggggagactgcctcctcaagtaggtccctgacccctgacccccgagcagcctaactgggaggcacccccaagtaggggctgactgacacctcacacggccgggtactcctctgagacaaaacttccagaggaacgatcagacagcagcattcgcggttcacgaaaatccgctgttctgcagccactgctgctgatacccaggcaaacagagtctggagtggacctctagcaaactccaacagtcctgcagctgagggtcctgtctcgtagaaggaaaactaacaaacagaaaggacatccacaccaaaaatctgtacataaccatcatgaaagaccaaaagtagataaaaccacaaagatgggaaaaaacagagcagaaaaactggaaactctaaaaagcagagcgcttctcctcctccaaaggaacgcagttcctcaccagcaacggaataaagctggatggaaaatgactttgacaagttgagagaagaaggcttcagacgatcaaactactccgagctaaaggaggaaattcaaaccaaagacaaagaagttaaaaactttgaaaaaaatttagacgattgtataactagaataaccaatacagagaagtgcttaaaggagctgatggagctgaaagccaaggcacgagaactacgtgaagaatgcagaagcctcaggagccgatgcgatcaactggaagaaagggtatcaatgatggaagatgaaatgaatgaaatgaagcaagaagagaagtttagagaaaaaataataaaaagaaacaaacaaagcctccaagaaatatgggactatgtgaaaacaccaaatctacgtctgattggtgtacctgaaagtgatggggagaatggaaccaagttggaaaacactctgcaggatattatccaggagaacttccccaatctagcaaggcaggccaacattcagcttcaggaaatacagagaacgccacaaagatactcctcgagaagggcaactccaagacacataattgtcagattcaccaaagttgaaatgaaggaaaaaatgttaagggcagccagacagaaaggtcgggttacccacaaagggaagcctatcagactaacagcggatatctcggcagaaattctacaagccagaagagagtggaggaggcccatattcaacattcttaaaggaaagaattttcaacccagcatttcatatccagccaaactaagcttcataagtgaaggagaaataaaatcctttacagacaagcaaatgctgagagattttctcaccaccaggcctgccctaaaagagctcctgaaggaagcactaaacatggaaaggaacaaccagtaccagccactgcaaaatcatgccaaattgtaaagaccatcaaggctaggaagaaactgcatcaactaacgagcaaaataaccagctaacatcataatgacaggatcaaattcacacataacaatattaactttaaatgtaaatggactaaatgttccaattaaaagacacagactggcaaattggataaagagtcaagacccatcagtgtgctgtattcaggaaacccatctcacatgcagagacaaacataggctcaaaataaagggatggaggaagatctacccagcaaatggaaaacaaaaaaaggcaggggttgcagtcctactctctgataaaacagtctttaaaccaacaaagatcaaaagagagaaagaaggccattacgtaatggtaaagggatcaattcaacaagtagagctaactatcctaaatatatatgcatccaatacaggagcacccagattcataaagcaagtcctgagtgacctacaaagagacttagactcccacacaataagaatgggagactttaacaacccactgtcaacattagacagatcaacaagacagaaagttaacaaggatatccaggtattgaactcagctctgcaccaagcagacctaatagacatctacagaactctgcatcccaaaacaacagaacatacatttttttcagcaccacaccacacctattccaaaattgaccacatagttggaagtaaagctctcctgagcaaatgtaaaagaacagaaattataacaaattgtctctcagaccacagtgcaatcaaactagaactcaggattaagaatctcactcaaaaccgctcaattacatggaaactgaacaacctgctcctgaatgactactgggtacataacgaaatgaaggcagaaataaagatgttctttgaaaccaacgagaacaaagacacaacataccagaatctctgggacccattcaaagcagtgtatagagggaaatttatagcactaaatgcccacaaaagaaagcaggaaagatccaaaattgacaccctaacatcacaattacaagaactagaaaagcaagagcaaacgcattcaaaagctagcaaaaggcaagaaataactaaaatcagagcagaactgaaggaaatagagacacaaaaaacccttcaaaaaattaatgaatccaggagctggttttttgaaaggatcaacaaaattgacagacagctagcaagactaataaagaagaaaagagagaagaatcaaatagacgcagtaaaaaatgataaaggggatatcaccaccaatcccatagaaatacaaactaccatcagagaatactacaaacacctctgcacaaataaactagaaaatctagaagaaatggataaattcctcgacacatacaccctcccaagactaaagcaggaagaagttggatctctgaatagaccaatgacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaagagagaattttagaccaatatccttgatgaacattgatgcaaatatcctcaataaaatactggcaaaccgaatccagcagcacatcacaaagcttatccaccatgatcaagtgggcttcatccctgggatgcaaggctggtccaatgtatgcaaatcagtaaatgtaatccagcatataaacagagccaaagacaaaaaccacatgattacctcaatagatgcagaaaaggcctttgacaaaattcaacaactcttcatgctaaaaactctcaatgaattaggtattgatgggacatatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggcattcaattaggaaaagaggaagtggacaaattgtccctgtttgcagatgacatgattgtatatctagaaaaccccatcacctcagcccaaaatctccttaagctgataagcagcttcagcaaagtctcaggatacaaaatcaatgtacaaaaatcacaagcattcttatacaccaataacagacaaacagaaagcctcatcatgagtgaactcccattcacaattgctcctaggaatccaacttacaagggacatgaaggacctcttcaaggagaactacaaaccactgctcaatgaaataaaagacgatacaaacaaatggaagaacattctatgctcatgggtaggaagaatcaatatcatgaaaatggccatactgcccaaggtaatttatagattcaatgccatccccatcaagctaccaatgactttcttcacagaattggaataaactactttaaagttcatatggaaccaaaaaagagcccgcatcaccaagtcaatcctaagccaaaagaataaagctggaggcatcactctacctgacttcaaactatactacaaggctacagtaaccaaaacagcatggtactggtagcaaaacagagatatagatcaatggaacagtacagagccctcagaaataatgccgcatatctgcaactatgtgatctttgacaaacctgacaaaaacaagcaatggggaaaggattccctatttaataaatggtgctgggaaaactagctagccatatgtagaaagctgaaactggatcccttccttacatcttatacaaattaattcaagatgcattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatcggagaaaatgtttgcaacctactcatttgacaaagggctaatatcccgaatctacaatgaactcaaataaatttacaagacaaaaacaaacaaccccatcaacaagtgggcgaaggacatgaagagacacttctcaaaagaagacatttatgcagccaaaaaacacatgaaaaaatgctcaccatcactggccatgagagaaatgcaaatcaaaaccacaatgagataccatgttacaccagttagaatggcaatcattaaaaagtcaggaaacaacaggtgctggaaaggttgtggagaaataggaacacttttacactgttggtgggactgtaaactagttcaaccattgtggaagtcagtgtggcgattcctcagggatctagaactagaaataccatttgacccagccatgccattactgcgtatatacccaaaggactataaatcatgctgctataaagacacatgcacacgtatgtttattgcagcactattcacaatagcaaagacttggaaccgacccaaatgtccaacaatgacagactggattaagaaaatgtggcacatatataccatggaatactatgcatccataaaaaatgatgagttcatgtcctttgtagggacatggatgaaattggaaatcatcattctcagtaaactatcgcaaggacaaaaaaccaaacaccgcatgttctcactcataggtgggaattgagcaatgagaacacatggacacaggaaggggaatatcacactctggggactgttgtggggtagggggaggggggagggatagcattaggagatatgcctaatgctaaatgatgagttaatgagtgcagcacaccagcatggcagatgtataaatatgtgactaacctgcacgttgtgcacatgtaccctaaaacttaaagtataataataataaaataaaaaaataaaaataaaagtaagaatttattatctctcacggtttctacggatcaagaatcctggcagggttcagcaggatggcttttctgtatgctacaaagcctgaggcttccgctagcagacttgaaagttaggggctggaatcatctgatatctcatgccctcaaatatctaagctaggggctgggatcatctgaagactcatgccctcacatatctgccagttgttgctcagggttagctgagaccacagctagagctagcagctggaatatgtccatgtggcctctccatgtggcttgagtctcctcacaacatggtggctgagttccaaagacgagttctgagagaagctgtattttttatgacctaggctcagaaatcacataacaccatttacactgcactccactggtcaggtcagtcacaaacccccacccagactaaaagaaagagaacaacagccttgccgccctcaatgagggagtgtctgttacactgtaagaagagcacaggattggataaatgtgctgatgtgatcacctttggaaaatacaatctgccacaacattctttacaagcacatatgaaacataagcaaaaattaaacatatagtaggcctgaaagtagtttcaatgaatatcaaacaatagatatcaaaggtttcttattataatgcattaaagttggaaaagaattactaaatatgatttttaaaatatgtttgaaaattacaattttatgacagtttccctttgtgaattgggattagacaaggaccttaactaaatcccactggatgaaggtccacatctggagtcaaaagagatcactaatttggttgtggatacattgaatttgaagtgccttagagacatctaaaggaaaatatccaggtaagcagttgggtagatgggactgtagctaagaggggaggtctgagagtggtaagttatctgtaagtaggaagtaactgcagttgtgaatatggatgtgactgtccagggagtcagtataagtagaaagacaaaagggcctaggactgatccgtgagcaagttcaacatctaacagttgtgttgaggaggatgaatcctacataagagagagaacagttgccagagaagtaaaactaaatcctcaagattcacagaaaggtcaagcaatataaatactaaaaaaagcccaataggaaggtcatcgaggaactcagcaggaactgttttgtggactgatggaggcagaattcagtttggagttggttaagacagaagtggaagtcattaaacaaagacaatgagtaaagacaatcctagataagcttggctgtgactggggaggaaagagtggcaactaaaggacaaagggctggaagacggtttgtttgtatagtttttaaacagaaaaaaggccgagtatgtatcaaggtaatggagaagatctatttaagatgcagagtgagtgtagaagagaaagggtaaccagtactgaaggttcctgagaaggttgaaagggacaggtggtaggactggttttaaactgagctttggcctcaccgtaatcatatagtgtcttatgataggaacccatgctattgtcttaatgcactactttatcgtgtgtttatgttttctcaccctaattagaatctaagctctataaaatgtatggcctttattgttcaaaccaaccccaccttactcacacattgaaaaccccagattctatcccagcacccaacagtcattcaataaacactcatgtgtcacttagtaatgggagtatattctgagaaatgcacccataggtgattttgtcattgtgcaaacatcactgcatgtacttacacaaacctagaaagtgtagcccactatacacttatcctatatggtatagcctattgctcctaggttacagacctgtaaagcatgttactgtcctaaatgctgtaagtaattataacacgatgataagtatttgtgtatctaaacatctaaacatataaaaggtatggtaaaaatatagtattataatattatggaaccatggtcctatttgcagtccatcattgactgaaatgacattatgtggcacacaaccatacttgttgaataaactaatacaagcagattctatcatctttgtgtacatctttgtgtaaatctaaaaatgtgtgtgtgtgtgtgtgtgtgtgtgtgtgtgtgtgtttgtgtgtgtcctggctatccaaaatgcgagcaagtcagaacccaaaagttcttgttccagagtatagatatctagacaatagtcaggaatagccactcaaattagccctctctttcccatgttttccttgacctaaaaatccaaggatctaaactacaggccatgaaaacattttcacctacagttacaatattataccacttcccactttcctcatgcctaattcgtccatattttgttctagagcagacaaactctgtatccttcatttgacctcctgcaagacataaattaaatttaaatgaatccaaatactttgggcttcagttctcctaaaagaaataaacatggaagtagagcagtacaggccagtaacacactgatttatcttgctgatttttcagaggatagccctccaaaaaatctttacaaacctcaagcctctcaatccatggatccaaaccccagctcccttaaaaataggtctgaatttaaacaaatatctttccgaaatatagaaacctgctttgatggtgactcatcttatcccagtagaaacctttctctgggtaccatccaactgcaccattcttaaggcaacattacctggaactgagggatttgcctctattgttgcattctgcagccctcacctgacttaactgccacgttaaggaattggttattgacctttaagtctttaacaattatttacatacctaggaaagagtctgtgcattcaggtacaagaatgaagacaccgaataaattcagccctcgttttcatttttatgctacgttcagtgagctgttactgcagacaaattattgcagcattctttcaaatgatagccaattttcaactaagagaagattcttaaacccctttctaaaaccttttcctgcatatcggtgaaaaccaggcagttggaaaacacagccctggttaaaccacataataataaattaatactttaaacacatggaattatttaagaatctgcataataatttaaaccctcataagacatagcagcaaaggccccaaaaacctaacacttctcagatatattcctagaagttttatttcaatttatatgtatgcatttcttacagaatattttcagaatttctgaaactcagatacatttagagtccagggaggtgaccagaataattcttacttttgttatttacctggggagctaatcaatattgttaaaatgtaggtgaaagtctttctatttgaccataagttcagcaataatacggaccacatctgtcttgttctatattaaatctacatcttctagaacactgtctggcacatatactccgtaaaatttctttaataaaagaatattataagttttcactattactaggaatgaaaattgattgcaaattattaaggaaaggttagttttgagttttgttcttggttttcattcattctcttaatttgtaccccatgctttcacaaaacaataagttatctctctactgaagcctacccttctatggcctgagacacatacacacaacacgacatgcccttgccacatctattcaatgctgtcatatttgccatgcatcagaaaaataaatttaccaagtagcagaagctctggaaaatcattaggtgacatctgaggagcagaataccaatcagccaataattagcatctgaaaattcatagagtcacagacaaatcaaattccatgaaatctcagggagcttggctccctgaccctggctgggttggtgcccaggcaatgggtaagcagtaaattgtgccaccccaacaggactggaaggtgccatggctagtctaaccccagggggagacattctgacaatgtggcatttgcacagggatgccctaacatggccccagtatgttttctcagaacgggatgacattttaagtcaaatagctctgttcccaatagcacaggtcctctcccaaactctaatagcctgaatttgagaaaaagaggttcatcttggggagaaactgatgttttgcagatgcaatattaaaacaatccatttataaggaaggcaaaaccagatattcagtgtttaacttcatttattacctttccatcattacatagacctcagatagccttagacttaaaaagtcattcacatttaagcaaaactctgttcctggagcatctacactggatacttttcaatgaatgctgaaactggttataaagttgtgctaccaagaggcatgaagagtgactgtcagtaccttaccaaacccctgctgactggaacatgcaagtcagtccaaggatgcagggccaccactgttactgctgcctccagcctaactaaggtcacctttcctgcatgcctgcctcattctaaaggaagaaaacagagaggttggagaataccagctccccatttggtttctacagttgccaactctacccacatgtgacttggggaaagcacccttaagaagagtggggtccaacgtccaaccagactgacccagccttgggggtaaacattccacctccaccacgtggcctgtgtgcacctgatttgaatctgctcctaccctgagccaagggtgaccattctgccaggtccccactccactgcagggtcaggcagcagcctctgctcctggctcctggcccagtgctcggatggcccagcaacgtcactgcggagagggagtctggttgtgccctcctctgaactctccatctggaagactctctagtctccttccctctcatttttaatctgacagacactgcggacagggaaactcagagcagaccaaagttcatcttccctttcctgcttcatggctggcataatcacaggggcagaacaaggttggcatggaccaggatgccaggaattaaatgagggtccctgaccactggaacacattagtcctgccttccaaagtcttaattagtcttcctgtgcctggcacacctaccaccagggaggtggccgggtaaggtgccatgctcacagcaagtattcaacaaaatattggtagagaatggcggtcacaaatgcctgctggctcatggctttgcaacaacagtcagctctgaggtctgggcaccagcggcaagatttctgctctctttactaatgcagacagttctagcagcgttattctgagtgatattcagccaccagctcaatttggaagcaaaatgatcttaacaaacagtggcagacttgatagacaggctgctgagcctggggaccaaaacaaaggatgaaaagaaaaagaaaggaagggttgatgacaagacgaggagtgggaaatgaatactgcaaagaaaaatgaggaggattacagtactagatacttcagtccggcaactctgaaatgagctgtgaacataacaacagactcaagggtggaaacaatggggggaatcaaggcaacggaacagggcagcatctgtcacgaattttgatgctgggacagacttagcgctagcagtggaatagatttgatagtaagtaatatttgagaggtttcaaaagacaatgggtcttaattctgtcctgttttgcacctcttgaactacagtgacataccaaaatttgctatttttctaagaggacattgacagatacaatgaaaattgtgaatacattttttccttctgcattcattatctctggcccttatccacaggcctattgcagactaaattggattttggatcactggtactgaggtgctgcaattaattaacaatagaaacataatatttatatccaggcctaacaacatctgacatttaaactattctgccagtcggacaaattccattcgacaaattttcattttaatgaacatgacagaccacagtttgcatgataggccaagcagcagaacagagttgacctcttggcatgtgttttcaaggactgaccatgctccagaagaaacaatctgagaaactgtcagaataacagaaagaccagatccccagttccacccagacagaccaaatacataccaccctcatgtcccccagcacagatcctagtatgaaactgtcctcatttcatgtgcgagctcaaagttaaatacttactgccccttgtaatccactggataatttttctatctttgggttgctgacattttctttggggtactgaagtcccttagcccttcctaattaaaaagtgataaacatttttgcaaggcatccaataatgtgcaaagtacacaagagttggaactgatgcagctttttcagttggcacaaaactggccttccacattttgccagatggtgtatctcagtaagtccccaatccctgactcgagtgaggggcattgtcaatatgatgctgaagcagagactatctttaaatgctatcttattttgcattatactaacacgatgggtctaacacttattcttgctgaaactttcacagctaaagaagttttcattcttctgtgactcattattcaagccaacagaatatgatacagataaggggaaaaattctgcccctcttaagaaccatataaatttgctggaaaccaatgtcagagagcagatctcccagcaagacttcccattgctcctctatgggttactggtccaaagcacactgggtgaaatagtatgtatttacccaagcccatctctactaccccaaaaacgtggatgtcaaggatagagataaagatgaaaaatgcaaagacagcaaggcagatagaagcttaatagatctgggaaataagtaaggtcagtgaaaaacaatatattgtagctgggatccctaagggccgtatagttctagttcacatatctacaacattccttattctagtttttatgtcaattcaaaagaactgaaataaaattccactttaaaagtaatacttctttggagtagggatttggttcatgggttccaatctcagcaactgaaatgactacctacatggtaatttgttttcaagctgtggctctgactagacccaaaatggtaaccatgcttatgttactattttattttattttattttattttattgacatggaatctcattcttatcgcccaggctggaatgcaacgatatgatctcggctcactctgcctcccgggttcaagcaattctcctgcctcagcctcccaagtagctgggaccacgggcacatgccaccacacccagctaatttttttatttttaatagagacggggtttcaccatgttggccaggctggtcttgtactcctgacatcagctgatccacccgccttggcctcccatagtgctgggattacaggcatgagccaccacatccagctcatgttacttttagatatggccatgataccagaacattaagcactgaaaggatgacagcatttccaccagtgtaacctaatttagaatcaataatgtgtcactcaaatcggcagcatgtacatatatacatacagtgtggatggacacacacacacacatatatatatacatacattaattatagtaatagccacatgtttgaggtttttacatgcatcttctcttatataacaccatgagataagtactattatgaactctgtaacacactgaggaaagggcagttacagttcactgacctccttaagaggtaaagtcaaggtcacaggcatgtaagcggcagagtttaagtgcaaatccaagtctgcccttcctccagagcctgtgctctacacaacacagtggcatatgacagcatccgcaagggaaacagcatgaaggaattgattccttttggcaacagtcaaaatatcttttaaatatcaggtataaaacattttcagaccaccagatgcttattcaattttgaaaaatcaatttttatggagttgctatgagtagtttcatgtttgttaatgcctggttatattcttgaaaaagtagcggcctcatagagaaaaatatatatatttttttgaaagttgggaagaaaaatgagaccttaactggattaaattgaaaatatttgacagaacacaaatgaatagaatctgtaactttaacatgcctttgcaggaggcatgttctaaaatggtcataccaaattcagaacacaatagacttaacatgcttcttgttgtaaacaaaggcattgggttaaatgaaagttccatcaaagcttaataaccaattcaagtgaacacaaagttaagcgttatatactttctgcggtttcagtaatagctaatctaataatggtaaatggagggttattgttgattcctttgcctgtttcataaattagataaagcaacgtggaagttagagtactttagagttttattggactaagtgattttaaagctatctcaaaatataacgaagtcatgacttgaatgactgctgagttgtagcttgttttccatcaccatgttagtacttttcaccagtgttaaataaaaagcttcctgttaactaaaacaattctataaatacaatgtctatctacagaaccaaaccatttaaggtaaagtgtcattgatacagtatgatctgatattctatttcaccagggccaagcttataaaatattaactataagagcagtcaagtgttatttatttcttctgatacaaaactcaggaacagtagaatttctctgcttaatgattttccatagcacatttccaattttctactacagtttattgatctggaatactaaaacagttttcttccctgtctaaagaacacaaaaagccctgtgcccctagtcccatgggatgtgcctccaaagataacagtcgtggcatctcatcaggcgctgaggggtggtaatgagaagcaaggcattttccttactgaaagaaggtgctagtcaaatctcaggccttttgataacgggaaacacttcccaagcctttgcatttggagatgaggctccacacctgcagttctgagagcagatgagttgcccttcacaaaggcagtctattttcctgcatttccccttcatgccctgatatggttactttcaattaccctgatagtccaggaagaaaaatatccctctctccatatttcattcacataataagaatctgcaagctgttctgtatgacagatgaggactgtgtgctgaagcaacttgttccgcctgtcagcctccgagaacccacagcaatgagatacaatcgtgatgacattactagagaagaagtgggtcaaatacatggtcactttaaaacagaatgtcaaccattctttctacttcagtaatttgatgcagtggtactcaaaacacagacagagagagagaaaaggaaagagagagagaaagagaaaaaagttcaccactattagtttagtgtccatacatacacaaatgcaaatgcaaataattgttaaaattactgttcccatatacccttacatgacttttttcatcctccagccaattagtcaagaaatgtttagtaagcatgtggtatgagccagacactgaaatgggtagaatgctgaaaacagacacagcccctgccctcttagagtttacagtctaggataaaggacaaagattaacaagcaattgagattaatgtaatgaagcctgaaaaaaaacgaagtagaaggtactaaaagagcttacaatataagaactaaccaagtctttcaggtcagtaaaggtttctctgaggaagagacatttaagttaaggtcagaagtattagagcagccagataagaggtgagagagaagagtgacaagtggaggacttttctcctcagaatgtttcctttcaaagaaaccattaagacaaaggcctcaggacacagtagaagatataatggagtaaatgacgccatcaagtctaccattgggacttattgtctttccttatttcaatccctagtttagaaaattaatttttaaaaaaaatttttaaacattagtatacctctgtcctatcttgccacataagggcaaaagttaatcataatcacattttcttgctgatctaaatattaaggtagattttactttaaaaaatctaatttatcttgactgtactggttaaaatccatgggttatttttaaaaatatgttttgacagcagtgaaacttgcagcacatacaataccaagagcataaatttgttcagggtataagtacatgaaaattaatataagcagttggtaaatgtgacttataaaaaaaaagactgtaccaactacatgccacaatgggtggaaataaagaagaaaaaggttctttttctctaatatttggtcatgaaaattctgatttgttcttgcagaaaattgtttttggatcattattcatctctcttacagcatagaacttttttccatgggatcaacaaattggaatggagaggaaaaaccggatatattcatgagtatgtttgccctttctactaaagcccgagtgtgatgttcggattattttctttccaaactcaaaatccattcccagaatccaaaatcaataaaaatggtactagcaaaactgagggttgaatttggcctaaaaactcaatgactaagtagagctactaatatgaggagaggtttttaaaaaaatgtctgtagttattaatcaccagcaatgactttagcagctgctctaaagtaaacacaatctacagctactttaaagcaatacagtgtaaaaaccatgagaattaacattctactgggtgaaaggtggcagaatatgccaccccaaaatataccacattggcataagaattattttcaagctaaaggcacttataaaaaaataatttaaaaaaaaaaacagcaggtgcaagaagggttttctgaccctcttctttttcttcataaaagcaagagctaaaatccctgtatggaaaatattctcctgacaccagaaggaaagtaacattcttatcatcaagggcgggatactgagaccaagagaactctgtacaaacaaaccttattaaactagctcttattttcctcgtcacctctccacccagttaaatatcctggcccaaggccctttgccttgtcacatcttcacaatttactactctttatccaattccatatataagtgttcaattctaacttcatctttgggtcttcatttccttatgagggctcccatgtcacaaaaaaacttacattaaataaatttgtatgcttttcttctattaatctgccttgtatcaatttaatttttaagcccagccaaaaaccctaagaaggtaggggtgaaattttgcttcccctacatctgttacttaggtcttatctagagttcaacctgaaaggcatattttaggaggaatattggccaaactggaaaatatctccaagaggacaactagaatggtgagaggttctgaacttcacataagaaacctggggatgttcagcctggagaaaagcaatgggagacagcaaaactaccttcatacattcgatgggtcattcatcaataaggccattccgttttactgagcacttcctctatacaaggtaccatgcaaggcaaaggagatacagcactgagagagaaagccagtcttttcttaccatgcggaagggaaaatggattttctccatgtcacttcacaagatactgtagagtagagcagagcacagattttggaatcagagcactagagtaaaaacctgtactgggttgaatgccattccccacccctccaatatgtctgtgtcaaatccctggagcctgcaaatattactttattagaaaaaaaagtctttgcaaatataattaagaatcttgagatgagatcatactggattgtctgggtgagctctaaatataatgatcagtgttcttacaaaagaaaggcagatgcagacagacagaaaagaagaagatatagaagagaaggccaaatgaagcaaacagttatgtgggtgcaagccaaagaatgcttggggccaccagaagctagaagaggcaaggaagttttctcccctagagcctgttgagggagcatggccctgccaacaccttgattttggacttctggcttccaggactgtgaggaaataaatttctgttgttttaagccaccaaatttgtagcaattggttacaatagctctagaaaactaatataactcccaattacttagctagctgtagtaccttactagctgtgttacccattgctaataactctagccctctgagaaccaggccctcattaggaaactggagacaatagaaatactcatctcacaggtcagagattaaggaggtatgtcaaacgtgcagcacagggcctagaacaaagtaagttttcagtacataatagtgttattattaatggattcagatttactgggaagcttgtgtagaccttagaacaatatatcaacaggtgtaataacagctaatttatgcagtagggctctctctactggtaaatatatgtagagaccagataaatcattttccagaaatactggaaaagggatgtttatattgtttgggaggctggaataaacatccactagccttccttctagatcaacccagtaaccatttctccttggtgcatcaggtcaagatccttaggcaggttaacccagtaagggaagtgaggtatacacagggtttggctgctaccttaaaaagtcccttcccctcgctgtaccttgttgtctttagctataaaataagcatattctgatcatgtcttagtatttccaacttgaaaatgccaagacacaatgagaaagacttggatcaatgagatagtttgggtatttgtccccccaaatctcatgttgaattataattcccagtgtcagaggtggagcctagtgagaggtaattggatgatgggggtggatttttcatgaatggtttagcactatcctcttggtgctgtcctcataatagtgagtgagttcttgtgagatctggttgtgcaaaggtgtatggcacctccccttactatcctcttgctcctgcttttgccatatgacatgcctgctcccattttgtcttctgccatgagtaaaagctccctgaagcctcccccaaaatggagcagatgccagcaccatgcttgtacagcctgaagatctgtgagccaattaaatctctatttttttaataaattactgagtctcctgtatttctttatagcaatgcaagaatggcctaatatcatcacacacttaaattttctgattctcagaaatgaagcaattagactagagtaaggattgctaaggaccagttgacaaaccaggaccaaaccataatattgtttttaaccagtacctagcaaaatgagaaaaatttaaaaaataataattttttaaatgtctttgcttggcagaattaaaagttagcaatcctatgtcagctcccatcctatctcacttcctaattcaaaaattatgtttacagcctctgaaattctaaagttttggaactggtatatcacagaacaatctattaaatttgattcctacactaatattctgtgatttttttaaaggacatttcagaactgtggattctatcactgacgtgttcaagttcaagaataagaagtcatccttttagaatttaaaaatactcactggtaaaatcatatagaactaaatgttcacaacagtaaaatggaaaaatctaaataaaatgagtcgctagtaaatatgatgctatagttttacaaaatgttatcatgaagagaaattgggtaacgcataggcatgaatctctctatactagttcttacaactgcatgtgaatctagaactatctaaataaaaatttcagttaaaaaatactcactgggttgtgtgcaatggctcatgcctgaaaccccattttggaaggccaaggtgggaggatcccttgagtccaggcatttgaaaccagcctggacaacataataagaccccatttctacaaaaagtttaaaaaaaattgctaggtgtggtggtgggcacctatggttccagctactcgggaggctgaggtgaaaggacctcttgagtccagaagttcaaggtggagccatgatcatgccactgcattccagcctgggcaaaagagtgagtctcggtctcttacggaaaaaaaaaaaaaatgctcactgggctctaaaagttcttaatgttgtttattaattcaaacaatggtcagattcaaactcaataaatataatcaactgtgctttatacatagcatatggacagttactatgaaccatttgtttggcaaagatgtactgaggatcttctatattccaggcactatgctaggtactagagtctggtggccaactcagttcttcccttcacagagagtaacacctagctggagaaaaaggcaataaataaagagacaacttcaaattgtaacaagtgctatggaaaaaagaaaggctgaggcagaaaacacagggagggataaggaactacatgagccatacatatggaaaatgaaactgtgatgcaggaatgtgcccttattttttgtatgcctatattattgaactggcataaattctgaataatgaaaatatgtgcttgggttgtgactgtggtgggctcttaaaggtaggctctgcccttctgcaccaataaaaggagtgagaaaaaaaaagtaaagttgacatttgcctttaacaaataaggcaatacaagactgtccatatgtaaaagttaaacatacaatgggggccgggcatggtggctcatgcctgtaatcccagcactttgagaagccaaggctggtggatcacttgaggccaggagttcgagaccagcctggccaacatggcgaaaccctgtctctacaaaaaaaaatacaaaaatcatccagacaccatggtgtacacctgtaatcccagcttcttgggaggctgaggcacgagaatcgcttgaaccagggaggtggaggttgcagtgagctgagatcttgccactgcacttcagcctgagggacagagcaagaccttgtctcaaaagaaaaaagaaaaaacgtattccataaacatacaatggacacagcactctgtgagatgaaattctttaaaaggtatgtgagtcataatttcccatatatgcccaccaccccttggaggaggaggggttggctctctacctaaactagaagataaaactctctcataatcaaagacaggggaggaccagggaggtcttcaagaggagaaacatacctttgaaattctctcccttcttagaagattcagaatatttcaaatactgcaaagtatgccctgggagccagtcaaaatatgtagtaggccagaccacaggactaggaaattaagatacagctgcctgctcctattaggcctaggtgcagggccagaatattaaggttaacttgggcccagtttggctgaaaagacacaggcttcaaataagactggacaggagagcaggtaaataaatagaatattcacataatggaacattatataacagtcaaaccaaataaagcaaggtacagaacaatgtgtattgtacaatatctttatataagaaaggaaggaaaataacgtacatacatatttgcctgtgtgctaataaaagtggctactaccttaagggagatgggtacaaagatgagggtatgagaagaggagcaagaacaaaatttcactttatacctttttatattgttttgtaaaaataaagagctaaaagattataattctcattgctggtgttagtcacacatttggagagggcaattcggtggtatacatccaggtccttaaaactggcatatccctagacccagaaattccacttttgaaaggaagttatctaagaaaataataagagatttgtgtacacacacacacacacattcactgcagaattatttatcatagttaagaaaatttttttaatctacatgtaaaataataaagaaccagtgaaggaaattatgggccatctaaacaatccagtaacatgcaactgtcaaaaactacactgtaaaacatataccgtagaatactcagtggcacagaaaagtattcatagtatattttttaaatcattcattaatttttcaataccttctttagagcatctaccaggtactaggcactgagctaaatgctgatttaaaaggccagttacaaaacagtatataaatggacaattccattttttgtgcatctgtgcatttataactagactagaaggatagacaccaatatgagagtagtgattacctgagtggcaagattatgggtgaaatatattttctataatgaacatatattatttctgcaatatgagaaaaaagcaccacttttttaatcaggctaacaactcccaggatcaagaatgtgtctcattcatctctctgtcctctcaccccctcctgactccctgaatacaaacatgatgcttgcttcagctgcagcaattctgtggccattatggaaaggccaagaactgcaagatacactctccttgacatctctgagctgctgaactaaagccaaagctaaccatttctagacttctttttatgtggaagaaacaaacctctattctttttaagcaggttacttgcagctgaaagcatttgaagctgacatagtaacctattaaataatacatgacacattaaggccagtacaggcaacccagcaaatttctttgatcaaccagcagaaactgaagactgatgtggttaattgccccactagcttctggctctgtattctcttctctgaagctcctgggaagtagagcccaggagaagctgttagtgaggattcgagatccataggggagcactgcttgctgcaaagaaaaaccaggcagctactcctacagctttacaacgtggcccagcattcccactcctggaaatgtctcctaagaaaaaatcatgaatgtgattatgcacacgtgcaaatacatcagaaaaaatggtgaggaaaacctatatgttgaccaagtgggatagattaaaaaataatgtcatgttctaacagtggaatactctgtagacattaatgccatgggaaaatgcatacaatatattgacgagtgaaaacagaaaacaaaactgtatgtaaagtattatccaaatttagaaaaatgtgtccattttctgttagaaaactaacagaacaaatatgcatgcaataaaaacaatggaaaaaaagccacacactgaaatattgatagtgctatcatgaatgggtgaaatgcaatgttattttattttttgagtatttctatatttttttaaatcttccaaatttattttcttgtgcagttggtaagaaaatttcttctaaatagcaccttcttacagaatattctgggccctccgaccaagatgttcaattcatccacaccaactttgtctaatacctgcctgcagatccaatggagttaacaagaaacaatttatttttgtgttttaaaaatagacatggcaacagctgtaagctaagctacagaaaatgataaagaaattttatttccaaataaatttgcattgtataaatgcagtacattttctttaattccataaggttttgatactgctaatttgagaaaaatattgatgtttccttaaataagtctaatttgtattgaaattcatcccctcacttgaaatggaatgatcttgaaaacaataaaaatgaatgttaatttgctatgtcattgataaaagcaattccttttatatccttgtccttatccattagacttcattttacagaaaaggtagctatcaggcaggtctgacctttttgccacctaaggacattagctattagagctcaagctccctagccggatggcctgggtccatatcttaggcccaccacttgccaactgggtgtccttgagcccttgtttaacctctctgagcttcagttttctcgtgtgtaaaacaaggataatacaagtatcgactccatagagttgctaagaggatgaaatacgaaaatctacataaagatcttagttcagtgcctggccatagtaatctaatttaaaaaaaaaaagtaaggtctcttttaacttgctttcaatttttatgtgcagatagatcatggacctgaaattttaggtcctaaagaggcccaagcatcctggtttaagaacccatgttggaaaaattagctgggtgcagtggcgcatgcctgtagtcccagctacttgggaggctgagacaggagaatcgcttgaacccaggaggcggaggttgcagtgagccaagattgcgccactgcactccagcctggatgacagagcgagactctgtctcaaaaaaaaaagaacccatgttggatacagatacttgacttttaaatgcagactcagtatcatttacttagcgttccctatgataaatgagatgtttagggaaaatgttgggtttttttagaccactggaaattgacttcagcatgtgtattagagaatgtaactaccccattcaccttgtcctgtccagtactttcactaaaagcaaggtattgtgaccaataataaaatcatagctaaaataatcactaacatgtcattagtgcttaatatgtaccagaaagtgccctgtgtgttttcatgtattatctcatttaatcctcacaactaaccaatgaggtaagttctcttactatccccatttttagatgagaaaactgtggtataaagagccaggaaagtgctaagtcaagatataaatatagtatgtaacaatatactatatttactatatgtattataacatatactataataatatatttttgttataatatatagtatattatattatatgttataataatataatatagatatataaatataaatatatattattgttatataatatatattatggtaattagtaataataataataacacagcatcattattcaatccctgtgacctgccaaatgcagctctagatgccttcccagtgacatctcttgtgttgacaacaatcttttactattcttatttaatggatgaggaaactgagaacttaaatgagttacttaagatgagctatagctctgactggttccaaagccagccactccagaattactcttctacagagggcagggaaaacagctcattaggtccctgaagtgctctacccaggtcacagaatgttggagaggaataggacttcagaatgatcagatccaagccctcactttacagatgtggaaagggaggcccagagaaaagagacttgcataaggcagtgggagagccagaactaaaacctgggtctcccagttgacatgatgtagccatctcatgttgagtcagctatctcaggcactgtgaaagcaggaagggaaagctgacagcttcagagtgatgacagcagactgtcctccctctctctgctccctgctgaccctgggactgctgcatatgcttcctggcccactcagagtagcagcaacatgacttgagaagaggctcttcaggagagaacccacaatgaagacaggaagcacccatgcccttacatgatctacctagggcccatttccaatggaatccccctgaaatagaattaaagatcaatggagatggagggttgcctcagacacatgtgggtctcttttgtagacatacaacacaacctaaatctttgagaacatgatctgactcaacaaattacctgcattttttctgattaaatgtacatccatcttagtttgtatactggataaaaataaaccaactcgtacagaaagttttttaaaaatagagttttggggtgtttaattaaaaatgctttcagtattatgtaatccttgaaatacaacagttgtttactctgctttgatttctaagctttcctttgatgacagatattaatatttatcatttttctgatgttggactaatgagaatcttaagtgtttatgagaagccatttaaatattacagtactgcagatatgtttgttttctgatttatattcctgtctttaacatcaaccaggatttatttttttgtgctgaatcctgggttgttgttcatcaacattttcagtaaactttaaatagccagaactgatgatttctacatttatttgatggtcaaagtgaatatgaaacttcaccaaataacatagtactatgggaaaggtttagttatgatttataaagtaaaaactggaatgcatgtataactgctagccaggaatagagtaacattccaggtttaatgacactgatctcaggtcatacgtattgagtgctgagtatgtatcaggcactgtgtagaacataattgaaatcaatgatttcacttgattcttacaacagctctaagagctaggtagtattatcatctccattttacaggaaagcgaagctcagagaggttgagcacttcactcaagatgacacagcaaatgagaggcaaagccagaagtgagtcctcagggtcagataatgggctcttatttataattcctctctcaagggtccctctgtgactccccagtatttgaaaaatcttattctctacaaagtataaataacccatctgcacagagcaacagtcttcagacaacccagactttcagatcttgatggctatgatgagtcacacctcattttgtttatcataggccatgcattgttctatgcatggagacagcaataaacagcaccaacaattgtccctgccctcatagtgctatctttctagagagggaagatagataatattaacacaataaacaaagcattatcaccattatggggaggaaacgggaggctatgcaaattcagagaaatagtaaaaggggatgaagtctgcagtttctgtagatttcacttgcatatactccccatgcagccaagactcagctaaccagagaaatgacttacaatcagtaacagaagatggcccagaagtagtgtggtacagtgcaaaatctaacactgaattctcagttagggacctgacataaatcactcaccctgcataaggaccaggtgcaggggagacagccatcagcaaaatagccactaccgctgcccttcatagagcttacagtccaaagggaagagaagcattgatttaaaatcaaaggttaaataaaagctgtaaaaagtataagaaggaagcaaaagacacaggagctaacctataggagactaagaaaggtcaacattctgccaattgcactgtctgtgacccacaccaagtcatttttcctctttacagccagtttttcaaatatgcaaataaaggagagtagactagatgaatccaaccagcttctttcaagctctttttaaaaatctcttgaagccatgattctaacatataaaaattatgtatctcctcttctttccaccaattaaaagatcccaaactgtcagtccctttcattgtattcatctgcctcactactgctagggctttgttcttgattttcactgccatttggcagagaagtcaaatcaggagggatatggatgtgataccgcattagggggcagaagtgggtatcgcagatgctctgatcagaacctagtgaaggaaatgagaaggaattgggttatacaaatggaacctagggtccagagagtgtattaacaggtaacaaattagcctgtggagatagtaggcattagggaagcatcagccaggactgtaactcatgttctggccaaagggaggggaaaaaaaaagtctagaagtagtggagaagcagatgagtggaagagaggtctagacagcaaacagcatggatccaaccacaatactgagatccagggacaggagcattacccatgggaaaaaaatccaaattccatactttgacttcaaggccctgtatggcctgggccctatctatacagccaatttcatctgatgtcagtctccctttccctctctatggttcagccacaggggccttcttttctccctttgatggtgttaagctctttcccaccttaaggccttggtataggctattccttctgcctgggaccccattctattaataccagctcttcatatggccagctccctctcatcctttacttaggtctctgcttaattctcagctctttctgtctggccattttatctcaataggttactcatccctctttctatcacagtatcttataatcttccttcttgtacttgacatattattattacaggtgtttgcctatgtgttatctgtccccttcactagactccatgagggcagtgctgatattttatatagatcatcccatttaattcataacaatctacgaagtgggtactattatgtccattttacaaagagaaataaaactgcaaagaaaaacaactggccatatatatatatatatatatatacacaaattctaaacaatactactcattacattaaaacagaatggcaacttagtagaagccacaaaaatctgaaatctttttatttcaagtgtagcccatggaccagcaacatatatatcacctggcagcttgttggaaatgcaaacacttctggcctcaccagggcccttgcatatagttccagcagtcctcaacccacaggagttggacccagctgttccatctgcaacaggaagccaaacacagctaacacctctaggccagggaaaccttggcctgttgccttgtggaagttcaagaggctagaggaagccttagtttagaggaagctttatccctgctcagaggagccaagagagggcctcagctgtagatttttctgaagcttcttggccttgtttttatccaccaggctggcagaacccagcaaatgggatttcaaactacagtggctacctgttttgctgtatccctagtgtcacatccctcttctgaaggtatcagcagctctcgttaaccagggcctttctgtgtgtacagccctgcaagctttgcacagcacaactccagcaggcaccagtcacatatactctggtatgaatggtggcctctgatgctaagaatgtggcagccctggcccacttcctctgggtgaatctctcctctcccagggtgggcatttgctccacacctggccactcacagtacccctccaactggctatagaaacaattccaagtggtaggcatatggcccaagctagaactccttcaatctgctgtaaattttgaggtattatgggcaaatagatatatttcagcccatacaattgagtctctctaaacttgatggaaaaaatctgggatctttaaggtaacatgttatatctgattattaagatgggaatttaaggtaccttgccttctaatggaaatttatgtagccaattacagtgcccccttctttacataattttaacccattgggattgctttctaaccagtggttcttggccctggctacaagttagaatcactagagcatgtctcgtccagatcaattaaattgggaaaggttggtggcacaggccttggtacctcaatttcagctgcgctagactctgactactcatctatgtaaggcgtcccaaagtggcatatggtgtgctacatagtctatgcttccaggcaggccaacaaagtggtagactacatccagtgaaaatcagacctgccactttctgatgatgtagtaactgacaggcagagactaattttacttacacaagtggctgtaaaacaaaatattcccctctctctccaccccaccattttttgttgttctacctctcccacactctctgcatttgttttacctccctcttgcctctcctgctctcccttggatttcttgccagggtcattcctagaagagattgaactggaatcgctagtgctccaggactgaaacaatcttactctaagcaggttccaacccttccctccacctgtcctcagggctccaaacgcataggtaaacttgtgcttctgggcacagcttaaacatctactgacaaaaccaagcaggtaccgtccttcagttaatgtggagtccaaaggcagcagtgagttttgtgttttgctttgttttttcaaaactaagatgtgggaagaagacttctcagaaaataaaaatcttgttcttaccacattccacagacttcagtgattaaatgactgtagattgtatgctcctccagcctggtctaactaaaatattcatgcattaaaccttgtgagggagtactgatacttcaacattatctatgatggtttctaactccagtagctgtgagtctgagaaactgcaaaatatactgaattttaataggattctgattgttaagaaaaagaggtaaatccataacaaagaacactaataaacacttaaaaagactcagcaagagtctttaagttacagaatcctgaaaatgtgtatcttttgtgaacttctcaagcagtttctcaattttctcttctattcccacttattcatcattaaaagaaaacactggcatacaaacaaaatacccctaaaataagtgatttttaactgcagttaacactctggcaaaaacactctttttcccaccctttctctttttctctgtatggagtgaacagaccagaaaagtaaggccactacattgtgaaataacctcctggtgggcagaaaggttcaggaaatgctgaaaaatgaaattacggtgctgggtaatatatattcaaaccaagaatgttcctggaccgttgatataagggtttaaatataaatataaatactcaaatataactgtatgcattttctatgagtcagaaaaacaactttccaaaggaaagggtctgaaaggggatcagaatatgctaccccaaaatatgccactttggcataagggttatttgagttgaaggcaattaagaacagcagattcagaaaaaacaacaacaaaaaaaaaaacacctctgccctcctccatctagctaaaagcagggcacagattttcctttgtaaaggtgacatattttctataaataaaggttttcccctttccctaccagagagacttcttacctgcataaacaaaccttactaaacaaccttcatttaccatacattttcctagtcattttttcacagtttatccccctaccccagaagcccaaatccccttgtccttttgtaaccacccaacaggttcattttgcctgctgcccagatggtttatccagagagaggaattgcaacagagaaagaatttaattcatgcagagccggctgaacaggagaccagagttttattattactgagatcagtctccctggaacatttcagagactgggattttttaaggataatttggtgggtagcgggccaggcagtggggagtgctgatcggtcgaattggagatgaaatcacagggagtcaaagctgtcctcctgtgctgagtcagttcctgcatggaggcacaagaccaaatgagccagtttatcaacctgggtggtgctatctgatccatctagtgcaaggttggaaaaatatctccagcaccaaccttaggttttgatgttatccctaggagcaactggggaggtttagaatcttgtggcctctagttgcatgactcctaaaccataatttctaaacttgtggctaatttgttagtcctagggggtttgggaaagggttgttatcatctttgttccaaagttacactataaactaagatcctcccaaagttagtctggcctacgcacaggaatgaacgaggacagcttggaggttagaggcaagttagatgcggttaggtcagatctctttcaccgtcataatttttgcaaaggaggtttcactttgtctagtttcttctccacataatatataagcccccagacctaaccacctctttagggtcttcacttcttttctatgaaggcctctgtatgcatatgtaataaatgatttctcctcttaatctgtcttttgtcagtttacttttcagtgccccaggagcagaacctaagaaagtagagaaaggattgtttttcttttttcctccctcacaatcaccacatatatggattatcaagaaaattaaaggtatgtaatcaaattagcttaattattcttctgctttgacagaggatgggggtaggaagaaaactttataataggcagcctttctagaagtggttcatttcaatggttcatttcaagctactcaattagaatgtaagaatattaccagtaaaaatgagtggtattttatctgaacaactgtttaaaccctttcaataacactgccatagatcatgaaagcatgtcactgagtttctttggaacacagttttaatgggattatagccccccactccacccccagctatgaggaatgaggcaaactaagtacaggacgagaaacacaacctgaaattcaatataaggaaaacccttagacaagcacagcaagagatacaaggagggtaggggagaaagagtgtccctggtagttaatctcaaagataactagtgcaaaatttatagttagttcatcaaattccatgacagctttgtgatgacgcttttctttcattcccaaagccttcaaaatgctactttctagatatttcattccccactcagaccttttacctattggattatacctgattcattccacgatgctgtgttattagaatcagtggttttcaatgttaaatgcactttagaatcagctgcgaatcattccacaatgctgtgttattagaatcagtggttttcaatcttagatgcactttagaatcagctgggaaatgtaaaaaataaacaaacaaaagaaatcacacaaacaaaaaaaacacctgctcccctccccactctttcggttatctggatgggaccagccccaggtgattctaacttacagccaagcctgagagccactagttggaaagcaatccaaacaaattaaaattacataatgaaggaataaacttacattaggaggccaggtacctcgaattcccatcctaataatcagatataatgtgttaatttaaggatcccagattttgtccatcaaatttagaaagactcaattgcatgggatgaaatatatctatttgcccatgatggggttcaggacatactaccctgaaatattgtaagctgaatgaatttgagaagacagcagaagccagaaggtcagaggtcactctctgaccttccttctgccctctctgaagcaggtcataaaacctaggaagaattatctggccttctcctgaagcaggtctaagaccctcctgtgaaaggtttctcacttcccatacctggaatgaaagaacatccttatctctgaaaacaaagggttacagagaatctgaacaaacaggtcttgctatgtttcctcccattgttagctcatgttttcttattcaatcatacttctacacaactatgtacttcttcatcaaatctagcataaaaaatacacaggtttaccagttttgggggtcttcattccattatgaagaatcctgtgtcacataaaacttacgttaaataaatctgtgtgcttttctctcgttaatctgtcttttgttacaggggagtcaaccaagaacctgagggtgaggaaaagatacttctcctccccgaccccataatacgccaacttttacagaggattgaagaaattccaaacatcatatcatagaggtaagcaaaaacagtagaattaaaggttatctaagtcctcttagtattcaaaatatgataaacaaggaaacagagcaggatgcatcaacttgtgttttttattgacaatgataagaataaaatcattagctaccatttatggagtaccagttactgtgttaagcatttcaatgggttacctcactgaaaactaaaaacatccctctgcaatagaaattatcgcccccatttcacaaatcaggaaattgaggctcagagagatttggacactttccccagagtcacacacatagaaagtagcagaaccaagattaaagtccaggtcttttgctctatcgagtccattctcttaactacatcatctgtcacctagaccactgaagagtatcctaagtacttgctactcaaaggacgatccatggaccagcagcatcagtctgttagaaatactgactctctgatcctttccaggtctttaatttaatcagaatctgcattttaagatcagcaggagacttgtatgcacattaaaattaaagaagcacaaacatacatgcttatcccacatcaactattacctcagataaattcattatccataatgcatccatactttttaaaacctgatttacttgacaaataaaaattgtatatgtttatggtatacaacatgatgttttgaaatatgtatcccatgtggaatggctacatcaagctaattaatatgcactacctcaaatacgtatttatttgtggtgagaatgtcagaggtgtttgaaccagagcaactccatcttcaataggggctgagtaaaataaggctgagatctactaggctgcattcccaggaggttaaggcattcttagtcacaagataagatagaaggttggcacaagatatgggtaataaagaccttgctgataaaacaggttgcagtagagaagttggctaaaaccccccaaaaccaaaatggccacaagagtgacctctggtcgtcctcactgctatactccctccagcgccatgacagtttaaaaatgccatggcaatgtcagaaagttaccctatatggtctaaaaagaggagtcacgaataatccatgccttgtttagcatatcatcaagaaataaccataaaaatgagaaaccagccaccctcaggactgctccgtctatggagtagccatccttttattcctttactttcttaataaacttgctttcactttactctgtggacttgccctgaattctttcttgcataagacccaagaaccctctcttggggtctggatcaagacccctttctgggaacaagaacacttaaagtctacactctaagtaatcttcaataatacaatacatagctatacatccatacttttatgaaaacaaatccaacaatttcatttccccatttaaggccattaaacaatttcccaaatgccctcggaataaggtcgaaatgcaggtaaccggactctgcatagtattactcaggctcaccattctcagcaaactaacacaggaacagaaaagcaaacaccacacgttctcactcataagtgggagttgaacaatgagaacgcatggacacagggaggggaacatcacacaccggggcctgttgtggggtagagggggaaggggagggagagcattaggacaaatacctaatgcatgcagggcttaaaacctagatgacagattgacaggtgcagcaaaccaccacggcacatgtatacctattaacaaacctgtacattctgtacatgtatcccagaacttaaagtaaaattttaaaaaaatttaaaaaaagaaaaacatatctattactcaggctcacctctgcagccttattctctccacctcctccagccattgattttcataccctaagcacacagaccttctttctgctcatcaaatcccaacatcccctccctccctccctcctgtcctccattgtactaggttcttccctgccgagaatataccctcactcaccccatcagtgcctccctaccagccccatttactgctctcaccagagcagatgcagtgcctggaacagagctaggagcaagataaatgtgctgaataaaaatatgtttaggatactgagggcctccgctgtttcctttgtccttctcctctgctgttgctgtgatcctcattcctgttgctccttccctgttccctgcatcacttcttttcagtaactcacctccttatcgtaacctcatggctattgaagttgtcagctttagaaagaagcactgccacatccccacggtcattgccccaggattactcaccagctggatgacaactgcctcactctaaccctgagcctcctgggataggaccaatcctttctagagatggacagaaggccccactgacagaaacaggctgcttttaaatcaaggatttaatatataggtggaaccatagatcaggggcctctcagcaggcagtaccgagccaaaagcttcactgtctctctgcccacacaagagagtgtcactgtgctgacaagacaggttatcaagagttgtgaggaacttcatattttaaatgtgatgaccaagtgtgctactctaagaaaacaagtggcaaacaaatccttttataatataaatacctgcttaaagttttaaatcttgaggaaatgtgaattttcatatatcaggcttacaataacaaaaataagagctattatatttatctattgactgcaagctgttaagagcctgacaacatgctcaaagctttaaacacactttcttcttcatcatcactgtgaggtagaaatgcttattatccctattttaagagagaaaaccaagggctaagtaacctgtctaaaaggcacagctgggaattaaatcatgggtccccagacaacccctctactgcttctctgctatgtcttactatatagatcactttctcatctgagaagtcacagatatggacattcccaaagagacaaccccttggagaatgatctcaaaggctgagatttttctctgcaatgtacatgttgaaagcaaagtaacctcctacatcttatatttcaaagctgcacttctgcattaaaagagtaaacagattcaatgaagagatgtgggaacagggtgcttatgaatgcaatgccacaagtactttttcagtgtctactggtggtcaggcactgtggtggaagctgaatgatcagactatcagttgggagagcgtgggggtgggggcatgggggtgatgaggagaacttctcaaatagactgtttcaggaatgtttagccaataattcataaaactgttactttattacctaactatatggaaatcatctttcagaagagaccagagttacctgccttattatctgtgaatacataattgaaagggccaatatgtcttccaaaatgaaagtcacaacttgatagatttctgagagttcatattagagggtcagattttaacatgtgaatgcaaacatagtgtcagaatttgttctcaagtgtctgaaagaacaaaagagaaaagagtaatgggagccaaaaccagactaacttccaaaatagaaacagagcatgttgaagttgcataaacacacaaataaagatggggacacaaaaacatttcctaaagcattctatcaaaggctgcaggaaaaaggccaagacaaggataccaaatagaaaagcataagcctaaaaaggttatccacactactgtgaggactccagaaacctgccttcttgcagaaacgggatacttttgacatgagggcatgagatgaagattgcagactacttcgtaacacactctcctcatttataaaataagagttagattagattatttataaggtccttccagtctgaatgcattaagtccttatcatctatgtggtccttgcaccttaagagagatgaccatataaagaagctcaaaaaacatttgttgaattcatgaagtattacaaccttaccaataataaataagataatttataacaattggtcctggtctgtggccttgaaagagcaaattagaggagaaaccattatctaaagagctacacatctggtgttcctgctagctgactgctggtggaatgaaaataaccctggacttgaaaataagatgcttggttctagtctaatctctgacacaaaccaactgtgtgaccttgggcaaactgctttaccacctgggccagtttcctaatctctaaaataaaggtattctaaaactatatacatatatatatggaatctttattataggccaagaagtgttccaagatctttgcattagaattaaatgatctcaaaggtttttgcagctcaaatgtttagtatctaagtacagaggcagcatggtataattaaaagattccaaattctgtagccagaaaggttggactcctcctcagctctgtaaggtaaggtctttctctaagcagagactgttaagcagaagggcttacagtctcagtccttttattcaccagtgttttaacttgaacaagttacttaactttcctagccttagttttctaatctgtaaagttgatataaaaatggttctcactctcatatagcttttaagaggattaaattataacacatatattttattgaatatatattatattgctagctgtgtaatcatgggctatcttctcaagttttttctcatatacaaatgggaaatgtagtattaaaaagagatcatgtgaacaggttctaaatggtcaagtgttagtggttttggaagcatgtacgttaatacttggaacaccgtatacaacaatcccatatctaacacttagaacagcatatgcaatcaataacaacacacacacacacacacacacacacacacacacacacacacacacacacacacacaaaccctagacttctttctttactaaatatttctagtccaggttgcagcaggtggacacaggccggcagccatgaacgcaggtccacatgggagttgtagttccgagtcaagcggctgctctacagaacggctagaagcgagacttcgtctcccaggagacatctcgccgtgcaaaatggcacgccacgaggtggagtacctgcccgacgagaaacaagaggcgggactgcaactcccagaagcctccgcggccaaggcctcaggccgcaggctgaagccaaggagggagagttcaggtagatccggcttaacatcaggtgcgagtagggaccacccttggtagtctgggcccggcccaggtcagaaccttactaaaacaaccactgtgagtattttctattggtcccagcacatttctgagagaccagaataataatagcagtaaatctgcaagtggtaaactttcacaagcataacctcaatttagatttcggcttcaggcaacatcctttggccacttgacctgggagcattgagctccttgtttcccagataagcgctgtgagtggctgttccaaggtaacacagcgagggcagaatgtgagcctacagagaaatctgcagatgcatctcaagttccactaacctgcctccttaccccccaccaccaccaacttggatatacctttaaaattcccccctttgacgctaaaaataaaaacaacaaccataaaataagtgtaagaaagtccgaccaagtaccgatgagttctcccacaacaataaattcgatgcctctttgcctgtttttgaagtagtaatgtaaaattatctcccaaaatgctgccttctctatactccggtttgctcctgtcctgggcacgtgttcagcaaccccttaggggaatccagagctgcgtgtttaacacagacctgttgggacggattttcgctacttgtctatgaaactgacgaaccatcccaaaacggcgggtgccgactacacccccagagccaagagctgtggcgtccccggacccgctggcgtggccccgtgcctcagtttccccaatgtataaacacggtggaggaggaacgggttagggctagggtcggtgcttgggaattggggggcccgagtccccaccctgagaccctcgtggggcggaagagtactcgggacagaagcccaccgccccgtgagcggcgccggccccactgggctccggggtgatgacctgacgcgcgtggaaacccagacccgcgccccagaaacagtattccacttgggcttgcctccccgcccctaccttccaggatgttgacagctgggaatgaaaggcagagggagggagcgcggggccggagcgccgcctgggagtgtgcccactgggtggccgcctgagggacccgggaacagagggcaaaaagtcctgtgaccggacagagcagagcggggactgcaattc

SEQ ID NO: 1170 - DNA, 1502098 bp, Homo sapiens; identical to SEQ ID NO: 1169
  misc_feature (369734)..(369734): n is a, c, g, or t
  misc_feature (455029)..(455029): n is a, c, g, or t

SEQ ID NO: 1171 - DNA, 33620 bp, Homo sapiens
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagaggtacgtggtggggggagggggagggccatatggggggcaacagggggaggggcagggggcgggggagagtcggggccgagggaagggagcggctgaaatggagggagaggggaggaccgggaaggcaggggtgggagcaaccgggaaggagggattggaggccagagggataggggtagataagggatggaggggccaggaaatgggccttgaaagggggctgaagggaaaatgatgaaggggaaagaaagcgccagaaaggggtgggaaggtagaaggattgggttggggaaaaagctgcagaaataatttgggggtgggagctgagtgatgaggaaaacatcaaggaaatagagggacagagtcttgggagaggggctaggaaggagaaatgaaaacataggggtgaaaagagaagccaagaagatgtggggggataatttggtgggggactcagagtatggtaaggggcggaaaaagagaggaggatggagggagagaaggggccagatggagagagagggaggcagtggggggtggggggatggagggtccagatggagggaagagagaagagagagggaacggtgggggaggggagaccagggcagggggagggccaaattatgtgtgcttgggggggtggcagtacaagtaagatgaaatgatgggagtaggggacaggttaggatcctgccccagactctgaccctcttaaaggctcttgaccagtaaaatgtaacctctggggtcttaatgctgtcttcacttcatcacttttacccccttcccccacccctccaatccttatttccattccccctccctcctctgctgtccatcacctatatctttccccccatatggtgtccgttccttatatgagtcccccttctgtccttcccctatatcagtcccctctctggtgttcattgcctctctcttatctcttttctatgtggtcgctcccttatatctctatcacttctttactagtccgtcttgaccccttctcatagcctccgcattaggtctgcctcctttgctctgacacatgtccagtcgagcccttcaggtgtattcccttgcccctgggcatttaccatcatttctgcctccttttctatctactcctattatttgtctcccagaccattccttgtcaccacaagtctgtgcctacccactttcccttaatacctcaactcttattatcatttctcttttcttgtctcctctacttattggggtgttggagatttggggtacaaagacacaggttttgatgattagaacaagggatccccatctcagcccttgagggatttctcatcctagtaaaaatttcccgtttctcagccatgttgctctgcctcttgcatctgcctcccagaatcattcttcaccaagtccagacagtatgtgtgtgtgtgtttctagagttgttcctaagttccctgctgccaggagaaagatgccctctgaagtctaacccgcctcccttggctgcagcctgaaccagccctttccccaaatgcttatgtgtatcaacagatttctcctctgggtataccaagtgtctaagtgcggtgggcatgttgcctgcaatgtctgtagtttcagaggctaggtattggtgatctctgtatctagagaacattagttagtctctgagatgggttgagatagagtttcaaagtatgtggtttctaaatggtggacattctgagggttcatcgctcactgtgatctggaggttgggtaaatttgagagacatatttatagacagaaaagggctgaatttgcaaaactctgctactcagtgcattctgttggaatgaagctcaaagaccagttctcctgcagtatactcatggttatcccataaaggtgacagagtttgatcttttttccatctaaaatctgataccttaagcctaatttctagctctttgctgtcgccaatgtgacatctctcttacttcaatagggcctgtgtggcattggggtttaaaggagaggcagtttgcagggagagcggcatggcaagaacaacagagctggggaaggaggaccctggtctcatctcagccataggcgacacttggtctactgttctctcttctcaaagttttgttcccatctccagctcttgtctttggaggcccctctgtgtcaccaggcctggatattccattctttccccctgacatctttcttcctcaagctcctcactgtgccttgagaaggctcctgacctatggagtggcttccatcctgtccactgagactaggtggggtgaggtggtgggggcagtgttgaatctctgggcactgaatgggagaagagataaatttggtctctacttgtccaaacaagggcatatttcccaccttctgccctggggcctccacagccagatgccgacaaaagccatcttctccttaccaccagaagaaccagaactttccctaaaggatgagcagggttgaactaggggaggagggcacagaggagggaagagttgggaggggaggccctctcatgtctctgactgtgaacaggtaagctccccgacttcttcttttctagatatttagccctcagaatctcatgatcccaatgttcctacacacacaccccatccttctttcccacagccatgtagctttcctcatactcttttatagaggggtggtgccaccttccaagtccttgtcttctgcagctatttggatgccttcctctacccagatatctgacaccaacttctctgtttttctcctgccaattttgcggcacctctaccttattttcctgaagtagatggagagctccttcatctttctctgcccccaaacgtgtaccttctctgtcatataattcccatccctgaacctctgcatttcttcccccaagtctccagagccttctgtgatgtgatcctctcctcttttcccctttgtataaatgcttgtcttgtgttcctttagagttgccaggtgtctcactttcaactgtgatctcctgaaggccggtagggtccccttctcactttgtggactctcttcttgccattttaggcctctgcttccaaatgcatagagcctcccttactgtttctgtgtgtctctgtcctccagatgtacggggaccctctatgcaccgaacccaatacgttcattccccgtatgatcgtcctggttggaaccctcggttctgcatcatctcggggaaccagctgctcatgctggatgaggatgaggtgagtgtggtgagaaggctgggaaaacgcatgtgggagaatggggagagtcctcattagtgaaggggagagagacacaaagaaggcagacaaagaagaaacatttgcaaatggcaggagggtggccattgagacttgggttggagtgtgacaagaggggtagtcattctctcatcttgggcagggagtctttgagggttatgagctgtgttggggaggagatgtggttctgaagatttcgggggtggggaggctcctgttttcacactgtccatattgtaggataggttagaatggggaaggggaactgaagggtttggagaaggggtgaagacatggaaggccctcccaaccaaagcaatcctcaggacccctctctgctttgcccactgagcaagactcccagtcctttctccatcagggggcagagtgcaagaagagaaattgcaggacgcagagaaaaggcaggggatagaggaggttttaggtagctggaggatactgggaaagaagactgaggtcagtggatcttggcatgatggggtgaagactgggagagtgattgagatcaaggtttagagagacactgagagggcttctgcaagggagtggttggacatcaggaaggaatataagggaggggaactgggagtatgtggagttatctaaaggagtacaagtggagtaggggcagggactagccagagtaaaggagatgaaacggacagaggcctcttatgggaggtggtggccaggtatggagatctgagagccagggaagtgtgggttctgatttgggagctgggtcagcaggagtgtccattggaggaaatagaggataaaaactggaatggtgccccacaagtgtgagtcagggaatgggggtgatttgggggacaagctttaaaaaatggtagggtagcctggaaaaccaaacgtggtgagagatggaccctgaaagttattgggaatggtgtgatgaggaagggttagaatttgagtcagggctaactagagtgtcaagggacctatgggggcaggtgagagtgtggagagatggctgggtagacagcttccaggccacagagtaaagtagaggtgttaaggagaggatatggtgactttgaaaggagaggtggcttggggagtctaagttttggacaccattgggagacatttgagtgactgtggtcaaacccctagatcaaggtttggagtctgtaggagaaatgggggaaactggaacccagagtggggactgttatagggatgaagagggaagacaatggattggggtaatgaaggaatgacagagatagggacagactgaagggaccagtggccagcaagttgaggggcaataggaatggccggtctggagcaggaagggcgtgtgtgtgggaggaggagtagatagaattgggaaaatgagcagcctgaacagacgcagggagttggaattggatgggtggtggaactggggctgggggatagtgaggggtctgttcctgtggctctttgtagaggtggaggagactgcaggggtggaggtgtatggaggtagggatggaggtggacagggggagctgggtgtgaagcttagggaaaggtgatggctgaggggaagaagggaactgagagatgctgggtcgggtgatggaaggagatgaaaggtgggggaaggtgaccaggccctctggcgggaggggaggttgggtcccagtctggccgcaagccgggccgtgggagggagacaagctgtggatcctgattataaatgcagcttctgctacccccgtgacaggctcggagggagagaagggggtaagggaggtgggaggttgggaggaaagcagggagaatggaggaactgaaggtcaagggaaaactggattcaggaagtagctaacttctgaggagttgcagaagagctgagtagggtttgggagaattctccggaaggtgtttcaagacaaatggagggagaaaagagggtgggacggcaaagaatgagagagagagactgggggagagaagggagagatccagtcaccaagtgtggaggggccggggcagaaaaagtgggcaggcttagggggaaaaggaggcccgcccttcctgggaggaggcggaggggggaagagggaggggaggggcggcgtgggccagggaggtctgacacacccccacctcccctagatacaccccctactgatccgggaccggaggagcgagtccagtcgcaacaaactgctgagacgcacagtctccgtgccggtggaggggcggccccacggcgagcatggtacggcggccgagcaggctctcatgacccggacaggcgcggggagagggctgaagatggaccgggctggcggggcgggggcgtcggggagcggcgggagctggccgggggcgggagaaggcggagacaaagtcttgcttcccgaggggagatggcgccctcctctggaaggtggagcgggacaggggctgtgggtgagaggcccctgtgggtcctcgctcggcttcgctccctttctcctctccagcagtgaagtttgactattttcctggtgcttgtaaaaatagtctccttagatctttagcttccagtccgtgtgttcctgcccctgcccctcccagcccctggtctgggatcttggaaagaatgacctagttcctgccctccccccagacctcttccccacccctatgctcctgattcttcttccggaccttcagtccttgaggtctccttttattaccccctgttttctcctctcatcagctgcttctattttctgcaattgtatcaccctttctctttcctccctgatttctcttattttctgtacccctcttgattaccccgtccctcccctctgctcccggcgaaagtccatcagactcccatctcatctcctttctgtctgtagagctatctgcgcggtctgtctctccaactctctccctctctccatctgtctcttcccctccctccccctttctgcccccccaaccccctctttagtcatttaaaaaaagatttttgtcttcctgagaagttcgcttaaaaggtttccatgggaacagtgaggggagatgaaggcagagaacagagatctgcagccaaggtgcagagagacgccctcagcccccggaaaccccctcgtcactgcccccttccacttcatttcccttcccggacctagcgatccaggttccccattcctccaacccccaggtgacccctttttcccaccagctccccctcccttcaggaattcaagctaccagtttctctcccttagagagccagtgacctgtccccatcctttggctccttccagccttctgataggtccaggccctactagccttgtgggccggtttggggaccttgggtgggtgggtgggtggtcagggatgtgtgtcattgtcatggaaaccccataccatcggggtgtgtgggtagcacatctctgtgaggcaaagtcaggtggtggtggagtgtatacagagaatgtgtgtgatgtctgtcacatctgtgtgtatatgtatatgtgtgtatgtcatgttcatgtctggggaagatgtgtgtgtttgtgtgcatgtgtgtacacctgcgtttccaggccagaatggtcacatgctcacagagcatgtttatcatgtgtcctgtggttggcagatctgcccacttattccccatctttctccttatcctgagtcctcagggtctaggggtctctggcgggggtctcccgtgtgttttgggtggggacaccgtgtgtgtttggagttgaggtggcatgtggaggttgctgtattggggttcagtaggggctgggaggggttccaggggcatatgtatttggggggagggcttagtgaaagttgatgggggtgaacgtttagggtcttcaggcagacatggaatgtgtaaagggcatggaggatgtgcagtggacataggggtcgttgggaccttggggacttggcaatgccaaggtgtttgctgaggctgtggactctccagcccgggagaggtcgccggacctttgaggggcattggaatcctgggctcctcctctgctgggtggagccgcgaaccctcgttctctccgcggttttgtgtgtgtgggggggtcctgctcaggaggggatggtgggtggcctggtttgttttgggggtccccttgcccccctcccccgtctctctcgcgctgtctccgggcgacagggctcgtgacagaggcggccacggcagcagcggtcgcctagcaacggcggcggggcccgggcaacggcggcagcggcgggagcggcggcggagggagccgttcccgcggccgtcaccgcgcggccgtcccggccgtcccgggccccgccgccgcccccaccgcgccgggcggcgcgagccgggccgtaccgccccctctccctccgcaccccgcccttcccccgcgcaggggcggggcccctcccccaccggggacacccctggcccccccggggggcggtgcgaggtaagggcggggccgggcggactaggagcgcgcgtagaggggggggcgccgcgcgcgtggggcgggggcgcgcgtgtgcgtgggcgcggggaggggggtggggaagccgcggtggcggcggcggcggcggcagctgctccctccgcatgttctcgctgcatcttccgagtggggggagttatggtaaccggagggggacagcggaggacgggagggtcggggaccggcctcgtgcggacagggtcttgagcacgcgggggcggccggtgtgtgtgggatcttggagcccctggtggaaggggcagcccgtgtgtccgcgtgtgtgttcgtgcccatgctcgtgtctcctgtgtgtcggtgccatgtgcacacgggggcccagttcctcgtgcacacatgtgcagccatccttgtgcaagtgtgtcctgtcttatcttgcctctgcctgtttcctgcctagggggctgttgggccagccacgggcttgtggggcagtccgcggccttgctggtccatgtcacctctgaccctgagcatgcatatccctggctggggctcacctcctgtcaggcttctgtgtgtgggaatgtgtggccctatgagcaggattttctgtgtccctggtggcaggtgtgtgtctttgcatgtgtgttccagcactggcctgagtatctgtgtcaatcccagcatgggtgtccagggcgtgtctggatgtgggtggtgtggctggggggagtaagtgtgtgaatgtgttccttggaattctactgtgtatgaaacacctttgggctgggcaggtgtaagccctgcttggtcagtaagtggggacagaaaagcttaaaaagggaagaaatggggtaaagaggaaaagtggggaggggataggagagaaggaatgagagaggcttgaagaagagagcagagagcagcaggccagggagaaagaatagctggagaatgggaatgtgggagaaagccaagccagacttagaagagagaacaggggataagagcttaagatggggaactggatagagatggtgggagaagaaggggtctgggagctggggaggcagtggggaggagagagtcaggccttctggtaaagtgatctctgaaagaagaaagggaagaagatgggagaaggcactggattcttgtaggccttgcaggatcaggcttggttttggatcagggaaggccactcaggcatacgggctggctcacagtgaggcctgtcatagcagggactgtcattagaggttcatatccccagcacagagctctgtctcccatttctctgctctgtgtccaaccctgttcttcgcccttctctggcaacctccctcctctggctccccttgagagctgccagctgggtgtggagaggaagaaaggccaaagggaaggttagggatttggagggcagggggagattctgtgggtgatggcaagattagagatgttggaggggcaggagtccaagcccttgctgtgtgtgtgtgagtgccattgtgtgtgtacacagggtgtgtacatgtgtgggtgtgtgcacaatgcctgtgttacgggtttgtgtaggtggctgttatgtgtgtgcatgcgtgtatacatcgtgcaggcatgggacatggagacccaggatcacagtttgtgcttttcaggtttgctgtgtgtgtgtgtacacgggtgtgtgttgttttctctgtacatgtcactgcatgcagcattaataacaggatgttctgtgtttctgtcactctgccccccctttcctctgtgtttctgctattcttttcctgcggcaacaaaagtgtttaataagcatatgtgtatgtggcctctgtgtacctgtgacttatgagtgagttcatggatcttagttcttggtaatatgtgtaaggttatattacttccaagaaccaagcaagccaattagcaaatttgttcttctgttaatgctttagttccaaagcggaattttaatgcatttaaagttagactttatgcctttattagatgagcttgcacatgaaaataatggctgagctcggttccctgaaatgagagtgaggcagccatacctgagaaatgcagaaaaaatgttactagggaagagatatcctgaaccattggatgcattgcttagtgtgtaccagaaggataattaacacatttgctcctggtttttctttactctggtggcaatctcggatgcctgtgttagagtgagagaagggctgggggaggaaagggggttgtcctgagacagagtggatgtggttgtacttttcacgtgaatgaaaggatgtttgtgcttctgagatatggggatacctttctgtggtcaggatcatggtgtactcaagcatgtatttcaggggttaaactggaattcccctgcatggggatatgtgtgtcttagggttataggtccatttctgtagtgtgctgtccacatgattgcccaagagacttgggccacaaagtccacaccagcagctctcatgtgggtcactgggttcaagtatgtactcccttgttgcagagctcacatatgtcaaagcatgtatcctgtggggtgtgtgggcctcagggtctcagaatgtggatccgtgctatgcccgtgctcacagttgtctgtatgtctcaaaagcacatagatccccagttatttttctgtattgtggttctcatatacacgtacctccatagctcagtatatgtttctgtactatacacctgttcctgagggagtgatagggttctcgtgtcatggggtccacatttttgtatgcaaacctcctaacacctgggttttacaggtaaagggaagctgaggactgattctagggcagtttgcaggcaatttgcaattctggaagcagacagtgaaaatataattgtggtcctcccttgttctgttctggaacctagagggttaacaggcagctcttccggtccacccccctccttccagcctgtagcttcttgttgccgtggagatggtggccccgccccgatgcagcacctgcccccccattggctgcagtggtgactgtggggctgaggggggagcccaggcctgggcagccattctggagctggagccggagcttggcatccccccacttacattctcttccagcccctcggcccctctaaattcccttgcagccgagcctcagcttcctttttcagcgcttgccatccctctaggctcttggcagactgagctgcatccgcattcacctcccctcctcctcctttccctatccttacttgggagtcccgagaacccccactgtccatccttcctgctccctgcccattcccctgcattctttgcttttcccctccccccaccaaccttctgagcccctgccactgcagtgcacgtggaaccggctccttctcccttccccccacctgccccttccttggattttctgtccccagcttctccccctgctactcttcacaggtctcttccaagacctccccctccagtccagggagggggtcatgggaggcagccctggccctccagacagacaggggttccaggaggtggggggcaggtggaagatgtgcccaccagggggaagaggaaagcctgcctatgggcaatgacctttaacccatctttccccccagctagccccttctggggtgggtgggcaccagggacctagcctccctggatctttggtgtccttcattactggggttttactgaccctctcagccatgctcccctgctgactgccagccccagtcatgggcctaaggcctcccaccccatccccctcagggggctcctgctcaggttccttgccccctccttcccgctgccagcctctccgccgtcgctgctcttcctgctgctttccggggggtaggtgaggccggagctgaggggcagagggaggtgggggcatgcactggggtcaggggtgggaacctgggttaacagcttcccttctggccccctccccaacttcccttctggccatttcctcccctccagaataccacttgggtcgctcgaggaggaagagtgtcccaggggggaagcagtacagcatggagggtgcccctgctgcgcccttccggccctcggtgagtggtgcctaccagatgtggctcagttgggccccctcccctccagccccaactggggccctaggagtctgagaaagagggcaggagggggagagagggagtgagagtgagaaaaagagtgtgtgtctgtgtgtgtctccccacctctttggtttcccccttcttggctctgcccccctgcttctgagaccagccctcccaccttctccaagctgtgtgtgtgtgtatatgtgtgtgtgtgtgtgcttgcactgtacccgtgggagcaaggaagacaaactggtattagggttcctatccccctttcctcgcctctggagacttcccttttccccatcccactttcatccaggggctctctaccagctgagggatgagtaggtagaactgaccctgccccaacccaccccatccccatttcccccccagcaaggcttcctgagccgacggctaaaaagctccatcaaacgaacgaagtcacaacccaaacttgaccggaccagcagctttcgccagatcctgcctcgcttccgaagtgctgaccatgaccggtacaggggctggagcatgtgggatgagattgatgtaatgtagggtctcctgtgtgagatgcagagggagggggttatctgtgtgcaaaggttgaaggattcaactcaagttggttgggggatgtcatggcacaggggacagaacagaaaagaactagaatagggatctgtgagcagcaggagaggggtagggtggcagagagaagacagacagacaggctggaaagggaatgaaggtgaagccaaggagggactcctcagggactcctcaggccaagaaggatgggctctagcccaggatcaaaggagctgtacaggaggagagtgaccctggaggaatgtttaaggaatgcagggaaggggttggtaggtgagtgagcaataggctgtaggtggaagggtgtcagggaaggtcaggaaatacaggggcagcaggttggagtggggctgggggtggctgaatgaatggatgatggctagggctcaaggacctcatcagtgagggaagagacagtatagagcatggcagagaaggggaggctgggacaggtgtgcagggtgacagaatgggaagcaacccatggactgaggcatgaagaagcagccagcggagaagtccagaaggcactgtccctgagaccaggctgaaggagacctccactgtttgcctttgttgcctgccatttggggttcctctctgggtttccccctcacccagtcactccccagggagaaccatgccctccctttcccccatgtctggccacccccaggattgggcaggtagggaggttgggataaagtgagtcacacctttccctgcccccctcccatgttgccagagctggatttggggccggcagggggtgagggcatggtattcctggccgcgggggcgggggggggggtccgggggccgggggagcgtcgcgctgacggcagccagagcctgcgatgacggggctgctataaataacttcttggaggctcccacacccaagctcccctcccgctttcccactgctctctactcttcatcccctgcccatctccataccgcttttgtattgctatcctacccctcattattccatgcccctagccccctttatcttctgccctcctgcagtgatttttttgcattccatcccctcttagccctcacctcggttctcccggccatctctccagttggccttcctcctcttctcctgtcctctgtcttgctgcacatacctttgtctccccctttcttcttcttgccctacctcctcttcttccctagtccgtgtattctgtcttttatcctctttgagctcttttctgcccacagctttctcctatttcttatgcttttccctcactctttcccctgcttctgctaaaacttgtcctcttatgctgtgttcattcattctttgaatcattaaatgtttatcaggcactagccgtgtgccaggcccaggctagacatatctcttctctgtgccttcacttctttacttccactttttcctttatactgaggctctggtttctggggttacctggaggtactacctagaagtgccccaggcccactttgttctctccttttttttttttcttttctgccatggtccatttctgggttgagatatttctagatgtccccagtcctcgcaatcccttaggtgtgagatggtgggagtttcttttttttcctttttttttttttaaatagaaatagggtctcactgtgttgcccagactggtcttgaactcctgggctcaagtgaccctcccacctcggcctttgaaatgttgggattacaggtgtgagccaccaggcccaggtggagcaggggagttccttaaaggattctgatttttctcacatccctcacgtccttcctgataggcagggtttctttctgtgtctgtttgggaagggtgttcagggggccttctctccaagtctccatcctggaacagactgatgatgcagggtacctatgtgtctaagaagagtaggggggccgggcgcggtggctcatgcctgtaatcccagcactttgggaggctgaatcacttgaggtcaggagtttgagaccagcctgaccaacagggtgaaaccccgtctcagctaaaaatacaaaaaaaaaaaagaaaaaaaaattagctgggtgtgctgaggcaggagagacgcttgagcccaggaggcagaagttgcagcaagccgagatcacaccactgtactccagcctgggcgacagagcaagactgtctcaaaaaaaaaaaaaaaaaaaaaaaaggaagagtgggaagccctgatcccttcctctcctgaacctcctgcctgccagggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtactgggtctggtgggctggggagggccaaaggacaggggtgatggaaggtggggggcagagaggtctagagaaagtggcacaggtggggacatcaaggaaacagaaacttctgggactggaggaaagggtaggccagggaggaagagaaggtagcagagtctcctcccctctgtagccctttccctcaactccacactcctttctaggtaacaacttcatcaggaacaaaatgctttgcctgtcggtctgcggccgaaagagacaaatggattgagaatctgcagcgggcagtaaagcccaacaaggtattggggaataaaggggacacaacctgtgcagggcaaaggttgcaccaacacgggaagctgggggcctagggaggaaagtgagttaaaggaggagaggcttggggaaggagaggattgaggtacagtgtatctggacaagcagggggagacccccattattctgagtcccccatttcttttcgctttctgtactgctaccctgccttacgatctctttccctgccatagaagtcatagacttacagagttgatggggctctggaaattctttagtctagcttccctgcaggcaggaatgcttcactaataccccgcaggacacatcaaatacacttagccaagtttctgtaccttggtttcctctctaagacagagggaactggtggcaatgggttggattaaatgatctctaaggtccctttggcacataaattctatgagtctgttcttcccaaaacttcatgcttccagttctgtcagctattctctgtatcccagtttctagcaagcttacagtcctagtcacactcctctggggggaactcttgtgtcttgatgtccttaaagaactcaacccaagatgctgacatgatctgacctatgcagagtacaaacaccatgttccctttcaacacactgcaatatcacctgagccttaccattagcttgtgctcaattgtatccccccaggcccttactgattcttttttttttttttttgagacagagtctcactctgtcacccaggctggagtgcagtggcgtgatcttggctcactgcaacctccgcctcctgggtttaagcaattcctgtgcctcagcctccccagtagctgggattacaggcatgcaccaccacacccgactaatttttgtatttttagtagagacgaggtttcaccatgttggccaggctagtctcaaactcctgacctcaggttgtctgcctgcctcagcctcccaaagtgctaggattacaggcatgagccaccacatctggccaagctttacccattctatatgcaattcttttttcacaatttctgatagtctctgcaggactttccagttcccttcaaattctacattaatatttttggcttgttattccagcttttgaaatctttccaatactgtttgtgttgtctagtgtatgtctacgcttctacagtagcttcctggggctgctataacaaactgctacaaactgggtcacgtaaaacaacagaaatttattctctcacagttcaggaggctggaagtccaaaagcaaggtatcagcagggccacgctctctttgatgctgtagcagggaatccttccttgcctcttcctagcttccggaggttgccagcagtccttggcattcctgggcttataactgcatccgtctaatttctgcctccatcttcatgtagctggcttccttctgtgtgtctctgtatcctgtatctctgtgtctccaaatctccctctccatataaagacaccagtttttataaggtgggttaagggtccactctaattcagtatggcctcttttttttgagatggaatatcgctcttgtttcccaggcttggagtgcaatggcatgagctcagctcactgcaacctccgccttccaggttcaagtgattctcctgcctcagcctcctgagtagctgggattacaggcacgtgccactatgcccagctaatttgtttttgtatttttattagagacggggtttcactatgttggccaggctggctcgaactcctgacctcaggcaatccacccacctcggcctcccaaagtgctgggattacaggaatgagataccatggctggcctcttcttagtttgattacatttgcagggatcctgtttccaaataagatcacattcacaggttcagggtagacatgagttttggtgggatactattcaacccagtacaccgtctcaccttatgattgctgtctgtatcccactttcttactgtctctcctcttttggtgtctctctgtcccttccccctttaacatcatgcccaccccaccatgccaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggtgagtgttgtgccctcagggaaaggtgacttgggaatgggcacttgcttgggggttagtgaggacagggcaaattcacgagattgggttgtgcagaggctgacacttggattttcctgggcctcaggacttcctttcagacatggccatgtctgaggtagaccggttcatggaacgggagcacctcatattccgcgagaacacgcttgccactaaagccatagaagagtatatgagactgattggtcagaaatacctcaaggatgccattggtatggcccacactcaggccctcttcttcccaaacctgccagatgtccaccccagaccccaagtccacccttccacagcttgatacttcctaacccagagtcctaggactccagcctccaacacctgattctgaaatttccccaaccctggccacccccttccctgcccttggaaagtgtgaccacaccctcttgtgcccccaccccccaggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactggtgagactgggaacgctgggctggggggccagggtcgggggaattatgtgttcatctgttcatctatctgtccatcctcaaagaggactgagcaccatttatgggcaaagcattgttctaggcgctatagagcaaacaggtgaaagaggcctggtccctgccctcagagggcctccaccagaatggggacaaattagaagaaaaaaaaaaaaagccacagagccataatggtgtgtaagtgctgagtaagggtccccccaacctctgtgtgacataaggtcagagagaaggcagagctttgagataagtggggaagaggtgcccccttgggtaggctttgaagactggtttaggttctgatatatggacatagttggcaagaaagacatttcagaagaaggctgtgagaaaggcacatgtgtgatggtgaaaaggcccaggagttttcaggggacattaaagtaggttagtagcaattacatcaggtttagtggagcatgtgcctcataatggggagtggcgggagagatgtctgggcaggaagattagctttagaaactggaaggcctcaaggagtctgaggtcattggtaggccttgggatgccattaaaggtgtcagaaatattgtgatttagaagattaatccataggctgggcacggtggctcacacctgtaataccagcactttgggaggctgaggcgggcagaccacctgaggtcaggagtttgagaccaggctgaccaacatggagaaaccctgtctctactaaaaatacaaaattagccagatgtggtggcacatgcctgtaatcccagctattcgggaggctaaggcaggagaatcacttgaatctgggaggtggaggttgtagtgagccgagatcacacgattgcactctagcctgggcaacaagagtgaaactccatctcaaaaaaaaaaaattaatccataagtagagtgtatgtagtagagtagagggatgtatgttgggggatgactggaatagagccagctgggggctcggaggcatgaaagtcagatcctgaatcagaacagtgacagaagttaggaaggagctactggaaggaccctctcgggaaaggatcagtaggaattgtcagcttattggaaaggagggagcatgtctgtggggagtcacggatgactcaagaggccatgaggctggtggttgggagaccggtggcctcattgacaaccaggaaagtcaggaggaggagccagttggaggtgtgggggcgatggtgagctctgctttacaccagccgagtttaaggtgtcagtgggacattgaagtggaactgggaggtgcggggagtgagctctgagccattccagggactggggatcatgcctggggcacctccatccccatttccctggaatccagaagagttggggggtccgagctccctgtacctcaagtgaccctccatctctctcccatctctgtctctccctggtgtctgtttttcttctcctcctctccttgtctctctcccacacccctccatctctctcccacgtgtctctcccctcaccttctctccccctccatttctctctccctaatctgtctgttccctctgccatggcccccttcttcaagcagcctcccatcttgctcctgcggtccctccttccctgtctctctcacccctgtttccacaccctcacctcctaccacccccctcagcatgttccctggaagctgagggtctctggggctcagtcccggtctctctctttctctctctctctctctgtctccccgacccttccccccagcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtgagggaagcttcaggagtgggcagggcagggagtggcagggcagggagtggcagggctgggggtcggcaagaagggtctcctgagtccccagagatcctgagatggggaggctatgataccttgtgtgtgtgtgtatgtgtgtgtatgtgtgtgtgtgtgtgtgtgtgtgtgtatgtgacctttatcttctgcattcttggctaggtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggtcagcagatcccctctttgccctatccccagatggctccagaggttcctggagcctgagaaactaccctttgaagattttttttctccccttgtttctcgaggtgtcaccactactatcccaactcaggccccctccacctgcaccctcagaggccctcttagagctgggcactgagcccccaggtaacagcctcacccttccaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacaggtgagcaccctgggacagccaggcctgtgccctaggagcccttctcctattctagatactcctcactgggccccacatgcatctctctagggcttgaaagaagggaggaaaaagcaccaagttctcaggggagacgataaggagacaggtacagtcagtggtaggctgagagccctttacagcctgagggagtgagagatttggagctctaggaatagggctgaggctccaccaactcacggcttagttgtaagcctagagcatccctgctgcaagctctgatttgctgtccctctgcctgcccatgctagtccccaggctgaggttcagccagcatgtcatgtcagccatgtgtcaaaatgttcaaacatctcagtaatagctagtgaataagcacttcccccagcccccgaccacaaccccacagacctccccatgatccagcacttagagcagtgacagcagaagcctagcagggcctgcagcctgctccagagtcccagcctccattctgataggtggtgcccgtgcttcatttgctgctcattattttgatgatggccctgctttttcctctgcccgtgtcttcctccatgacaccatacccatcccaccattcccgcctctcctttcatttgtccacatctctctccttctctgtctgtgctcgcccctctttccatctctctccagctccatcgaccttcagtccttcatggctcgaggcctcaacaggtgaggggctctcccctcccccgccctcctctcctctcctgtctgttccctctcccactccactggccttcgccctactcctctcctctcctcctccatggacctcatctcctccatatgtgcccagccctgcccccatcccttctcttgctgcccccatctcccctcctctaggcctcacccccttcccggaggggccctgtcctttccctttactcacctgtcccctcccatcctccctgcctgccctcttcagggctgccaccgctagctctcagcccttccctctgggtcccacttttcaccccaaggcctgtgccagaccacagcaaggttcaattgctaggagccctgaccttaccttctgcttgtgtgcccccttcccttctgacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcaggtaggtgaaggcaggaggaaggcgggctgggtcacaacagggagggaagaaggagatggggggtggggttgaaacagagtctgtggcctgaagttacaatcttcttgcctccttttggccattaaacaaatgtgtatagagggcctgctatgtgccatgtgctatgccaggcactaaggatacggcactgaaccctcttagcactctcattccagaggggattaatccataagtagaatgggggtgactggaatagggccagctgggggcttggaggcatgaagatcagatcctgaatcagaacaacaggagaaattctctggcattcaactcacatctctggcattcagaggtgataaaggctacagcagggcaataggactgggactgtcgtctcctttggctgtgctgttgccctctaaatgtaccctgctttttcccaccttttctttctctgttcgccctcactgtgccttgtcccagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtacgatgggctctaccagctccaagccccagtgtttccttttacccacaggggagatctctagtcacttccaagggaaacctccagggtcagttatggtggtaagaaaaggcaaagacctgatcacctcttgagaagccttccgtccatctggggagaccagatacacacagttgttaaaagtcactttcaactctattttgtaggttatatatatcatagactatctggggatcatctattttaggcttacctccatgttcttccccaggaggaacataagccctggctcctgtgactgcttaggaaaggaaatgttactttactggcagtaggagctaataaattggatggggatggagggggttgcagctatattacaagtgatgtctggcctacccagtcactgtcccatgggcataagtgacagtcagtgggcagggaatgcatgtggtaaagtagtatgtatcagtcatgtgtgaaaagaccatccagaccctcacttggtggaggctgagggcaaagggcaccaagagctctggggctaacacagataacttagcagaaagttacttgaggaagctgttgttcctagggcctgaggaagagggcggctgcaggattaggtcatatataaagaacatatgatcctaacacggggaagtggtctttgagcataggaaatgttgggactgactcagatgggcttgaccagcaaatttaatgagaattaaaccctaatattagccccaaggcagccaccgtaggaagttaattcacatctctcctctgcatgtagaagggttggtgatatatgtatgtatcctcttcagagaatgaggaaatagtcttttgaatcatttttttttctgtgcttcagatgaggaaaccttgttgagaaaggctgtagactagcactatccaatataactttctgcagtgatgaaatgttctgtaatctgtagtgttcacatgtgtctagttgtgattcaggaactgaatttttagatctatttaattttaattttgtaatttttttgagacagggtcttgctctgtcacccaggctggagtgcagtggtgcaaacatggctcgaggcaacctccgcctcctgggctcaagacatcctcccacctcagccccctgagtagctaggactacagggtcgtgctaccatgcctggctagttttttttcttttcttttttttttttttttttttttgtagagacggggttttgccatgttgcccaggctggtctagaacttgtgagctcaagtgatctacctgcctcagccttccaaagtgctgggattacaggtgttgagccactgtgcctggcctaaattttaaatagctacatgtgggctggtggctaccatattagacagcacagctgtagactctagagccaatagggcagataaaatgactcttctgagctcttccagctctggaattcctagattctcagcctagaattcacttgtagacctcctatccttggcaccttgacagagccaaggagagggtcacatggaggacagcacctgcctttcccccgtcaattgccttttcttcctatgtctccagcatgtgttctggggcctggcttagggctgaagagtcaccctatttttaatttctgagcacagttactcaaggtgtgtttgtgagtgtaggtttctgtgtgggtcttcatgaggggccatacatagacctcagggtgtgggagtctgtgaccttgctccattttgagggaacctcagcaccatggcagggtcttctcaaaagcaggtgtgtggatatgatccacaggcagggaaggggttggggaaggcagctggatgtccctcaacatgcagtggctgtgcttggcagacagggatggaggctgggtggtgggcttggggtggggcgcccctcatagtgcggggtcgtgtgcccggcgggcaggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggtgaggggcggcctggggagggggttgtgagggagagcctgaggctggagagagcaagtgggtgagctactccgctgactcccatccccaaactcaggagcccaccaggagagcccaccactctcctccccaggaagccacccactcactcatcaccagatggagagaaaccccaacctgcttagtgcattaaatatctctttaccaaaccctgacctctcttctgatagagtagcttcggaagcccttggaaaatgtacctgttcctgtccaaccatcactgcatttgcatttaccctaggccagagctccccactagttattctcaacttaacctgtgatgttcactccaaacctaagcagggctccctagccagagtaggccctgcccttcctgggtggaccctccctctctagccttggaaaggtgttctgttagaaagggtcttttagcctgtgtatgttttcagctgctccagcaagtcctgggctccaaagagggtatcctcagcaaagaggtcaattatcttcagagtggtggggtcggggtgggggggaccctgggcgcactccaaccagagccacctccattttgatccattctaaatgtattttatgtaagatttaattagaagaaaagggcttcttgaaatattttttgaaaaccactgctctaattgatatcctttatgataaatcacctcgaggatcttcacagtgaggtgacatgggggatgcagaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttcctacccatactcctctttgctctgactgctaggctccccccgcctgccatccccccaccaaggctcctgaccccatgaccccactctctcccactgcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctacctctccagtgtatgtctgtcaccccccatttcaccagagcgtccttaggggctgggggtgggtttgttaatggggtggaggcaatgatgggttggaggatcttggctataggggctgtgctgactgcagcaggtaggttgggtttccctcttccttccctaatcttggttctctaccctcctttccactcctcacctgattctctctcttcctcctccttatatctgtgaggcagaaggcatctgaagctcatattagcccccattgggtgggaattaggagtgggtagttaactcagggagacttgagataccctggaaaaaatgctattgagatgtcctgacattaggcagggtggatggaacaagaaggagcaagaaaggaacctcaggcagatgttaggacatggacttgatcatgtggcctgggagtttagaaatggggagagacatcctcctagatcagatcgtgggctcagtaggcatgttgattcccagggagaggtgccaggaacagcatggtaaagaatgtactcttcacagctcacatccccaggttgctgatgccactcactccccctctcctgccatcgagtggccttgccggacacatcaccctacctaaaaagccagtaaatgagaacctgtcagctatagccatcatttctgagatgcgattttctttgggattgagctgcagtgggcagtggctccttacactgtaattttaattctctgcctgcccagcctctctgtcaaagtagctggtgatctataaagatgctaaaaggcaccaggggactttgccatttaaaggactcctgcagtgaattcttttgtaaaatgaataatggcaccctaatttatccactttctaaatttgggtccatgggggtgtccagggcatgcttatgtgctgtcaccagcagacaaacagagggaatggaatctgggggttccttccctgctctcccgccatactcaggataccctaccataagtgatttcctctcactgacttgcagaaaatgtgtgagatacccagcaagctaagaaggcagttttgctgggtatctcatacccaaggctggggtttgggtgatctgagaggttagctccttgatcctaggatggaagggagagcttatatagaagcttttacttggaaggttttgtatcctaaggtcagacatagctatattaccaagcctaaatgccatgtggcccaggaaataatttggacatttgttctaaaccacttgtggtaggtattggtctctctgcaactcagccattaattagaaattagttttgagcctgaattttaaaaagccaagtgttgcccccagcccacacacacacacacggacatgtacagtacaaaccccagataattacaacagccaaagagagaaggaagtgaatttcccaaccagaagcgtagggaaattcagatggctttcttttctcccagcagaggaacagaaggcggagctaagggcaggaaccaggagttggtcaaggagctataggaggtgatgagagtagaaccaggggtaggagctggtctggtacccctcaccctctaattgggagcccagggagaaggactgaaaagaagatgggagtggaaaagaataaagccagtttctgcttcccagggatgcagagattggggcatgctgtgtctgcagaagctcctagtcatttccgccataattgtgagagagaggggcagccctcccacaagatttttcccttcccatatcacttccctgaatccccttcctttccccccagtacagttaaacctctctctaatttggaatgttatatttgagaagatggccactgtgaataagtgacaaacggaatgacagtgtctatttaatgaaatgcatgtcttcaaaatatatacagaactcgatgaacaaggctttttccactcctcagggagcatgcattaatgaatagataggattcaaaagtctgttttctggtatgggttaaatatcccctcctacagacatatttccaccactaatttgcttagtacaccttttcttcacagataaaggaaaatgcaagctcagtttttcttcagattatgaagaaattccaaatccacaggggtttggattaatgaggttttgctgtactgcctccccttattcctcaacatgaagttcccacctcggattggggatgggtgggagggggtttcaagaggaggagggtgggatgggcaaggaatatacacaggtgaagccagagaagggttaggttgggggtgcggtgggaacttgctgttttgatctggtttcctggtgtgacactctgggttaaaggcttgaaggcccctgttaggagtctaggggtgagattctcttctctctgatcccagaggacgttaacttctactgcaggtgagaaacaaaataggaggatggtggggactgtcctgggaggagggggtggtccatggcttgtggtgtgggctggctataggggaggccactgctaggggactggcatccaggcccccttgaagcgtctcaataagtccgcgctctcctttttggtgtcttgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 1172 - DNA, 557733 bp, Homo sapiens
tcaaaagaaaaaaaaacttttattttttctattgcataaataatggtaaattagactctttttatacagattatatatttacagacaagttcggttaaagaaaacatctggtaaatatggcagttttcctttatacactaagataacatattaataatatatacttcatttgatcggtaagttgcatgctaagttaatttatattaatatgtacattttatataaagattcttttttgactagtctgctgactttctcatcacttaatagcagaaatcatcaactaatactgaatgagagaaaatgggatgctaatgaggtaaatgggaagatggtgattgatgagttccgtcttagtggcttattctggatatgagagctgccaagctccaatcgtcctggccatgatcaatccccagctgtgcttctatttacacccaacatattgggggcaatatacaaaatacagtcatttactactgtgctttgagagacaactcacgtcccaagtctaatgaccgctacgatcacagcgacccctcctccccatccaacagttgacagttcaccaacccaatgcctggacagactttctgagtctaatttttctccaaagtcattgtttttggttggtccttggagaaaaagcttcttcctggattcagaactggggaagaaaatcagaccccaataaggacccctgaaagctgattttgagctaagaaagagaaaatatgctttaattttccttggagagagttgagagccactggcttgtgcaactctccaccaggagctgacaggatcctttcttggccaatctaggtctttcccagggagaacaacagggcttgttagaaaaacaattactgggacgtcagtctactttaggaagagggaaaaagaacaagaatctagggttttatgttgcctggggcagaagggttagagacttgtggatcctgcagctgctctcttcctgccctctctccctggtcatgggtgggccacatcaaaagcaggcaccgctcagcactcagcatccctcattagccatttaaagggctgtcgcaggtagccggtcccccgcgactgttaatctaattcctcacaatcaccaaagatcacgactctcttctttctggggtattaggaataattacaagctactatcaacatatactggaagtgctgttatagtggccagaaaaaaaaaaaagcaaagaaagaaataactggaaattgtgctctttattcagtagctttcagtaaggctttctcaaatggagaaacaagcatctcttcttggaatctgccattgtttcctccaactttctcctgaattctgattcacatgacctttggggaggtgactgactccctttattttcacacttgccaagacagacagaaagctcatctttgatgctccctcgagtcagcaagtccttagagaataaacaaaacctcttgcctgcaagctgtgacacatttaacatacaccaatttgcattgtttcatttacagacagcggacaccaaaagagagactttatcacaactgcctcttgggacttgtgttcaaaaaggagctcccagttcctagtgcaattcatgggtgaaatccagaccctctcagtagggagcattcactccatcttgtttcagacaaaatagatgggagggcttgtctggtttacttttcctctggctttagagaaacctgaagccagggaggaatgtcactcaacataacctagatagtgggtggaagagtcctggctcctgggctttctccagctggtagtaccgtccacactttgagttctttcttctgctctcctggcctcagtttaacaggtctgagagccctgagagaggcattctgggcttgacagatgtcagcatcctcccaggaatggcgagctaccagcctgctcttgaaatgcacagagcctttcgtgtggatcagactgatgggcagccccatggcactcaatggcctgcatgtttccaaagtaggccagcgatccagagaagaccttcagaggacagcatctgcagccctttaagaactttctttgtctccctcaggtccagggatggagcaatatcgcagttgcaccttgcattccctggaatattccttcctaattagcctgctcttctatcccactggaaaattccagcctctgcatcctttccacttggacaataacttctaacagtgcgagaaacactagtttgaaagccaacccatcacacctgaggaaaagagatgggtgagtctatgcccggcatgggggttgtgctcaactgatgaactaccccaaggtcagggtaggggcaggtggccgggcaagcttttccactttcagaggactgtcttgtgggtgggactggaaaaacctcattctttgtgatatatttccagtcaacggaataaaattaattttgccttggagacgttttgaacagtattgtcatgtctctcgagaccctatgaagagtcccaaatgaatatgaaggagaaaccacagctgtcaaaatgaccatatgcattagcaatgaccataggatactaagagaaatgcttggcttgttggtgtaattgatctcattgctccaaaccaatcatagaggctggatatttgttccccccaaatttcatgttgatctccagtgctggaggtggggcctgctgggagatatttgggtcatagggacagattcctcatgaatgactcggtgccctccctgtagtaatgagtgaattcttactttattagttcatgcaattgcgggttgttaagaaaaggagactggcacctcttctcctctctcttgctcctgttcttgctgtgtgacgtgcctgctcccccttcaccttccaccatgggtcaaagctttctgaggtctcaccagaagccaagcagatgttgataccttgctcaaacagcctgcagaactgcgagccaaataaacctcttttctttataaattacccagtgttaaggtattcctttatagcaatgcaaaacggactaacatacacctatttatggcagggccaaaaaattgaggacaatcccgagtgacttagtcaaagcaagtatgaagtgaagctgaacagttgtgacactcaaattatcatggagactgggtcggtaagaggcagcccaaattctcctctatgttgctgtcactttaaataatttaaattgaaaagtcttagctggtgaataatgtttcttttttaaaattattttttgagatgaagttttgctctgttgcccaggctggagtgcagtggcgcgatctcagctcactgcagcctccgcctccagggttcaagtgattctccctcctcagcctccagagtagctaggattacaggtgcccgacaccatgcttggctaatttttgtattttttttttttagtagagatggggtttcaccacgttggccaggctggtcttgaactcctgatcttaagtgatccacctgccttggcctcccaaagtgctgggattataggtgtgagccaccgcacctggtccttaatgcttcttttctatttcagatagattctccccttctggggcagttgagcaatcaggtgtggagggaagatggctatggtaaggcctttaggttacggactcttagctccatggggatcactgaagaggccaatgagaatgttctgatttgaggtcttttaagacagatgttcttcaggggttgcagctctgcagacctcctggttatacaaccaggatgtgtgacgtgctgaagtctaaaagtttcatctcagttcatctgtaccatcacggtgatataggaaaaggggcccttcctagcaggggaattccagaccccccctgttatcttggtgaaatggtaaaaaatgtaatgactatgggcctttggagaaatagtgtggcaaaatgacccaatagggtttgagacctgcagttaggaggagcagagcttagcagcttctgcaaggaaggagagcaaggacacagtaaacacagatcccaggacatgtgaccacacgtggccaggccagcccaaaccagggagctgtcctgggtggttgcatccttcattttctgtccatgccctcatagggcctcagggaaactgctagatttaggtgaagagcaacgtgcaaaactgtctttgatttatgacctgagtctggacttaaaccgagtacgaggcatttggaataaaaggtaaacttttctctctcagttctgaaacatatcgctttatgattctatgaatgggaagttgggaggggcattattgtcaaaagcagctgtccatttttcataggctcttttggataactgcaagatcgtagaccatttgtcaagtgagatttgagacagggcaggtattgagaaagaagactcataagacacatcttgttctctgcaaataaaacacccagacatttctgaaaccactgggtttgcctaagaccacacctaaacctcagttcaccaaagttcacgtgtttggcttgcaggagtgtgctcaacaggcaaaccgatacttttaaagattggaggcttaatatcttgtttgccttccaagatgatatttctgtcaatttacctagattaaggggtcctggctctggaccctgggagaaggggctgggagtagggatggggagataccagggcttacaggtagctcctgctctcctgagtaaatagaaggacaagttcaaatgccagacaaaaaggcagagataccacccagattctttaagggtaattgcctctcccagcaggatacagatgcagagagtcaggttgcactcaggctgaattggagtgttctttaagaaaatgttccctatttttgtgtgccttggcaaactcagggtggaatgcaagggttgccatggtaatatccctcttttttttttgtcagatcagtcacgtgggacccaagcacattctggaagccattgctaatagtcccgatgctagattctgtctgggggctttgtgggtatctggaaaggtggggcgcagcttctttggggatcaagggggtcagggtccatttccccttctctcccaaggaaaatgccttcttgctcatcacttgtgctttccaggggggcggcggggggtacctgctcttgcagcaagaatgagccaacctgtgtttgtcaatcactcagcctccacacagttgggcagccaaggtcactggttcctaagtccggaggacagaatgaggggtgagctattccctctcaattcctgcggaagtcacttccagctggggctacatggcatcccttgggcatgggagaccaggaccttctggaatcttcagccgtgagcttcatagccaccatgatggggacactgactggcatggggccctagcataaaatttgtgtgaacagggctgggagttggctgcctgacaaggaaggcttccctatacccaagacaaactgtccaagcaaagcagccagggtgcaagtcaccgggacaaactctgagctcctgaagtctaaggaatgccgctagctcagggccgtctccacgcactgtgtccttcagtccctgggtgccacatggggggttaccacagtgggaagataactcctaggctgtcagaaagaattctgtgtcttccttcttgccatctctctctagcagtctgcagaggaatgcattctcctagattttcccctggggagggtgggcttgcttccaggtcactgggagcaagaagaaggtcaccgttaggaaaggaatcctgcagcctttccagaaaacaggatggcggcgcctctccagaactccttttcctccctactcctgcacagtggctaatctctctgccaatgaaatctaaccctcacctcttgaagggtctctgttctccagcaggaggcagaagaactcgcagaaaagccaccttcaaagaagtactcattttctgccctgaagaccagcctcagctgcagcatttcagtcccctctcatggaggagggggctttgaagaatcatccctggggtttctacccagtctacttagggtcctgcacccctatggatgtggttgggtggttcgggggtcagggaaaaacaggaaagtatatcccttcaagatctgctatgccctcccatctaagtccagatgggagagggcaaactgcccagggcagagattaaggatgaagttgttcgatgtattaatattctgcatttggaccggttctagttgagaattccaatcctaaggggacagtggtgagtcagccaacaggagcagcagaaggggcaggcatgcagtgtgcaggcagcagggcaggtaagggggaaaggcaggttgctgcctccttggtctggccttgctgggctgaactccaggaagttttgcagagggacctgtgatcccccaggctcttgggagcttacatctgctccctcctccatattatggctgaagccttagttttacttgtgctcatcaggaatattcatagtctcccacagagggaaagtttctacagctgccctcaggctgttgccagtagcacttgcagaggtgaatgagaaaactttcattggagaccttgggtgctccaagtctgaaaaggcagtagggagaaagctgagcaggaagacagggagggagatcaggaacacacaacgcaccaaaaaatcctacccactgcatagagacaagaaagcttctggtggctcgctactggaaggggggaagcatgtagttttaggatgtaatcaaaagaagtaggagcaaggtaattccattacaaaataaagacctgagcttggaaaagtacaaagggaactattacatctagagattactggctaatctgactacacaagcttgaattcatagtagtggctgacatctaggaaaagtcaggaaattacagacttggaatggtgttgaaaacagatccttggattcagttctcttccccaacgaaaagtattctgcaggcaggagtaaattacctgttctgttggctaaactcataaacatcttttcccccaacctcctgaaaatgagtcagttgcagaatctgaaggccagaagatcttatgtgaaaatacagtcgtttgatctctccatctttccattttggattgcatttctctttttagctggggaagactaacaaagcaaactccaaggtaagggaaaggtaagatgcacaaggaccttaacttacaaaggtcatccggcatagagacgtggtgggtctccatgactccagatggctgggtgtgggtatcaaaacctcaccgccagtcccagtcccctcccccctcaacctgcctcacccctgccccaaagaagcagggatgagtgtgggagggaggacaagcttatattaggtgtaagcgattagggaagaatgacatcacacacgaagaagccaaatatatatatctgtctatgttatagagatgcccacgattatgcttctttttttctctaatggcagcacaggcggcaaagctgggagaaaggctctctgcaggttccaaaatgctggtgcgggatgggctctaggaacagaaagccaagtgccgacggaaactgagagcaccccagctctaccaatggcagtcctctagaaaaggcagtaagaacggaagcggtgaggggtgcagctgaagaccgccagggctgcaccccacttaatggctttcccctcatgccttgggggggtctccactgggtggaggaaggaagccagggtgggatggaaagccccctcttctgtggcaaccctgaagtcagcctcttggaactgagggttgacctcagcagagagtctcctgttgacccttgggttgaaagaatggggagtggaggtgactgtgtgttcatgcctctctcttgctctctcaccattatacctggatggctgctggaattccgagatgaagatgaagtttttctctagagttatgactgatggttgaagcaataatttggaaatcctggcgatttattgcattagaaaacaaaaccattaaagcactgaagacagccctttagtgtccctgccaaggagatgaagctgaagtgcaaccccagttgcactcaaccttgggttctttactgaacggttccatcgtccgcatccatccatagtccataggtccgtgtctgctgtgtggaggaagagtctgcccgcacggcatgcacatgcgcggtgagctgcaacacagtgtggctggcgggaggctgctactccatgccgctccggagtatctggttggctgcaatcagcatgacactgatgatgaaggccatagcaaaggcgcatatgaggctcttccggacgcaggtctgtctgttctgcttctgggaatgcactggtggtgggagaagcaggtgtgggaagaaggaagaggggttgggagaagagagaagagagaaataacacagtgagataggttgcaactcttcctcaacaggccagcagtgagtcctataggatgagactggtcaaatcaagttgacaggcatttatgggaccactgccatggagactgcataatacaaaatgccttctggtgaaaggtatgaaatgagaaaacttctataacaagaatcatgatggatgtgatgatcagagtaaggcctaaattttctgatagaatagagccagagtgactttcagagcccggaaatatgggacattccagggtgagtttcataaaagacatcatccagtgactgctgtatccatttctgcagctgatacaaacagagtggaagttcagatgcttccctacacctctgtgatcagctgggtgcaacttacctttcctggacgttttcttgggttttgctaatcaccataagtgacttcttgcattatttcagacatacacatagtggttctacagtggggtcgttggacaagcagcatccccattactaagaggtttttttttgttgtttttttttttttttttagagaaagtgtcttgctctgtctcccaggctggagtgcagtggtactactgtagctcactgcagccttcttaacctcctgggctcaagctgtcctcccacttcagcctcctgagtagctggaactacaagtgtgtgccaccgtgcctaattattattattttttttgatactggagtctctctctgtcacccaggctggagtgcagtggcatgatcttggctcactacaagctccacctcccaggttcatgccattctcctgtctcagcctcctgagtagctgggactataggcgcccgccaccatgcccggctaattttttgtattttttagtagagatggggtttcaccacgttagccaggatgatctcgatctcctgaccttgtgatctacccgccttggcctcccaaagtgctgggattacaggcgtgagccactgcgcctggccgactaatttttttaattttcatttttgtagagatggggtcttgctatgttgcccagtataatctcaaactcctgagctcaagccaccctcctgcctctgcctcccaaagtgttgggattacaggcatgagccaccatgcttggccactgggaggtttttgaaaatgcagattcttggccaggtttggtggctctcatgcctgtaatcccagcattttgggaggctggggtgggcagatcacctgaggtcaggagtttgagaccagcctggccgacatggtgaaaccccatctctactaaaaatacaaaaattagctgggtatggtggcacatgcctgtaatctcagctacttgggaggctgaggtaggagaatcgcttgaacccgggaggcagaggttgcagtgagctgagatcaggctactgtgcttcagcctgggagacagagcgagactctgtctcaaaaaaacatgcagattcttgtccagcccccaccccagatttgctgcatcagaggctctgggagtgggggtccccatctgtgtttaacaagccctccgtgagatcttggatgctgctgaagttggggaagtggggattgcttgctctgggcagcaccaatgtgaagataggggggcaccaaactctcttagacatgccagaggcagggtgtcctgcctccagataccacggccccacagggtttactttgggtctaggggtttcgttctcttaatctttctgttgtgccaggtcttgcactttcatttttataacgcccatgagaaaccatgtataggtctcaatcaaaaggcatgaattagcggatattaatatgggccagaaacagataaatggaaataacaagaaaaagcattagcctgtaattgcagcactttgggaggtcaaggcaggaggattgcttgaagccaggagtttgagaccagcctgggtaacatagaaagaccctgtccctacaaaaaataataaaaaaaaaatttagctgggtgtcgttggtgcatgcctatagtcccagctagttgggaggctgaggcagaaggatcgcttgagcccaagagctcagggctgtggtgagctgtggtcacaccactgtattccagcctgagccacagaggagtgagaccctgcaggagagagagagagagagaagaaagaagaaagaagaaagaaagaagaaagagaaagaaaaagaaaaagaaagaatcaaagaaagagaaagagagaaacaaagaaagaaagaaaggcaggcgaaagaaagaatgaaagaaaggaaggaagaagaaagaaagcaagaaagcaagcaagaaagaaacgaaggaaggaaggagaaagaaagaagaaagaaagaaagaaggaaagaaagaaagaaagaaaagaaagaaagaaagaaagaaaagaaagaaagaaagaaagaaagaaagaaagaaagaaagaaagaaagaaagaaagaagcaagcaagcaagtgggctttgatgaagtgcatcaaggatcccaggcattgcattacctaaggggaaactgagtggatgtcagaatgtcttttccatctcctcctccttttcctctacactttctcccttgctgtctgtcctgcagttgtgcacggttccccagatagcttagaggagacatctgtgcccttgaggtcggcaggaagccacctactccagagcaactggctgaaacagcagcaccagcgccagctgagagtttgatacaaatgagattctcagccctattgcagaattactgaatcagacctctggggtggaggttgggaatttgtgttttaataagctctccaggcaattaagcaattgctagacatccactcgggagtttctgattcagtaggcccggagtaggatggagctgccggggacaggaggggtgtgtgtgtgtgttgttggggacatgaaatcaggggtgttgaagaagatggctctttacattcagctgttaaagaagactgcgtagcaaaagaaaaaggtcaaggttgtgttcacatgcctttagagaatataaaaatcactcaagctcaactacctctctcccttgatgtgaagtggctcatccaaactcctggtattaataccaggtaagaagtaggaagctggccatatttccaaaggcaaacagaattttctccaagagaaagggtcccaagggcttgtcaaaggatctctaaaaatggcattgatcttttttatggctgtgtagtattccatggtgtttatgtaccacatttcctttatccaatctaccattgatggccatttaggttgattccatgcatgtgtctttatggtaaagcaatttatgttcctttagatatatacccaataatgggattgctggatcgaatggtagttctgtttctagctcttcgaggaatcgccacactgctttctacatcctttacaggaacattaatggtgctggaggccatgatccttggcaaactaacacaggaagagaaaatcaaataccgcatgttctcacttacaagtgggagctgaatgatcagaacacatggatgcaaagaagggaaccacagacactggggcccacttgaggatggagggtaggaggagggagacgagcagaaaaaaatcactattgggttctaggcttagtgcctgggtggtgaaataatctgtacaacaaacgcctgtgacacgagtttacctacagaacaaacctgcacatgtatccctgaacctaaactaaaagttaaaaaaatggcattgaggccgggcacggtggctcacgcctgtaatctcagcactttgggaggccgaggcgggcggatcacaaggtcaggagatcgagaccatcctggctaacacggtgaaaccctgtctctactaaaacatagaaaaaaattagccgggcgtgttggcgggcgcctgcagtcccagctactggggaggctgaggcaggagaatggtgtgaacccgggaggcagagcttgcagtgagccgagatcgcgccactgcactccagtctgggaggcagcgagactccgtctcaaaaaaagaaaaaaaaaatggcattgagcaggaaggtttctccagaaagccaggcttcaagaaaatgcacttcaaatgctgggtgtggtggacagagctgcgacctggcactaattcatgcgtttcctgataattattgaagattatcatgcatttgcattgtactatatttttgtatatttatttactcttgcctcttgctgtctattatttagaagtctgtaatagaagactataggtcagcctgggataaactgtaagtctaagatctgacttacagtgaccccagtgagccagccgcaacccccagccccctcaccagtatgatacttgtgaattatttcgccatggtctcttaggtctcatctcattatctttattccttctgaatccactgatttctgcttccctggggcgatttaaagtatatgtggctcagctttcttcttgccgattgaagcttccaccttttggctactacaaataatgctgtttaggtgtgggtctcagaatcttacaagttcttacctggaggaagacaatatccttggggtagagatgggctttatcccatcagtaggcaaatgtacaaagataccaagtcccaggaaggaaaaaggaggtggcatttaagaaggaaagggccaaagaagaaaataagacgagaatgtggaagtagcatatcctaacactttctggctaatttattctgagtagcttcttctcctggaaatgtttccgaaggcagcccttttccattccatcttgagggcctgcgaaagcattaggaagagaaacattgcatgactgggctgagggagaaagtttttgctgaagctcttcttcgtgaaggtcaaccaggaaacaaggttaccagcaacagggattatcccccaggagagcggggctgcaagtttgatctaaaaatccatccaagcagtaggaagggagagataaggactgagcaatcgcctggagaattcacaccaatgtcctataagcagagaggagcagagccgggtgcggtggctcacgcctgtaatcccagcactttgggaggctgaggtgggtggatcacctgaggtcaggagttcgagaccagcttggccaacatagtgaaactccgtctctactaaaaacacaaaaaatttgctgggcatggtggcgggcgcctgtaataccagctactagggaggctgaggcaggagaattgcttgaacccaagaggcagaggttgtagtgagccgaaactgcgccattgcactgcagcctgggcaacaagagcgaaactccatctcaaaacaaaacaaaaaaaaagcacagaggagcttctagatcattagtggattgtagcagctctgaaatagaccttagtctgagtcagtaccctgtgctttgaagagaatcattttacaccacattctgacatcatcacgaatagtgtggctaagcaaagaggaatgactttggagccagaccaaaatgtggatcatgattctctgtgtgactttgagcaagcaaatttccctaggcctcaattttctcatctataaaatgggataataagatctatctttgttgggctgggtgtggtggctcacacccgtaatcccagcactttgggaggttgaggtgggtggatcgcctgaggttaggagtttgagaccagcctggccaacatggcaaaaccccatctctactaaaaatacacagaaaaattaactgagcacggtgttgtgtgcctgtaatccccgctactcgggaggctgatgcaggaggatcacttgaacccaggaggcagaggttgatcatgccactgcactcaagcctgggtgacagagcaagactgtctaaaaaaaccaaaaaaaacaaaaagaaacacatacaaaaaagatctatcttcttgtggagattatgcatataggaaggaactggaaaattgtttgtgcccaatgaatgcgagctcccttgtataaaccttttaaatgctcctatttctttattgaacaccagcctcagcgggttgggtactgcgttaagtgctttttttttatgtgcagaggttgcatagtggcagataccatgtgtgatgggtgtgttgtcttcatttattgcgtgaggagcctgaattccaataagtgaagttcaaggtcatttgggaaatggcagaggtgggatttgagctgagggcttactgttacgcccaggttcaaaacttgtgtacaaattctttttggtctcctgcatagcaataaacaggtccaaagaaaatgcacttcaaacaccgagtgtggtggacagaactgcgacctggcactaatttatgcatttcttggtaattattgaaggttatcatacatttgcattgtactatatttttgcatatttatttactcttgctgtctattatttagaagtctataatagaagactataggtcagtctgggaaaaactgtgagtccaagatctgacttcttctcctaattgccacttagaagccccggacaaatgaaggaacttctgcgagcgtcagtttctctctctgtaaaaggagctaataattgctctgctcatctcaagaattatttcaaagatcaatgagctaatcaaagtgaaagctacatccaactgtaaattgccagagaaatacaaaatttcattcttgcatcccctgaggacaggaggaaacccctgctggtttttcatcctattccctgcagcctacagcacgaggctgagactaactcagatgctcccaaatctttgttttcatctcttccttcatcaagtcattcagaactgcagctagactcacctttcccttcctgcaaaggcccccgctgatgggagaagcctgttccagcccctaagctcagcacataagaccatagctcactcttccccgcttcctggctctgttccagccttggccacttctgttccagccaagcaggtctcctcattttcttcagtgtagatcagtggtgccttctgatcttgcctattttttttcttttctttttttcttttttgagatggagtctcactctgttgccaggctggagtgcagtggcacgatattggctcgctgcaacctccaactccctagcaattctcctgcctcagcctcccgagtagcggagaggggattacaggcatacaccatcacactcaggtaatttttgtatttttagtagagacggggtttcatcatgttggccaagacggtctcgatctctcgaccttgtgatccatccgcctcggcctcccaaagtgctgggattatagacatgagccactgtgcgtgcccggccatcttccctctttttctctggggcccagcccaaacttttctttcctctgaggtttcttctgaacaccctgctctataaaagggcctgctccttgtgtttatttgttgtaatgatctagctttcaatatttatttatttttaattaagatatagttcacataccataaaattggcccttgttctaaaattatgtccaattcagcagcgtttaacacattcgcgagattgcgcaaccatcaccactacctaattccagagccattttttcaccctaaaaagaaatcccaggcacattaacagtcgctgctcattccgctcgctctgcagccccaggcaaacactaatctaccgtctgtctctaaggatttgcctgctctgaatctttcaaataaatacgatcatacagtaggtgacctttcgtgtctggcttcttttagcataatttttcaaggttcctccagctgtatgtagcatttaccagtacttcattcttttttttttttttttttttttgagacagagtcttgctctgtcacccaggctggagtgcagcggcaccatctcggctcactgcaagctccgcctcccgggttcacgtcattctcctgcctcagcctcccgagtagctgggactacaggcacccgccaccacacccggctaattttttgcattttttttttttagcagagatgagatttcactgtgttagccagggtggtctcaatctcctgacctcgtgatccacccgccttggcctcccaaagtgctgggattacaggcatgagccactgtgcccggccatttcattcctttttatgaccggataatattttattgtatgaatatgtcatactttgtttatccattcgtaagctataaacgtttgggttccttccaccttttgggtactatatgagtcatgccgctatgaacatccatgcacatgtttacatgtcaatatatgtcttaaattctcttgggtgcaaacctagaagttgaattactgggttatatagtaactctatgtttctttctttttttttttttttttttgagacggagtctcacactgtcgcccgggctggtgtgcagtggcatgttcttggctcactgcaacctccgcctcccaaattcaagtgattctcctgcctcagcctcccgagtagctaagattacaggctcccgccaccacgcccggctaattttttgtatttttagtagagatgggttccactacgttggccaggctgatctcgaactactgacctcatgatccacctgcctcggcctcccaaagtgctgagattacaggcgtgagccaccgcgtccagcttatgtttcgttttttcaaggaactgaccttttggggtcttactgaatatgtcatgctgctggtgatcttttctatcttcccactaaaccttgggctctttttcagcacagtccttggcacagtggaagctcagaaagtatttgggaatgaaacgtgagttgaggaggctgccgcgggaggacacagaggcagagtttcctgttttcctgcaagcttgttcacaggctccatgcatgacagactggtggctgcctcagtgagacctgggtgtgcaagctctagcgacagactgtttgactgtttctttccctctcttattttaacagccattcacactgctccactcagcaaatgacaggcagtggttcttggcttttctcctggagagagtcatctgcagagactctgccactcattagcccatggccctggagacaacaggttcataatccctctgccttcaatctccacatttgggagctgggctgcatgttttcagagacaccggcttccaaatgaggcaaatcagagccacgaaaattctgattccttgctccgcgacagaccaaaagaagtcatattatttctggcagggagctgggggtgcagggatgttaaaaaataaaacagtagcagtctcaactcaggtgattcttaggataaccagagccaccaggtctgggagctatttttgctctttgatccttccagttctgatattttatgattctatgaaattggctatttatgcaccctaaaatggaactaattaagagcttttcaaagagaattttgtatacaccaatgatatcagaaatgcccaggtacccaaaactcaaaggaagagctggaggatgtggcttctatggaataagagtgagactggtatgtttcatgatgcttttgttaagaggaagataagtcatgctgacttgtggggctgggagctggtcccttctcctctacaaaatctcatgccctgcatctcaggtttgctagaccccagacagctgtgttttgctttgagggtcctacaatgaactctggtgcagtagccaggcattgtttttgtctctctggaagccctaccccttgttctaataacaaaattcatcttttgtggttgggaccttcaccaccactccatctggtggaacttagtccctgacttcaccttttccaccatcgcaaaccaggttgaccaggtgtcatacccaaagattgttctgcagtaggcacctgagttaatcaggtttgattggagctcctttttggatgaagacagatactgagagagaaaatcttgataccttgtgaagagagagtctgcccaggaatggagctaacagggagttaaaaaggacagagagagggagaggcagagagcaggcaagagagagagacagagagagagagagagacagagagagacagagagagagacagagagagacagagacagagacagagagagagagagagagagagagagagagagagagagagagagagagagagatgttgcttgagctctttgagtccaggccacccaaagttcatgcacttgacttcccccattatttgagccagtgcttttttggtttaaaagaatcttggttggctttcttttatttgcaacccaaactatattttatttatttatttatttatttatagaaactgggtttcactctgtcttctgggggcagagcagtggtatgatcatagctcactacagcctcaatctcttaggctcgagcaatccccctgtctcagtctcctgtgtagctgggactgcaccatgcttggctaattttttaaaaaactttttgtaaaataggtctcactatgctgcccaggctggtctcgaactcctgggctcaagtgatcctcccacctttgcctcccaaagtgtttggattacaggtgtgagccaccacgcctggctggtaagagtctttttttttttttttttttcttctcagatggagttttgctctgtcacccaggcttgagtgcagtggtgtgatctcggctcactgcaacctctgcctccggggttcaagcaattctcctgcctcagccccccaagtagctgggattacaggcatgcaccaccatgaccgactagcttttttttgtatttttagtagagatggggtttcaccatgttggccaggctggtctccaactcctgacctcgtgatccacctgccttggcctcccaaagtgttgggattacaggcatgagccaccacgcccagctgagagtcttgatgaatatccttgatacccccaatgtgggcagtgatttgactccgggtatgaatgtgtcaacagcaaggctcccaccccctgcatttggttcctgctccatgaagacatggagctccagcagcagcacatgttcagcaatgtctccaggtaaaaaaaataactagaagaagataactggggctagggactggttagccttgcctttcattcattcacttccagtgcttactaatatgttgagttttgtactgaatattgtcatggatgatgttgtttaatcctcaaaacaactgcatgaggaagattgtatcatgattcccctttcacagatggagaaaaggagactctcaatatttacccaagtgcctcactcaagtgagggcatgctggggaaggattttaagccaggctcgtcctgggtgcagagctggagctcttaaccagctctgtttcagtgttatttacacaaaacagctctctgggtctttttatttatttatttatttatttatttatttagttagttagttagttagttagttagtttttgagacagagtctcactctgttgcccaggctggagtgcaatggtgcgatctcagttcactgcaacctccacctcctggattcaagcgattctcctgcctcagcctccctagtagctgcgattacaggtgcccgccaccatacccagctaatttttatttctttttgtatttttagtagagatggggtttcaccatgttggtcaggctggtctcgaactcctgacctcaagtgatccaccggcctcaacctcccaaagtgctgggactacaggcatgagccgccgcgcccagctgggtctctattttctgtttcagaatctcattgcttcctacaggtgtgctgtgaagggtccccaaacagaagaaaaattcctttttgtctgaagtcccaaatctctttgaaaactgtcctctgtctcaccactggctactgacctcagctccttaacctcctatgtctacccaaggagaaaggttttatttcaggaaagtcacagcacaggagaactgcgaacagatggtgttgatgacatattgtgccctttttatttagatgggcatgagagaaccattgtgcatggccaggtgatggggcaggtctctccatccaggtgtgaacctgacagcccgacaggaacgctgtgacttcagcggggaggactgagctgggaaccttggatttggctgcagaattccttctgaccttccagtgagcccagaagtttctgtatttaaatatgaccatcatcatccagccttttcatgggatggatgaggaaaataaggctcagagaagttaaccaacattcccagggtcacacagctagttggcacagaatccacacctcttccccagggggcttcctggggctgcctggcctgtgtcaccatccttggcacttgtttcttttgtccctcatatggaagcgctgagtgattcagagcagctctgtcttgtctttcacagaaactatttattccccagttggtgatttcgctttacttgcctctcccgtgccggttgtcagaatgtctagaaaaatctgacagctggtattccatttagggacaacacttgggggatgtgtcttaagagggcgcacacacagatcttgctgtgcttctactcgacttccaaatataatatgctttcgtcggcaatgaaatggaaaatgagcacgggtgatgaagcaccgtttcgtatgaagactttgaaatgccaaagcccaggtaaatgacccagggtgaccaatgaagaggccagggctgggcattgacaggtagacccaggttaaaattattttcttttgttttgactcagcaattaaaaaaaaaattattttaagttccatgatacatgtgcagaatgtgcaggtttgttaaataggtaaacgtgcgccatggtggtttgctgcacctatcaacccattaggtaggtattcagccccgcatgcattagctatttatcctgatgctctccctcccattgccccctgacaggccccggtgtgtgatgttcccctccctgtgtccatgtgttctcattattcaactcccacttatgagtgagaacatgcggtgtttggtttcctgttcctgtgttagtttgctgaggataatggcttccagcttcatccatgcccctgcaaaagacatgatctcattcctttttatggctgcatagtattccatggtgtatatgtaccacattttcttcatccagttaaaattctttttataaaaacattgagacagggtttcgttctgtcacccaggctggagtgaagtggtgcgactgtggcttactgcagcctcaacctcccaggctcaagtgatcctcccacctgagcctcctgagtagctgggactacaggtgcctgccaccatgcctggttatgtatgtatgtatgtatgtatgtatgtatgtatgtatgtatgtatgtatgtatctatctatctatctatctatctatctatctatctatctatcgagacagggttttgccatgttgcccaggttgcaggttaaaattcttagccactatttgacttgggaaaaatgacttcactttgtggagcctcagtttcctcatctacatgaaaatggtaacagaacttgtctctcagggccatgcagaggggtcaatgcaatgtgttcatattaggttggtgcaaaagtaattgcagtttttgctgttaaaacacttgccattgctgggcacagtggctcatgcctgtaatcccagcactttgggaggctgaggtgggtggatcacctgaggtcaggagttcgagaccagcctggccaacatggtgaaaccccgtctctactaaaaatacaaaaaattagctgggcgtggtggtgcatgcctgtaatcccagctactcaggagactgaggcatgagaattgcttgaacccaggaggtggaggttgcagggagttgagatcatatcacttcactccagcccgggcaacagagcaagactgtgtccaaaaaaaaaaagaaaaaattgccattccctttaatggcaaaacccgcaattacttgtgcaccaacctaataaatgaccagcacttggcaggcatgcgtgacagttctcttccaccctcttccttctggactgcatccatatggattaaacagtaaacatcctggaagcaagcaccatcaaccttaatagatagtataatgtgtcatgggagcacttaataagaatctggtgaccggcaaatagatgattcaaccacaaagaccactgaattccatagatgccagcaactggaaccaaataataagatatacattcgtctcagtgtcattgagcttatgatctctaaaaccaagaatgtctggtgcctaaaatgggtggaactgaggcaaaacatccttaaaaactcccttattcagtatgaatggtgaatgggtactttcagtagacacatacttaaatgtccaacctgttatggggatatgggcttggtaagttttttattcagagttggggtcttgctctgttgcccaggctgaagtgcactggtgcaatcatagctcactgcagcctcgaacccctgggctcaagtgatccctccacctcagcctcccgaatagctgagactacaggcatgcgccaccatgcctggctaattaaaaaatttttctttttgtaaggaagaggtcttgctatgttgccaggctatggtaatttttccaaaaaattaggacgcaaagattgacaagtaacacaaaagtatatcaagctgggtacgggggctcacgcctgtaatcccagcactttgggaggccgaggatggggaatcacttgaggtcaggagttggagaccagcctggccaacatggtgaaaccttgtctgtactaaaaatacaaaaattagccgggcatggtggcgcatgcctgttaattccatttgctcaggaggctgaggcaggagaattgcttgaaccaaggaggtggaggttgcagtgagctgagatcgcgccactgcactctagcctggatgacagaacaagaccctgtctcaaaaaagaaaaagaaaaagaaaaaaaagtatagcaagcatattttatcataattacgggattcagagatatctgagagactgggagtgcctgaaagtcatgcttttaaccaaatattctcatgatactggggacatataaagttctaatactatgtaatgccagagagttcctgaattcagaggggtgaaatgaattcatatgcacaaagcacccagaaccgcgggtggaatgtggtcagcacctgactcagtttgagtgattttccatcgggaagccaggtgtgattgatggaaaggtcgactgcagacccctgagctagggtcttctagcctcctccctgccttcaaaagggtttctgtagggaattccttttggtgctgtaggaaaatgaattctatatgcaatgtgagcccctgatacagggtttcctggagcagtcaggaagacttgccttcttttttctttttttggcagagtcttgctctgttgcccaggctggagtgcagtggcacaatctcggctcaccgcaacctctgcctcccgggttcaagtgattctcctgcctcagcctcctgagtagctgggattacaggctcctgccaccacacccagctaatttttgtatttttagtagagacagggtttcgccatgttggccaggctggtctcgaactcctgacctcaggtgatcctcccacctcggcctcccaaagtgctgggttcctgcctgggtgcaggcaggaaccactgcacccagccaggcttgcccactatccagcttggagtttcatcccatttattcttgtcccttccttgggagaaaatgtaaagggtgatgcttccatatgactgcagggtgctcctaccacaaagataaggcagactggctaactggaggggctgtgtatttgtgtatgtgtgtgcgtgtgtgtgtgtgtgtgtgtgtgcgtgcatgtgtctgttgtttgtgttgacctaaaaattaaacaagataacaaaatcaaaccaaaaacaaacctttcccatcaaaagtgccacaatctttggggtcttattttttttctttattctttattcttccattcatgtagaaggaatagtcaatattgctcacttaatgaagaccatctgaacacctcttagtaaaattatcagacccaaaattcagacaaatgaaaaatagaatcattgctataacatgggcccgccacagtggctcacacctgtaatctcagtcctttgggaggctgaggtgtgaggatcacttgaagctatgagttcaagaacaggctgggtgacacagcaagaccctgtttctacaaaagtaaaaaagttagcctggcatggtggcacatgcctctagtcccagctactcaggaggctgaagcaggaggattgtgtgagcctgggaattccaggctttagtgagctgtggttgtgccactgcattccagcctgggtgacacagcaggactctctttattttattaaaataaataaataaataaactcactgggtgccgtggctcatgcctgtatttccagcactttgggaggccagggtgggaggatcacttgatgtcaggagttcgagatcagcctggacaacatggcaaaaccccgtctctactaaaaatacaaaaatgagccgggtgcggtggcacatgcctgtaatcccagcactttgggaggctgaggtgggcagatgggcagatcacttgaggtcaggagttcgagaccagcctggccaacatggcaaaaccctgtctctactaaaaatacaaaaattatcaggacgtggtggcgcatgcttgtaatcccagctactcagaaggccgaggcaggagaattgctttaacccaggtggcagaggttgcagtgagccaagaccatgccattgcactgggcaacaagagcaaaactccatataaaaaaaatataaataaaataaaaaataaaaggatgctgatggcattttcaagtcctcccattaatttctaatagagtccttgtcccttgtgctgcccacagcagcattttgaaatcttttccatgctccagatctcagtcccacctccagctctcctgagctcccagccctctgatgtgggattctttaagttccatctctgccacaaaatgtctgtttctttgcccatctcttagtttctggtgaagaggcagatgggctcttccaccttctgatggcaaagaccttcctaattggtgtgattacctgtttgctctaatgagagcagcaggaaagaaattcctagggatgaggggtgggttagcaagagtagagaagacctgagtgggggctctggggctgagggaagaggcccagcccgttcctttccctctcattggtcatgtggggttgcgaggaggattcagtttaatgagaaaagaatttcatcacttggaagaaataaaggaaaccatcttggcccttcacagttaggtgctagattcatcaagacttgggatggagggagcagacagtgagtcagggatctgagattgaactgttctgccccgatacaccttagaaaattaatcaaggaagaagggcaggagagaaacaaaaataaaccaaatttgacacacactcagtgttgatcgtgaggtcagctcgttttccaacttgcttcctcataggcgtttgctgcctattgccccagaatcacatagaccctattataagattatagttctttataatataatgatttatattcctttgggaatatacctagcaatgtgatttctaggtcaaatggtattgctggtcctagatctttgaggaattgccacaccattttctgatagactggataaagaaagtgtgtacatatacacaatggcatactatgcagccataaaaaggaatgagattatgtccttgcagggacatagatggagctcgaagccatcatcctcagcaaactaacacaggagcagaaaaccaaacactgcatgttctcactcataagcgggagctgaacaatgagaacacatgttgcggggtgggggatggagaggagagcatcaggaaaaatagctaatgcatgctggcttaatgcgtaggtaatgggttgataggtgctgcaaaccaccatggcacacatttaaatgtaacaaacctgcacgtcctgcacatgtaccccaaaacttaaaaagtaaaattaatgaagaagccaggtgtgcacatgtgcacgcatgcacacacacacacacacacaaacacacacacacacatgattatagtttccccctccttttttttttttttttgagatggagttttaactcttgttgcccaggctggagtgcaatggcgcgatcttggttcactgcaacctccacctcctgggctcaagcaattctcctgtctcagcctcccgagtagctgggattccacgcacatgccaccacacctgactaatttttgtatttttagtagagacggggtttcatcatattggtcaggctggtctcgaactcctgacctcagtttatccacccgccttgccctcccaaagggatgggattacaggcgtgagccattatagttccccttaattgccctattgataacaatttgaacagtataaaacattaagttttccctttgagatattctttaggttctgcatatcaatgagactactgatgtcagctggtctgaaggacccccccccagggagctgacttaccaaagaatgcagtttccacatcctgatggtttcatcaaatcaacaacctcaatttttcagtctcttgccctccacaatccccttaaaaaccctagctcaacactcctcagggaatggatttgagggttcctcctgtctccttgctcagctaccctactgtcattaaactgtttctctgctgcaaaccctgctgtctcagtgtattggtctattactgaacagtgggcataagaacctggtggtcctgtaacaggacgtcagcaagggcatggttgacgtggctggacaaggcacgcagcttaggccaagggcaaaagaggatagggaggagttgacagtttgggagagatggggaggccccaaagcgctcaaggctgggaggaggagagggagatttaggaggtggaagcaatgcagctgtgcaatcaggtcttgatagaagaagggaaaggttcaaaatgccaacgggcccccgtttgtggatatgggagcaatatggaagcaaagggtctaaggtgagccacaggatctcagacaaactcctctagtcctaggatgctaagcaggtagactcaggaactcagtattctcttcctagacacctctgcccaaaatgcaaccagggaggctctttcttgcatgtggaaaggcctgtgagcattaaatatattcacccatcactttgatcatgcttgaaaaattcttaaacctaaacacaaatcaacgagcttgtgtctgggggacaaacaaccctgacataatgtttttgcaaagtttctctgagataaaaatatgcaaaagggattatgtaatgaccgtcccagaggtcatacaagaatgcaacgtgcaaattacaaaataacagcttttttaaatgaaataagataatgaattttaaaccacttagtgcagtgcctggactaacaggctcacacctgtaatcccagcactttgggatgctgaggagggggaatcacttgaggtcaggagttcaagaccagcctggctaacatggtaaaaccccatctctactaaaaatacaaaaattaggccgagtgtgatggctcacgcctgtaatcccagcattttgggaggccgaggtgggcggattacgaggtcaggagattgagaccatcctcactaacacagtgaaaccccgtctctactaaaaatatgaaaattagccgggcatgggggtgggcacctgtagtcccagctattcgggaggctgaggcaggaagattgcttgaacccgggaagcagaggttgcagtgagcagagattgcgccactgcactccagcctgggtgacacagtgagactttgtctcaaaaacaaacaaaacaaaacaaaacaaaaatactactatagttattggttaggtaatggttaggtacctaaccatggttagataataccataattattaccataattattaattatgatatttattaaatgttatggtgataattattaccataatggttaattaatgttaagccacttagtgcagtgcctgggctaatagttattaatggcaattaataatggtaacaattattagtccaggcactgcactgacttaaaattattaattaaccattatggtaataattattaataaacattaataattattttataacaataaggattaataatttttaataaacataatacttgcagtatggttattaataaatataattgctattaacgatcattatatattaatcatattacattaattataaataagctattgacaaatcattaaagcaaacccagcaaggcttctgtttggtagcccctttgtcaggcatttattttattaatgtataaggttttgagaaataaaaaggccttacttcgaatttagattatttcccagtatagcctgacctttcccaaattactaagatctatgacatttccctgaacaaaacactgatccaccaacaaaggctgttgtggaaaatgagatgatacccaaaaatacccttctccacccatctcaagagtgctgactagcagtagagcgcttgagccccatgtgctttcattgtgtggggctcacatcatctgtcagccccgagcgagatggattgggaaggccaggtctgctgttttctcaagtttcagttctcaatcccttcgctcctcacccctcctcaccctcgcatgtcctgctggaaatggccttggctgtgaccaccccatcctgcccttataagatcagtgtgactcccactccaaatacagtcattgatgctatcaccccattgtcacagcaaggagaccaaggcaacttcaggaccacagctgggttttgtttgatgcgcatggcagttttgcagtgtttaaatttgagtgacttcagaagagatcattgctttctgttttgcaacagactccactactccctctctcccactgtttgcaacctcagagtacaggccatctcctgttccctcctgtcgtggcctttaatgctgggtccatgatgcagcagttcagccaagacagggctgatgggagcctgggtttgcatggacagttctggtgcctgggaccagctcagctccaagcacactagcctccccccatagcactcactggctctaagggagacagctacaagaccaggcaaccaaatatatccttctagtgtctatgtgacagcttcccaactatgtatactgacttatttaaatgttcaaaaaaaaaaaaaagaaaagaaaagaaaaaaaatttgacctccttaagaaatgtcagcattgaacagaaaagttgctgatagcctgctatatgatgttttaatgtaattaaaaattttttttctatacaacagggctattaaaaccactctgattttcaaagttggaaagaaggattaaatcctttagcttctcaggaattctctactgattaggagattcagtaggctctcttttttctttaaatttgctttcatgaataaaaaaaaataacctttcatgggtctcttttttggcctccagagaaccttatttcttctgtaactacttggttaagttcatcagaggactctgtcccttttttttttcttttttttggccagtgcatttgggaacatagaggtcatccattcctaagaattctgcgaagtaggtgtaatcatcctgatgtttatagatgaggaaacacagagaaggtccatcctttgcccaaggtcacacaacggactcgacccaagtttgccggacagccaaaataggctctttgcaccgccccatgcagccacaaccaagagaaggcaaacagcacaaaaccacacatccaatcacacgcagacctcagagagccttgagagaaaagacagggtcagtggagattctgcaaaaaatgcagaatttggaggagaaagatggagaaaatgaaacccaccgcatcttagcaaaaaagatctttaacctcagtcctggatttttggcttcagtacaagggaacatcagcccaagagcctgtgtgtgaacgcatttttcatatagagagtgtggtgcattggcctgtcccggaccggggaggggatggcagcaggggcacctacctccttcaaactctgtttggcagttccccgaggtctcattcaggctctcttcctcattgataatgatgttctcaatgtccttcatcgttaggtggtctcggaaggcatgatagagaatgtgcttcaactcttccagagttatcctttgcatgtcaaactgtggagataaagagtagtgagatggtcagaagcatgtggagatgggaagttggctcgggccatgacaggccagacccacagctgctctgcagaaacttgtctcagcgtttcaggatatcaggtgaacagttttccatcctgttcagctccaagtatactcatgaacttgcagggacttattggaatgatagagagtggaacatattcccttcgctttagcttcttggagaaaaaaaatgccacccgccagtctggtttcctattcatccagccatctgctgtcaaccctgcatactttgtgtactttagaatggtgaaaccctttatataatgcatacgtctctaaaatttttataatttaccaacactctggcaattcccatattggtttaagcatgtatctttttttttttttttttgagatagaatcttgctctttcgcccaggctggagtgcagcggcgagatctcggctcactgcaacctcgcctcccgagttcaagcgattctcctgcctcagcctccgtagtagctggaattacaggtgcccgccaccacgcccggctaatttttttgtatgcttagtagagacggggtttcaccgtgttggccatgctggttttgaactcctgacctcaagtgatccgcccgcctcggcctcccaaagtgctaggattacaggcctgagccaccacgcccggcctaattatgtatcgtttaaaaaaaaatttagagacagggtcttgccctatcatccaggctggagtccagtggtgtgatcatagctccctgcagccttgaactcctgggctgaagccatcctcctgcctcagcctcccaagtagctgggattacagacatgagccactgcgcctgtctaacatttacaattttttgtagggacaaggtcttgctatgtttcccaggctggtctcaaactcctggcctcaagtactcctgccttggcctcctgaaagtgctgggattacaggtgtaagccactgtgcctggccatgaatcttgttctaacaagataaaaacacaagttcaaagtcatgttcatgaagaaaagctgctgaaggagaggtgcagagttcctgattacatcctgcccctccccgagagaggactgtacttttccactccatttatattaggtttgatagtgtcgctttcttttttctttttttttttttttttccgaaatggagtcttgcttccatctcgcaggctggagtgcagtggcgcgatctcggctgactgcaaactccacctcccgggttcaagcaattctccttcctcagcctcccgagtagctgggattacaggtgtgcaccaccacgcccagctaatttttgtatttttagtagagacggggtttcgccatgttggtcaagctggtctcgaactcctgacctcaggtgatccacccgcctcggcctcccaaagtgctgggattacaggtgtgagccactgcgcctggccagtagtgtcactttcttggccaataaaatgtgagtagaagtcacatctaccacatctaattcacagctttatgaatcattgtgtggttctaacatttgttctttccctctgctatgagaattacatgccccagatagaggctgttccttcgggctgggtctcagaatgaggataaagtggggaacacctacagctgaatcacaatggacagctcacgtcaggaataccctgtgttgttatgaaccattgagatttggggcttgtttgctacggcagcataacttagaccattgttggtctatgtcaaaaatagagaaattggtacataaaactaagaggctaccataaccaaaattctaaaagacaatgtactggttccggagccaggcagtgaaaaatgagaaaactgtgactggaggctggaaagacacagatccctgtaatacgatagcaaaacatttggtaaaactgttgcctgtgataccttggaggacaggcagatattgaatccgagtccagtggttttaggtaaaaagtctgtgaaacagaatgccgtgattcacaattgaaattagctgcatctaacagagcactacaagaaagagatgagctcaggaaagaactggttgatttgcaagccaaaaataaaaaccactcagaaattcctggcgttgcagcattgaaagaagcaattgtttcttttttttctcgtaatgatcttgttatcttcctatccacacatttctcaaagcccccatttctatttctagttctatttttttagagacaaggtcttgctcggtggtccaggctgatatgctgtggtgtgatcacagctcactgcaacttcaaacatctgggctcaagtgatcctcctgcctcatcctcctaagtagttaggatgacagacatgcaccaccatgtccagctattttatttatcatcatcatcattattattattattattattattattattattatttgagatggagtcttgctctgtcacccaggctggagtacagtggcgcaatcttggctcactgcaacctccacctcccgagttcaagtgatccttctgtctcaccctcccaagaagctgggattacaggcacacaccaccacacctagctaatttttgtatttttagtagagacagggtctggctatgttgcctgcctcagactcccaagaagctgggattataggcatgtgcaccacacctggctaatttttgtatttttagtggagacagggtttcaccatgttggccaggctggtttcgaactcctggcctcaagcaatactctggcttcagcctcccaaagtgctgagattacaggcactgcaccaagagcaattgtttctcatctccaactagtaagagataaaataaagaaatgctttaagtaataatacagccctattgaaacaaatcaatgcctctttaaaaaaatctctgaatgtgttaagtgactctcctaggaagcctgttattaagtttagagagaggtatgtctcaaaaataattgtggatgtgtttactagcataactgattggagccagataaaaacataactaagtccttgagagctatactggccaagagccaacaatcttggattaaaagacactataactgttccaaactttaaaagatctttggggccgggcgcggtggctcacgcctgtcatcctagcactttgggaggccgaggctggcggatcacaaggtcaggagattgagaccatcctggctaacatggtgaaaccccgtctctactaaaaaatacaaaaaaattagccgggcatggtggcgggcgcctgtagtcccagctactcaggaggctgaggcaggagaatggtgtgaacacgggaggcggagcttgcagtgagccgacattgtgtcactgcactccagcctgggtgacagagcgagactctgttgcaaaaaaaaaaaaaaaaaaagatctttggacttcccaacctacgggcccaagcaattaagaggataagctacacgggtcccaggaagggtgtattacacaatgccctcatagagtaagtacaagaatagtggaaaaggacagctttcctgggaatcttggagaacaatgtcatccagggtcacttctaggaagcagaagcagctaattgagggaaaattcctcaccccaaggtttttgtccaacagggtttcagaactgctctgagcctctgaccgctatgggtatcccatgttttgctttccagaggggaatgtttttggtggttggcctgaccctggtccaccaccatatgtcaagtgtgtgtttgtgtcgggcaagggtgaggggtaatttgactttttagtttttatgtttccataccaagaagagccacatccagatttgatgagcatcatgagattctagagcttgagtctggtgttataactggatgggactgttgggaagtctcccctggggaggggaggagtatattttgcagctgaagagagggaaatgaatattgatgagcaagagtgtggactgtaacagggtctattatttccagctataattgagccttgaaaaacatgggtttgaactgtgtgggtccacttatatgtggatttccttctccctctgccattcctgagacagcaagaccaacacctcctcttcctcctcctccacctactcaaggtgaacaccatgaggatgaagacctttatgatgatccatttccagttaatgaacttacttcctcctctttatgattttcataatagcattttcttctccctagattactttattgtaagaatgcagtgtacaatacatataacatacaacatatgagttaatcaactttttttttttttttttgagacaaagtctcgctctgtcccccaccctggagtgcagtgacgcaatcttggctcactgtaatctccgcctcctgggttcacgccattctcctgcctcagcctcctgagtggctgggactacaggtgcccgccaccacgcccagctgattttttgtatttttagtagagacggagtttcaccgtgttagccaggatggtctggatctcctgaccctgtgatctgcccggctcggcctcccaaagtgctgggattacaggcgtgagtcaacacaaccagccttgagttaatcaactttttatattattggtaaggcttccagtcaacagtaggctattagcagttaagtttttggggattcaaaaattatacttggatttttgactgcacgtgggtcagtgcccctcatctttgctttgcctaagggtctactatatttgtttccccttgtaggagaggatgatatctccttgcctgttgatgtcacaagctttggccaatcaactgagagccaaagtgatagaagtatgaaagtccaaggagaagcttcaaagccattgtgttttctgccatttccctttctcttctttcacataacatttacacaaaagaggggctgctgcttcattctaggttctggaatgacctaggaattcaacctgagtagatcctcaaccatcccacaaaggacgcgggatctgagtgagaaataaatgcttgctgctaactgctaagactctgtggtttctgcagtgtaacttagtcaagggtgaacacaaaactcagtgttttcagttactctgcactatgaggaaggaagttttagactcttttttccctctctctctccctgcctcccttccatccttcctttcttccttccttccttccattcccttcctccttctttccttccctctccccctccccctttcctcccttcccaccctcccgccctcccttcttttcttcctccctccctccctccctccttccttccttctttccttcctcccttccttccctccttcctctctcttttactttcttgtttcttgctttgtcacccaggctagagtgcagtagtgcgatcatagcttaccgcagcctcaaactcctgggctcaagcaatcttctaggtggaactacaggtgcatgacaccagacctggctaattttttttttaattttttttttctttacagagagagtcttgctatgttgcccaagctggtctcaaactcctggcctcaagccatcctcctgccttgcttgcttgttaaacaatttgtaccttgctttaactgtgcacctctgttctaaaaaattaaattgggatattgaatcttgctgtaaaatctaaatgattcaagttcaaagccatttatacacttcagagcaactgaaggggaggtgtaaaacaaacttgttttctgcattagagtttaacgatcctagacaggaattttgacatacactcagagaaaactcatgggaccctgtctctttatattgggtaagggagcaaggtattgttcatttggctttggggaaaaacctggcagaatgcatgaagaggatgatttacagatgagaacaccaagaccccctgccatgatcagagatgaagagtggcaagatcaaggtcaacaagactcagaaaatgagtaaccatttcctaacacttgaagagtgtggtgcctggaaaacctctaacctgttgagaggttgctgtcattcagaaatcaggccaaaagattggtcaggagcaacgagaagagaaggaaagatacagactccaaaatctatagttttgggccaggtgtggtggcttatgcctgtaatcccagcactttgggaggctgaggtgggcagatcacgaggtcaggagttcgatcacgaggtcaggagttcgagactagcctgaccaacatggtgaaaccctgtctctactaaaaatacaaaaattagcccggcgtggtgacgcattcctgtaatcccagctactcaggaggctgaggcaggagaatcacttgaacctgggaggtggaggttgcagtgagccgagattgcaccactgcactccagcctgggcaacagagcgagactctgtctccaaaaaacaaaaatctatagttttggagatctgggtcatgttttagtattagggtatatatttagtattaggacatctaaacaaaataagttgcgtagcattccatatatcacctatattgtcaatatctgtctttcaaaagtttgaaaaaaatcactgtaaaacaatgtgtaccccatgccaacaagcctttcttctgtgattgtcagtccattttacttttcagtttttcttcagtcaattttggaatgttgtagttttttggaaaaccagagagaacattttcattatcattagtatgcaactatggaccctagtcctgcaattttaaattcctcccaatcattattacatcccagttctcctttgtacttttattggtttctctcttctagttgattttcgtcacctttttctgttgttaatggatcatagggaagagaatgtggcccatacatctgcaatttttggaaacctaaggaattttccactatagtagaatctctgtaaggtcagttatacaaatatatttacatttatttgtttattcatttatttatttttttgagacggagtctcgctctgtcgcccaggctggagtgcagtggtgtgatctcagctcactacaatctctgcctcccaggttcaagtggttcttctgcctcagcctcccgagtagctgggattacaggcgcccaccaccatgcccagctaatttttgcatttttagtagagatggggtttcaccatgttggccaggatggtctcgatctcctgaccttgtaatccacctgccttggcctcccaaagagctgggattacaggtgtgagccactgcacccggccatatttatatttattaattacattacgtaaccttataattataatctttttctataaacttacttttttttttttggactactggagtcaaggaccatgagtagcatattgaagtctgtgaagaaaacttgttctccataaattattcttatagttcaaatatttgttaaatgaggctattctgtagtgcaaaaagatttatatactaatccaacaaatggttattgggaatgactctgccagatactgtgatgggaatacaaaagcgaacaatacataaatcctgttcttgaaaccaagcaaatgagtcatttgaattcaatgtggtacatgctgtgggagggaagccaggatgtcttggcaccacctggttgggggtgaagggtgggtcagagggggctttctggagaacatgcctactatcaaagacctaaaggaaaaagaggctgactttgccaggtgagtgaggggagggtgggaaaaggataaggagggaagaggagacggtcaggtagggtagggggcagccgtaccaaggcacagagttgcaaaagcttgacatgttcattaactgacaatatgttgagttcttctgaggcttcgagtagccaggagaaggtgggaaggaatgaggtgagggatatgggtggggcactagtcagtaaaggccttgtatgacacggtgaaaagcttaattgtattttgtttgtttttattttttaattcttattcattttgtagagatggggtctcactatgttgcccaggctggacttgaattcctgtgctcaagtgatcctactgcctcaacttcccaaaatgctgagattacaggcacttgccaccatgaccagcttattttatttatttatttatttatttatttatttatttatttatttatttatttttttgagctggagtctcactctgtcacccaggctggagtgcagtggtgcggtctcagctcactgcaacctccacctcctgggttcaagcgattctcctgcctcagcctcccgagtagctggtattacaggtgtgcaccaccatgtctggctaatttttgtattttcagtagagatggggtttcaccatattggccaggctggtctcgaactcctgacctcgtgatctgcccgcctcagcctcccaaagtgctgggattacaggcgtgagccacagcacccacccgaccagcttatttttaaaaaatagttttgtaaagacagggtcttgctatgtcgcccaggctggtcgcaaactcccaggctcaagcagtcctaccacttcagcctcctgagtagctgggactacagacatgcaccaccacttgtttttatttatttatttttattgtggtaaaatataataactaaaaatttactattttattctttttttttttttttgagacagggtttcactcttgctccccaggctggagtgcagtggtgcgatcttggctcactgcaacctccaccttccggtttcaagcaattctcctgcctcagcctcctgagtagctgagattacaggcatctgccaccacacccggctaattcttgtattcaccatgttggtttcaccatgttggccaggctggtctcgaactcccgacctcaagtgatctgcccgccttggcctcccaaagtgttgggattgcaggcatgagccaccgtgcctggcctattttattcaagtgtacagttctgtggcattaagtactttcacagtgtcatacaaacaccacaattacttctctccagaagtccttcatcttcccagactgaaactttgtacactattattaattatcattaaacactatctccccattcctccctcactgcaaacccaacaaccaccactctattttttgtttctctgtgtctttgacttttttaggtaccttatgttaagtggaatcatatgatatttgtctttttgtgactggtttatttcacttagataatgccctcaaggttcatccatgttgtgtcatgtgtcagaattcccttcctttttaaggctggaccattttctgtaaacccaaaatagaattctaagctccacaaccatcggaatggaccccacttctcagccaagggcattccaaagttaacctgaaaaatgacttcaggctatgatgggaaggaagaattgaacatgactcattataccctcctcccttttggaattcaggcccaaatattaaagttaattaatgtttcaattaactaacattaaaacagagtaagactgataggacaaggaacacttacaatctattctctctgcagcctgcaacctggaggcttcatctgcataataaaaccttggtctctacaatccttatcataagccagacattccttttgattgattccaagtctttagataatacctcaaccaactgccaatcagaacccaccaatgaccaatccacctatgacctggaagctccccacccaccaacctccagttgtccagcctttttagactgaaccaatgtcatcttatgtgtattgacattttacatctccctagaatgtacaaaactcaggtgtaggctgaccaccttgggcacatgttctcaggacctcctgagggctgtgtcataggccattggtcatttgtatttggctcagaataaatatcttcacgtattgtttagagcctgagtcttttcattagccattccgttgtatggacataccacattcacaatagacataaagtagaagcagcccaagtgtctgctatggatgtaggtgtacaaatatctgttccagtcactgcttttaactctttggggtatatacctagaagcagaattgctgaatcatacggtaattctatgtttaaatttttcaggaacagagcttggttttatctgttgagtatctttgagttgtatttttatccactaaaacattttcatcagagaaattacttgatcaggtttgagcttgagaaaaactaccctttgctgatacaaaggtcccaacaaccagagaggaggctattgaagttacagattctgagactgaagtaggctatggagatagggagaatttatgagctgtgtaaacgagaggttgataagacttgatggatcactgtgtgtggtgtgtgaaggcgaatgggccatccagggagacacctgggttttacgttcagctgaatgtatgggcttagaaagaaaggctacacgttaaattttggatgcattctttgaaggttcctgagggacagcccagtagaatagcctaggatgcagtagaatgtatagatacaggttaatgacacagatttagcattcatttgcatacagatgatgataaagtcatcagaaaggatgacaccacccaagaagagagtgtgggctatgaaagccccgagggatgcattcagaggacatcaagatgaacaagtgggtggccctcgttactgaatgcacagagtgtgacttttatcttcatattaatccgttttcatattcttctaatgaagacatacccgagactgggtaatttatgaagaagaagaagtttaaaggactcaccgttccacatggctggggagggctcacaatcatggtggaaggtgaaagtcatgtcttacatggcagcgggcaaaaaagaatgagaaccaagcaaaagagggaaaccccttataaaaccattagatctcatgagacttactcactaccaccagaacggtatgggggaaaactgcctccaggattctattatctcccactaggtccctcctacaacatgtgggaactatgggagccacaattcaagatgagatttgtgtggggacacagctaaaccataccaatcattatacacggtctttaaaaaatatttcagtgctttgttaatgtcttttggaaaaaaatctatttttgtatcagtacagctatgcttaattcctttggtgtgaattctgctaaatgtttctttctttttttttttttttttgagtcagggtctcgctgtgtcacccacgctggagtacagtggtgtgatcatggcttactgcagccttgacctcctgggctcaagcaattctcccacctcagcctcctgagtagctgggactacggctaatttttgcattttttgtagagatgcagtctggccatgttggcccaggctggtcttgaactcctgagctcaagtaatctgtccgcctcagcctcccaaagttctgtgaccacaggtgtgagctaccacacctggcctttcttttggtttttaaactttttaatgttatattttagagatatgtctcttacaaggaggctagaattggattctaaagaaatctaatttgagattctttgctttccaatggtagagtctaattccatttttatatattgttataaacatatttggctgtactgttgttattttatttcctgcttctggttcttctgagatggcgtttcgctcttgttgcccaggctggagtgcaatggtgtgatcttggctcactgcaacctccgcctcccgggttcaagtgattctccagcctcagcctcccgagtagctgggattacaggcgtgtgccatcatgcccggctaattttgtatttttagtagagacgggatttctccatgttggtcaggctggtctcgaactcccgacctcaggtcatctgcccgtcttggcctcccaaagtgctgggattgcaggcgtgagtcaccgtgcctggcccgcttctggttcttatggtttgttttctcttttacataagaaacctgtggacattttagttttggttatgctgctggatgtttttccatttgtgtaatgcatgacttaagccaccatttcttaaattatcaaattcaagaaactaaatggcatcctgtcattttttcttgtatgtaataagattaatagaccttttattttcctaccttttgcctcatgcttttcagtctttgtaagtttaatttgagatttatgatgacacattttctactatttgcatctttttctagaatagtatttggagtctgcatttaattttgtaacaaaatttacaacagctcctgctacttcattatatttaagtgattccaatgcttacttccattttttaataactgtccctaaactaagtgcctgattgtcatccaaatatctgctagagaacatttaaaactatttgacaatgaaacacttgtgaatattacattttctgcattcttagaattctgataatacctttctccccttctctcatgacagacaatttattctgacataaaattctagaatcatacaaatctccccctcaaagttgttgaagcttctccagtttcttctctctctctccgtctctctctcttttttttttttaagagacagggtctcactctgtggcccaggctggagtgcagtagtaagatcagagctcactgtagccttgacctcctgggctaaagtgatcctcctgtgtagctgggattacaggtgcatgttaacaggcctggataaatttttatattttttgtagagacgggatgtgtgagtctgttctcacgctgcaaataaagacatacccgaccctgggtaatttataaagaaacagaggcttgggccgggagcggtggctcacgcctgtaatcccagcactttgggtggccaaggcaggcggatcacaaggtcaggagttcgagaccagcctggccaatatggtgaaaccccgtctctactaaaaatataaaaattagccgggcatggtggcaggcgcctgtagtcccacctacttgggagactgaggcagaagaattgcttgaacctgggaggtggaagttgcagtgagccgagattgcaccactgcactccagcctgggcaacagagcgagactccatctcaaaaaagaaaaataaaaaaaattaataaaaagaaaagaaaaagagaaagaaaagaaaaggaaaaagaggcttaatggactcacagttccacatggctagggaggcctcacaatcgtggcagaagacgaaggaagaacaaagggacttcttatatggtggcaggtaagagagagaacttgtgcaaagggactcatctttataaatccatcagatcgcgtgagacttactcactagcatgagaacagtatgggaaagatccgccttcatgatccaattacctcccatcagctccctcccatgacacgtgggaattgtgggagctacaattcaagatgagatttgggtggggacacagccacaccatatcatgggtgtctcactatgttacccaggctgatctcgaactcctggactcaagcaatcctcctgcccaggtgccaggcctctctgttgtttagtgtggggaaagagccaagaggttggataatgtatgcagaatacatgttttctgaatgactaaacctgaatcttctatttgctccacagcccagtctttcctgcctgtttccccttcctcaatcattgtccccccaaaatccaggagaaggccaggaggagcactctctacaggtggacttcccatgttcagcttctctaccgtgttgcatggaaaaagcagactaactgaacttgttttcctgctgtgaaaggaacctcaggggtgcctgagtccccagtgaagtctgaattcccgataagatgaaatgccaggctgccaaaagcccagagctcgctgctggctgccggctgccttgtgaggcctttgctccatttttcgtccctgactcatactgggacctgcacagctgggggccaacatctttcctgcccagatttgtgagcgagtccaatctcatgtcaactttcactgaatgtctggaatgaatttgatgacacagttctttctcctctggagaaaaagacaggcggaataaactccaaaatatttcacacctctattcctttctctgcccatctgcaaaaggcattttcctgccgagagagagctgcctggacgatcaatgggtcagaacttcttaaccagggagcagaattggttgcagtgcaccacaatagtaactcctgttatctggggtctcctgatggggtcttgaacagctggagtcctacctacacagttgagtgatctcacccatttatcttggtacacagtataaaaatacagtcatgttttaagtctgccttgagcgccagcgtgaccaggccaagcgaggtcagtagatctgcataacttccttccagggccttctccttcctccttggtccccacagcgcaaacaatgcagcctcttctatcaaataagcagacccccttcctaaagggtgggtccaaccatcaacctcccacgggggtccagatgtgaagggcaggagacaccaatgtaaccagagagacgtctagagtctgactggtatggtttggctgtgtccccacccaaatctcatcttgaattgtagttcccataattcctgtgtgttgtaggagggacccagtaggagataactgaatcatgggggcagtttcccccatactgttctcgtggtagtgaataagtctcatgagatctggtaagttttataagggtttcccccttttgcttgtctctcattcttttttgcctgaatgcacagagtgtggcttttatcatcgtattagtccgttttcatgttcttctaatgaagacatacctgagactaggtaatttataaagaagaggtttaatggactcacacttccacatggctggggaggcctctgagatttttccctatatgaggaattaaacagcgggaccgaaatgaaaggtatcctgagacagactcctccctgccaagaacagagagacagacgtaccttggacaagactgcttgggaagatgagtagtttgggcaaagaaatggaagactggtaaaggtattgagaaaatgcaacgttcaaagcagaaagcagggctgggcatggtggctcatgtctgtaatcccatcactctgagaggccgaggcaggctgttcactcgaggtcaggagttcaagaccagcctgaccaacacggtgaaaccctgtttctactaaaaatacaaaaattagccgggcgtggtggcaggcgcctgtgatcccagctacttgggaggctgaggcaggagaattgcttgaacctgggtggtggaggttgcagtgagccaagactgtaccactgcactccagcctgggggacagagcgagactctgtctcaaaaaaaaaaaaaaaaaaaaaaaaaaaggcagaaaacaacaaaaaacccaaaacagtaggtgccagactatggataaatccatttggactcctgcacatcttgcctcattggtatggagagacaggaggacagagagaaaagtgactccctgccttctttggcccacaaggaatcagctcaagggagcaaggggatggggccagggcatgtgactaagcctctgcagtcgacccccagaatgcactggtggcttagaaaaagatgaaaatgcccagtaacacccaaacgaagattgagcacctattgactcccacagtctagaagaaattttccactaacagcaagatctatggagcagacatgtgactcagacatcgtggttgactttgaaaagctttgctctctgaaaaagagcacaagatcattctgagtgaagccaggaaggtgctttgacctgcccttgaatacctagggctagggtgtccccagtctctgctcctgaagcagctctgaccccaaccctagcctcttgtaccagcattcctccctccactcctcttcaaaggcaatcaaccacagaccatgttggaggggacaggggaccttgacgtggccttgctgcttgcctgcccggcatcagatgaagtgaggtgtgaatctgttgttcccacctctgatctcatttcctacaggtctcgcccaatgtggggtctcatcattgcaacctctgcctcccaggctccagcaatccccagtctcagcctcctgagtagctgggactacaggtgcatgccaccatgtccacataatttttgtattttttatagagatgggtggtcttgctatgttgcccaggctggtctccaactaggttgctatggtgcctggagatgtctatttcttataaagcacagccctgaacacatgtcaacatcaacaagggctcagatgaagaaattgatctcttgcagcctggaggaaatgccagccggatgcacgtagggatagggtgcagccggagtccaggtcacgtcgcagagcctgggcttgtcacagagcctgggctctgtggaagatggtattcccctacatcatgggtgagaggaggctgcatttcaacttggcgtgtcacttaaatgaagacctgtgaatacagacagcttgtctgggagctaagcccattggtgggtcctccggcggcaaatctgagaagggatggccacaggactgggctgtcggcatgccaagtgtctggtccccacctaggctgtctgatggcaggtcagagaggctagatgcagggagagcttcctctgagccaggagcacagcagatgtggcctcatttaagtctcatggaggaagcaaaggctacatgatgcctattttacagataaacacagtggagttcaaagaggttaaataacgtaggcaaagataagaaacaaaagagtgaggacgggcatggtggctcacgcctgtaatcccagcatttggggaggccgaggtgggcagatcactggaggtcgggagttcgagacaagcctggccaacacagtgaaaccccatctctactaaaaatacaaaaaattagctgggcatggtggtgggtgcctgtagtcccagctactcaggaggctgaggcaggagaattgcttgaacctgggaggcagaggttgcagtgagccgagattgcaccactgcactccagcctgggtgacagagtgagactccatcttaaaaaaataaataaataaataaataaataaataaataaataaggactccagggaaagtcacattgagaaggtgatatttgaggaggaacatagaggaggcaagggtgggtccatgtggatatttgggggacggacattccaggtacagggaccagcaagagcaaagaccatgaggctagaacgtgctctgtgtgctggggctggaagggagatgagggcatgtgtttccacaatgaatatgtatcactggagaaccagataaacgtttctccttttaaaatggagataatcaccatgctgaagtgcatttcctcgggtaaaattataggtatggttttggaggacaggtcaaaggagaagcccattagtagctctctgctcccaatttccaccactatcctgatgggagccttgaccccaaataataattcattggtgtctcagcccttcacaccagcttgatctgacccgctggagtgcagaatgtgtgagaactccagagaatatagttcactctgccctcaaagaaatgggttttgtgataagccaattggtggccccaaagatatccacatcctaatcctgagaacctataaatgggttaccttacatggtaaaagggcctttacaggtgcaaagattcgcctggattatgcggatagaccctgtgaaaggaaaataccttgggaccccaaaattactgagctaaagggaaaattcaagcttggaactggtcagggcaaatctgcctcccattgtattttggaaagacttatcagaaaaaagaatgcaaccatctgtctctcatcttccagtgacctagaagctccctccctgttttgagttgtccctgcctttctgaacagaaccaatgaacttcttacatatatatatatatgtaagatatatacataagatatatacatatatacatatatatatgtatatgtgtgtgtgtgtgtgtgtgtgtaatttggggttttgtgtgtttttttgagacggaatctcgctctgttgcccaggctgctgtgcagtggcatgatcttgactcatggcaacctccgccttccaggttcaagtgattctcctgcctcagcctcccaagtagctgggattacaggcacacaccaccacacccagctaatttttgtatttttagtagagacggggtttccctgtgttggccaggctggtctcgaacccctgacctcaggtgatccatctcggcctcccaaagtgctgggattacaggtgtgatccaccgcgcccggccacatatattgattgatatctcacctccctaaagtgtataaaaccaagctgtgccccaaccaccttgtgcacatgtcaggactccctgaggctgtgtcacaggtacgcgtccttaaccttggcaaaataaactttctaaattaactgagacctgtctcaaattggggttcacaaccctaaatgtaatcatgtaagactgggggagagagagatttcactaaagaggaaaaggccctgtggggaaggaagatggggcaagcggccacccaccttgtcaccaaaagccaccaaagggcatggaaatggattcttcccttggagcctccaggaagacaccttggtgtcagcccaagggaattgattacagacttctgacctccagaaatgtagaatacatttgtgttgctttaagccacaaagtgtatgataatttgttataagagcaacagggaatgaatagagatttattttggttgttgtctgtaaagtaaagggcttttatgccaagagctcactctgtctggaagtaactcatcatcagaaatctggacacagggtaggctgtggtttgctagtggcggccacacagctattggattgcctgggtcgggccctgagggtaagctgtgaatagcctctagagtaaagtgggatgcaggtggagttctcaacagggagcccactctattcaatacctgggagctgtttgcagtctgcactgtctggggatgatgaaatgggaaacaaacagggcaaaggaaaaacattcataacctcacagcactcctgagaataaacaacagagaaaattccccattgcacatcgaagaggatgtgccagtgttctcaagtggttcattttatgtgaaacagacaagcatgtattacagatctgagtgaagatgaggacttactgaagaagccattgtctgtctgtctgtctctctctccatctttttctatgtgtgtatgtgtgcatgagtaagttcctttttttttttttttgttcttttttggagatgggagttttgctcttgttgcccaggctggggtgcaatggcatgatcttggctcactgcaacctctgcctcccaggttcaagtgattctcctgcttcagcctcccgaatagctgggattacagccatgcgccaccacggctggctaattttgcatttttagtagagatgggttttcttcatgttggtcaggctggtctccaactcctgacctcaggtgatccacccgcctcggcctcccaaaatgctgggattacaggcatgagccaccgtgtccggccatcagttctttttttctttttttgagacagagactggctctgttgcccaggctggagtgcggtggtgcgatctcggctcactgcaacctctgccgcccaggttcaagcaattttcctgcctcagcctcctgaatggctggaagtacaggtgcccaccaccatgcctggctaatttttgtacttttagtagagatggggtttcactatgttgtccaggccggtcttgaactcctgacctcaagtgatccacctgcctcggcctcccaaagtgttgggattacaagtgtgagccaccatgcccagccaatgaataagttcttagtagtaataaactgagaaaaagtcctcgaacttggttcttactcagataccatcacataggggctgtgtgactcattgaaagttactaaacttctctgttccttagcttccctgtgaaaaatagagatgatattgtttacaacatgtggttgttatgtggatagaactctttttattcccaaatcacacatcttcattttgctgtggcccacacataaaaagttaaggagaaacaaagtcattcagtttgttatcgcagaggtaagaactcattgacaccctgattccccatccaaagctcctttgtgtcacttttattggcagctgcagctgttccggaaaataaaatgaatcacctaagttctctgcctcctcatgcacataaatgcagaccccgagttcaggagctaatggactcataatctaggatggattctgccactaactagttgcgtaccctgaagcaggtcatttaatgacttggaatctgtttcctcatacatttaatagataatcctaatgataaaaagaatagggccaggcgcggtggctcagacctgtaatcccagcattttggaaggccgaggcaggtggatcatgagatcaggagttcaagatcagcctggccaagatggtgaaaccccgtctctactaaaaatacaaaaaattagccgggtgcagtggcgtatgcctgtaatcacagctactcaggaggctgaggtaggagaatcgcttgaacccaggaggcagatgttgcagtaagccaagatcgtgccactgcactccagcctgggcaacagagcaagaccctgtctcaaaataattaattaattaaaagaataatatgaatagcaataatatgataagaataaccataataatgaaaatcccttccttatccaccttatagaggtttttgtgagaattaaataaagtaagaggctgggcgttgtggttcgcatctataagcccagcactttgggaggaggaggtgggcggatcacttgagctcaggagttcgagaccagtctaggcaacatggcaaaaccccatctctacaaaaaaatacaaaaacaagccgggtgcagtgtggcagcacgcacctgtagtcgcagctactcgggaagctgagtcagaagaatcgcatgagcccggaaggtggagcacattgcactccagtgtgggtgaagggagtgaaaccctgcctcaaaaaaaaaaaaaaaaaaaaaaaaaacaaaccaaaaacaagaaaactaaataataagaaatgttaattttcttccacaaaaatatgcaaagtaatacaaatataagacatactgttgataggcccgttaatgatgtgatgccaatttcatctctgtatttaggctcagaatgtccatctctgctccaggtgggaggctgatgttgtccaattcataattctccctgagaatggtgaaatttaagttcctcgtggctaaaacacccctgcttttttttgttctcatttaaagaatgtcatgtaggcttttaggcttccctcaacagcttccatctggcattcagcaaagcaagaggatgagatgtcactgctatgacttgtctcgttctggacagttccttttaccacaccaatgaccctaggcaagtaattcttattgaatatcttcagatagagaagaaagccatttctgatggggttttgaaggggacggaaaagagtcaaacagcaacaaagtgcaatctaaataaggagatgcctttttgcttgtgcttagcaaatgaatgaagtgtggatttaccttgattctgtatgcagggactgtgacttttgtagatatgggcacttattcagaaacaagttcccagatgccaaggtgactgctgaaaacccttcaatgactcttagttccttcatcattgagtccaagttctgaaacacagctcctaagtgtttccttttttgttttttgagacagtcttgctctgtcgccaaggctggagtgcagtggcacaatcttggctcactgcaacctctgcctcccaggcttaagtgatcctcccacctcagcctcctgagtagctgagattacaggcctgcactatcacgccaggctaattttttttttttttttttggtaaagaaggggtttcgccatcttggccgggctggtctcgaactcctgagttctggtgatccacccgcattggcctcccaaagtgctgggattacaggcgtgagccgccatgctcgcccacttccaagtgtttctataatatcatccagccttgtcattgtgtcctgcccgcgatgtcttgatcctctgtatgccagccattctacttagtggctgctctatgcaacaggctttctttcatccatgggtttttgcctagtctttctgtctggaacaccattctctgacgtgtccttctccaaagtgattcctcctttaggcctcaacttctctgacattctctggcaagcctcctagagttctaggggttggatgtgttttctcttacatgtgatccatgttattctatacaaccttaatagagcacttgcaacggtgtgtgagaatcgcctgctgacatttttgttctgtccatgagactgtgaattcctacgggatagcaaccatgccctgttggtggttttatctccatactacttagcacacgtgagccctagatcaatatttgttgaatacaaggatgagtgcacattgtcctaagaaacgggtaaaacaaccaatgcatggaggaaaatcctcacttatgaagaaaaatatgtggcaaatggagacgttcaacaaaataagccatgattctatagaagcattaaagcaaggagaggggtggaataaaatctagtgacagccatgagacttaaggaatggaaaatacaggatataacatggtaaagaaaaaaaaaaaaaagaccaaatagaggatgaagaatcagaagaccaggcgaggcacagtgatgaatgcctggaatcccagcactttgggaagccaaagcaggactgcttgaggccaggcatttgggaccagactgggtaccatagcaagaccctgtttctacacccctgtgcccctctaaaaagaattagctgggtttagtggtacaggcctgtcataacagctacttgggaagctgaggtgggaggatcacttgagcccaggagttcaaggctgagctatgattgtgctactgtaccctagcctgggcagcaaagtgagatcctgtctcttaaaaaacaaaaaaaaatcttaaaagttaaattggcccggcgcagtggctcacgcctgtaatcccaacactttgggaggccgtggcgggtggatcacaaggtcaggagatcgagaccatcctggtcaacatggtgaaaccccatctctactaaaaatacaaaaattagctgggcatggtagtgcgtgcctatagtcccagctactcgggaggccgaggcaggagaatctcttgaatccaggaggcaaaggttgcagtgagccatcatgccactgcactccagcctggtgacagagcgagactccatctcaaaaaaaaaaaaaaaaaaaaaaccaacaaaaaaaaactagttaaattaaattacataaatgacacagagtaaaaaggaagtggccacctgctatctcagtctcccttttaaaggtaattacgatccaccctaaaaaaaaaaaaaaaaaaaaaaaaaatcagaagacttaagtcaattgagcccaggctgagtgaagagtagaaaagaaatacgtatatagaagtggttgagaggaacagcaaggtaaggaatgtgtccctttcatgctgtacaaatattagcatcaattgttaaaaacattgggaaaactaagctattgtgttctgagatgtaaaagtgttctgagatggaaaagtgaaactaagggggttattatgatttttttcttagaagcccaaaatactcagaatatccttgcaccagttttagttcccaggggaagccctatgcaatttggagacctccttcttcttccaggaaacaatcagacaggattccaaggttaggcccggggccctctgttcattaaacagatgacaaatgcagactgcgtttaagccatagtcactggggcacatatatggtgtatgggaatgtggtacaggactctgttttagctttttcatttctttgagacagcgtcttactctgtcacccaggctgcagtacagtggcttgttcacagctcactgtagcctcaaactcctgggctcaggcaatcctcccacctcagcctttcgagtagttgggactatgggtgcacatcaccatgcccaggtaattttaaaaaaaattttcatagggacgaggtctcactatgttgtctaggctggtctcaaactcctggcttcaaggaagggatcctcctgccttgctctcccaatgtgctgggattacaggaatgagccactgtgccctgccaagacttttgttttcataaccagctcacaaacacggcacttgcctaagcccctggccttttgttttggtaactgatcacaaaggtaacatggctgagcttataatcctccagtaaccagatcactaatatggcacttggataagtcacacttccttctgtttgtcttaccaaatcatacataaggcatgcagttaggaattacaaccctctgttttagtaaccacagggaaacatggcggcacggggtaagtggtagaaatatctattatatttaggaaccatatcacgaacttagcctgtgtttaaaccgtagcctctcccttttaataaacagatcacaaatatggcaagtggcattgcctctcagatcacaaatcgagcacacggctaagctgtgcaatgtgacatttgttagattcaattatacatcctggcctcatctttttaaatttatttgttgcttatgaaattttaattagctaaagaaaaacaaacactttatagaaacaaggtaacagaggccataaagcacataaaccaccagccccatagaagcacttaaaaagataggtagagatcacatctaggaagttacagagtcaaggcagagaaaactgtagaagaaacacaccgaccccactagagttggcactgtgagggcatccgagcagccatggggtagaccaaggacctttccttgtgaagctcttttgtcctcgtgaatcattatatgtggggacagctgggagttataatttggaatattgcaaagcaaatatgtacttctctcactttggggtatattcctgcctgttggtgttagactcggctaggtgacttgctttgggcaatgaggtgttagcagctgtggaatgagcagaggcaatcggtcatgacctcttgcaccaaagacatctcaatgagaaaaacttgccttgagtttctgctgcctggacctagaatgaatacatgagacagacctgacccaatttcctctagaagcagagcctcccagctgagcccagcctggatcaaccgggtctccgcctacctgcggatcctggaacatcagggtcaatgcttcttgtgatatgtcactgaatttgggggtggctgcaacctcattgtgcaacattaactatcacccttgcaatttccaagggcaagagtaacgacacgatgggggcagggagcagctccagggaaaaggctgcacaggtggacctggatctggagtggaggtcaggtccaatgaataaaagggaggaaaagaccttgcatctctgcagtggtgcaatcgcatctctgcagtggtgctgactccaggttcagtgactttcaccttcatagagaaacagcgatgaaccgcctttaagggacttatctgtattccatgctctctgcacattcaggaactgtttctggctcactgagactcattctattttatggcaaattctgtcccattatttctctctgtctctttttttttttttttttctgagacagagttctgtcgcccaggctggagtgcagtggcggatcctggctcactgcaacctccgccttccaggttcaagcaattcttgtgcctcagcctcctgattagctgggcttacaggcacccaacaccacgtccagctaatttttgtatttttagtagagatggggtttcactatgttggccaggtcggtctcaaactcccaacctcaagtcatctgcccacctcggcctcccaaagtgctgggattacaggcgtgagccaccagtgcccagccagaaaattgttatttctaaacaagagccactggccaggcaaggtggctcctgcctgtaatcccagcactttgggaggccgaggcagacaaatcacttaacgtcaggagttcgagttccgcctggccaacatggtgaaaccctgtctctactaaaattacaaaagttagtcgggcatggtagcacgggcctgtaatcccagctattcaggaggctgaggcacgagaatcacttgaatccagaaggcagaggttgcagtgagctgagatcacgccactgcactccagcccgggtgacagggcgaaactccatctcaaaaaaaaagacaaaaaaaaaaaaaaaaaaaaaagccacaaagttagctctccagatctgttgggcttattgttaaccaggtaacataatttaatagatgtctagccttagacataccttgatggctgatgtgtttgaaatgcaagaataaagaaaacattgtgcaaatatcttggcataaaacgtgaattaactataagggaagaaaacccttctgggacaatccttggatacaacagagagattccaggacacaatggagagatatcactgagtttttagggcaaagggcttttacttaagaatttgacacctgggaaggttatgatccatctacaaggcaacagaatataaatcagttatgcgagagctcaaaagcataaaatctatcacccttcctaaagaaatactgaaagtgcacataggccctgagacatgaatcaaaacaaggggttcaagaatgggggtaaaacagggtcttaaggttctgtttctgagaactgaaaccatccacatctaaaatttaatttaaaacaaaggccttaaacacagctatagaacaaaatggaaatgacgtggtgatgggttgaaagggaagacataatatgaaaaaccaataattttaccataacaaattggatctaaatcccatattacataagcaaagatcaaaacgccagaacaggagggatgaaaaggaggggggtgggagaagtactaattttattatttaaatgggggcagagttcttatttaattacactgattagtagattaacgttaagtggtaattgtggtaacaggcatatttatcatgttacagattttaatggacatggctttagaggctgcataaaattgccgtgtatttttccagattttgttctgcggaaaagagttccaggaagtaaagtgctcttcaaaaaaaggaaaaactctgccatggttaatatgaatggaaatatagcatatgatttccccaactggaaatgaaaaaatgaaaaatgcctgttagtataaatctttttaagcaggcttgtagttaagagatcattttttaagtctagtgtttgccagtaattaaagcaggaaaatcttttctcatggactattgtggtaaacatttggcattgtcctctaacatccattctgtcccagatgagcatgtgacccaattttgaccacagagatactctttgatgcccgctttatagagacagggtcttggtctatcccccaggctggagtgggtggcacaatcatagcttgagcccagtcttgaactcctgggctcaagtgatccttttgtctcagcctcctgagtagctggggctacaggcatgtaccaccacacctgtggtatggtttggctgtgtccccacccaattctcatcttgaattgtagttcccataatccctgtgttgtgggaggagcccagtgggaggtaattgaatcatgggggaggttacccccattctgcagttctggtgatagtgagtgagttctcaggacatctgatggttttataaggggcttttccctcttttgcttgccacttctctttgctgtagccatgtgaagaaggacgtgttttcttctccttctgccatgattgtaagtttcctgaggcctccccagccatactgaactgtgagtcaattaaacctctttcccttataaattacccactcttgggtatgtctttattagcagcatgagaactgactaatacaacctgcctgatttttaaaattttctttagagagagggtctcaccatgttgctcaggctggtctcaaactcctggcatcaagcaatcttcccaccttgaccttctaaagtgctgggattacagacatgagccactgaacctggcccattttatcattcttgagagagagagagagaaagggagacccataaaagagatactccccctttaaactctaggtattgtcatgtctagatgtgatgtctggaactgctgtaaccatcttgtaaccgtcatgaaaatgacacttttgggccaggtgctcatgcctgtaattccagcactttgggagttgaggcaggcacatcacttgatgtcaggagttagagaccagcctggccaacatgatgaaatcccatctctactataaatacaaaaagtagctcggcatggtggcacacacctgtaatcccagctagtcaggaggctgaggcaggagattcgcctgaacccaggaggtggcagttatagtgagccgagattgcaccactgcactccagcctgggtgacagagtgaagctaagaaaatgacacttttctggttatcactgctgtataacagcttaatcattttatggattctgtgggtcaggaaagaatcaaatgctggattggattatctgctgaagccttgttcacggtgccagagccagaaggagtctgagaccaggagtgccaactcagcccctctccatggcctctccaaatggctcagcttctacctagcatggaagcctcaggctggctggacttcttatggcggcatctcaaggcactaattacaaatgatccaggaaacaagacagatactgcattcccttccctgacctagcatcactcttgctgcattctctgggttacaaaaaagtcacatgcccacccagattcaaagggtgggaaggtggacccctctctctatggagggctgcccaggtcacatgcagtgccacggctgtctttggagaatgcagtctgaatggaagtcagcactaaggcagggagagggggctcaaagaatctgggttactgttgggccacagattcaaccaaccctgaagttttccctgactctgtttttgttttctgagatattttcctatcctttaagccatttagaattggtgtgttttgtttatgtttttgacttgttgcaaaagtgttctaacagaagcaaacaggcaaggggcagtggctcacacctgtaatcccaacactttgggaggctgaagcaggagcattgcttgagcccaggagttcaatgctgcaatgagctatggctgcatcatagcctgtgtgacaccacaagacccgtctccacaaaaaatttaaaaattagccgagcacagtggtgtgcacccatagtcccagctacttgggaagctgagttgggaggatcatttgagcccaggagtttacagctgcaatgagctacgattgcaccatggcactccagcctgggtgacacagtaagatgctctctttaaaaaaaaaaaaaaaaaaaaaaaaaagagaaaaagaaaaagaaacaaaccccttcttaacatcctgcagggccaagtgtgtggaagaaattgtccagacagtgcttctctttagatattaaattcggagagacctgtgactgtatggctgggctctcttaggcattgattgaaccgctcagagcaaaacctcagtttccttatatataaaatggggataataatactaatgaataggacagttgtgaggctgaaatgaagcagcacttatgaaatttttttgttggcacagaggaaacagtcaataaatggtagccttcgttagcactgtttgaccatgactatttcatggtaatatatgatagcattttggagggaaaaccacattttggatacatcctttctatattttactaagatatgtgggtgtgtgttttaagaatgtattgaagtcattttccctttttctttggaaaaaaaaaaaacctttttaaaggtaaagagtcagggaagcatctgtcacagaatgatagcctagagctcttcattatcttagtggagacgttttgcaaacaaccagaaatccttccaaactgagttaggtaacaaacagaggctatgttggaaggacaaaaggaagtgccatagaatcctaggagaggagatgaaggatgcaacaacggttctccaagtgtaacaagggtagctgtgttccacaggatcattgaaagtagaatgcacgaccctccccagactctcactccgggaaggcaggctgctgcctctctgccctccctctctctgggactgtaagaccctcagctctttcttcttctctgttcatgtggcaggaaggagcctgcatgactgatggttccatccgttcatgcctgcaaagactggatggaatcatcatgggccaattccaacaagatcaacaaatctcaaagcagtatggagatttcccagagaattcaaaacagaattaccactcagcccagcaatctgatttttactggatatctacacaaaggaaaataaatcattctacctaagacactcacacttgtatgttcattgcagcactattcacaacagcaaagacatggaatcaacctaggtgccctagatggtggactggataaagaaaatgtggtagatatacactgtggaatactatgcagccatagaaagagtgcagtcatggcctctgcagccacatggatgcagctggaggtcattattttaagtgaattaacacagaaacagaaaaccaaacactgcatgttctcaattgagtgggagctgaacattgggtccatatggacataaaaatgccagcaataaacactagggactactagattagggacagagggagggggacaagggcttaaagactacctattgagtattatgttcaccatttgaatgatgggttcaatagatacccaaaccccagcattgtacaatatatccatgtaacaaacctgtacatgtacctcctgaatctaaaaaagaaaaaaaaaaaagacaaaaaacaaatctcccagcccttcttggtcaagggtccgtgccagtttgttactgattaggagagagagacatatggctcatatctcacatagggaggctggagatagctagatactaggcagcaactcacgtgtctgcctctgtcctaaaaacaaagtctagtcccgagtaaactctttgacaagcaggattcacccaatgtgacaatggagaattgcagcttgagtgtgagtcctcaaatgactgaagcaagcaatactatcctgccctgcgggagcataaaagtgaggaccctgctttgtcctgaaagcttactccaattcactggatgctcctcccaaatttctccctgatgttgatcgctgccgttttgtctgggttcttagagacagaatccattctcacctaagatcaagggatgagtctgagctgttgggattttgcccctgtggcttagctgatttcttcctgggattctggcagcagggttggtggcacaagagcaagacatccacgtttacagtgaattctgaattaagaaaacctcagcacagcctggaatccagccagagaaatacaccggtacattagcttctctgcttccatttgcaacgttcaccgatgcctgcaagctgtgcttgttagagcactttgataacatgctaatacacttagtgaggcaaaaataaataataaggcctcttcaagcttgcctggctttgaaccccataactattagtacttccataagtaattattcccaaaagcttacaggtccgttcctgtaccctcagcactgcctatcttcggggttatacctcctgtaactatatttagactgtaacataactacattagactgtcatattgcattttatcctaacaatactctaaatactttacatgactgtaaatctgatttacaaggattcttggaaaatcagtgaaggaaaatcctagacctccagcattccagggtagtgagaggttgttatttcatttttttctctgctaggcattaactaataaaggaagagatgtgaggatgggtattggacggcctccaaataagaaatgtaggtgaaacatataattgatagaagctgaatccaccataatttctacatcttcttattctccctaagaagacacttctcctttcccctctttaaatttctttcctatgcttcctgaagacctcttagaagctgggttggcccataaatgcaatggagcaccatcttgaattcacaaataaagaacgaaccagccaactacatcaatgcactcattgcaactaagagtaaaaaattttaggccaggcatgggagctcatgcctgtaatcctagcgccttgggaggctgagggggatgaattgcttgagctcaggacttcaagactagcctaggcaacatagtgagaccctatctctaaaaaaaactatttagaaaaatagccaggcatggtagtgtgcacctggagtcacagctacttgaaaggctgcagcaggaggattgcttgagcccaggaaatcgaggctgctgtgagctatgattgtaccactgcaccccagactgggtgacagagcaagacactgtctctaaaaaacaaacaaacaaacaaaaccagagagctaagctaagctcctcatggcaaagataaccctcagtttcctcatttgtaaaatgggactagaatggatctaattaatacattatacttacaccatacttattatgctcatgggcacgcatgaggtatgctaaatgccagcagccacaagccctctataaatgttaatttcctcccctgtgtcctctttcttctctgacagtgactgaaatctgcacacagatggcgttagagattctacatagtgtgcttgattttctggattggtatttaagggagaggaagtggggtaacagcatcagagaagcagctaaatgcacgttactcaggaattgatctcggtgactttttggttgatttgctgcactgggcattctggcatttatagagatggaccctggagttgggacagtcatgtcacttttgcacaaggagcacactgcgatatgattttcctttctccatagagcaggctacaaaagacaggagagctgattgtcatagggtggcaaagctatctttctgaagcctcattcttgggaattccttttatgatggtgatctatgtcattccatcagatgcccctgccatcaccccagataatatttgctcctcccagaaatagcttggagcaaggcccaattttttctgatttaatcttacctgccttctttataatgactcaaaaatgtgttgctacaggacaaaaccaaagttctaagtttatgtgacactcaccctggaaaaacaacagctttatgcatagccagtttcttgagcataaatttggtaccaagcattacaatatccttaagcagataaataacaaatggggaaataatttagtcatttcaattggaacaaattcccaaaatatcttcttgttatcactttgatgaatcagactccagagttcttagggaacatatcacaataactaattaaagcttttaagatgatggaaaggaattaatattaaatgggttggaccaaaagagggaactgtaacacttagtggaaagggcagaagagaaaaggaagaaatcctggctaaactaagaaatgattgtgaaatggactcacccctgagacaaatgtcaaaagcagggaagaaatcacatcttctaccaaattctgccttaaactaaggatctgtaatttattggaaacatcacatgttttaaattggaaacaacatactcctccatctgagttctttaatgtcttatttttttcaattttttacattttttgagacagaatcttgctctgttgcccaggctggagtaccgtggcatgatcttggctcactgcaacctctgccacccgggttcaagcagtacctcagcctcccaactagctgggattacaggcatgtgccaccacaccaggctaatttttctatttttagtacagacagggtttcaccatattggccaggctggtctcgaactcctgacctcaagcgatcctcctgcctcggcctcccaaagtgctggaattacaggtgtgagccactgcacctggcagaatgtgtcttacttgttcaatttcacctggttcctgtatcttgataaaacaagctaagtctgaaaaacaatgtcaggtaagaatttcatatggaacatctatactgacgaattccattcatctttccaatttggcaaacactctgccagaaagcaagaactgaggaggaggcctaggcagggtttccttcatgcctgtgtttcgtttaggtgtggtctgtgtgtttcaataactcacccacctccacttctagaggctggctctaaggccaacagctcctggcagcttggctttgttcacggcccaagccctggtctctcctcttctactttgccctctgctgtttggccttattgcaagggtcctgacttcctgctttatgattttctgcctctagccctttccccctagccctgaaccctaatgcagaggttcatcagcatggctggggaacttgttagaaatagatacactcaggccccgtccagagactctggggtggcatccagcacccagaattcagctgattctggtcatcacttctagggctgacctgggatttcccgctgggttaagattaacactctcatccgggcacagtggctcatgcctgtatcccagcactttgggaggctgaggcaggtggatcacttgaggtcaggagtttgagaccagcttggccaacatggtgaaaccccgtctttactaaaaatacaaaaattagctgggcatggggtgcacacctgtaatcccagctagtagggaggctgaagcaggagaatcacttgaacctgggaggcggaggttgccgtgagctgagattccactactgcactctagcctgggggacagagccaaactcggtctccaaaaaaataaaagattaacactctcctcctggatgtcatcgtcttctgcccactttgcataacaaaacaacagcaaaggagggttgaacattcagcacctgactgactgcagcatttaggatacaccaacaaagaatcgccctatgaagcgaaacacacttctcattgaatatatattgatgccaaagtttgggaaagctgaaaccccttaagtgatgtaattgttgccgttctgattctcttattttacagagatcagcagagacttgggagatgccaggcagaggttatggccaggctgaggcgctgtccatggtcatgaaataatgacacagattcttcaggaggaagaaaggagcccgcagttttctgctgagcaggaaaggcaccaaacactgctccttgggaagctgtactagtcgggttccccagagaaacagaactaataggataaaaatatgtgtgtgtatgtgtgcgcgtgcgtgtgtgtgtatagatagatatagatatgcatatatatcaagctttttgttttcccccatttacagtgctattctttacttctacagggtaaccctccttctattgtgcagaaattttctgtgcaatattctgtggggttttatttatctacctgtctacttggaggctatatatatatatagcctactagggatagtagtaaacaaaatccatacatatatgtatatacacgtatataaatatatatacgtgtatatacatatatatgagcaatatatacataaatatgtgtatatacatgtgtatatattatatatgtatatatgtatgtatatataatatatacacacatatatgtatatataatatatacatacatatatgtatattatatatacatatatgtatatatacatatataatatatacacacatatatacacatatacacacacatatatatatattgcttatgtcatggaggctaataagccccaagatctgcagggtaaggtggcaagctagagacccaagagagctgatggtgtagttccagcccaaagggtggcaggctcaagaccaggaagagcccatgtttcagtctcttctcttggtgaattccctttaaagggagaggaagcctgaaggcaggtgatatggtttagctgtgtcccccactcaaatctcatcttgaattgtagctcccataattcccatgtgttgtgggagggacctggtgggagataattgaatcatgggggtggtttccccacaattcttgtggtagtgaataagtctcatgagacctgatggttatataaagggtttcctggctgggtgcagtggctcacgcttgtaatcctagcagtttgggaggccaaggtgggtggatcacctgaggtcaggagttcaagaccagcctggccaacatggtgaaaccccatctctactaaaacaaaaccaaaaccaaaaccaaaaccaaaaacaaaaaaaaaattatccagatgtggtggtgcatgcctgtaatcccagctactcaggaggctgaggcagaagaatctcttgaacccagggggcagaggttgcagtgagccaagattgcaccactgcacgccagcctgggcaacagagtgagactctgtcaaaaaaaaaaaggaggaagaagaaagaagaaagaagaaagaagaagaaagaagaaagaagaaagaagaagaaagaagaaagaagaagaagaagaaagaagaagaagaagaagaagaaaagaagaaaagaaggagaaggagaaggagaaggagaaggagaaggagaaggagaagaagaagaggaaagttttccctttttgctcggctctctcattctgtcttgccaccaccatgtaagaagtgccttttttcttctgccatgattgtgaggcctccccagccatgtggaactgtgagtccattaaatctccttttctttataaattacccagtctcatccaaaaacacctgaacagaaatacccgcaatagtgttagaccaaatatctgggcaccctgttgtctagtcaaggtaacacataaaattcaccattgcagaagtgaaactggttataagaaagcaccctgggagaatggtactttgggaatgccaattttaaagaattgtaaagaactgttcagactgtgtcagattagccagatgtgagcaacaatcccacagtcagaagatgggatgataaagtatccccctcagaactgcatcacatctgtgcttgctaatcaaatttgatgctcacacccgtatttatactgaatggccccttctgttcaagagccaagtttggaattctattgatatccagaagaccaaagaggaagaccaagaagcaccagccattctgtgtcctggtatttgtaaactaggggagacctttcttctttgaaggataaacaggaaaataaaaccccgtagaatattgcaaagaaaatgtctgcactgtaaaaggagggatactttgtaaacatacagaataacactaaaggggttattacagaaaaaaagcttaaaagccatctgttttgtgttctcaatgaaacacacacacacatacacacacataatattacctatgaaacaagagctatgataattgaagactgggatagaattattttaagttgagaaaaaagggaattcaagaaaagaaaaaatttaataatattaaaacataatagaaaaaaattacattggtagttgtaaagtccaatatcgatgatgctgaaactctaactcaggttacagaaaacaaacttggaaagctcatcagtcaactattcagtttacccttgggttgttcacctttactttttaaatttttactccttttatatattttgcatgctaatcttttgtttattgtgaatgctgcaaacattttctcctggtctgtagtttcttttttaatttgttatggtggctttccccatgtgagggtttttaaatttgcatttagtcaaagctgtttgttttttccttctggatacgggtgtcttaaggtgtttaactcaatgggataaatataatccactctatttacatctaaccattttagaattcttatgtgtgtttaatctatgtgtggcttatttttataagtgctgctgggtgagcatgtagcttttttacatctccaatagataggcagttgccccaattgtattgaatatcccatccttagcccaagtgatttagcacaagtttcacgctaaattcccacgtagacctgggcatatatatggactcccagtccattccattgatctagactctattctatttatggctagtactgcataggtatatgtgtgtcttgatatttgataactctttgttctttttcaatcttggatcttcctatttttttttttttttgccacatgtattttaggatcaatttagcgattccatgagaatcttgttaggatttgtttattagtaatcagggaaatgcaacttaaaactataggatgctattttaaatctatctaattggcaaaatattcacatttgatggtattgagggttggagagaatttagtaagaaaaggtcttctatattattagagtaactttttcttttaaaaggcaggatgttattcagttgcccaggctggagtacagtggtgcaatcatagcttactgcatcctcgaactcctaggctcaatggatcctcccacttcagcctcctaagtggctggggctataggcgcatgccaccacacctctgtcattgttttgtagagatagggtctatgatgcccaggttagtctcagactcccagcctcaagcaatcctcccgcccaggccttccaaagcactgggattagagaattgagccatcgcactcaacccgtactagcaacttttaaaggtgatatgacaatgtctattaaagctgaaaatgtgcatggcctacaacttggcaattctgcttcctagaatctctcctagaaaaagcctcacacctgcgtgcatggaggcaagaacacatatgttgcctgaaggattcttgtgaaaggaaaaagtactggaatcaaatgtccatcattagaaaaactaaggaaaatatccttacatggaatctatgccatatatcaagagatctgagtgcgtaatatactgacatactgtttttgttgttgttttttcttggagatggagtcttggtctgtcacccaggctggagtgcagtggcacattctcggctcactgcaacctccgcctcccgggttcaagcgattctcctgcctcatcctcaagagtagctgggattacaggcgcataccaccacacccagctaatttttgtatttttttagtagagatggggttttgccatgtagtccatgcttgtctcgaactcctgacctcagatgattcacctgccttggcttcccaaagcgctgggattacaggcgtgggccactgtgccagcctgacattctcttgagtgaaatgaaaagcaagaatactaaatgactacgatattatttgtggaaaaagaaaaaatcactcaagaaaacagtatattttttgtaggggggaggttatagattctggagggatctatactaaagtaataacagtggctagttagctctgcggagttcaatatttggcaggcaggtagtggtaatgaggtgaaagcacacagaacaatacaattagctcttaaaagcatagattagtgaataaaataaagaacagaataaaatctatgttatgaattttgtttactactatccctaggcagaaagtagtggttgacacatagtgagtactcaatacatatttgaaatgaatgaaaaaacagaataccatttatgtacattaaatatgcatgcaatattggcctggtgcagtggctcatgcctctaatcccagagcattgggagactaaggtgggaggattgcttgaagccaggaggtcaagaccagcctgggcaacatagccagacctcctttctataaaaattaaaaaatggattagctaggcacggtggtgcacacctgtagtcctagctacttgggaggctaaggtgtgagggttgcgtgaacccaagttacagtgacctgtgactgcatcactgcactctagcctgggcgacagagagagaccttgtctcaaacacacacacacacacacacacacacacacacacacacacacacatcacacatatacagctgggtgcagtaggaggccgagatgaccacttgaggtcaggagttccagatcaacctggtcaacttgccaaaaccccatctctactaaaaaaaatacaaaaattagccaggcatggtggtgggtgcttgtgatcccagctattcgggaggctgaggcaccagaattgcttgaatctaggaggcggaggttgcagtgagctttgatcatgtcactgcactccagcctaggtaacaggtgaggccgtgtctcaaaaaagaaaaaaacagtatatatatacatatatatatgaatatatacacacacatatatatattcactaaaagcaaaaatgcaaattttgcaccaacagccacacattaaaatcctttggataattgcccataggaatagaggtggaataggagggaaacagagagaaaaggaaataaacaaatgagcaaacaaacaagtaagagagaggctttgcatggatctaagatggtgtcctaccctaaatggagaaatataatagatgcaactctccgccccgatgcagaaaagtgcacaaacaaacaaatgtgtctgtgaactgacaagaaaggaagaaaactccagagggcagacattaagaacaagcagttaattaagggagagctcagagctggcttttttcctgagaggatctgcccaagcctggtgcctggaagctgtggtttaatgaccctgcagaacccgagggacaggaggcagagtctatggaccacacaagaggaggatctaaaggaggttctgcaagaaggcagaatcctcagagccaggtggaatggtttcgatattcatccatgtcattagaacatgattagttcattccattttgtcatcgaacagcatttcattgcacacgttcaccacaattttgtttatctgttctctggttgattgacatttggttgtgtctagtttgttgctattacgatcaagactccatgaacaatcttgtacacatcattttacggacatatgttttcacttctcttgggaaaatacctaggagaagaatgtttgggttaaagaacaagtatgtatttagctttataagaaactgccgactgggcacagtgactcacacctataatcctagcacttccaggagctaagtggggaagacagattgagctcaagagtttgagaccagcctgggcattatagtgagaccctgtctctaaaaaaaaaaaaaaaaaaaaatcttagctgaagtgggaggatcccttgagctcaggagtttgaggctgcagtgaaccatgatcgcaccactgcacttcagcctgggtgacagaacaagagactctgcctcaaaagaaaaaaaaagaaaacagaaactgccaaacagttttccaaagtgatcgtaacattttacactcctctcagtcatgtctgagaatctcatttactccacatccttgccaacattcggtattttcagtcttttcagcttaactttttttctgggcaagaagtgggtaactcacggctgttttaatttgtaatttatctagacaaatgatgttgtacgtctttatattgattgtgcttattagccatttgtatattttctcttgtgaaataactagatgttgagcacaacctttacaggattgtttgtcttttacagtattgagttgtgagactttaaaaatatatttaatatattctgcttacgactcttttctcagatagatacgttgaaaatatttttttcctaatctgtgccttgccttttcctattcttagtggttcctgttagagagctgaagtttaaacacttattattatttgcttttttttttgagacggcatctcactctgtcacccaggctggagtgcagtggtgcagtcatagctcacagcagcttctaatttctgggctcaagcaatcctcctggctgagcctcccaaagtgctgggattacaggcatgagccactgcactcagtctaaaaagttatttttaaaattggattttaaaataaatttgaaaatattttctaaaattttatttatataattggcaattaaaaattgtatatattattatttatggcatctaatttgatgttttgatatatgtatacattatgcaatggctaaatcaatctatttaacatatacattatctcatatgcttatcagtttttgtgatgagaacatttaaaatctctccgcaattttaaagtatacaatatatctttattgagagtcttcacaatgtatgatagatcttttgaaattatttttcctgtttaactgaaatcttctgtcattctgaaattttaatttttttttttttatttgagacagggtcttgctctgtcagccaggctggagtgcagtggcatgatctcagctcactgcaacctctgcctcccaggctcaagcaattctcctgcctcagcctcccgagtagctgggattacaggtgtgtgccaccacacctggctaatttttgtatttttagtagagacggggtttcaccatgttggccagggtggtctcgaactcctgatctcaggtaatccgcccacctcggcgttccaaagtgctgggattacaggagtgagcaactgcgcccagcctgaagttttaaattttgattaagtccatgagtccattttttaatggttcgtgattttcatgttctgttcaggaaacctttgtctacctccagttgtgaagatactctgttttcttccacaatccacatatttctatgcttttgggactatgatcagcctaaattaatttgtgtgtgtgtgtgtgtagggtttgaggtagaggccaaatagatggtagaattttaacttaaatttggatccttgatatttgctttaaaaagtctttacacaacatgggctagaagaaaacaccccaaaccattgacagtgtgtgttcctgaaaatgaatggagagaaagaaacaggccgggcaggaggctgaggcaggagaatctcttgaacctgggaggcagaggttgcagtgagctaagaccatgccactgcattccagcctcggtgacagagcaagactccctctaaaaaaataacaataaaaaacagacagacagacagacagagaaagaaagaaagaaagaaggaaagaaaaaaagaaactgaaatggcatacaaaagagatatcaatgaaatcaggaatgtgctatttattttaagaggaaagaaaaggtcagaagcaattatagcaagttggtgatgtttgttcattctgcattgtggttacatgcatgtttgttgtaaggacctggttctttttcctactgcaaataattttccaagtaaaaccaagaaaaagtgtacactacaaagtagcaataaaaagttactttgaagattggcagtttcatgctagacagtgcaattagatgcagttgaagttgccaaactctctcgaaagatcacagaaattttcagatttggagaagccacatagctgattcattcactgtgagtgtctgtcagtcagtgggtgataactgtcagaagcttcgggctcatttcccaagaaaaactatataatgtgaagccaagcttaattcaattaaacaaagaaaataaatcacggcttcccttaaacattaagaagcagaaaatctcacagttctttgatacatctcaaaactatgctgcaattcaaaacgatgctaaccctgtctggacaagggctatgaactgtgaaaagctctgtgctgttctgaggttctgtgtaaagaactgccgatggctgaaagtgatttagaacatgcttcatactaactgtgaacacagcttaaactcaaacttcgagctaataaagaagaaagggatatggaattgtatgcatcaatgcatgctaaggggaattgaaaaataaatatgcattctagcgtcgttctccaagtgtggtctatgggctggcagcattacccgagtgctgattacagatgcaaacttgcatgtctcaagtctgacttactaaatcagggggagtagctcaggagtccgtgtttcatgaagctttccaggggatgctctggctgacgctggacaatgactgctttagtggaaatgtgacattcagttttaggtgcacacggcacccaaatttcctttctacattgggcggtgcttcatcttaggagccttggtaagtatcccccacctcaacttggaagccccaaaggccataaatgtcaccatcccccatgcaactgagatttgggcatgtgacccaggcttggcaattcaaatgcagcaccccagcctttcaatctggagctagggctgcaaagaagctgttttggaggttccgtctgaccctaggcagcacccagggtgttgtggtccctcgtgggcactctcagtcccctagtggcagtgagggtcttgctgtagctttggtgatggcatttggactctggtgctggctaccctataccttacttatttcctatgccttctccaagcctgacccaccagccttcctgtcaactctgtgagctacccagtgctttagaatacatttcttttcagcttaaattggtcagagttgatttctgtagtgggcattaagagtcctgactacatgtgcattgaatgcagtgctttttcatttattttattttggttttgctccaaaggcactttttcaactgatattatgtctgtgtgcgtgcacattatatacacacacatacatatacatattgagacagggtctctatgtatgtatgtattttgtatatgtagatatgtatatatttgagagtttcaaatatatatgaatatattaaagatatgcatgtatatatttgagagttttcatatatatatttggaactctcaaatatatacatgcatacatacatatatacagcccttgcctggggtgatacatatgtaaatatacatatatatttataaatatacatatacatatatttaaactcctgagctgttcattctgcaatccttcattaattttaatgtaaatattttgtatgtatatattttgagacagggtcttactctgtggcccaggttggagtgcagtggtacaattacagctcactggagtcttgacctccagggctcaagcaatccttctgccacagcctctccagtagctgcaactacaggtgtgcaccaccacacctggtcaatatctttgatgttatattttagagtcaaagatgtttttagaatttaaaaacattacttattatatgtatatatatgaacatatacatctagatgtggaggtaaaacatctggaaaaaatagatcatactgtttaactgcttcattttccactgttctgtatttttatatttgttttcccaagactatacatgtatgtccaaataaaaaataataactggccgggtgtggtggctcatgcctataatcccagcattttgggaagctgaggtgggcagatcacttgaggtcaggagttcaagaccaggctggccaatgtggtgaaaccccatctctactagaaatacaaaaattagctgggtttggtggtgcatgcctataatcccagctactcaggaggctcaggtggaagggtcgcttcaacctgggaggcggaggttgcagtgagctgagatcgtgccattgcactccagcctgggtgacagagtgagattttgtctcaaaaataaaataaaatgaaataataataataactgtagacaacctcatggtgtgtatatgtatgtgtgtgtgtgtgtgtgtgtgtgtgtgtgtgtgtgtgtgtgttgcaaactaaatttgtccaggcctaagtgtagaaactatgtgttattcaaatggaccatgcttcttttaaaaaagaatcagaaattcaaacaaagatgtaggtcaaaaatatctatcacaattatttgtaattaatacaaaggacatgagttaaataatctcacaaatgggctaagtgaattttggtgcctccatattctgcaatcttacatggctattaaatattagatttttgaagaaagcttcattctgcatcttcccgcctctggcactgtcatattgctcagagttaagaattcaatatagggaatgtgtcagacccttgtgaagtgggaattcaccctgtgagtcaaaggagtttaaatggaggggctggaagtgctgtcagggctctcacccattctggctgagaactgctgccttgggcgtttcaaaggattgctcctttagaaaatcatcaggggagatttacccacatccatccttcatcctgtctccagacaactggctgtctcaccgactcctcttccctctcctccccctgttctcttggtggagttgcccccgcccacttaatcaggcgagcgctgaggctgcagaggtggcactggccaatcaccccaggcaagggctctgcgatccttcattaattttagtgtaaattaaattgttcaatttattccttccatgggagagggcccaaggaccaaggtatcttaaaccaagatgtctgatgaaaatataaaacaataattagaaaaggaaaaaaggcataatgagaaatagctgagtccttcatggttcagagactccaaaggccacatcacgttcctgggaatgctgcatattctatatttctattatcaaggaagtgggccaaagaactgcagaatcctggcacttaagaaatcaggtgatgataaaaatgtcacaaaagatgtgcaaaaggcaaataaatctcaggacccctgatatggtttggctgtgtcctcacccaaatctcatcttgaattgtagttcccataatccccacgtgtcatgggagggaccctgtgggaagtaattaaatcatgggggtggttacctccatgctgtcctcatgatagtgagttctcattagatgggatggttttgtaaatggctttcccctgacttcactcattcttctccttcctgctgtcacgtgaagaaggacgtgtttgcttcatctcctgccgtgattgtaagtttcctgaggcctccccagccatgctgaactgtgagtcaagtaaacctctttcctttataaatcacccaatctcgggtatgtctttattagcagtgtgagaacagactaatgcaactcccaaatcactaagtcaaagggaagagttgagctgggaactatgtcaggaaaacctgcctcccattctgttcctatacaagatagctacaaagagtaaagaaaaaaaaaaaagctacagacctccctcacaatttgcccaccttgcccacaaggaaattccttatggacagaggacagacagaactcaaagtcatccttctgcttatgtgagacaaatatatatctgattgcttcccccgccctaatatttcactaagccctcctctcacatgtaaattgtgtgttcagtgaaaggccaatcagagattcaaaagagtgaatctacctatgacctggaagccccctccccacctcaagttgtcttgcctttcccgacctaaccaatgtacattttacacatactgattgatgtctcgtgtctccctaaaatgtataaaaccaagctgtgccccgaccactttgggcacatgtcatcatcaggacctgctgaggctgtgtcacgggcacgtccttaaccttggcaaaataaactttctaaattgactgagacctgtctcggatattttgagttcacagatgtaaactgaacaagttcagagtagaaggggtcctctgctgggtaatcatttttctttttgtcttttttctttttttgtatgtttgtttgtttgtttttggagacagagttttgctctatccccaagctggagtgcagcggcatgatctcggctcactgcaacctctgcctcctgggttcaagcaattctcaggcctcagcctcccaagtagctgggattacaggcatgtaccaccacatctggctaacttttgtattttcagtagagacagggtttcatcatgttggccaggctggactccaactcctgacctcaagcaatctgcccgcctcagcctcccaaagtgctgggattacagccactgtgggcatcattttttatttgtctgttgacctccggacaccaagtcagtctaagccactcttcatgttgatgtgtttctatcactttatgctgtctttgaaaggaatgtgtatgggttgttcccgtcagaggcctctaggaacttctgtttctccttcaacctccagttgacatcatgacccttggctatatgagtttgagactgtaagtgtggactcctgtatccaggtacactccaaattcatttgatctcctgtctcctctgctcattccaaacttgaaagaatctatagcaatgaaggatatcaaaccagagactaaattagaagttgcccttcctggcaatgtggccctgctgcatggtgtatatgaataagctgtaggatggaaaatccatcactgttagttctttttaactgagcccatgcggacacggtgtcagaggcgtgggtaccagagtgactccatcttgaataggggctgggtaaaataaggctgagacccacttggctgcattcccaggacattaggtattcttagcctccagaggtgtatgattaagggaacagattgataacatttactaaacagacccagactcaggaatgtcctaatatcccgatatcttgagaacaggaacattcctagtcttgctttaaagagaataatatcaattcttgcaaatatagtaattaagaaaattaaccctttatcacaaacccttgtagtagagcatatctcccaggatatttttgctaccctgtataaacaagcattgtacctagggtgggtgcattcctcctttcgggaaagccctgctctgcctttattgagcattctttattttcattttttttttttttttgagaagcagtctcgctctgtcacccaggttggagtgcagtggggtgatctcagctctctgcaacctccacctcctgggctcaagcgattctcctgcctcagcctcctgagtagctgggactgcaggcacatgccaccatgcccagctaatttttgtacttttagtagaaacggggtttcaccatgctggccaagctggtcttgaactcctgacctcgtgatcctcccgccttggcctcccaaagtgctgggattacaggcatgagccaccgcacccagccttgagcattcttttattcctttactttcttaataaactttctttcactttactctatggacttgccctgaattctttcttgggtgagatccaggaaccctctcttgggggctgaatcaggacccctttttggtaacaacaacactaatagttatgacatgccccataaaaaatgacatgacattgttacacagcaaagaaacaccaggtcaatgtcacattgcaagcctttaaggccacgtaccactgccaggagaggttgaaagtgaaagacagaaaacaggcagcgaggaagagtcttcagagtaaacttccagggagcactctgccagggatgattaatgcctgaatcctccctgggtggtgctactctcaccaaagctacagagagcatttgctgaggggacatttataggcagaggatgatcccacggagaactctctgtgatcaggagaccaacgatgacaaagagaaccatctagttcaaagtaacccacattattaacttaacatgtgtgggtcttcaaagaggaccatttaggtcagatacagagaggcagaacaaggaaagaagagaagacactccttcctcatgtctccaagagatgcatggagacatgcatgcttaacactgaaccctgaatgccattttgcatgcataaagcaaactggtgtgttgtggtgtggggtgtgtgtgtgtgcgtgtgtgtgtgttacgcttatgcaagtataagctgaccgataaacattaattgagcatctacttgttttgggcaccaaactgagtgtgcaaaaaagagagacaccttccctgacttcaagaaatgtattactctatccctcattttgaattggtctcttcacttaactttcttgtccttacaaaatctcttttttaatcccttctggtgttatttaatagcatcaggggaaactcagatttggaccccaccctcagaaagatctcataggttatcaaatctgtgttcaagagtaatgtccaggcaagatgtggtggctcacacctgtaatcccaacacgttgggtggccgaggcaaggggatcccttgagaccaggaattcaagaccaacatggtaacatagtgagaccctgtgactacgaaaaaaaaaattacaaaaattagccaggcattgtggtgtgcacctagtcccagctactcgggaggctgaggtgggaggattgctggaccctgagaggctgaagctgcagtcagcccaggtcacaccactgcactccagcatgggtgaaagagtgcaactctatccaaaaaaaaaaaaaaaaaaaaaaagagagagagagtaatgtccaaaacatgttgattgggtttcctgctttaaggactttactttagcctggtgtagacctttccaggtccttttcagtttccttagagaattccagggctgcctgtctacttagatgaaaatccttgaccatccaagacaggcagaagcagggaatgggaagcttcaccttaaggtgctagcttgtgagctgtgcttgcttcctcaaaggttagcaactaactaactttctctaagacgtggccatctcatctttccttgacccttttgcgctggacagagaatcccgagcctaattctcaggaacaactagcctctcataaatctgcaaaggtacctgctgtaagcagctgggattcaaggcttacgcccctttgaaaaatctagggtgtggctgaaattaagatcagcacatgctggagacactagcgtatgctgttaaggcccaagaatgctgatacgatttggctgtgtccctacccaaatctcatcttgaattgtagctcccataattcccacgtgtcataggagggacccagtggaaggtaactgaatcatggaggcaggtctttcccgtgctgttctcatgatagtgaataagtctcacgagatctgatggttttataaaaggggctcctgcacacaccctcttgcctgttgccatgtaagacgtgaatttgcttctcctttgccttctgccataatcatgaggcctccccagccatgtggaactgtgagtctattacacctctttcttttatgaattacccagtctcgggtatgtctttattagcagcatgagaacagtttaatacacatgctgagttagaatggaaagacaaaaccactcttgtaattgctaggaagattcatgcaatcttgataagctcacatctttagatacattatcctgaccaggatttaaattcccagattttgttcagcgtttcttctaagtaaggcaatatggttacttactattccagtggatcagctcaagataacaatctactagtgggcagaaattcaggagacagggcgccctccagttccagcaagtggacagagaagaggaaatcccatgtaatgacaagataatccaagttagttgaatgtggcttgaatgaacttcaataggggaactattatgaaacaacaacggctgggcgtggtggctcacgcctataatcccagcactttgggaagccgaaatgagtggatctacttgaggctaggagtttgagaccagcctgggcaacatagggagacccctatatctacaaaaattaaaaagttagccaggcatagtggtaaacacctgtgtcccagctacttaggaggctgaggtggggagattgcttgggcctgggagatggaggctgcagtgagccatgatcgcaccactgcattccagcctgagcaactgagtgagaccctctctctctctctcagaaaaaaaggccaggcacagtggctcacatctgtaatcccagcactttgggaggccaaggcaggcggatcacccgaggtgaggagtttgagaccagcctggccaacatggtgaaacctcgactctactaaaaatacaaaaattagcagggcgtggtcacacatgcctgtagtcccagctactccggaggctgaggcaggagaattgcttgaacctgggaggcagggattacggtgagctgagttcatgccactgcactccagcctgggcaacagaactaaactccatctcaaaaaaaaaaaaaaaaaaaaaaaaaagaagaaagaaagaaataacaacaaaacacccatacaagcaactagcttgatgccatagaaaacacactgcaaaacaacggaattactattgggaaggctccacgcaggagtctgtctacacaactgactgtaagattaagaagtataaggtcagcaatcatggcacctgcagcaatcctctagcctgtctacatctcttccctgtgttctcatgaagtctgggaagttgacattccatcctgactgatgatgcctcaatctatgtttccagctctctctcttttttgagctccacgcatgcatagctaactgtgaattctccactggatgtctgtatcgaataggaatctaaaagttagcatggcccaagctgagctctttaattccacttctactaattactaaagtcaaagtcctattcccctattctctgcaaagcatccagttagctttgttctttacagattctctattgaggttagtgatttttaatgtttaaataagatcctcccccccgattacaattcttcaaatagcttcttattgcaaatagaaaaaaaatataattttccttcccgctgtggtagacagaattttaagataatcttcaattacccacagtcttttataacctccttcacttgaggatgggatatcactcccatgattagcttaaaaatcagttgcatttgagttgatggaaatggatagtacactgggtgggcctgcccaaatcaggtgaagtctgtgaaccaggctctggttggcctggaagacagcaaatgtgcatgctgtgaaatgcctgtgtgagccacacagcaaggattcatgggcagcctgtaagagctaagagtagttcctggcccaaagctagtacaaaacagggacttccatcctggagccacgaggaactgaattctgaccgtgaattagaacgaacctggactagaatcctgagctccaaataggcatcccaatgtagctaacaccttgactgcagccttcaaatagcttcccaggcagaggacccacctaagcctcctgacccacggagactgagagatgatatatttgagttgttttaaatcactaagtttgtggcaatctattatacaacaatagaaaataaatgcactggccaggtgtggtagctcacgcctgtaatcccagaaatttgggaggccaaggcaggaggatcacttgaggtcaggagtttgagaccagcctggccaacatggtgaaactctgtctctacaaaaaacttataaattagccaggcatggtggaacacacctggtagtactagttgcttgggaagttgaggtgggagaatctcttgagcctgggaggtggatgttgcagtgagccaagatcacgccactgcactccagcctggatgacagagtgagaccctgtctccaaaaaaggaaaaaagaaagaaagaaagaaagaaaagcaagcaagcaagacagaaagcaagaaataaagcaagcaagcaagaaaataaatgcaccaataaaatctgatttttgataatggtttggctctgtgtacctgcccaattctcacggtgaactgtaatccccagtgtcggaggtggggtctggaggagatacttggatcgtgggggtggtttctcatggtttaacattacccccttggtgctgccctgtcaagagtgagttattgcaagatctgattgtttaacaatgtgtgacacctcccctctctatctcttcctccagctctggccacgtaagaagtgcctgcttctccaggaggtggaggcatggccttccgccatgactgtacgtttcctggggcctccccagaaggtgatgccgccatgcttcctgtacagcctacagaaccatgaaccaatgaaacctcttttctttataaattacccagtctcagatatttccttatagcaatgtgagaacagactaatacagttctcaaagccttatctggttcttccctgcctcgttggctttatttgctattaatcttctccttcactcatcatggaacattaaaacgtagttttgtcacaatggctaaccttggagggggttgttaattgggaggacacatggtggcttctggggtattggtaatatttcacatctcatctaggtgctgtttagtcaagggtattgagtttatttatagttaaaattcatttaactatacatttggatttgtgcattttatgtattatacattagagtcaataaagagtttaaagttagttttgcagaataatatttaatgatgtgacaaatgctcctaagttaatatttatgtgaaacaagtcaaataaaaattaccaattttagaaagagtagtaaataaaacacaaaagtatacgaatagcagctttctgagaaatgcaaaaattgttaaatacaaggcacattttttttcttttttttttgagacagagtctcgctctgtcgcccaggttggagtgcagtggcatgatcttggctcactgcaagctctgcctcccgggttcatgccattctcctgcctcagcctcccgagtagctgggactgcaggcacgtgccaccacacccggctaattttttttgtatttttagtagagatggggtttcaccatgttagccaggatggtctagatctcctgacctcgtgatccacccgcctcagcctcccgaagtgctgggattacaggcatgaggcaccgcgcccagccaataccaggccagttttatatgtttattatatattacacatgcaatattatatatttattatctgttccatatgctatattatgtatattatgcaatatacatattatatatgtaatagatcttatagacatttccccatttttgctatttgttttacatggaactgtaaagtaagtagcatatgatccatatgttattggtaaaaaacatatagatcattgatagatattggaaagagattttataaaatgcaatatttggttttgaattgtaagccttttagcaagctaataatggaatgaactgagtactccacatgcttgagaacatttaactgaaactaccagtcaacatcctaccgaacccccaaatctagagatggtccaggtaaactcaggggatgatacaggatgcttttcaacttcaaaataatttagcatgattctagaatttcaaaccaatatagtagagttatgaaatagggggagaaaggtctgttatttgaaaaaggagaaaatttggcagataatttgtctactagaaaatctaagggcaggccgagtgtggtggctcacgcctgtaatcccagcactttgggaggccgaaatgagtggatcacttgaggtcaggagttcgagaccagtctggccaacatagtgaaaccccgtctctactaaaaatacaaaaattagccaggggtggtggtgcatgcctgtaatcccagctactcaggcagcggaggcaggggaatcgcttgaatccgggaggcagaggttgcagtgagccaaggtcacaccattgcactccagcctgggtgacagagcgagactctgtctcaaaaaaaaaaactaaggacatttacagtagcattactcaaattgatagagtatgatctggaatggaaataaacataaaaatcaacagctatattatacaccagaaggcgtctgtcaggaaatatgagggaaaaaagaggccagtcacaataacatgtaaactataaaatacatcaaaatgtccttaggggaatgacaggaacatcaacccaccagaatttgaccacatgtaggtttgaatgcatttggtggtgtgttgtggggagagatggggactgcctttttacttatttatttatttatttattttgagatagagtctagctctgtctccaggctggagtgcagcggtgcaatctcggctcattgcaacctccacctcccggattcaagtgattctcctgtctcagcctcccaagtagctgggattacagggatgtgccaccatgcccagctaattttgttatttttagtagagacgaggtttcaccatgatggccaggatggtctcgatctttcgacctcgtgatctgcccactttggcctcccaaagtgctgggatcacaggagtgagctaccgtgcccggctggggactgccttttagaatactccttttgttcatttgtttggttttctttttaaccatcaaagacccacagtatttgttgacagctatgtcagggctgtgagagtgaacagagccacgccaaaggcaggcttgctggttacaggtagctgaaggcttctctgactcagttcttacttatttatgaggactatttacatattagaaacagtccacttatgtttttaaacatctatgatagacatatctcctttttcattatttattttaatgtacggtcttttcacgtataaaagtattctttttttgttttcaaatctattaccatttattttttgctttatttctgctttgaaatatttatgcttacaaaatctatccccatcctagaatcagtataattcggaagaagggcaatgtattagcctgttctcgcatggctataaagaaatacctgagactgggtaatttataaagaaaagaagtttcattggctcacagttccatgggctatataggaagcatggaggcttctgctcctggagaggctgcagaaagcttccaatcatggcagaaggcaaagggcaagcgagacgtctcacatggcaggaacagcgagaggggaggaagtgctacacactttttttttttttttttttgagacggagttttgctctgtcacccaggctggagtgcggtggcactatctcggcccactgcaacctccgcctcctgggttcaagcaattctcctacctctgcctcctaagtagctaggattacagatgtccgccaccacgcccggctaatttttgtagttttagtagagacagggtttcgccacgttagctgggttggtctcgaactcctgacctcaggttatccatctgcctcagcctcccagagtgctgggataagaactcattcactcattatctcaagactagcaccaaggagatggggctaaagcattcatgaagggccacccccatgatccagtcacctccccccaggtcctacctccaacattggggatgataattcaacgtgagatttgctcgaggacacagattgaaaccatatctgggaaggatctgtttgccctattaatagtaaaagagaatataaagtgataataagagttcaatcactgtgtttgtagcctaagaatagaggttcctgttgaaatatacgctgactccaggaaggagaccaggagaggctggctcagctgaccaaactgtcatctgactcatttcctcttagcttccatggtctcctttttaagaacaagttgggtgaggtagctatgttcacttcaacaacctcagtgagtcactaccacaatgggggcagggacagagtgcttctcctctcctaaaatgggagatgagaaactctcccataagggtctatatatacagctgctagagatctgtatagcagagaatacattcaactttttcaagacctggaaaaaacacttttttttttttttgagatggagtttcactcttgttgcccaagctggagtgcaatggcacgatattggctcactgcaacctctgcctcccaggttcaagggattctcctgcctcagcctcctgagtagctgggattacaagcatgcaccaccatgcctggctaattttttgtgtttttagtagaaacggtgtttcaccatattagccaggctggtctcgaactcctgacctcaggtgatctgcctgcctcggcctcccaaagtgttgggattacaggcttgagccaccgtgcctggccaaacactcctttaaatactggcttatggtcaactttcagccttggtttctaatactgttatatttgccctttggtatttcttcatgtaaaacctaacaggtaatcaatatttttaaatgtgaatttgaagtctagagtgggcaaacagtactactctgccatcctgttaacctgggattaatttcattcttggaacataatgtatatatctgaatattcatgaagtagtacattttacactctactctctggggtgatcgggttgtttgaaggagacaatggaatcgtgtaatacaattggaagatgccccagaaaggtgagtgaaactgcgagttgccgcaggatcgtgttttgggagtagagcagagaggtcaccacctccttggggtgggcctcagctttgcagaccagattcctcaggtttcctggaattaccaaaaccaagacaccaacccaggtgggcactgattagcacatcgcaggaaatccccaacggccgtagttacctctggggagaaaaggaacgatgaggagtggggatgggctttacctgcacctataatattttatttgttaagaaacaaagagtggctggcgcagtggctcacgcctgtaatcccagcactttgggagtccgaggtgggccgatcacctgaggtcaggagttcgagaccaacctggccaacacggtgaaaccccgtctctactaagaatacaaaaattagctaggcatggtggcatgtgcctgtaatctcagctactagggaggctgaggcaggagaattccttgaacctgggaggtggaggttgcagtgagccaagatggcaccattgcactccagctgggcaacaacagagaaactccatctaaaaaaaaaaaaaatgagtgctctaaagcaaatatagcaacatgttgacacctgttcatttgggttgtttgtaaattattttttatacctgtctgtatgtttgaaatgactcataattgaatattaatttttaagagaaaaggctaaaaagaaagataatatattacaattagtggctgtctttgaatagtagaattgtttttttccctccttccaaattttcaatattttccaaaattttgatattgagtctctgttacttttataattaggagaacaacaagctccatttgaattaggcatatcaccaatcagccgagatcaatagaaacgtactgaggaggaaaatggatcaaggatgatgctgataaaatggcaaatgacgaagcataaaatgtggttaagtctcattactttgtattttacttattctgaattagttagtgggcagttgggttggccttgcatggttggtggagagaaaagactgctgagcactaggtgggattgtacttttaatgcttattctattctggagtcccaccatacacttcctataggcaagggacgtgttttctacatattcagtttctccttctgttttggggatttctgggccctcaactgtctgacaacacgcacctgttgaaggaatgattaagcaaaaaaaagaaaaaagaaaaaaaggtaagcaaaattgcagggaggcagagagattctcaatctacttaagagaacaaactcttttaacagctgttagctcattaagtgttgaaatgtaaatattgtagctaattaaatacagctttatttattcattttggcaagacccagctgaacataaattatacaggatacatttttaatgaataaaagagctttaaaaaaaacctatgtttttgctaacactggctgacctttttccaattagcgtgaattgtcatcaagcctcatttccccggtatctgtagcctgtagggctttctcaaacaaaaactggacacaaccagccctccacctactccagacctgcacccacacagctgaatgtgactgggaaaaagcatcaagttgccacctccaggccgggcaccacagctcactcctgtaatcccagtgctttgggaggctgagtcaggaggatcactcgaggccaggaaagtttgtgaccagcttgtacaaccgagtaagaccccatctctacaaaaaataaaaactccttgctgttcctggactgcctcctgcctgcccccactcccaccaccagatggctcctcctcaggacatcgcaccttctgttcccactcctggaatactcttccatcatttactcttctctagtttcccatgaatcactctcctctggtttcccatcactcactctccactcttatgttttttttcaaatatcaccttttcagagagattctcagatttatataaatgtcagctcccctgttctccacatggcctgttgtccttcccagatctgctttttaccataatatatttcatcttccaccatggtctcgatcaggaccatccacagaactttctgccatgatggaaatgatcattccgtactgtccaacacggtagccactggctacatgtgtctactaggcacttgaaaatgcctaacgcaataagataacttttaatgttatttagttttaatgaatttaagttcagtttaaataaccatatgtagctcagggctactgtgttggacatagtaggtctatcattgatttatccccttgctagtttattcagaggttgactgtttgcacatttgatcttcctgaaaataatacccctgattgacttatccccatcactagcatgcaccctccataagggcagatgtttttcctgcacctgacacatagtaggtgttcagtaagtgagtcaatgccctttaactcaagtttatcattttaagagccagagtgttttcattctaaacattttcagaaattattctaagctctgcagaatctgtccttattttaacttagtaccagaatgtattgtttccttgcaatttcaatgtcgcttttctgtacataacttgttatgttgtaataaattgtgtcctcagagacggttaatgtcattccttcaacaactgcacagattgctgggtttttattgtctactaaatgactgtttatcattaactttttcttatgtctgtctctattatatgctttatttacttttctttctttttttctttttttttttgagatacagtctcattctgttgcccaggctggagtgcagtggtgtgatctcaggtcactgcaacctctgcctcccgggttcaagcgattctcctacctcagcctcctgaggagctgtgactacgggcatgtgccaccatgcccagctaattttagtatttttagtagagacagggtttcaccatgttggccaggctgacctcgaactcttgagctcaagccatcctcccgccttagccttccaaagtgctgagattacaagcatgagccacggcgcccggccgtgctttatttttccatggaaatgactgggtaaggtttgaaggtacttccattctcccacatagttaaacacacaaagtttgtgacaattttttttttttttttttttgagatggagtctcaccctgtcacccagtctggagtgcagtggcgcgatcttggctcattgcagcctttgcctcccggattcaagcgattctcctgcctcagcgtcttgagtagctaggattacaggcacccaccaccacgcctggctaatttttttatttttagtagagacagggtttcaccacgttggccagccaggcaggtctcgaactactgacctcaggtaatctgtctgtctcaggctcccaaagtgctgggattacaggtgtgagccaccacgcccagccgaaaatttttttttgtggacacattcatggtctgttcagagagactggttgcctatacatacagtcatcatgaaaataatatcagaaataataaagaaggcagttattgctatttccctttataaattggaccacgaaaataaaaggtttgaaacctaaagccattgagctagaattaaaacccagtgttttcctctgagtccaatgttctcatctaacccagttcttctcaaaagcgtagtgcataaatcatttactaaaaatcatctgctttcgactcaaagttgctcaagaaaaaaataaaagtaaaaacaaaaaaaatcacctgcagtgcttgtttaaaacaaacatccctgggctacccaccagacctacgtgggcagaatcttggggccaggccccaaaaatctgtagttttaacgcactgcagagtttgagacccactgtgctaagtttactttctgaagacttgacactaccttgagcttttattctacaggggaaaaatgacactattttcattggctcccaaatcataaacttataacaactattctgttgcaaaccaaatgaggattttaagccttgatatatacattcaactaacctgaccataagtagagatatgatcagtaaaaaatgtatttcagtaatagattataggtcaaaaaatacttctagattcggccaggtgcagtggctcacgcctgtaatcccagcactttgggaggctgaggcgggtggatcacttgagatcgggagtttgagaacagcccagccaacatggtgacatcccatctctactaaaaatacaaaaattagctgggcgtggtggtgggcacctgtagtaccagctatttggaaggctgagatatgagaatcgctagaacttgggaggtagaggttgcagtgagctgagatctcaccactgcactccagcctgggtgacagcgagactctgtctcaaacattaaaaaaaaaaaaaaaaaaaaaaaatctagattccctcaccgtgtcttaggaacagaaagattcatccatcaagtattaagacctaagaggataccattgctacaatgtagggctaatctcagaaaatctaaaaggtgattattctatgcaataaagaaggtcatttgcagcaaaagcaaatgcacgtgtccttttgctaggttcacattcttcattctctagtttgggttccagagcacggaatgactttgtgatttaaagccacacttgcagcgtggactgggactggctttgaatattagtgttgtgtatactcaccagccactacagtaattgggtctagaatacaagaaaacaactttatttttctgtgattccccggggctagttctggcaagaagaaattctggcagagcttttgcttctgcagtgattccagggacttcgagtgagacaagactggtctagggcaaataagggtacaaaggggaggccaacgagagaaacggccagagtgggaactcaggagccgagtccagcagggccgagcacatagttggaagggctttatgtgtcttggggtgggtaaaggatcagtaaaatggctgggtactgtgatccatgcctgtaatcccagcactttgggaggccgaggtgggcggatcacttgaggtcacgagttcaagacgagcctggccaacatggcaaaaccccgtctctactaaaaatacaaaaattagctgagtgtgggggtgcatgcttataatcccagatcctcagggggctgaagcaccagaatcacttgagcctgggaggcagtggttgcagtgagttgagatcataccattgtactccagcctgggtaaaggagactctgtctcaaaaaaaaaaaaaaaaaaaaaaaaaaagaatcagtaagatgagctctctagtgaatggtgtcaccagctgtgtcagcagatgggcaaatgcaaggagccatgcaggagaccagagacctgacagaactgggacaaaccaccctgaagtatgggtcacacccaagtttgccaccagataccagggatcagtttacagggaaacctggatttctaggcaggaactgcagtccaggaaagccgtggggtgaagagcagtaaatcattttgcagattgggaaaacatggtagaatgccaacttttgatggcactgtgtgtgcttaactctgatataatgaagccagtaattgagggtctgggtcatggggcatagtcatcaattatgagtctgtggcaggaggtcatggcaggaagccagaccctaggaccctgatactggggactgtggtagaataacatgccccagatcctctgctcagccatcatctaccatcaggagctatgtatctggagaataggtgaataagaagccacctgtcactgtctttctaaagtgaaaaagaggtggggtaagggggcccagctaggttcttatactacacactagacagactcaaattccaggaactccatattggtctgtgttattgggagactccatggggagaactttaaaagtggtctgttggcacttttgttatttcctgctcagtccaccatggtgagaaaaaggtagtgctcacagaccatggtcagtagcaaagtgtccctgaccatgagcacaagttcaaggccagcagtcaagaggagacctcaccccaacctccacagaaacctatttatcagatgagaggtttggggcatttggccaagaaaccacacaagtgactccctctgcttcatggtaggttatgttttgacagttaacagggaaagaaaaaaaaatagccttgctatggtgtgaaaatggtttgtctccaccaaaagtcatgttagaatttgattcctaaagtaatggtgttgagaggtagtagaacctttaagagatgtttgggtcatgatggcgccatcatgaagggcatatgccactcttgtgacactgggttagttctcgtgggagtgagtgagttcttgctcttgcaggattggattagttgcctttagagtgggttgttataaagcaaggtcactcctcgtgtgttggccctttcacatgcactcacttgcatttttccatcgtgttacaaaactttgtgccagaagctgccaccaagcttttggacttcccagcctccagaaccatgagccaaataaacttttcttgataaattatccagtctcagctattctgttatagcaacagaaaacagactaggacaagtctttttataaaaaattccataaatgagggtatagagctaacttttattgattctttgtaatacatgatctcttacttggtaagggggggagaatgtgatttagagaggaatgaccccgggtgtcctcccctccactccaactaacctaaatgaatctacataatgtgtttagaaaacacagtaaaagttcaataaatgctagccatttttcttacccaaagttgcccaggttgcaagtggcagaacaaatattgggacccagacttctctgagacagaaactaatgctccgacccaccacattattactgttatcaatgattaccttttatctgtcgtttggtttagttgggatggtaaaagatgaaagagctccaataattaggtgtgcaggcatttgtgttttagcttatcagacttacgttgtgttcagataacttacctaagcaatcaattagaacccttgtttctttgtttttgttttttaaagaaaactgatgaaaccagaaattgattgtgataggaatttgtgtttcttcttgctacagcataagagcaacacattaaagaaaaaaaaccatataaatatcaatagacgctggaaagacatatggtaaaaatcaacagccattcctaataaaaatcttaattataacagggctagaaggaaaccacttaaatgtattaaagaccaccaagcccaatagtaaatgttattctaaatgttgaaaaagtaaagctgttttgaattgagtcaggaactagaccggtgcatttgcttttgctattatttttccacattgtttacaggttctagtgaatgcagcaaaacaaaagagagtataaacatagaaagaagaaaattatcttctcattaaaaatgtcactgcaaaaaattacaaaccacttgaataaataagataatttaataaagtggctacatataagataaatatttagtttatataatagcttttttctctaattgggtaacaaaaatctagaaatggaatagaaaaagtacttaactcaatataatgacctcaaactataaattatttatgaatacatttggcgagaaagtcagaagacctttataaaaaaaaaacgatggagaaataaaaagacattttgtattctcagatataaacacttaatgtcacaaaaatgccagttatcctaatgttaatatataatttattgcaatgccccattggaaccacagactgttttaatggaatggaatttatgttcatttgaaagaacaaatacatgcccatgaataggcgagaaagtccgaaataaaacactgatgaggggcattgattttatgacagtcaatatacaagcatctagtagaaagccattttgccatagtggtagtcaaatgtcagcatgcatcaggatttgctggaggacttgttaaaacacggaagaccaggcctcacccagaatttctgtttcagtaagtctggagtggagcccaagattttgcatttctaacaagttcccaggtgacgctgatggtggctgctgggctaaggaatactctcaaatcaatatagtgttgaccaaaaagaagacaaaccagtagactagactagaaaagccaggaattagcctagtataagttaagtatttaagaaatgacaaaggatgtccatgaggtaccactgggtaagaaaagtaagatgtataaaagtttgtataatgtgggccaggcacagcggtgcatgcctgtaatcccagctacttgggaggtggaggcaggagaattgcctgaacccaggaggcagaggttgcagtgagctgagatcatgccattgcactccagcctgggcaacagagtgagaccctgtctcaaaaaaaaaaaaaagtataatgtggtttcataggaaatgcaaaattagtttctcatggaccagctgggccctatgagacagctggtacagggctgtctgaaggaccacttaagagggaacatcagaccagaccccagtgcaaaggagctacaggtatgacagaatccctaaaagccggaggagaaggaagtgaacagctgaaatggaagtggattttacctgacatgaacaccacaggtgagtgatattgaccaatgtagagtgtgggaggtccttgaaaacacaaaaatgcccatgaaatgtgagaaagaggtggctttaaccatctgccacgtccagagagctgggacactacatcatcacaatagtaatgattacaactgtgccagtcaaaaggaatgacccctgctgtccttccctccacgccaagcctgaattcctggtgacccagagaccacagccgtggagctccaagaggagcagaagaatcaggtgagaagagagaaccaaatcaaccaagtcccttcccacaacctgggtcagggatggggtgctgggacagtgacttccaatggaacttgcagttttgacgatggcagtgaactgaggacttatgggacctcaagtgaccatagcacagaacatttttattgtctaagagtgagtagaaaaatctgcctgtgtttttacctgatggcagagaaagaataaaattaagggacatggacagacaaaaacagagttgctttattccaagagtgtatttcttcaatttaagagttacataagaccataaaatatttaaataaattgccattgaaaaacaactgagatatgtttttttctccccatgagaagatgattatctctgtcctctgagtagggaactccagattttgggggctactaacagctgcagagtttcaacaccctagatagaatggtctggcacctagaagataagcctacttacatctccctccaaaagattttgtgcaagaggcgaagacttgtttaaaggaggggagataaactcttgctgagagtggaaaggcagaaatggtctcctgtgaggtggaggcttcccttccagaggctgagaaagagcagagattgtggggtttctgaaagttgtagagacctgtcccctcctgttgttacttccccagctgggctgagtgcaggatagctgtctggcagaccagttttttctcaggcttagagactaaatggaaaagatactctgaagagctccagggtccaaggatggcagagaggaaaactatcagcatctttctaaagcaaagggcaagagggtaaccatggcaacctgcaaagaaggaccaaaaggaccctcctgggctccaggtaccactctgatgcttacgtgcctcacagagatggaaagaggctcctcaaacatgactgagaaggagtttctcaccactgtggtgagggagattgtgagctagattaactctgaattaataagccactctggaacacaaaatatttggagtatatccatctatgctctggacagacatctaggtactgtaagccaaatccttgaaaaaacagaggttaggctgggcatggtggctcatgtctgtaatcccagcaacttttggaggctgaggcaggaagatcattaaagcccgggagtttgaggctatagtgagctacgattgtgccactaccctccagcctgggtgatggagcaggatactgtctcaaaaaacaaaaacaaaaatggaggttagagattttcacattctcaaacaattgctcaaggttgattagtttgatccttcaattgagctcatcaacctaaagtgaaagagggaaagaaattaacttgacacagtgctaattctccatgtgatagcattctcccagggttgaagctatgtcctcttccagcttgcattttgcttcaggaagactataattacaacatcactacctcttgcatgaactttcccttgctctctgtggctgtgtgtctcaggctgcccttgaaatccaagaattgcccaaggcttagcccatctctactggcttccttcccttcccctctcttgccttttctttcccccttctcttttcttctatgtttaggggatcctatctggttctatgctgatgacctttgcatttatttctttaatccaatctctcccccgaattctagacttttatatacaactgcttacgaaacatctccatttgggcatctaaggaccatttcaaacttaagttcaaaatgtagttcttaagccctctccctctctaaaaatagaaaaataaataagttaaataactaacaataaaatccccagactcttccctccctttgtatttcagtaatgggaattccacagttgctccagttacttgctatttgtcaggagttatcttccctaccacttttcctcgcattccttccatctagttgtgatggtgaatattgagtgccaacttgtttggattgacgcatgcaaagtattattcctggctgtgtctgtgaggatgttgccaaaggagattaacatttgggtcagtggactgggagaggcagatccaccctcaatctgggtgggcaccatctaatcagctacctgcacagccagaataaagcaggcagaaggacatggaaggacttgacttgctgagtcttccggaattcatctttctcccgtgctggatgcttcctgcccttgaacatcagactccaaattcttcagcttttggactcttggacttacaccagtggtttgccaggggctctcaggccttttggccacagactgaaggctgcactgttgacttctctacttttgaggttttgggactgggactggcttccttgctcctcagcttacagatggcctattgtgggacttcaccttgtgattgtctgggtcaattctccttaataagctccccttcatatatacatctatcctattagttctgtccgtctagaaaaccccaacacatacactagcttatcagcaagttctatggtcttcacctttgaaatagcccagtcctggcaccttctcattgtcccatcatcacttctctctaactggtctccattccccaacttctccctctttgggttatcttctaccaagaagccacaatgttgatataaacatgcaaattggatcacagttgtcctttgctcaaaatgtttccaaggcattgattcacgctccgattagagctcaacagccttacctagggtaaggctctgcaaggctatcccgggctctccatgatttgacctttgtatcagggtcccagtgctgctattccaaattaccatacacttagtggcttacaacacaaatttattcttttatagctttggaggccatagctgagcacagtggctcatgcctgtaatcccagcactttgggagacgtaggtgggaggattgcttgaggccaggagtttgaggtcagcctaagcaatgtagcaataccctatatttacaaaaaaaaaaaaaattagccacatgtggtggtatatgcctgtagtcccagctacttgggaggctgggataggaggatcacttgagcccaggagttagaggctacagtgagctgattgtgctactggactccagcctgacagagtcagaccctgtctcttaaaaaaaaaattggaggttagaagtataaaatcaaggcatcagcaggatcacgttccttctggaagctctaaggcagaatccatttcctcgcttctttcagcatcttgaggctgcctgcatcccttggctcatgggcccatccctctatcttcaaagccagcagtgttgcatctcctgttctctctgacctctgcttttgttctcacgtcttctctctatctacctggccctcctgccttcctcttatgaagacccttgtgattacactggggccactttggtaatccagaagaatctctccttctcaaggcctttaatcacatcggcaaatttcctctactgtgtaagacagcatagtctcaggtccaggggttacgacatggacatcttggaagggccatgattcagcccaccacacctgcttaaattagctctaaccttgtctctgaatacctgcgttagcactgtggctttagccacactagccatcttgcaaatcctggatacatgaagtttgttctagataactgctatcctctcagagaggccttcccctttgcatccaatttagaatagtcttcccccaatactttattcccttgtcctacttaaaaaaaaaaacaactttttaagagatggggtcttgctatgttgcccaggctggagtacaatggcacaatcatagctcacttcagcctccaactcctgggctcaagtgatcctcctgcctcagcctctggagtagctgggactatgggcatgccaccatgcccatctaatttgtgtgtgtgtgtgtgtgtgtgtgtgtgtgtgtgtgtgtgtgtttgtaaagacagtgtctcattatgttgcccaggctggtctcaaactactggcttcaagcaatccctccacctccacctccaaagtttccaggattacaggcatgagccgccacacccagcctcatcttactttacctttgatagcacttattattgacctactatatatttatttgtgcattttccctctatcacatgaaatactatgaggatagtgatatatatatctatagctctatatctatataaatctatccatctatacacatatacacacatgcacacacacacattttgtttgttcactgttgtgtcatcagtatccagaagagtttgtggcacaaaataagtactcagaagtatttggtgctgtatgaataactgaatgaacaattattcattattctaggtttggaaggcctagatgggaggatcgcttgaagccaggggtttgagaccagcataaacaacataatgagatcccatctttacaaaaaccaaaaatggtgggggatgtcttcagagcctcagaactcagtagcattttaagctcctaagctgtaagtcactccgtttctcttcttcccacttcttgttaggaacataatgagcaggaagtaataatgagcaggaataaggagttaggaacataatgagcaggaagtgtggaggagaagggcaactccaccttgcatgctaatccaccatactgactcacggttaaccctgttcctggaatgcctctaagacttccagtgtatctactgctccttgtgtaagagcaggtgcttactgtaaatcccgcccttaggtcaaacaaccttgatgtgatcgtatttcaattaccttacccatcccttctgaactgtcctttccctgtggtatataatcgctgggtcttgagggtattggcatgagatttaccatcttgtttcaccgctgcccaagacacatacatggcttctatttatatgtctccattaaatgtttcctcctgagaaactggatatatcagcctctttccttccttcctttctttctttgacagagtctctctgttgccaggttggagtgaagtggcgcgatcttggctcactgcaatctccgcctcccaggttcaagcgattttcctgcctcagcctcccgagtagctgggactacaggtgtgcgccaccacgcccagctaattttttgtatttttaataaagacgaggtttcaccatgttggccaggatggtcttgatctcctgacctcatgatctgtccccctcggcctcccaaagtgctgggattacaggtgtgagccactgtgcccggccatatcagcctctttggttagcctctcagcttcctgggacttttggggatgggtttgcatagacccgcccaccttgaaacatacgccttaagcaacttccacatgcagtcctggaggaggtccagaatcttggggggtgtaagctgcctgtttcccttccttccatcaaaacactggacagggcggacacatcatcctatctgaatactgtgaaaatcaatggaatacgaaacccaacagaagccacagaccctgaggctgggggcgatgatcactgaaccatgaggtcaccatattccagcttgggccagatcgatctctcggtggtggtgatggtttacactgggaacagtcaccttttaaaaataatactgaggactaaactctgattcttttaaatcttgcgcaaattcccagttaaggggtctggggattcatgccctacaaatcataaattctaatcagatgggttttatttaaacttatatatcatgatttactttccaacccgactctggcataatattacacaacaaggaatcaaaatattttaccccgaaacctgtttctttgccatattttgaaatggtcctgcaaagttgttctttgtgggggaaaatctgcatctataataatctctattaacgtagctagatctttttcttccagacctacccaatcctaaaaagattaactaaaatttgaataggaaaacttgtcatctattgtctctaagggaagccactgtaagacttcaaaagaactttggtctctgcaatctttatcttaacctgaacattccctttctatcaattccaggtctttagacaaactcaacaaattgtcaaccagaaaatgtcaaaacttcacctatagcctggaagctccctgcccgctccgctttgagttgtcctgcctttctggaccaaaccaatgttatttcttttttcttttttttgagacggagtcttgctctgtcgcccaggctgctctgcagtggtgtgatctcggctcactgcaacctctgcctcccaggttcacaccattctcttgcctcagcctcccgagtagctgggactacaggcgcctgccaccacacctggctaatttttttgtatttttagtagagatggggtttcaccatgttagccaggatggtcttgatctcctgatatcgtgatccgcccacctcggcctcccgaagtgctgggattacaggcgtgagccaccgcccccagccgccaatgttatttcttaaatgtatttgattgatgtctcctgcccctttaagatgtataaaacaaagctgcacccggaccaccgtgggcacatgttctcaggacctcctgaaagctgtgttcactcatatttgactcagaataaatctcttctaatattttacagagtttgactcttttcatccacaatattgtctttcttttgggagtgagttctgttgggacagaatgagcaaacagaattgctgaggttagcacataaactacaaaccaaacaaataaacaagagtgagacgcgctgaccacgagcagacagatttgccaaatgtttctgactattatacatccccagctctctcttcctgtggttctattttcatcctttcccctctttggggagaaattcacaggagtcttgcaaaccttgctgtacagcctgcaaatcaggaaggaaccacaaaagtaacaaattcatttccgtagtaacaggctcaggaccatcctggctgccagtacaatgagccgatttaattccttcccaacaaacatatccaccattttaacatgtgaatggcagaagaaagttaatctgaggggtctagagaagatagctggctgaaaaattcagggtgggttccaagtcccagcgaagaatccagcacactgttaacacaaatccaaaagacagttgtaagttttctctgctttgaaaggagtgattcatcatttcacagtgacatacaaagcccttgccccaccgccgcaaggcgaacatctcctttgaaagcttcattgttaaatccagcagggtccttaggacagctcaaagtcacagcagcccaagttggaataggctggcctgaagtgccctggaagggattttcggcagatcctgcctttcccttcagtgtccaatgcttcagccactgccacgcccccttagcatgtcactcacgtctttctgttgaaaggaatcaggataaagcttcatgtgctctttcattcatgcaagagtctgcggtcaattattgcaagccttccggctgggcatggtggctcatgcctgtaatcccagcactttgggaggcgaagacaggcagatcatctgaggtcaggagttcgagaccagcctggttaacatgatgaaatcctttctctactagaaatacaaaaattagccaggcttggtggtgggcgcctgtaatcccagctacttgggaggctgaggcataagaatcacttgaatctgggaggcggaggttgcagtgagcagagatcgcaccactgcactccagcctggacaacaaaagtgagactccatctcaaaaaaaaaaaaaaaaaaatattgcatgccttctatgttatggggtagcattctgcaatgaggatccaagctgagaaatggtgttcgctgctgaagaattcacattctactggggcacagagacatgccctgaaaccataaaaatgggggcatagcaaaataggattaggtacaaagtgctgtgagaacttaggggagagagtgcctaccttagttgaaggaaccatgagctgcatcgtagagggtgagtgagattttgctaagggaaaattctgaacggaggaaagtctaaataatgttgcaaatgtgtgaaggtgtaaggaggatggcacggttggggagcgccgagggattttgtgcggtaggggtgggggtgtcaggaggagatctgtgaggttggcaagacggatacagttctgctcatcaggatcttgaaactcatactcaagtgtttgggcttgatctgtaaagtcaagtgcaccaggcacacaccacggatggttttagctggcaagtccataattatgcttttgttttttgagatggagtttcgctcttgttgcccaggctggcatgcaatggtacaatctcggcttaccgcaacctccacttcctgggttcaagcaattctcctgcctcagcctcccaagtatctggaattacaggcatgcgtcaccacgcctggctaattttgtatttttagtagagacggggtttctccatgttggtggtcaggctagtcttgaacccccccacttcaggtgatccacccgcctcggcctcccaaagtgctgggattacaggcatgagccactgcacctagcccatgattatgtttatagttttggaaaagagctctggtagcaaacatagggggagggagattagagcgggggtctctgcaaaagtcaaagcaagaggtcatcaaggtgtgaattgaggcagccacagtgcaggagagaggaggcaatgcaagtaaaacatgctcagggatgtagagttagcagagtctggcaaaggctggagatggagggtgagaaggaggagagcaggtggacaaggcttactttgaattacacagtgaatgctgctaccgagaatgtgtgtgcaaaatgtgttgcaataaatgatggcggcttgggtgttgcgggcttggagggcatgattcgttcaacctgggacccgcggagtttgacatgtctgtagggcaactggtgcatatgtgcattaaacttgcaaccatggcactaaagttttgaaatgagtctgggcgtagaaagagagctgcgaggatcatagggaagtctgggataaaagcataggatggaataagacctcccagagtttgggggcaatgtaatataagaagagggctaaggagtagggtctggggaacaaaaatgcttaagatgctggaagaagaagagaaggctgagaaagaacagtcaaacaattttggctaactgggaacaaaaagcatctgaaaaaccaacgggctgctaatgggcgtgggtttattttggggggagatgaaaatgttctaaaatcgactgtagggatgactgcagaactctatgaatatactgaaaaccgctgacttgtgcactaaaagtgggcgattgtatggtttgtggattgtatctccatgaagccattatcgagagagagagagaaagacattttttcttaaaaaaaaaaaaaaaagcaaaaaaacaaaaaaacaaaacaaaacaaaaaagcaatgaatacctatgtccaatacagccaaaggtcaataaagaaacggctaaaaagtagtctttgatgttgctaattaggacagtagcgttgatctcagggaaggaggcatcaataaagtgaagggaacagaaagcatatggcaataggttgggtgagaagggagttagtcgtttctagggtaggtcggtggttaacaatcacaggcagagttcggagctggtagtgaggaagtggaaaggaggtggtggcaagaggggtgacgtgatggggcccattcctagaggagaaaggggaggagggcaggggacccagagcttggggtggggtgctttgggcagaaggagacaccatgatgccactgagtttggcaaatgaggcaaaagaatgaacaatgttcaccttcgatgttcccttttgttcacaatgtaggaatccaggccaccgctgaggagggaagccgcagtgtggtgaggagatcaggaaaggtaggaacaacttggggtaccagctacacagaacagaaaatgtacaggctggggacaggtgcaggaactgcaccccagtgcccaggacccaggtgcgatgtgagatcaggtgtcttagttccttctggctgctacaacaaaatatcataaactgggtagattctaaacaactgacatttacttctcacagctctggagactgggaagtccaagatcaaggcatcagcagatttggtgtctgatgacctggttcctagatggcaccttcttcctgcgtcctcatgtggtggaaggcaagctcccttggggctcttttatttatttattttaagaaacataacattttaatagatgaaataaatactccagtacatgcaaggtaaaaacttgacgttggggcaaaaaaaaatcactctatagtgtaaattaaaaaataaaacacatgctcacagtagcttccccccatttgcaaatcactggggctcttttataaaaacaccagtctcattcatgaggactccaccttcatgacctaaccacatcccgaaaggccccgcctccaaatcatgaccttgaaggaggttagggtctcaacctatgaataaggggggacacggatattccaaccccacaccatggatttgtgattgtgttgaaaagaatttgagccacttggctgggcacggtggctcaagcctgtaatcccagcactttgggaggctgaggtgggcagatcacctgaggtcaggagttcaagaccagcctggccaacatggcgaaaccctgtctctactaaaaatacaaaacttagccatatgtggtggcacacgcctgtaatcctagctctgtaatcctactctggaggctgaggcaggagaatcatttgaacctgggaggcagagggtgcagtgtgccgagattgcactactgcacaccagcctgggtgacagatctagactctgtctcggaaaaaaaaaaaaaaaagaattggtcactttagagtgtaaattctcagagaaacacaacagtggctgattttgaggttatttgagttgaatccccttccattccctgaatgagagcaatgagaatgagaacagagcttttatttatttatttttttggagacaaggtctcactatgtcactcaggctgaagtgcagtggcacaatcatagctctctgcagcctcaaactcctgggctcaggcgatcctcccgcctcagcctcccaaatagctgggactacaggtatgctactgcacccagctgagaacagaatttttaggaacagaacccaagacgggcacatcagccatgacaaatggtgccttggaagttgctatgctctggagccattacttgtttataaggtgtgggactagtccatgttctccaaccagactgtgacataaaacactcatcttcccttccctcctttccaaacagttcctgggcttctgattccctctttctctctccatactgtgttcctcctttattctagcaatactttgttaaagtctttaaagacctttcattacagtagcaacacatgctcatataaaatagaaaaaattattaagaagaaaaaaaattatccataatattttatctagacataactactgatagtatttggtatatctctttccaatatctttccatgcacctatacctatatacctatacctacatgcacctatgttttaacattgttaaggtcaaatgtgcaattttgttttctagctttttttttttttttttgagatggtgtcttactctgttgcccagactggagtgcagtggtgcagttatggctcactgcagccggaaactccccaggttcagatgatcctcccacttcagcctcctgagtagctgagactacaggcatgcaccaccacgcccagctcatttttgtatgtttggtagagacagggctttgctattttgttcagcctagttgcgaactcctgggctcaagcaatccacccacctcagcctcccaaagtgctgggattacagatgtgagccaccatgcctggccttgtttcctaactttcaacctaaatgtctaccctttaaaaaccttctcctagttattaaatctaattgtaaacacaattttcatggctgtataatattcgacatacagatataccataacataggaacattcttgtgttcttagtttgtttcgatttttattgtattaaaaatgcgacaaaagcaaaggaactctaatttttgtccacagctcttgcttcctagaaatcgaactattagttcaagtcaccatgaatattttaaagattctggatacctgcttcccaattgcttttcagaaggctcattattcttctggacttactcgacacaagtcatgttcaagggagccttgttccaacttccatggtgctttctccagaagctgcctatcaaactggttaagagcagggactctggagcagaattatttatcctagactcccacctctgccacggctgttgtctttcgggaagctacttagctttttggtgcctccattttcccatcaataaaatgggaggataatgacagtgcctattacatagggttcttgagagaactaaaagtatcagaatttgtaaagtgctttcctagcatataacaagtgctatatgccgggcatgatggctcacgcctgtaatcccagcacttcgggaagccaaagtgggcagatcacttgaagtcaggagttcgagaccagtctggctaacatggtgaagccccgtctctactaaaaatacaaaaattagctgggcatggtggctcacgcctgtaatcccagctactctggagtctgaggcagaagaatcgcttgaacctgggaggcagaggttgcagtgaaccaagattgccccactgcactccagcctgggcaacagagtgagactccgtctcaaaaataaataaataaaaaaaaaaataacaagtgctatgtatgtgtttgttaaattaaattgattatatagactagaagcttgagggcagagactatatcatgcctgtctcggtattcagagctcccagcttggtgactggcacacaggtactcaataaataaatgtttattgaagtgcacagaaccttggccacattgaatattttcatcactatttaatatttgctgatttgatagtctgacattgtatcttgtgctaatttatatttcttttaccatgaatgaagtttgatagatttttaaaaaatgattattggccatctatttttctgctttcattcatctgttcctgctttttgcttacctaactattgagattctagtatttttctcataaaataaagatccagggccaggcgcagtggctcacgcctgtaatcccagcactttgggaggccgaggtgggcggattacttgaggccaggagttcgagaccagccttgggcaacaaggcgaaagcccgtctctactaaaaatgcaaaaattagccaggaatggtggtgcccacctgtaatccccgctactcaggagaatcgcttgagcctgggaggcagaggtttcagtgagccgagatcatgctattgcaatcctggatgacagagtgaaactccatttccccccaaaaaaaatccaaattattttcaataattattatagatatttttcctggtttcttgtgtgactttcaatttcatgtatgctgggctttgagagcagagtaaacagaggggcttacaaagccctcctcattcacaggcttgagaaatatctacttctgtctcctttcacattttgtatgttctgagttttgtatgtttctaatagttaaataattaacaaaacagctaactctctacctaataaatgacgtgagaaccacgtcattttttttttggagacaaacttatttttgtctgcatgtcctagcttttaggaagcttaaaatgatcattgaggtgtgatgtgtccaagtaaattacaacttgcaaggctttgaaattgactctgaaaagccaataaaaaggttctgtttaataactcctttctttcattttcttttccttgttcattacgttagataccactgttaacagcccacattttcttgataagctatcttatcctggtggttcaccactgggaaggatcctgcaccctcaggggacatttagcaatgtctagagatatttttggttgtttaccacttggctgggcaaggaacgggggagatcctactggcgtttagtgggtagaggctatggatgctgctaaacaccctgtgatgcacaagaaggcctcccactacaaagaattgtctggcccaaaatgtcaatgatgctgaggtggagaaaccctattttaaactgaagtgtacaatctagttgaaataaggtgcttttggccaggcgtggtggctcatgcctgtaatcccagcactttggggggccgaggcaaggtgagcggatcacttgagcccaggaattgagaccagcctggccaacatggcgaaaccctgtctctactaaaaatacaaaaattagctgggtgtggtggcgtgcacatgtaatcgcagctacttgggaggctgaggatggagattcacttgaacctgagaggtagagattgcagtgagccgagatcacatcactgcactctagcctgggcgacagagcaagactctgtcttgaatacaaagaaaaaaaaaaaagaataaggtgcttctgcaaactctgaggctattctcgggatgtcaagaagaaaatgccgtgagatgaaccattaaggtttcctctgagcctctttagttctgcccattgcaagatttgggcctctctgggaatagaggagctgacatgaaggctaaggaaataatattggtccaaagatcatctcttagagatctgtgtatgttttctctgtgaatcaggcttgtactccttcccatgatgctgcccacctagacatcacacaacttgataaaatctcccaggatttaaaaagcttggcaagactcgttttttatattctgtcacgttcttcaggactcaaactcctatagctactgaaactgggttctgatgccttgtgcctgatgtcctagcacagccagagccctacttgtggagtaacccttagtgatttttagtgcttcctttgtcccatctgatgtctttatttataaacgggtttaattctggacctattatactgttgatttcactgatttaaatactataactttatactgtgttttaatatcccattggccaagtctcacttattccttctatccccactcaaccagaaagacaggatcttgctctgttgcctaggctggagtgcagtggcatgatcacgccaaccaggctgtcacctcagccttctgaattgctgggactacaggcacacgctactatgcctggctaatttttaaattttttttgtagagacggagtctcgttatgttgcccaggttgttctcaaactcctggcctcactcaggtgatcctcccacctcgacctcccagagtggtgggattacaggcatgagccaccatacccagctcaatcaattattttcttcaaggtcttaagtttttattctgtattccagatgagattagaatatatctgccatttcaataaaagttccattggaattttgattcagagcacaatgatctatgcattaatctgaaggaaataaaagaaaaacccgtagtgttatttattttgctttctgagagcatgatatgttttttcacttaaatcaactcttagtttagttttcagtagtttaatttgtatcaattctgtatatttcttattaaggttattcctgtgtgctttatatttttgttgttactagaaatgaagtttccatatttctgactggttattgataagaaaaacagactgcaatgtttgtgttgcattcagctaccttgaatttcattttctttttttggagacagggtcttgctctgttgcccagtctggagtgcagtgatgcagtcttggctcacagcaacctctgcctcctgggctcaagcgagcctctcatctcagcctccccagtagctgagaccacaagggtacatcaccacgtccagctaatatttgtattttttgtacagacgaggttttcctatgttgcccaggctggtctcaaactcctgggcccaagcaatccaccttccttgacctcccaaaatgttgggattacatacatgaaccattgtgcccggccttgaatttcattttcaatttgtgtgtaattttaagtgattctcttgacaattttctctcttttctttttttttgagacagagtctcgctctgttgctcaggctggagtgcagtggcgtgataactttatctcattttaattgttcctcttgttttgatttcatagaattgtctacaactttcagaaaatgttaaataagatgatcgtagttctcattcattcgacaagagtgacatgactcattttgtttctgcttttggtagaagcacctctcatgtatcacctttggctgggctgactttccccactccctggtgaaatttccaattctcttttatggggtctaaattctgatataaatattacattcatgccaggtgcccaacaaaattctctgtaagagttatgacagaatgacaaggtaatatacagaagaacaaaaatgaccgtttaaggaagaaatctgagaagaaaaatgactcctgctagagatgtacctactaaggcatggattccttccagtcattcattagagttcgtgcttgactctagctgagaatgaaagtaatgtggaactatcacttttaatggcaaaaacagcagtgacttttacaccaatctaatggttccatcccatcattaccttagattctaaactaataggagggaggctccaaatgtcaattgttaataaacttggaaccacactggccacagaagtatcttaatgtgcttatttcctgagaataatgatctcagtaggctccctaaaataggagtgggctgccctgtatagtgcctgctgtgcccagaagccaactgaattctacaaagggcaccaattattctgaaaatgacactcacaatacctttccattttaataatatacgctttaatgttttttaaccgtccattcatttgcagttgttgcccagatgaggagggacgtgatttgattggtaatgtcacatttctttgcagggcaccaagcctcatacataatacaaatatctgactatctgtgactacataaactcgacaattgagggctgatttgtcaccaaatatcatctctctttactaattcagtgtgtctctagagaacttctttctttcttacaagctcagcacttcctcatgtttaataaaagattaggtttcccaaaaaatagctgagcaggttaaaatggaatcatgcttacaaggcctgatgcaacagttcccagtttctcactaaaatacttgcgaaagaacaaaaaacaataaacaccgaaattagatgagaatcttatgggaattcacaatgaaaggcctgtgatgctggattcacagacaggataggagggccttgtgtaggtccatcaagcttcctgctcttgagtatgaaaggaaggaggaccaggctttgagaaactctcagtgtgtgtccatctcacataggccctgagagcctcagactgaaccaacagcaaagctgggcacacgtctttgttctgaggcagccagagagctcttagctcctctccacctccactctcattttaacttccttctctgtccatacagagctgcagttccctgatagcattctgctcccaaacagaggagaatggcgagattcctgggaggagggttctcttctgcagagcattgcatgtttgccaaggaggaaaaagaaacgcgctgtggcagaggttttccctatattctacatttttgtgtttcaatgagccaggaaataaggctatgagaagacccccatctcagtctagcagaaacttattggagggtcatttgctaaaaacaaagcaaaacaaaaatccctggaaacttgcaggcagccctggaaatgtgttcatccaccaacacaagagaaagctttatggacctacaaaaggcctcctgtaatatctgtgagtccagcatcacaggcctttcgttgtgaattcctgtaagattcgcatttaattttggtgtttattgttttttgttatttcagaagtattttagtgagaatttgggaactgttgcaccgggacttgtaagcataatttcattttaacctgctcagctatttcttggaaatgtaatcttttattaaacataatattaagtgctgagcttgtaagagagaaagaagggggattctacaaaagggccggttggaagaaccaagcacttgctattctgttggtaaacaccagctcagcacacatttcttcctgtccaaggataaaagaacagaaaacaaaaatttcaccttgagcctctggaaacacaaggtaaagggaagataattgtgactgctcagattaaatatgccatctttgaaatttattttctaatgaaaaggaaggaaattgagcatttccttcttcttcttaacaggatgcagaaagatcctgcaatgggaaatgaggagaggggctggggggaagataatatcaacccaggcctcaaaatatttctgttagtgttcaaatctagtatcccacaaataataaaaaatagtgtggcctatgaagagacaacacattatgaacccaaaccagcaaaaacagcagagaacagaaacagacttggagggaattccaatattgaggctatcagacacagactgtaaagcaatgtggtttacaatgttcatggaagaaaaaaccaagcttgagaatgttgtcaatctagccaaggagtagtgttggaaaaaaacaaaaaacaaaaaaaaaaaaaaaaaaaagagagagagagggagggagggggggggagagagagagagagagagagaatgttggcaatcaattggaaactatcagaaagaacacagacattgcaaataaagaaaaatagttggatcacctgaggtcaggagttcgagaccagcctggccaacatggtgaaaccccgtctctactaaaaatacaaaaattagctgggcatggtggcacttgcctgtagtcccagctactcaggagcctgagacagtagaatcgcttgaacccaggaggcagaggttgcagtgagccgagattgcactactgcactccagcttgggcaacagagtgagactccatctaaaaaaagaaagaaagaaaagaaaatatcccaaaatttaaaactcaatagttgggtgtaacagcagattggacatggctgataaaaggatttaggaactgaaatgtaggtcaaaatgaatactcctgaatgataccggtagaggacagagaatacaagagacataaagcatactgtgagaagatctgacataaggtttattccagagtttcacaaggagaggagatagagaatgaggcagaagcaatatgtgggggcttaaaggctaaaatatacaagccatggtttgaagaagcccaacaaagcccaaggaagacacataaaatgaaatccacaactggacacgtcatagtaaaacttgaaaaatgcaaagacatagcaaaaacctccaaagaggccacagaaaaaataagaagttactcttaaagaagcaatagagagactgatggctgacagattgccctcaagaaatagcatccagatagagaagactcatctcaacaacaatggatacaagaagacactggaataatataatctcatttgaatgagaaagtgactgcttgcttagaaatttattccagaaataaggggcataacttagaaattagaagacaaaattacagttattgaactgtatagaatcatatatccatagaagctaagagactaaggttcaatagggtgaataaaattcagcaaaacccaatgacttctgtaagccaaaatactaaaatataaagaaaaattccattcaccacaaatacacaacttctctctctctctcactctccctcccaggcccctgcagagacatctttttttttttttttttgagacggagtttcactcgtcgcccaggctggagtgtaatggcgcgatctcggctcactgcaacctccacctcctgggttcaagcgattctcctgccgcagcctccccagcagctgggattacaggcatgtgccaccgtgcctggcgaattttgtatttttagtagagatggagtttctccatgttggtcaggctggtctcgaactgccgacctcaggtgatatgcccaccttggcctcccaaagtgctgggattacagacgtgagccaccacgcccggctgagacaccttctataaaatgccaagaaatgctaacaagaaatttatgggatgcttatgaaaaacagtaagcatcaccactgaaatttataaaggaaaaataaatatttagacagggatttcatgttcctgaatggcaaaagcctatatcttaaaggtccttaaagtaatttaataaacatcttgatgatatttattttggaattagaaaaaaaatcactctaaagttcatatgaacaaataaacaggaaagaataatgtgagagggccaggtctccaggtattaaagcatataacatacttcagaataactgataccatgtcgtaacaacaaaatgtcaccatatggatgcatggcatagaatatgtccgtacgtatattaggcacattaagacgtttgattctctggaaaaaaaatgaggtgaaattctcatcacataaataaatgtaagctctagaaggactgaagaatttaatgttactaaatcaaactataagccataaaatttaggcaactatttaactcatcactataagggcaaaaccttttaaatcataaaacccacggagtaaataaaataaaaacttgctagacttgtctactttaaattttttaaactttatcatgtcaaaaataggagaacgaagatgaaaatacaaaggaaaacttgcaaaatagcttccataattgtgacagacaaatttttaacatcctgaatattacggcttttatagatcaataagaaaagcagttaaggtcatagaaaaagaaaatgcaaataactatggttatttttttaaatggctaatttaagacaaagatgtccattttcaccactcctattcaagagggtactggaagtcttagccagagctatctatcaagagaaagaaagacactcaaattggaaaagacaaagtcaaattatctctgtttgctgatgatatgatcttatacctagaaaaccctaaagactctgccaaaagactcctagatttgataaatgaattcagtaaggtttcaggatacaaagtcaatgtagaagaattagtagcagttctatacaccactaacaatcaagctgagaaccaaatcaagaagttattccattaaggcaggcagttagtgaaggaatggggcacaattacttgcaggtggctaagagcaacacaaatggggccaaacaggttagcacaaggaccccagtcagtaacagatgttccagaagggggctagggcagatgtctgtggtcacctgtggttggcaacttccttgctgaaggaggaatgactgttggagggaaagtcccaaaggctgagcaggcatactggcaaaggactgtgtcgttatgctgaactttgctcattttaatagtaaaaaacacaccactgggtggagatttaaaatgctaatgagacatccgacatatgtagtagcatgtacagtaactgtgcacgtgggcccaagagaccatccacaacatgctgagcaacaatgcccattccagccctttcatgaataatcatgtaagactcacataaaaggagtttccccaatgccagtcagcactgtctcattcttgagcagcccaccggacccagctatccgagtgtacttttgctttgcgataaacttctttgcctactcttactttggacttgctctcaaattattttgggtggtgaagtcaagaccctgaaccagtcctctgaaaacactataattaccaaaataataacaataaaatacctagaaatgcatttaacaaaggacatggaagatccttacaagaaaaacactaataaaagaaattttagataacatgaacaaatagaaaaatattccatgctcatggatcaaaagaatctgtatcattggaatgctgcccaaagcaatccacagattcaatacaatccctatcaaagtactaatatcatttttcacagaattaataaaaaacaatcctataattcatatggaaccaaaaaaaaaaaaaaaatagagccagaatagccaaagcaattctaagtaaaaggaacaaagctggaggcatcaacattacctaacttcaaattatactacaaggctgcagtaaccaaaacagaatggtactagtataaaaatagatacacagaccaatggaacagaatagagaacctggaaataaagtaacatacctaaagccaactgatttttgacaaagtcaacaaaaacatatactggggaagggacaccctattcaataaatggttctggaaaaactggagagccatatgcagaaaaatgaaatgaccctctctctcaccatatacaaaagttaactcaagatcgattaaagacttaaatataagacccaaaactatttaaatactagaagaaaaccttcaaaaacctcatctggatgttgactttggcaaagaattcatgactaagacctcaaatgcaacaaaaacaaaaaccaacaaacgggacaatgggacttaattattactaaagagcttttacacagcaaaagaaataattaacagagtgaacaggcagcctgaagaatgggagaaaatatctacaaactctgcatccaacaaaggcctgatatccagaatctacagggaactcaaacaattcaacaagaagataacaagtaaccccattaaaaagtgagcaaaggacatgaacaggctgaggctggagaatggtgtgaacctgggaggcggagcttgcagtgagctgagatggagccactgcactccagcctgggtgacaatgcgagactccgtctcaaaaccaaccaaccaaccaaccaaccaaccaaccaaccaaccaatcaaaaaaaaaaaacatataaatggccaaaactcttatggaaaaaatgttcaacatcactaatcatcagagaaatgcaaattataactacaatgagatactatcttacaccagtcagagtaactattattagtaataaataacagtaaaaaataacaggtattggagaggatgtgaagaaaagcaaatagatggatagaccaatggaacagaatagagaacccaaaaataaagcaacatacctaaagtcaactgagctttgactgttggtgggaatctaaattcatacaacttttatggaaaacagtatggagatttatcaaataactaaaaatagaactaccattcaatccagcaatcctactactgggtatctacccgaaggaaaataaatcattataccaaactatatgtataagttatattcttgtatgtttattgcagcactattcacaatagcaaagatgtgcaattcataaagaagtattgcataaggaaaatgtgctgtatatatattacggaatactactcagccatataaaagaatgaaataatgtctttgacagccatatgggtggaactggaggccattatcctaagtgaaataactcagaaagtcaaatactacatgttctaatttataagagctaaacagtgtatacacatggacatagagagtagaatagtagacattggaagcttggaagggtaggagggtgagaggaaggtgagggatgaaaaattacttaaaaattttttaagtaaaaatttaaaaaaaatttttacttttttttaaaaaaagtaaaaaaattacttaacgggtacaatatactctcttcagattgctacattaaaaagctcagacttcaccactatacaataaaactgcacttttaccctctagatctataataaaatatttaaaaagggctaacttaaatgagaaaccattttttgaaatcacccaattggcaagatttaaaataaattctagtgtttaaagttgcaggcatcacattacctaacttcaaaaaaatactatgaagctatagtaaacaaagcagtatgttattggcataaaaatagacacatagacccaaggaacagaataaaaagcccagaaataaatccacatatttacagccaactgatttttgacaagggtgccaagaacacacaatggggaaagaatagtctcttcaatgaatggtgttgggaaaactggatatctaaatgcagaagaccgaaattagaactttatctcacatcttatacaaaaatcaactcaaaatggattagagacttaaatgtaagacccaaaactatgaatttactatatgaaaacataaatgaaaagcttcatgacattggtctgggcaaagactcttttgggtaagacctcaaaagcacaggcagcaaaagcaaaaacagacaaataggattatatcaaactaaaaagttttatacaggaaaggaaacaacagagtgacaagacaacctacagaatggaggaaaatatttgcaaactatgcatctgataaggggttaatatcccaaaacatataaggaatttaactccattggaagaaaacaaaaaactggattcaaaaataggcaaaagacctgaatagatgattttttcaaaataagacatatgaatagccaataggtatatgaaaaaatgctcaacatcccttatcatcagggacatgcaaatcaaaactgtaatgagatatcatctcaccccagttagaatggctatgatcaaaaggacaaaagataacaaatgtttggaagatggggaaaaaaaggaaacccttataaactgtttgtgggaatgtacattagtgcagccattatggcaaacattatggaggttcctcaaaaaactaaaaatacatctgccctaagacccagcaatcccactactgggtacatgtccagaggaaatgaaatcagtacactgaagagaatctgcactcccttgtttgttacagcagtattcacaattgccaaaatatggaattaatctgtctatcaaaggatgaatgggtaaagaaaatgtagtatatattcccaatggaatactattcagccatgaaaaagaataaaatcttgttatttgcaacaacatggatggaactagaggacattgttaagggaaataagccaggcatagaaagacaaataccaaataatctcacttacatgtgaaatctaaaaatgtttatctcatagaagttgagaatagaatggtggttatcagagactggggtgggtagtggggagaaggagatggggagatactggtgaaagaacacataattacagtttgaaaggagaaataaactcaagagctctatcgtacagcaagctgactatagtcagtgacgatagtattctaaaaaaatgctgagtggacaaatgcattctccacaaaaatgataactatttgaggtcacgcatttgctaattagctacatttaatttatcccacaatgtacgtatacttcaaaacattatgttgcacatggtaaatacatacaatgttacctgtcacttttttttaaatgtaaaaatgagaagagttcatatttctgtggaatgtgtaacaatatacatttatggttttggcttagaattatattttgttgtttttgttcttaatttctttatttgatttatttattgagacggggtcttgctttttctcccaggctggagtgcagtggcgtgatctcagctcactgcaacctctgcctcccaggttcaagcaattctcctgcctcagcctcctgagtagctggaattacaggtgtctgtgaccatgcccaactaatttttgtattttcagtagagacggggttttaacatgttggccgggctggtcttgaactcccgactttgggtgatccgcctgcctcaggttcccaaagtgctaggattacaggtgtgagccatcgtgcctggcctatttatttattttttaaaattatatttcaatagcttttggggtacaagtggctttttgttatatggatgaattatacagtggtgaattctgagacttcagtgtacccatcacctgagtagtgtacattgtacctaatgtgtagttttttttttttttatctctatcccccctcctaccctctaaagtctctaaagtccattatatcactcaactcaggattatattaacttttctgccttctgtcataatgtagtccaaaaagatcagggctttttggacatcctacggaacatctcattgatcctctacatcagtagcatgctaagcttactgagctggataagcaagaaatggattagtcctctggagaccttggcaagacatacgcactccatagagtgggagataaactctataaagattctagggcctgacatgtcagtaaaatgtttaggaatccagtcaccagaggtacctggaatatgtcctctaaagtgaaaaatgcatcattataaaaaaaatctagggtttaacactgtgaaattgtattagtctgttctcacactgccataaagatactacccaagactgggtaatttataaaggaaagaggtttaattgactcacagttccacatggctgaggaggcctcaggaaacttacaattatggaagaaggtgaagaagcaagcaccttcttcacatggtggcaggagagagaagaggaagcaaaagaggaacttgccaaacacttataaaaccattcaatctcatgagaatgaactcactaccacaagaacagcatgggggaaactgaccccatgattgagtcacctcccaccaagttcctccctcaatatctggggattacaattcaagatgagatttgggtagggacacaagcctaaccatataataaatggacactccctatcattgctggaagcagtgtgcttggtgccatctttctggcacgctctggtgatcattcctataaatgtgagacattgtggaatctggcagcagccgggcggaactttccattttccaggctttgggaagtgcaatttagaggtagaccacgtatttcccgggccatgagccagcaggcagtgaggaggagcttagatattgatccagagactccgaatgggtggggagatgcagatggaattcataatttagggagaaatatagtagtcactagagttgcaaaatccagggcaatagggacaggtaaaagtcaggtcagaaaccttggttaggagccaggcagaaagcttggacgggctcattcattgacaaaaatggagcaggcatgacagaccaggcactgggtatcaccgatggtggtaccacttgttactgatggtgacaagcttgatgtagtcaagcaccaacaagcttacactgtagcggggcaaattggacaaccagattttaaaaaccaagcaaatgagcaaacttcaaaataatgcaagttttcatgagaatgatgaaggaaatagatctggcatccagacagagttagggcagggaccctcatttccagaacaaaacagaaagcgaggagtaagactggcagcagccaagggttttgcagttgggttgcccaggtggcaaataggttcacgatgtctgtttttgcaaaatcaaaaacaaaaaggctgcatgtaatgttcaggtctgcagctctgttttacgcatctgggcatctagatgaggaggtttccccacccggttcaggtgacagaggcagggggcagggcctggtgccatcctgcctttttgcagcttgcttgcatccaccctgggccaggtaaagctgactgaacatgggggagccattctctgcatgtggtttgtgtgtgcttcctctggccttttcagctttggataattgaacatttaagtgattgttccacttcataaagtatggtccagggaggcactgtgcaaattgctaaatcaatttacttttaaacagaaatgaggtttaaacacacacacacacacacacacacacacaacttaaggaaggcttgatgtgttccatcgcaagcgtctccagaatgctgcactgctctccctgtgaagtcaatattacagattcctgggctgcaaaccagaaggacaaattgggggccatgtgcacagccgcattatttttctcgtttgcaaaggtcagtgattctccatgcatcaactatgaagcacaccacacagcacctcagcatcagcagaataaagctgtgagtcagaaccgggtttggagctagaaaaagacctggattccaatttcagtccttcccctatgtgattttggagcaaactatttaacttctgggccctgaagtctcttcatggtttaaaagcgataatacctactttgctaggtcttgctgagaattaaatgactttataataacgatagttgccaacctgtatgcagcacttattatgttccaggaacaatgcatagtgccctatctgtgaattctcagatgtagatatccttaggagatgaaaacaattcaattcccattacgcagctggtatttgtaatgtgcagagcacacacttctagttcttccattggtctacaaaatgacttgtcatgcgcttattttgtattcaaaggtgttagatttgatgatatcctgtccccagggacaaaggattaataaaaaatgtgtatgcatatgcgtgtgtgcgcgtggacatgggggcaacgttgaaacaactgctcttttgaatcagaaatgtttcctataccagattattgtggattttaggtctagctttcgggttattgctccaatcatttttacttggttctgttacccttcagacaaatgattttcttctaggcttctcacttcacacctccagtgagctcagatcaaatcctcttttctctgtctgacctcctgaaccctttggtggccccctttgttgcaggcctccacccaaagtcaaccaatttttggtcctcatctcccaaaaatctgaactcctggtattgcaaaacttgaattttcccctatgcttacactatataattctttttaaaatcatgggctttaaaaaaaatttggaattatttttcttccaatttaggctcaattgcaaaacctggagtttggtcaaggaaagctactttcaatgcgaagtgaagacagaacataaatcacaaagttaacgtcgaaaggtttctgagaagcctggagaaagatcaaacctaaaggtgaccctggaagtctggctgggaatagaagataaaaattcctttctttaatttccaaagttcactgattcacgagaaaagtagatatcttaaaaggacacggaaatgcaccaaaaaaaataaacacaacgatgcataactagctgttttaattcaacaccctctctcctgtgcctgacatggtatctctaccatatcctccaaaaagtaaggacaggcaaggactgaagtgtcctccttattgtgaaagggaactgaggtagagcctcctacagtggtcaactcactaacagcttaagctggacaaagccaagtcaatgtgtccacccccagttccaatgagtcaacttggtccattgattcagggcaaatcagggtgttcttaatcttctatccagggatgtcctttcagggatccagggacgtcctttcagggatccagcaacgtcttattgagcacttcaatgtttgttcatgtttcatgtctggaaatataaccttaatgacttctccgtgacattttattgattgattgattgactgacgggcagacaaggtcttgctctgttgcccaggctggagtgcagtggtgcagtcatagctgactgcagcctcaacctcctaggctcaagcgatcttcccacctcagcctcctgagtagctgggacaataggcaggcaccaacacgcccagctgatttttattttttagagatagggtcttgctgtgttgcccaggttggccttgaacttctggcctccggaagtgctggtattacaggcgtgagccactgtgcccagcctgtatgatgtttaattttgagtttctcattgcggcaagccatctttatttgtcgaatgtatttccttgcgataaaatcaggtatgcaaggattcacatatgtttctcatgcaagcacaccatttattcctccttatacaaacacttactggttaaaaaaaaaaagcagactgctaataaaggctttctgtacttcacatggattccaatggattggaagccaatgagccttggaatattagattgttattatccaataataatattctaagtctgggcatctcagattgagagaatgaaattaggcagacactcatctgaacaggtctggtgtacaatgacaggcttccatacctttttgtcatatttgtggtgtttcaagttgcaaggcagatttctccccaagttacacaggggacgtttggtatcacttggtttccattctctgaatactctatagaacactgtccaaaggggatgcatttgtcaggactgttgagttatgccattggttctaactaccctgaagtctcaggtgatgataaccccttagagacccagtgtattagtcagttctcacattgctgcaaagatactacctaagactgggtaatttataaagaaaagaagtttaatggactcacagttcagcatggctggggaggcctcccaatcatggtgtaaggtaaaggagaagcaaaggcacatcttacaaggcagcaggcaagagagctttgcaagggaacttccatttataaaaccatcagatctcaagagacttattcactatcacaataacagtatgagtcagttatctccagctggccccacccttgacacatgggaattactacaattcaaggtgagatttggatggggacacagccaaactgtatcacccaggaagacagagattctatcatcttatgatgctgccatatcaacgccagacctgagagtttgccatggtggggaaagatatggagaaccacacagcagctcttaaaggcttccatccccaaaccaacccacatcacttctgcccaagtttcattagccaaatcaagccatacatccacatctaacttccaagggttggggaggacattcctcttacgtgccagaaggcgaggagatcaggaaatattggtgaacaccagtaatgtccgtgcaccaaacgtttgtttgttctggctgtcctgcatccacacctaacagacagatgaaccaagttgggccaactgcaccctctctccagggtatcaaatccactgaagccatgttcatttacctgcaataccaagaaactcactgagtctagagatgaaagtctctctagagacttttgttcttgagtagagttatgtaagaacagagaaaaaaagggcttactcattctagcagattctagcagcctcatcttgctaatcctgtcagttaatttcctcttgtccagtccccctgaagctacccttgtttcctgcaccgtttttttctcagcttgtttctcgaactgtcctatgaacctgggcactaccaataccctcccaatgtattgcttttgtgcttagtattaagactcagtttctgttatttgtgccaaacagtttcccaaacagaaagcaaaagccaaaaagaaaataaacgcccaacagaagcaatttgctaggtgctctgagatatacacacaggtatgaacttgtagggggaggtaggaaaattgggttcctgtctcaggtctgtcacctgtcttgctgtgtgaacttcaacaaacccccaaattcatcagtaaaatcaaagtctgggactagttaatcttcaaagtccttactggcgccagcagacaatgactgtgccattttgggattgctgaaacaagcacaaaccctgtattttggtagctgattgaaacccaaaccaggccccacactttgacaaataacctgccaagtctccacatttgctgagaatcacattagcctaggaaatcacggattgcttatattttacatttcaaatgtgtagagatcttggcattgatctgagggtatgccatcaccctggggattcgtctcagcagcagggctggtattcactgcaaggaaccacgctcggtactcattggatgcctatatactgtgtagtatgtcctttagtttgtttgagaccagttggggtcctttatttgcccgtcagcttagtactcgagaggcagaaggacctgacatttctagaacattgtgatgtactaatatcaataaaagtaaattattattataaaacctcagctctccatctctgattagaacttcaggagctgggcagagagaaaaatcctaagtatgtctgtgcaggtgggtgtacagatgaaaaatgagatgactttccctgtgaataagtttcacctctgattaaaattctgcctagaatgaaagggcgatgtgctaagatatgaatgactcactaaatcagaagggcctctctgtacacattattcttcctgcctttggctgcaataaactctctctcattcttacattgataaaaatggaggttttcaggatatcctgccccgataaagtaacgacgaagatgagtttccatcaggagcatgggtgatccttgtctttcatacacatgaaggggcttcaccaaatcccagaacaccacggtgagaggaatttcaggggtcactgattccataggctatggtcagggggcagtctctgcttgtggataattttttcctctctgcaaagctaactgggtgaaacgggctcaatcctaagatctggacctcttcaatccaggactaactaagtaggacttgcactttaaagcggacctcagtgaacgttagtcttctgtgtgggatgagaagagaaaggcttaagtggccggccaaacagaacggaggtccagctgcctagtgatttcagaagatcctgacaagctatgtcttatggaacctgagactttctgctgtgccagagcccttgttcagttcctcagcaaattctcagtggtcccagttgatgataacagacagtgccctgccaaaccaaagttcctggcaactggaaggtgtagttgctctaggatggatctcaagtgtttccaatgcagttttcctgttgaacacagttacaaatgtgataccttgcagcaacttaaaaacacagaaaccggccacacacacaattcgtgcatgtttgtgtttagtaccagaaatgtggcttgtaacttttctgtctttaatacaaggtagggaatttttaaaacaatccactgcttccagctttggctctttctcaggtaggactcacccagtagatataactgagttcccgctgaacttggcagtagagagcgaacccaggaatttggcaggaagtaagttatgactgcacaacctgagaagctacacgtctgactcaggatgccatgggtttgggggttgggattattctccagatcccaagaatccatgtccaatgattcccttatggcctaaactattgatctggcagtactgagtttggttttcagtattcagttccagggcatccacttgtaaaaacaatccataaatgagattctcagactcagcagtttctgccactaccgacttgacggactaagccagggctgtgattgagccagaattccttggaggagaagcctggggtgctaagctgattgtgaagcagcacccatcaagtggaggctgaggagagcatccaggataagcacttgcaggtgatgagctgcgagtgtttatctacttcgtcaactttaataggaaaagaacaagaccaggatgtgcatgatccactcagggttacctcgtcccatctggttgcagctgatgactttcaccagaaagaggaaaagtgaaaagtaaagagaaacgaggagctggccaggccagggcatggaagatggccttcatcaatttccaaattctagcagtaagtcacttctactgtgcattaggtgagttctctgcactttgccacagaaagccttatagccactgttaggattctatgagctggcttctgaaacctcctttagtggcaaattcttcaaaagatcagaggggcagcaacccctgaggataatatttcagccgaggagatgaacagtgctcattgtaggtactaactatagaattcagggccaggcttctctctatgtataagaaagaaggatgttggtggcaaaagccttcccactcccatagtacaatacaagttgcaaaaggttttattgttttttaaaatgtacttaatgttttagagacaggctctccctctgttacccaggctggaatgcagaggtgcaatcctagctcactgcagcctcaaactcctgggctcaagtgatcctcctgcctcagcctcctgagtagcttggactacaggcatgcaccatcacacctagctaagagatacagcacctggtattcacaggtggtctcccatccatgcactaaccaggtctgaccctgcttaacttctgagatcagaaaagatcagtcatgttcacagtggtacatctgcagatgctacaaaaggttttaatacacattatccattcgagcttcatcacaagcctgtacaaggagtgagttaggaatcattgtccctggcttatggatgacagaaatgattgactgaggtgaaatagccagtccaagtttatgagctagtaagcagcagaactgaaattctttcacaccatttctccaaaagcaaaggttttgttttttaacttttaaattccggggtaaaagtgcaggtttgttacataggtaagcttgtgtcatgggggtctgttgtacagattatttcatcacctagatattaagcctagtatacattaattatttttcctgatcctctccctcctcttaacctccaccctccaaaaggccccagtgtgtattgttctccactgtgtgtccacgtgttctcatcatttacctcccacttataagtaagaacatgcagtatttggttttctgttcctgcgttagtttgctaaggataatgacctccagctccatccttgtccttgcgaaggacatgatctcatccttttcatggctgcatagtattccatggtgtagatgtaccacattttctttatccagtcactgatgaacatttagattgagtctgtgtcttggctattgtgaatagtgctgcagtgaacatattcgtgcatgtgtctttataacagaatgatttatattcctttggtatatacccagtaatgggattgctgggtcaaatgatatttctgtctttaggtctttgaggaatcaccacactgtctcccacaatgattgaactaatttatactcccaccaagagtataagtatcccttttactacacaaacttgccagcatctgttatcttctgactttttagtaatagccattctgactggtgtgagatggtgtctcattgtagttttgatctgcatttctctaatgatcagtgatgttgagcttctttttcctatgattgttggccgcatgtatgccttctcttgaaaagtgtctgttcatgtcgtttgcccacttttttattatgcatccaacaaaagtctaatatccagtatatataaggaacttaaacaagtttacaagaaaaaaaataaagtttgcaaaatggttttaactcttactgaaggatatataccctacaactaaacaatggtggcaacaggacgctggtacacaaacacttcctgtgttttgtttaaggcaacatcacaaagggattagtctctccactgccctgggtctctccaggtcaacgttcaagaagcctaaattttctccttttgcaacctgaattctctattataggcctaatctcacccccttagggggccaaggtctccagtgcaacaaaagcccaagagaggattaactctcaaccacacttgcaatgactgccttagaaatgagaaaagcaatgaggtcatctcagtgggactttctttcgaaaagaggtgaaccaattaagtttttgacaacccctttcttctttctcacttcttcctcacatcaggctctgaaaccaaatgtctaggaatgaagacatggcctgctgatgtcaagcaactatgtattaaaataccaatctgggccaggcacagtggctcatgcctgtaatcccagcactttgggaggctgaggcaggcagatcgcaaagtcaagagatggagaccatcctggccaacatggtgaaaccttgcctctattgaaaatactaaaaaattagttgggcatggtggtgcatgcctgtagttcccgctactcaggaggctgaggcaggagaatcacttgaacaggggaggcggaggttgcagtgagccaagatcgctgcattgcactccagccccgcaacagagcgagactccgtctcaaaacaaaaaccaaccaaacaaaaaaaaaacccaatctgcccaagaggtagagcagggccctgaggataaggaactacctttagtggacccagtttacaatttcttgagaaagaaaacccatccctccaacccatcctcccaactcccaggattagaggcaccactgtcgctgcaaatctgcagcaacatgtgtctagcagctaaaatgtcacaacccaagccccaccgtttctggaaatgacttagagcaacagggcaataagacaatagcattcttcctccctgtcctgtccctccacttccacctccaatccagcaaatcttaaaatagtgaatttccctagacatcaatggtaaggattatttgtttttaatgtgggatgtgacacttgagcgaagattggaggtgggttctagaaacacaaagggatgttcccatcaaggttgcctaggatagtagtataagaaagaggatctgagtatatactagcgatataaacatatctgttagtcaatcaaacattcttagtccaggaagagagagaagacttgggaggtaaaatgtagactccttcctcagagaagatggtgaatcaatcgcctgaaaccaagcagaggacaggtttgatacaaatgtgattttttttaatcaagagaagagtcaggcaaagagtgggcagaggagaagaaaggcatcaatgattttctggataaagaaaatgtggtacacatacaccatagaatactatgcaaccataaaaaggaatgagatcatgtccttgccaggaacatggatggagctggaggccattatcctcagcaaactaatgcaggaacagaaaaccaaataccacatgttcccacttataagtgggagctgaataataagaacacttggacacagggaggggaacaacacacactgggcacctgtgctgggggaggaggaaaaacatcaggaagaatagctaatggatgctgggatgatctgtgcagcaaaccaccatggcagatgtttacctgtgtaacaaactgcacatcctgcacatgtaccctggaacttaaaataaaagttgaagaagcaagaaaaaaaaaattcttgcgatgtaagtagcataggttctgaacatccactgagtttctttccctgggccacagacagtcttctgacgtggtaccatcatgttgtctgaggacagctggggtttttatcagactgtgagggcattccacagggagttaggaacaaaaggtcccattttccaccttatagctcacagagaagacaaacaccaacatatttcctctaaagataatggatttaacagcctaagaaatggtaatgagctagttgagaaggtgcttttctgagatgtggaaaccttgagctcagagcagcaaaagcacagtgctgcttcttccaggagatttcactggaattgtctcatggcccattgatacatttggaaatgccatcaaaggctgaggaactttcagaaacaacaggatgaggcaggttgccagaggtcaaagggtggtagaaatggggagacagatgttggtcaaaaggtacaaatgttcagttggaagatgagtatgttctagaggtctaatatacagaatggcgattattgttaataccactattatataattgaaacttgatgagagcagattgttaagtatcctcgccctacatgcatacgaaatggtaactataaatggtgatgaatatgctaattaattgattgctgtattagtccattctcacactgctataaagaaatacctgagactgggtaatttataaataaaagaggtttaattgactcacagttctgcatggctggggaggcctcaggaaacttacaatcatggcggaaggcacctctccatggggcagcaggagagaatgagtgcaagtggggggaggaaatgccagatgcttaaaaaaccatcagatcatgagactcactcatttttatgagaacagcatggggatgattcaattacctccacctggtcccacccttgacgtgtggggattattaaaattcaaggtaagatttaggtgggggacacagagccaaaccgttacaattgtgattatcttacacaaagtatgcatatatcaatcatcacgttgtacacattgaatatgcacaatttttatttgttaactatgtctcagtgaaactggaaaaagaaagaaacctcagatatgaaaatccagagtcacgaccaaatgtgtttagggtcgatggcatgcattataaaatgattctcttcaatttcttattttcctccagtttcctcatctataaaatttggataataacccctgacttgcctagaagataggaattgcataaggatcaaattaaatcatgcacaactgagtgctatgtaaaacacacagctatacttgcttatcaccattcttaggaacattaaaacactgtacacacacatgtgtgctgcctggctgaattactttcatgaggacctgagaacaaagtgtctcttgccatttttatccacctgaagactctcgaagagtcgtgaggcaggttactgacaaaattgcttcctttgaaacaatgcatctgtgtgaatcaggatttctcaataatgagctgatctaagactgaaattcagcaaaaatgctaacagctctgggcctcaacttattccaactgtaaaatgggaacaataactcagcccttgtagggtttctgatgatttaggaggtggggtatgtagactgctttcctactgggagaactgaggcatgccaaggtttttgcttgtttgtttttgcctgcaagcacaagaatgagaaaatctggagggagaaaatgttggcactaggcctgaaattcttgaagacagtgtgggaagcaaagacccccttcatcttctcaggcacaaaatgcacgttcccagaaggaagaaggtcaacctaaagcagcctagaccaaggacatttgctgagagtcactagggaaaggtcattcctactgtccaccaaatgcttaatccagcccccagctccttggaattctatccatctcttaaagccatgttcaagtcttccttcctttgtgagacactcccagacctcctcatttggaatttccattgttttcctagttctactttctttggttgcattatataacatgctttatggtttgccatattttattatttgtgggcatcttaatctttttaagagactttggagagcaaggagcatgtatttttcatctttatgtcccttatactgctccataatgatgtctgcttttgaatgaaatgtgtttgaaatgctcacctcatcattcatttaaagccaattctataaataagcaatgagggctgtctttgccatcaccacctaatgcccgatgctgccacgcttcttaacaggcatcttatcttcagactggcctcccagattcatcatctttaaatgccattttaaaactccttattcaaatttcccactcaaaatcttttaaaggcttcacaatgcctacatgataaggtacaaacgtcaaagccttgaatgtaagactgtccaccagctggctccaatccagctatttaaactcatttaacccacatattcccaaagcagtgggctgacttcattcattcattgattcgtgcatttcattcagcatggattgaatgtcccagtcattttcatagtcattgtgttaggtggtagagatatctataggaaaagacatagtccctgatctcaatgcagttatcatccactgagttggcgggaagtaaagagaatattacaattttaagtgatagtagctataacagaacaatgtacaagagacactgtgagtatggaaaagctggggcccaaactggcctaagggagtcaggggagtgttagtaaaagaagaacaaaaggaagactggttttccaggaagacactatggtggagtaaagagagtgcatttgaaacagagagaaaataatatgccccctacacatacacacacacacaaaaaccctacaatgatgctacaagaatctggtataaagttaccagtggtccgcgaggacctagttgaagctgaactcaaactaaaagggatttcttgtgtctgtaagtggtatttattatctaatgacagtatttcccgatgtgttcctgagcctggttctgagaggcacagtaagtagctcaccatgacggaaagaaaaaaatatcattctgtggtcataaaatgtctgcagagtaaacacatgcttttctccttcttgggaaggtacaatgttcaaaagcatatgaaagcttctgctaagtcttgcaataaaacaagctgtttaaaggattgcagacatgtttatctatagagtatcatgccactatgtacttcctgcagaatgagatccaaggaagagttttggaaacaccggtctgtatctgtaacctgctctttagatgcacctgtactggcctgtaaatagtttatgaaggcacaggcttcaaggacaaacacacttgattttaaagcttgtctgcatcacttagttactgtttgaccttggacaaattagttctttttttttttttttttttttttgagatggagtcttgctctgtcacctaggctggagtgtagtggtgcgatctcggctcactgcaagctctgcctcccagattcacaccattctctcgcctcagcttcccgagtagctgagactgcaggtgccctccaccacgcccagctgattttttgtatttttagtagagatggggtttcaccgtgttagccaggatggtcttgatctcctgacctcgtgatccgactgcctcagcctcccaaagtactgggattacaggcgtgagccacagcacccggccgacaaattagtttttttatggacagtttcctcagttgtaaaatgggcataatatgtactttctccatgtgtagttttattgagcacatatgcctgacacatacctgattaaacattttcttttcattattagtggcaaacatataagctgaactaggtataagaaccttgcggcaatttctcaaggatctataactagaaataccatttgacccagcaatcccattacccaaaagattataaatcattctacaataaatacacatgcatacgtatgtttattgtggcactgttcacaacagcaaagacttggaaccaatccaaatgcctatcagtgatagactggataaagaaaatgtggcacatatacaccatggaatactatgcagccataaaaaaggatgcgttcatgtcctttgcagggatatggatgaagctggaaaccatcgttctagcaaaccaacacaagaacagaagaccaaacaccacatactctcactcataaatgggagttgaacaatgagaacatatggacagagggagagatacatcacacacacacaccgcagcctctcagggagtgggggtctagggaagggagagcattaggagaaatacctaatgtagatgacaggttgatgggtgcagcaaaccaccatggcatgtgtatacctatgtaacaaacctgcatgttctgcacatgtaccccaagacttaaagtataataataaaaaaagaaccttgtaagtaagttatatagatttgttcctcttttagcattctagcagaatttctttccaatggctcaccagtgattcttatttactgatacttaaaccttggcacaaaaggattccctgaaatattgcaattatataaatgagaagagaaagaagaagacaaaaaaccaccttaatacatatattatcaggatggactgattttcctaagtgaggtgccataatattcagaataaccccaatgtcccttactggctgaaaaataaactatgtaaaaaagaaatatctaccacgttaggattaaaattatggcatttagtgtggaagaaatctgaatctgcagatttttaaaagtaggtgaggaagtgctctcttccatgtctagcctgggacacataatctgtccttggtccttggctttgaaaaccctttctcactgtacctctgcaccatcccccccgccgccatcctacccccttcccagacacatcctggccaactcaactcatccattattttcttcaaaaagttgtccttgactccccaggttgaggcaggtaacaacctttggttcccatagcctcctgtgcacacatttccattaggcaacaatgagtgcgttcttactgagtggccgttatggccagggagctggagatgcaattgttggccaaacagaggtgagcctgccctcagggagcttactgtctgatgcaggcagcacataccaaacaggtaaacaggtgagtcaggtatggtcacaaatggagacaagcactatgagcaaataaaagagacgttataattgaaagtaaaatggattctcttttaattacttatcttgtctctttggcacgctatgaaggatttgagtgtaatatctggttcacatttgcataacttggcatggcaatgtgcctgtatacattgagcaagaattaactgcctcatgaataaacgaaagaatgaatgaattcaacgacaaagctgagacctataggactagcctacagtgacaactagttagtgacaatttaaagtccccttcatttaaagtgagtatatataattatatttatttatatttacatataaatatgaatatatattaatataatatataatatataaatacacaatatataacacacagaatatattatatataaatatataacacacagattatatataaatatataacacacagaatgtattatatataaatatataacacacagaatatattatatataaatatataacagaatatattatatataaatatataacatacagaatatattatatataaatatataacatacagaatatattatataaatatataacatacagaatatattatatataaatatataacataccgaatatattatatataaatatataacagaccgaatatattatatataaatatataatatacagaatatatataaatatataatatataatatacacaatgtatattaatatataaacatatatattaatatatatgtatatatttgtatataagcatatacaatgtgtgcttatagatatatgatatgtacatatatagatctatgtatccatctatctctatgtatctatctaactacactatactatactatactatactattctatactatactatactatacagccagcacatccaaacaacctcttaatttccaggcctaagaaatgggtaattttgggtactcaaaatttatttttggcccagccctggctgctgttctttgttggtaaacaagtgagtagcttcaaagtggactttacaccacgcaatgtagagaaggcaccctttatgctcatttgttctttctgacagaaaaagcctacagccaacctcagaatgattacttctgtgctctgttgatgcttgctttcatttggctgtttggttctgccaggccctataaaaacacagatataatcaacggcttcaaaggagaactagctagcttgaaggaagaatgcattttatttgggaaatggtggctcccctatgcacttgtgattaaagggggaagaaaacatttgtgattcatccaattaacctcaatagtatgtcattcaagcaaggtccagacaggagtctcactctattattccaaatctttcattaaaccaattccatctgcagccagcactttcctgttttcccggtgcattcttgtgattacctaatttaaataaagagctagtttattgtttttcctgggtgccaggaagatttagagcaatgacctggagcagggataacattctcatgtaattttcagaatttacaaaaagtcagaaagtgccctcctaaggatgctcatatccttcctggagacagctagacacagatgcacttttttagagcaccacaatagaccacagtgttcccctccctgtggcccccactaacatttgatttttaaaatgtcacccatgttagcatggcctttgaaggctctgcaaccagaagtttgcagtccaagattaggatttcagggctgggcatagtggctcacacttgtaattccagcactttgggaggccaacatgggtggatcacttgaggtcaggagttcaagaccatcctggccaacatggtgaaaccccgtctgaactaaaaatacaaaaattagccaggcatggtggcggccacctgtaatcccagctactcgcggggctgacgcaggagaatcgcttgaacccaggaggcgaaggttgcagtgagccgaaattgcgccatttcactccagcctaggcgacaagagtgaaactcagtctcaaaaaaaaaaaaaaaaaaaaagattaggattaggatttcagatctttttaaaaaagattaggatttcagatctttttaaaaaagattaggatttcagatctttttgcagtgactggtggaacccacctctgcacttcagaccagcctttccagatatagaatatatttccttggcgagaggtataaaattaacctttacatttttaatataatacttaatatatacaaaagaatgtttatatattactttcaaggcaatgatcataataaataaaacacctatgaaattcttatccatctgaagaaccagaacacacccaatacgcttgaagttatagatggggtctttccaatccatgctatctcagataaaacaatatctgaggtttgtgttcctaattccttgtttttaaatagctgtaccttaatctgtttttctctgtattttttttttactctatctgccttcatgatatctgtttacctttggttttcagtggtttgactatgatgtctatcttcaaataatacaatgctcattacacataagagcctgaaaacagtattctcctgatttttttctctccaatcttttgttctattgttgtcaatcatttaactttgacatgtgctacaaatacattatgtcttaaaactattaattgctttaaataattgctttaaaggatcaattatttttagggtgaatcaatagaaattgatttaaaataaaatcaacctttagatttacaatgaaataaatttggccgggtgcagtggctcacgcctttaatcccagcactttgggaggccgaggtgggcagactacttgaggtcaggagtttgagagcagcctgaccaacatggtgaaaccctgtctctactaaaaacacaaaaattagctgggcatggtggcacatgcttgtaatcctagctactcgggaagctgaagcaggaggatcgcttgaacctggaaggtggaggctgcagtgagctgagattgtgccactgtactacagtctgggcaacacagtgagactctgagggggagagagagagagagacaaagaaaagcaagcaagcaagcaagcaagaaaagaaaagaaaagaaagaagaaagattgatttatattgatttgcctttcaactattcctagaaattcttattctttatgaagatgttaagtttctcccattatcataattgttctgctttaagaatgtccttcactattttttatagtaaaggtctgctgctaatgtgttctcaaaacccccctcctattttttgggtttttttggtttttttttttggttgttgtttggtctggaaagtcattatttgtctttagttttaaaaaatattttcctttaattttaaaaataattcatttttaaaatattttcctttaattttaaaaatatagacttctgggttgacagattgggtttgcatcagttatccatttattgcctctcagctctgaatgcatcttccaatacaggcaatacaataaagtgtgagaagcaatggaatccctttgagcatttctcctttaaagtcagcaggatgttgagctttctcggtagagggtgctgaagccaaactggagaaagaggcattctgcaattcctggtgtcatccaagaggggtcagtggtgcagtttgttgttgtttgaaacggagtctctctctgcggcccaggctggagtgcagtggcgcaatctcagctaactgcaacctctgcctcctgggtttaaatgattctcctgcctcagcttcccgagtagctgggagtacaggcacctgccgccatgcctggctaaggtggtgtagttttgaggacaactgtcacaactcagatcgtggtccctctgtggccttgaagcctcagtttggcaataatctttctgcagccctctcaacacagaagctaactccccacatgctcgggctccctaagcaagcttcctcctctccccaaccccctaaccaccacagcctgcacacagctccatgtgtccccgatgagcatttcgcaagtctccagatacccaagcttgctccttcagcactgaaagcctttgcccctgccatcatccagattcccactgcatactgcttcacagccagcactccagaaagttacctattgcttgcccagcaactccagaccagatcttttctgatcaaaccaatgagcttctccactacccagtcatcggaacataccatctccaataggcctattggagagcaaaccctatccatgcttgttctgctgattagacccattctgttacagggttctctgagcatcttggatctgtgatttgatgtcttatattatttgtagatagtgttctgctattatctcttcaagtaggttgtctgtccctatctctttctaatccttctggcattccaattgtacaaatttcagactatctgatattagcccgttgatcttggatgctctatattttttaaaatttattctttttacctctttgtgtttcatttggtcaatttctattgattcacctttaagttcataaattttttctttggctgtgttaagtccagtgataagtccatcaaagtcatttttcatctctgttattgtattttttatttctaagattttctttagactctttcttataacttctgttgaaattctccaccatgcatattgcctactttttccataagagcctttaatatattaatcgtaggtattttaaatttcccgagagttcaaacgtctttgtcatctttgagtctggttctgttgattactttgactcttgacagtgagttgttctgtcttgcatttttatttgtcttgtaactttttattgcacatgaacactgtgaggtatgatagtagagaataaagtaaacagtacttttgcttggtctgccaacataaagaagagtctactggaattgatctgggtttagcctttgttgttgctatggttaccttcagtatactaccagtctcaaattttttgtatgtgtttttttgagacagagtctcactctgttgcccaggctggagtgcagtggtgcaatctcagctcactgcaacctctgcctcctggactcaagtgattctcctgcctcagcctcctgagtagctgagaccacaggcgtgcaccaccatgcctggctaatttttctattttcaatacagatggggtttcaccatgttggccaggctggtcttgaactactgacgtcaggtgatccacccgcctcagccttccaaagtgctgggattacaagcatgagccactgtgcccagcctcaaatgtttttaatgtaatctagttctttggatggggtatgtgttgcatgtaagctgtttctaatattcctgtttatcccttagcttttgtctttctctgtgtgtctgtacctcagagaaggtcccttttttatgctcttcctcttctctcagtgatagattgctactgttacttgatgcctgctggtctagtagtggtgtataggagaagacaggtctctgttttcctagtccagccttggtcttaggaaggccctgtgtccctaagtcttgcagatcaggttttctctgtaattctgatcctcctctctgtagcagccaaatgatgtcttgaatctttggtggcccttgtgaacgggagagtttcttgctcttcccccagtggtaggagatctttaatggcctgggtcaaacacccaggaatggaagacttttcccttttctttctgcttccttgctgcaatggtctttacctgtgtcctagtgaccacaaggtttgctccccttctccagcatcctaaggcttttgatccttagaggactgaccttggtgagaatctgtgctttgccacagaagtgacactcatctcctctctgtcttcaatatggaggagggctttctctcacctcctgccccatcaccaatctttcttgtgagtgcacaacggaggtccatggagaataccctgtaagtgggcgcaagcctatattctcatgcaagtccaccccacgacttcagaaatttgtttaaaaatttcactgaatgattctctcccactgtatggcacctggcatctctacctccttggtttcccatagatgactcaatggttgtgtccaatctctccttgggaatgcctatctttccattgacttcaggccacccaattgccctggggcttcaattctctgagaggtttgccattacttttaatggcaaaaaaaaaaaaaaaaggtctgtccgtgttttgtacagacacaattttaccccgaatatttttgatccacggttatttgaatccatggatgcagaacccgtggatacagaatgccattacttttaatgtcaaaaaatgcaattacttttgcaccaatgtaatagttcacataccatatctttcgcttaaagtatacaagtcaatggttttttgtagagtcacagagttatgccatcatcacaacaacagattctacaactgatcttagaacacttttatcgccgcaaaaagaaatattctaggcctggcgcagtggctcatgcctataatatcaccattttgggaggctgaggtgggcagatcacttgaggtcaggagctccagaccagccaacgtggcgaaaccccgcctctactaaaaatacaaaaatacaaaaaaaaaagaaatattcttgattttcacctaccccccacccccaaacccgccagcaacccctgctgctctcctaccagggacccacttccctgctttctgattcaatggattcaccgatttttgatgtgtcatgtaaatggaattatatgatatgtgaccttttgggtctggctacttccacttagcataatgttttattcacattgtagcatgtaacagaatttcatttttttaatatttatttttccaacttttaagttcaagggtacatgtgcaggatgtgcaggtttgttacatagttaaacacgtgccatggtggtttacctcagatcatcccatcacctagatattcagcccagaatccattagctattcttcctgatgccctccctcctcccactccccaccctctgacaggccccagtgtgtgttgctccccttgatgtttccatgtgttctcatcattcagctcccacttacaagtgagaacatgcagtactggtatttggttttctgttcttgcattagtttgctgaggataatggcttccagcttcatccatgcctctgcaaaggacatgatctcattcctttttatggttgcattgtattccatggtgtatatgtaccacattttctttatccagtctaccattgatgggcatgtaggttgattccacgtccttgctattgtgaatcatttctttttattgataaataatattccattgtatggatatgccacttttgtttattcatcagctgaaggacatttgggttatgtccactttttggctattgtgaacaatgcagctatgaatattcttgtatatggtttttgtggatgtatgtttttatttctcagtattacccaggagtgaaattgatggagtatatggtaattgttcagccgtttgagggatgccagactgtcttcccaattggctgcacaatttgcattcacagcagcaatggatgagggttccaatttttccacatcctttttagtacagctgtccctcggtatctgtgggaattggtttcaggacatctcatggataccaaaatccacggctgctcaagcatcttatataaaatgatgtcgtatttgcatataacctacgcacatgttcctgtatactttaaatcacctctagattacttacaataccgaatgcaatgtaaatgttatgtaaatagttgttatattgtatggtttagggaatagtgactaaagaaaaaaatctgtacatgttttggacagacacaatttttttcccaggctatttttgacctatagttatttgaatccacagatgcagaacccacggatacagagtgccaactgtacttactggtatctgtctttttcaatatagccatcctagcaggatggtgtggtgactcattatggctttgatttgcgtttccttaaagacataatgtcgaacaccttttcatgtgattactggccttttgtgtatcttcttaggaaaactgtattttttagatcgtttgtccatcctttctgtatgttgtctttctatcattgaaagagttctttatacattctagacacaagccctttataaagctatatgatttgcaaatatatgcaccccatggtgtgagttgtctttttagcttcttgatagtgtctttttaaatttttaatacactttttaattttgatgaagtccaatttgcctattttatctttggtcccttgtgctttatgaacatttgctcctatatttacttctaagagttttatcgtttcagatctggaatttaggtctttgatccattttgagttaattgttgtgtttggtgtaatgaagcagtccaacttcattctctcgcgtgtgtgtattctggtgtcccagttccagaaactcttctgcgcttctcacatgctgttttctgggtctcgaaactccttcccttctcttctccatctttaaaatgcttaattgcttttcaagtgcagcataacccatgccaaagtcttctctgacttctttgtctaatttagatgtcccttttggtacttttataacaccgtacatgtttctagacagaggtctgcaaacttttttttctggcaaagcgacagattacaaatatttaggctttgtgtgccagaaggaaaaatcaaggaaactgtggaggtacttaataagagagaaaacaaatttccaaaaatacttgtattgatgaaattaacaaataataatagaggtttttctttttgaaatgtgggtacatgaataagaaaaactgaattctttttttagaggggataacattttgcttaattgggatttaaagttagttcttcctatcatcaaattggtagcatatgttcatctgtgaaaaccattctcttttttttttgtttgagatggagtctcactctgtcacccaggctagagtgcagtggagtgatctcggctcactgcaacctccgtctcctggcttcaagtgattctctttgcctcagcctctggagtagctgggattacaggcatgtgccacaacacccagtcgatttttgtatttttagtagagacggggtttcaccacgttgcccaggctgttcttgaactcctgagctcaagtgatcggcctactttggcctcccaaagtgctggaattacaagcatgcgccaccgcgcccagctgaaaaccatggttttcttgggccctacgaaaacaggtagtgagttagatttggctgatggactgtaatttcacgacatggtagtaggtcagtagttctaaccctttctttcaaagccgttgctactgagggatacagtgcaatcccagtcataactgtggatagttagacagggattctctttgaggagggtgatgatgggaggcttacggtggcaggaattacagattatcttaatcaataatcattcttctgatttgtcttcccaaagtgtagaggagcccaaaactcatttcttagacttctttgcagcaaggggtctgccagcctagcacactttacatcaaaccttgatttggaagtgagacacatgagcagagaatcagggcagttggcatgcagtttgccagtgtgaatgatgacactgctggtgtgattctggaactggcaattaaggtggtagcttctggattcagcaaacggctcactgaatcaccagcttttctgttgtgccactggaggtagccgccttggagtcccaggttgtcagtgtgctttggagagtggttctgggaaactaagaccttccaacaatgctgtgacccaagacccctaataaatgttttatttatttatttatgtcatttctctgtcacccaggctggagtacagtgatcatagctcactgcaacccccaactcttgcgctgaagcgatcttcccaccttaacctcctgagtagctgggactacaggcacacaccaccatgcccagctatttttcatagagatgaggtctcactatgttgtctaggctggtcttgaactcctggtctgaagtgatcctcctgcctcggcctcccaaagtgctgtggttacaagcatgagctatcgtgcctggtggtaaaatggtttaaactatattaacttgaatcttttgtctacaacttgactataagaagtatatgtgccgggcagggtggctcacgcctgtaatcccagaactttcggaggccgaggcgggcggatcacaacgtcaggagatcaagaccatcctggctaacacggtgaaaccccgtctctactaaaaatacaaaaaaaaaattagctgggcgtggtggcgggcacctgtagtccagctactcgggaggctgaggcaggagaatggcatgaacccgggaggcggagcttacagtgagccgagatcgcatcactgcactccagcctgggtgacagagcgatactccatctcaaaaaaaaaaaaaaaaagagaagtgtatgttagaatctaggggggtatgggaagatttttattctgatacgcttctccccattcataatcactacttttgacaattccagatagggcgcatgtcacattgatgtaggagttaagaagaaactacttaggcagatagtgagggtacaggagtccttggtaaggtctccctttttaacgaaaagcagcccccaaatcatattctaacaaagagcagcctgcaaaatcgagctacagacatagacatgcaagctagaagcttgcatgggtgaatgccatcaagaaaaaagctacctgggactaggcatgtccaaaatggtggccccatcttccctcctctttgccagccgtatgtacagtaagaagacaagatggcgccagttaagtgggaaacccatttgcataataagagtagggtgaggtggccaggcttccctgcgtggtacgtaaatgtcacacctgatggaaccaatctgtgggtcctacataaagaagacactgcctcctcaagcctgcttataaaatctggtgaacgccgccgccggctggtctttcctttcggaagcccctctcactagagagggagctgttctcctttctctttcttttgcctattaaacctccgctcctaaactcctcatgtgtgtccatgtcctaaattttcttggcgcaagatgatgagccctgggtatttaccctagacaaccacaccgcttcaacatcgtaaaagaaatggttgctttgcttaacactcatcaagtcacaattttgtgtgggcaggcactttgtcttactcacctctgaatccttggtgccaggcagtcagtagaagcttaacgaaatgtgcatttctaggtttttatgttctagaattaattctctatataaatcttagcttatctcccagtgagaatgtaagttattttatgcggagagactttaacataaggtatcataagtcacacggtcctgctgtgctaggttcggagcagtattgataattattggccttagcagggtcaagggattatcaacaccagggccaggcaggtgacgtgagtgagtgacatgggatgactgcaacacaaaaggggtggcaaagatcaaggaaacctcaaatgtatgtacgtgcaaaggaagcagcttcagtcgggggctgccatatgggaatgtaggttcactctttacagaacagccaatctgagtttttgcattgaagctccctatttgaaaatgctgatatcaaatttttttaaatgtgacttatatttgccagacaaaagagggctgcaggctggaactggctcatgcaacttctagctaaaatagttctcccgacacctcaaaagattgtgaattctcaaagaaagataatattcaatgagaattgttctttcttagatcccatatctgaaggtgttctgttaagtggaatagagaaaactgtggaagattgttagtacttatgggatgtgtgaagtcactggtatagtcactgattatcttagtctattttgcattgtataaggaatacctgaggctgggtaatttataaagaaaagaggtttacttggctcatggttctgcaggatgtacaagcatggtgcctgtatctacttggcttctggtgagacctcaggaagcttttactcatggtagaaggcaaagggggaacaggtgtgccacgtgacaagaaagggagcaagagagatgccaggctctttttaagcaaccagctcttgaatgaactaacagaacgagaactcactcattaccatggggagggcaccaagccattcatgagggatctgtccctatgacccaaacacctcccaccaggccccacctccaacactgagggttgtattagtctgttctcatgttgctaataaagacatacccaaggctgggtaatttataaagaaaaagaggtttaatggactcccagttccacatggctggggagacctcgcaatcatggtggaaggcaaggaggagcaagtcacatattacatggtggcagagaagagagagaacttgtgcaggagaactcctgtttataaaaccatcagatcttgtagcacttattcactaatacgagaacagcacagtaaagacccacccccatgattcaattacctcccaccaggtccctccaacaacacatggaaattatgggagctataattcaagatgagatttgggtgggcaaacagccaaaccatatcagggtcacctttccatatgagatttggaggggacacatatccaaactgtagcactggtgtagatgttgttgtctaaggatctagagtagatgaaaaagcttgaggggtccaggccaaggcaatgatgaggctttactgaagacgaactagacagaaggctgctaacattggtgtgaatctggcaaaggagttgtttcagctcttcccagagcagacagcaagcagggtgcaggatagcagtgggttaaacaagtgaaagaaggaaaaagtgcttctggccctaggaaggaaaaaatgggaggtctttctgccaggaatgagactgtctgcagagtgaattagcagtggtagatggattcattaaaaggcatccctctaggccaggtgcggtgtttcaatcccagcagtttgggaggccgaggcgggcggatcacctgaggtcaggagttcgagaccaggctggccaacatggtgaaaccctgtctctactaaaaataccaaattagctaggcgtggttggcgcatgcctgtaattccagctattctggaggctgaggaaggagaatcgcttgaacccgggaggagaagttgcggtgagcggagatcgcacccttgcactccgcctgggcaacaagagcgaaactccgtctcaaaaaacagaaacaaaaaacaaaaaacatccctcctcctgtactgccagggcactgcttttcattttccatctttcagctgtgagtgaaatgaagacacccatctgcccaatggtagtcttgaggttgcgggatgcttgaccacaaaatgcaatctacaggttacatgtaccttctgcagcttttgcttttagctaaagctttttctgtaacctcattttggcagtgcaggcaaggagggagtgttgacctgtcagtgtagtagagactcccaggtgtcctgggtgaagttgtgcagagcatttgggatgttcttaaaataataccctggaagttcttctctgcatgaccagaagccatgtcagaactctaatggcatcacctgctgagttagaaaaaagtttccagaaaccacaagtttgatttcataataaacagcttctcagggcctcttcggcatggctacataaatctactgcttaaaaatagatgagtggactgggcgcggtggctcacgcctgcaatcccagcactttgggaggctgagacgggtggatcacgaggtcaggagattgagaccatgctggctaacaaggtgaaaccccatctctactaaaaatacaaaaaattagctgggtgtagtggcaggcgcctgggcgactgagcgagactcagtctcaaaaaaaaaaaaaaaaaaaaagatgagcgtagagccttgcttcactcctctggcactgtacaccaagctggaagggccactgatgatactggaaccatcttctaggcccctgggaaattctgggggaggtcaacatggacactgagctctagggcgtgaagattccatttgtctggtatggggctgcagcaaaggctggaaggtgggtatttgggtctcatctgctgaactgcccttgtttctaaggtattcttccccaacccctgttatctactctcctgaaagcttttttcaatttgatccccacttccaaactccattagtcatatggtctggctctgtgtccccacccaaatctcatcttgaattgtagctcccataattcccatgtgttatcggagagcctggagggagacaatttgaaccatggaggcagtttcccccatactgttctcgtggtagtgagtaagtctcatgagatctgatggttttatcaggagtttctgcttttgtatctccctcattttctcttgctgccaccatataagaagtgcctttcatctccagccatgattctgaggcctccccagccatgtggaactgtaagtccaattaaacctctttttcttcccagtctcaggtatgtctgtatccacagcatgaaaatggactaatacaattaggcagctctttaaatatctatctttctaatctatatatcacacgtaggaaaccctgtctctactaaaaatacaaaagtagctgggcatggtggtgcatgcctgtaaacccagctccttgggaggctgcttgaacaggagaattgcttgaacccgggagacagaggttgcagtgagctgagatcgtaccattgcactccagcctgggcaacaagagtgaaactttgtctcaaaacaaaacaacaccaaaaaaaaaccccatacgtatttatatgtgtgtatatatgtagatacacatataaatatgtatatatgtatttacatatacagacacatataaatatgtatgtatatgtatatacatctaatatatatatatatagatgtataatttcacgtgtatatatgcaggtatatatgtataaaactttccctgtggaccagacgggagtccggtggtgcaatcatagctcactgaagcctcacattcctaggctcaagggatcctcccacctcagcctcttaagctgttagggctacaagtgtgtaccattacatccagctaattttaaaatgtttttgtagagatagggtctcgctgtgttgccaggctgatctcaaactactgggctcaagcagtcctcccacctcagcctcccaaactgatgggattacaggcatgagccactgcacctgccaactctttaaatatttgaaggctgtagccataccttcttcctacctggtctgtttaaggaaaaataaaaaaagcaatctatgttccatcacgcagcacccaagtgaaatgcagcctgtgctttcaccaatctgactgcccttttccagaaccacatcatttttatctctgtcactatttattcaacacagatatttatgcagcactcagggaggtcccttgggagggttagggaaagactgacgttttacgcaacatctgggttggggcttgtagaaagagaaagagtttaccaaagaatgggcaagttcccaagagtatcagagagattggcacagagataatcaggaaatatcatacagatgggggctgcattcttccctggggtggaaatttcattccatagccatcatttccagatagggacacatagctgtgcctaccctgcccagaaagacagtgagaaagttgtgatacaatgacgacagacttttttttgcttatttggtgctctatccccagtgactgaaatcatacctggaacacagaaggtgctcaaaaaacattgggtaaataaatcaacaaatgaataaagtgaagtcagtaggaagatcagggaaaggtcagttaatggggcttccaagagattcccataaaggacattatagccataatgtgtgtctgagagtggggcgggggaaagaagaactgagaggagcattataaaaacgtacacagggccgggcacggtggctcatgcctgtaatcccagcattttgggaggctgaggtgggcagatcacgaggtcaggagttcgagaccagcctggccaacatggtgaaaccccgtctctactaaaaatacaaaaattagctgggcgtggtggcaggcacctatagtcacagctactcgggagcctgaggcaggagaatcacttgaaactggaaggcagaggttgcagtgagccgagatggcgccactccagcctgggcgatagaacgaaactctgtctgaaaaaacaaacaaatgaacaaaaaaaccacacacagaccccacagactcactgagaacagagagcgccatggtgggatagcaggagggggccatgaggcttgaaagagcaggagacggacaaacatctgcactaaatcaatgcttgtcaatgccttcatcatcaattcaatgcattcagtcatcaggatgattgaatgattgaatgaatgaatgaatgaatccaaaatggagtcctggaagaaaacaagacacaaggaaaccaaagcttttcagcaatgttctaataaaagaataagagggcagactaaagacagcatgcattttaagcttcttgcaacacaatgataggcaagggaaaatcaggtcaggaattaggaatactaggtcatatcttttgcgatactggatactacttattccgtgtttaacatgtgccaaagtacagcagtgaccacagtctcaatacacttaatgtgtatggatgtggccgggcgtggtggctcatgcctgtaatcccagcagtttgggaggccgaggtggatgggtcacttgatactaggagttccagaccagcctgggcaacatggtgaaaccccacctctactaaaaatacaaaaaaaaaaaaaaaaaaagttggccaggcatggtggcgggcacctgtaatcacagctacttgggaggctgaggcaggagagttacttgaacctgggaggcagaggttgcagcaagccaagatcgtgccattgcacttcagcctgggttatagagcaagatgttgtctcaaaaaaaaaaaaaaagtttacggatggtagttatgatcatcctctccaccccacattccctagacaggaaaatgaggcaagaaacaaaggtaatttgcctaaatacactgcttggaagtggtggagctgggattgggattcacactgtgatctgagacacctctttatatcaactaagacagaccctaacattaaggacacagaggatacctaggggtagaggtcagggcctggctggcatggtgcatttctaaattcctcaggctactaggaaatccatactcttgccaaactccctaacaatgggagctaccagggaagttaccagctgatttacaacccagaccatatcaactccaatggacagaggatacgccttacaaacaacataagcaactgcggaccttaagccagtttcagccagcttatagaggctgcacaaaaactgtgtcccctcctaaacctttgttattgttgttgttttgcagttttccctctcttcaaaggtatatcccttcaagggtctcaactggaaacctggaagtttaccagggttcctccctttttccaggctctgatctccactttttttctcctcagcactgtgagactgacaaaaatctgattaattttttatgctttgagcacctagaaacaaagatgtattgaacttgtattttacagtttatgagttggtgaatgccttgaggtgaaatttcatgcaatctgttcttctgggatggagcccttcaagttcaggctgacttactagccattaactccaatcctgtagactcatcccagtgagtaccacgatctcaatgccactgctttctcttccacctttatacttgttacagcaaatttcctgagagtaaaatgctgtggaaaatatcaggcttatgtcaatgcactcttctctctgactttttggaccctcaagtcttagttgtcttgtttactttccaataccatgaaacagctgttctgttgtttgctattcagtttttatagttcttcttctgttttttgtttgtttgttttttcagagggggcctcaatctgtcacccaggccgggttggtgtagtggcatgatctcagctcattgcaacctccacctccagggctcaagcgatcctgcgatcctcccacctcagcctcccgagtagctgaaaccacagacacagaccaccacgtccagataattttttgtaattttggtagagacaggattttgccatggtgcccaggctgatctcaaactcctgagctaggcaatccacccgcttcagcctcccaaggtgctgagattacaggcgtgagccactgcacccagcctatagttctttgttatagaagcttagttttatacaaattactccactatatccagtcgatgtctaaggaaattattttccaaacaagactccaaggtttaataaaagccccccaaaatcagtggatataattatatcaatattatgaatttctggccaggcatggtggctcacgactgtaatcccagcactttgggaggccaaggtgggcggatcacctgaggtcaagagctcaaaaccagcctggccaacatggtgaaaacccatctctactaaaaaaaatacaaaaattagctgggtgtggtggcaggtgcctgtaatcccagctacttgggaggctgaggcagggagaattgcttgaacccgggaggcggaggttgcagtgagcctggatcacaccactccactccagcctgggcgacagagtgagactgcatctcaaaaaaaaaaaaaagaatttctgttcaataaggacaccataaatgaagttaactgacggggggaagactgagaaggcaatatttgaagcctctaaaattgatggtacctagataacaagacagcagacccagtatcaaaaatgaacaaaatatatgaataagaaattcacagaaaggtaaacccaacagcctccaagtttatgaagagaggttcaatttcattcatgcttagagaaatgcaaatgaaaagcaacaatggtatacacttgacaaccatcaaattggtaaaaattataaagtcagataaatgttcatgagaaattagagaaaaaagaatcttttgtgctgctgggaagagggttagttagcatcatcatgccagaaatcaatctaacaggcagtgtgtactttatatgccagcaatcccattccaaatgatatattctagagaaattcacacaggtatgtaaggggccatgagtgagaatgtttattagaatgtttggggattagggattgggagacattctgactgcccctcattagggacataaaaaagtcaactgggctgggcccggtagctcacgcctgtaatcccagcactttgggaggctgaggtaggcagatcatctgaggtcaggagttccagaccagcctggccaacatagtgaaaccctgtctctactaaaaatacaaaaagtagccgggcgtggtggtgcacacctgtagtcccagctactcggaggctgaggcagaagaattgcttgaacccaggaggccaaggttgcagtgagcccagatcacatcattgcactccagcctgggagacagagcaagtctctgtctcaaaaacgaaaaacaaaaaacagaacagtcaactgactctgccagaccgccacgccgccgtcatggacaccagccacgtgcagcctatcaagctggccagggtcaccgaggtcctgggcaggaccggctctcagggacactgcacgcaggtgcgcgtggaatttatggacaacacgagccgctccagcatccgcagtgtaaaaggccccgtgtgtgagggggacgtgctcaccctgttggagtcagagcaagaggcctggaagttgcgctgaacttggctgctcactgggtcttggatgtggggtttgaccacttggctggtgggaatggtgtgccacgatctgctcctatattttattttttgcccgccacacgggaattgagatgcgcctttaaagcatttgtgcttcaaattaaaaagaaagagtaagctgagatggatggatgtgatggaatgctctgtggcgatccatcaactagtgatatctttagcaggtgattagatcttaaaagcataatgtagaatgaagaaggtatgatatagaagggtatctgtagtacgaaaggaaaatatcttgggccactaatatcactaaggaaacctaaagccgggaactgcttagggcaaacctgcctcccattctattcaaagtcacccctctctgcccactgagatagacgcatatctgatttgcctcctttggaagggctaatcagaaactcaaaagaatgtaaccgtttgtgtatcacttgtctgtgacctggaagtcccttcccccgttccaatcttccgcctttgattcaagttgtctcacctttccagaccgaaccaatgtacttcttacataaattgattggtgtctcatgtctccctaaatggataaaagcaagctatgccccaaccacctcgggcacatgtcgccaggacctcctgaggctgtgtcacgggtgcatcctcaaccttggcaaaataaactttctaaattaactgagacctgtctcacattttctggtttcacagtagttgcacaataacattcaaatacattttaaaacacacacgcgaaacaacacagtatattttaaaatatagagtagatacagtactgcagagtgctagagctcaggttttatgtagcctggattcgagtcctcacgctgccatatgctaaatgcatgatcttgggaaaattacttcacatatccatgcctctgtttcctcttctgttaaatgggaacaacaaaagaatttttctttttttgagacaggatctcactctgtcacccaggctggagcacagtggcacgatatcagctcatggcaacctctgcctctggggttcaagtcattctcgtgcctcagcctcccgagtagctgagactacaggcatgtgttatcacatgggctaattttttttatttttaatagagatgggggcttcaccatgttggccaggttgatcttgaactcatgaactcaggtcattcacccacctcggactcccaaagtgttgggattacaggagtgagccaccaggccaggccaaaacaatgtttctcatagtgctgttgggaggatgaaagaagagaatgtgtataaaagtgcttggaacaggaccttggaaaattaaattggagtcggcaataatatttattttcaaagacatctatgtataggcaggatgaaaatggggagtgagcatggagataaagaaaaaataataaaataacccaacaaggtgtctttcatgggcttatggtaagggtgtgccctgaattgacaggaataatgaactcaagttttggaacctgacattccccaaatctgcaagagttaagcctaaaacaaacagaccaaagccccaggttatgaatctagtcactgttgagcagtgagctttcgccatcttccttctgagaaggagctcagtggttatatggtttttgtagtgttaaacaatgctgctaggcagggtgcagtggctcaagcctgtaatccgagccctctgggaggccgaggtaggtggatcacttgagcccaggagttcaagatcaacttgggcaacatggtgggaccccatctctattttaaaaaacaaaaaaataagaaaacaatggctgggcgtggtggctcacacctgtaatcccagcactttgggaggctgaggtgggtggatcatctgaggtcagaggtttgaaaccaacctggtcaacatggtgaaaccctgtctttactaaaaatgcaaaattagccgggcatggtggcacatgcctgtaatcccagctacttgggaggctgaggcaggagaatcgcttgaacctgggaggcagaggttgcagtgagccgaaatcgtgccattgcactccagcctgggcaataagagtaaaactccatcccaaaaaaaaaaaaaaaaaaaaaaagaaagaaaacatttctgaatttatgtaataatttacctattgtgtctaagctgttctttaaaaaactaattgctatcaaaatgcttaatgagtcaattactaattataaatcagtgaattaatacatccgaagtcaagaatctgttatgtttacaaacaattgctaccctctgtctaatctttgaatttgtgctcatgaagaaattggctaccaatgtggtaccagtctcccagcatccttgaagaagagttaggaggcaggagaaaacacatgtacgtctttccctagaggtgactacactgaaatctagctaagtgatatagtttggatgtttgtaccctccaaatctcattttgaaatgtgatccccaatactggaagtggggtctggtgggaggggcatgggtcataggggcggatccctcatgaatgtcttgaggccctccccacagtaataagtaggttctcactctattagctcaaaggagagctggctgtttaaaagagcatggcatctcttgctttctctctcaccatgtgatgtacctgctcccccttcccttccaccatgaataaaagcttcccaaggcctcaccagaagccaatcagatgtgggtgccatgattcttgtacagcctgcaggaaccaggagccaagtaaacctcttttctttctaaatgacccagttttgggtattcctttatagcaacacaaaatgggctaagacattaagtcaacaagatacacaaaacaacgcagttaagtaccaacacaaggcacaacccaatgagaatgaaataggcattgcagagtgccagtgctcgagagcagggctcctcatcgcccaggctgtggaccagcaccagtctgtggcctgttaggaaccaggctacacagcaggaggtgagtggcaggtgagcaaacattgccgcctgaactctacctcctgtcagatcagcagcagcattagattctcataggtgctcaaaccctattgtaaactgcacacgcgagggatctagattgtgcactccttgtgagaatctaatgcctgatgatctgtcactgtctcccatcacccccagaggagatcgtctagctgcaggaaaacaggctcagggcttccactgattctacatgatgtgtaattacacgttgtgtaattatttcattatatattacaatgtaataataatagaaataaagtacataataaatgtaatgtggttgcattatctgaaaaccatccttcctcactggtctgtggaaaaactgtcttccacaaaacaggtccctggtgccaaaaaggttggggaccgctgctccagagttcagagaagttagggcagagacgacctgggcaggcttctgaaggacttccccatgaacggaattctgctcagcagaggcatggggtgagggccgctttagggactgcatctggtggaagctcaaatgcagactttgtggattagctaggcaattcaagttccaaaaggatttttggaaattgtggatcttagggaaatggtagatgttgggctcattttgttttaattagctgaagaacataacaagaaaaaaagtttctccaaaggagggaaatcagaatatcttcatacatttctatttttgtctgtttcccaagaccctgagtaaaaaaatctaattcttatagaaatagtgacaataataatggtagcctaaatttatgttgccttacatctagcgggttccatttctttctttcttttttttttttttttttgagacagggtcttgctctgtcacccagagtggagtgcagtggtgcaatcatagctcactgcagccttgacctccggggctcaagtgatcctcctgcctcagcctctcgagtagctaggactacaggtgcacgccaacagactcagctaatttctttttaatagacaaagtcttgctgtattgcctaggccggtcttgaactcctgggctcaagcaatcctcctgcgtttgcctctaaaaatgctcagattacaggtgtgagccaccatgcctagacagccaagaacgttacatacacatacatcattttcccacatctgtcatgaggcaagcatgaaaaggccttttttcctccttgagatggaaaataaactgtaaggcattggatggtacctgacacggtctggaatcaggatttcctgactttgaattcggtgccgtgagtgatggcaaggaaactgctgtttttcagtcacctgaaactttaggtgagttgctgtgttgcccaggcttctcatgaactcctgggctcaagcaatcttcctaccttgacccaaagcactaggattataggcatgaaccaccatgcagaagccacgtttggtgggagttgtgtttttgttgttgttgttgtttgtttttttgagacagagtctcgctctgccacctaggctggagtgaagtggcgtgatttcggctcaatgcaacctctgactcccaggttcaagccattctcgtgccacagcctcccgagtagctaggattacaggcacccaccaccacgcctggctaatttttgtatttttagtagagacggggtttcatcatgttgcccaggctggtctcaaactcctgacctcaggcgatctgcccacctcggcctcccgaactgccgagattacaggcttgagccactgcgccccgccagtgggagttttatgtacattatctcaggcaatgcaaccacatcatgaactaaggcaattttacagaaatggacagagaatcagagggcatctttcagtttgagttaaaatccagtacaatgaagatatgatactgatagtgagaatgagatcagacatggaagccagagactctctagacacacccttttcctatgctatggtatgtcttgaatttctgaaaatatcactgggcttaaaagtgaagaaaattatactggaggttttttcttcttctaaaaatctccacataaatgggtcaccttgaaatactgttctcataatgcagttacaatttttaaaaattgctgccgggcatggaggctcacacctgtaatcccagcactttgagagccccaggcaggtggatcacctgaggtcaggagttcgagaccagcctggccaacatggtgaaaccctgcctctattaaaaatacaaaactagccagttgtggtggttggtgcctataatcccagctactcgggaggctgaggaaggagaattacttgaacctgggaggcagaggttgcagtgagctagttgcactgcactccagcctgggcgacagagcaagactccgtctcaaaaaaaaaaaaaagaaagatgtggacatgcttttttcttctcttttccagggaggcaggtatgtaggaagatccacagaggggcagtgcatttttgggggactgatgcccagattttgttcaggtgataattatctgccagacttctcatcgaaagggcgatagtgcatgcagggaaaaggtaccttgagccagcacccctgaggaagatgtttgtattatgaggactcacaatcggtctggggaaggtgtggatgtcagcagagaaggagccgcaccaccacaaggactctgttctgagtgggggggaagaggaccacatagtctcttcccttgcccaggcagcaaaggtccctttttgatcagcaaatcaaatcagcaaataaaagctgatttgatgggtcttccaaatgctcagtttctctattactcccatgacccaaggaagccatggccttctaagagagagtcatcatacatgtgacactgagctccattagaatttggtttcaggccgggcacgattggcttatgcctgtaatcccagcactttgggaggctgaggcgggcggatcacctgaggtcaggaattccagactagcctggccaacacggtgagatccccgtctctactaaaaataaaaaattagccaggcatggtggtgcattgcctgtaatcctagctacttgggaggctgaggcatgagaatcgcttgaacacaggaggtagagattgcagtgagccaagatcatgccactgcactccagcctgggtgacagagagagactctgtctcaaaaaaaaaaaaaataataatttgttttcagccaggtgcagtggctcatgcatgcaatcccaatgtttttggaggccaagatgggatgactgcttgaacccaggagttccacaccagcctgggcaacatagtgagaccctgtctttacaaacaaatttaaaaaatagccaggcatggtagcatgtgcctgtagtcccagttacttgggaggctaaggtgggaggatcacttgagcccaggagttccaggctgcagtgagctgtgatggcaccactgcactccagcctgagtcacacagcaagactctgtctcttaaaaaaaaaaaaaaaaaaaaaaaaaaaagaatttgttttccatgctgccagtttgtcactatgacagtgcggtctggactgaaagaatggccataaatattgtggacattcagagtaaggaagcgaatccctgacaggctatgaggcaggagaatagggtttggagacagggaacataaggacttcctagagctaaatcaaatggaaacacttcagctatgacagaactatcctctccatttacaaagggtgtacgtcgagtaagtgactgtaactttacttcatcctcttcatttacataaggcgtataccaagtaaccaatggaaacctcgagagggttttttgtttgtttgtttgagatggagtctcactctgttgcccagactggagtgcagtggtgtgatctcagctcactgcaacctctccctgaggttcaagcgattctcctgcctcagcctcctgagtagctgggattacaggcatgcatcactgtgcctggctaatttttgtttgtagtagagatggggtttcaccatgttggccagggtgatctcgaactcctgacctcaagtgattcacccaccccggcctcccaaagtgctgagcttacaggcatgagccaccaaacccagccttagagggtatttaaaccccaaaaaattctgtaacagggctctcgagcccctatgcctgggcctgctcccaacctgtggagtgtactttcttttttttttgagatggagtctcgctttgtcgcccaggctggagtgcagtggcacgatcttggctcactgcaagctccgcctcccgggttcacgccattctcctgcctcagcctcccgagtagctgggactacaggcgcctgccactacgcctggctaatttttttgtatttttagtagagacggggtttcactgtgttagccaggatggtctcaatctcctgacctcatgatctgcctgcctcagcctcccaaagtgttgggattacaggtgtgagccaccgtgcctggccactttgatttttaataaatctctgcttttgttgcttcattccttccttgcttcatttgtgcattttgtccaattctttgttcgagatgccaagaacctggacaccctcccctggtaacacctggagagtgagccccttatgggaggagaattgctcacagttgttttagccacagcacaagtatgggcagggcggaaaggggtctttcatgtaatctgttccaactccatcattttacaggtgaggaaactgaggcagagggactcattcaaggtcacccacagatacatggaagggttgagaataggatctaggtctccgacaatcactaccacgcatttttggatattgcagagtacttgccaaaaaacctaggcatcatctttgattctgtgtcttccttcaacaccccattcctatgaccaatccatcaccacggtcctcttaaagacttgcaagcatagcccgaactgatcctctccccaccactctggccccaaacagctcatactgagttcctccctgacccagagtagtcaagtccttcttttgtccctaacacccccgatccacagagccacccgagtcagactttgaaactgtaaatccagtcagaacacacctctttaaacttaaagctgcttcagaccacacagggaatcacgtccatactcctacctgatcagcccactgcacatctggcaccagccagtctccctcagtctgctccagccagactggctttcttaatgctctgggaacatgccaagctgctcccaccttaggactttgtatctactgttccttctgcacagaatgccattcccagagttcttcataaagccggctccaccctgtcattcctttcctagccatttcaccctctctgagaagcctgccctaaccaggcattcctgaataggcccccgtctatccccgttttatttctaccataacatttatccataaatgacatttccttgtttgttcatttattgcctgtctgccccatctctctcattcacggccagtgcctgaaacctgctggacacatagtaggctcttagtaaatatcagtttaattactcagtcaaaagatgacagcatagctgcctctagggcacaacacccttttctttttatatggcataagggactttgatcaaagagctctctaacaccatgtactctccagaaaacactctcagtaaagaaatgcttttacttacagtaaagaatagcagaaacggccgggcgcatggctcatgcctgtaatcccagcactttgggaggccgaggcagctgcatcacctaaggtcaggagttcaagactagcctggccaacatggtgaaaccccgtctctactaaaaatacaaaaattagctgggcatgatggtgcgtgcccgtaatcccagctacttgggaggctgaggcaagagaatcgcttgaacccaggaggcggaggttgcagtgagtcgagatcatgccactgcattccagcctgggcaacagagcagtactccatctcaataacaaacaaacaaaaacaaaacaacaacaacaacaaaaaacgaataacagaaacaagtttttccagcttctgcaagaactcagtgaggagtctggtctgctatagcatctctaaatatactttttggattggcagatgtcacataccctactaagacaaaactgatcacagccagaaacctggcatctatggctcagtggctggttctggttggctcaccctgagccaggatttgaaatcaaagtctttgactttgaaatcatgcaagcgacttgcagaatggtggatcttctgatgtcttgcactttttctgtgctctagtttgtcaaactgctgcagcctttttttttttccattcccctcctgggagtcagacccaaccaatccatcacttgcccaaaccaacagatgcggctgctgatggtggagggagaaccaggcaggaccaccccaggatgtgagtgagtctgctttctgggacatcttcaagagaaacagttgctagctgaagtatgaaaaatgaagagtctgcccagcagcttccttcttgcatctctatcaaatcactgatctgttgaattggatatgcgacctgcaactgctaaattgaagataccacaggtcacctggcaggatcttcctaaatcatgaaactttcatgcttagggtcctcccattcttggctccaccctgacgcctcaacagcggctcagtggctcccagtcatttctgcctttcccaagtgcacccccctcacctccttgcctgaggaagatgttggtattaatatgataataactccacagttggtccagggaaggcgtgcatgtcagcagagaaggagctgctctgccacaaggactcggctctgggtgaggggaaggggcccacataggcttgtcccttggccaggcggcaatgctccctttttgaggctagcggcacataaaagctgatttgatcggtcctccaaatgctcaatctctgcatcacttccgtgacccaaggaagccatggctgcattactttcatgacccaagaaagctagtgtagatcgctagcgatctcaactcattcctggactattacaagtacggccatacggacgccccaggtgccgggctgttccctcttgcacaatctgctgaattcttttttctaaaaccaagccccaccatgctcttgtcggctcggcccctgtaggatccctgcatccttcctgccttcacattcaaagctcatcaatacctgtccagcttcttctaatccccagaaagtcttcttcgattcctctaataggagaaagtgccttcctctttagcttgtcataaatgccttttgcatggctttcgtgactcagtcctccataatttattatttggagataaagtcttgccctgtcatccagtttagagtgcagtggtgtgaccacagctcactgcagcctcaaactcctgggctcaagcaatcctccttcctcaacctcttgagtagctgggactacaggcacgcaccactacacccagctgctgtttttaattttttgcaggaacgggatctcgttatgttgcccagggtggtcttgaactcctggcctcaagcaagccttccactttggcctcccaagtagctgggactacgggcatgagccaccacagctgcctcagtcctccacactttatcttaatctgttggtgcccacggcttctctcctccatcctgttcttcatcttaatattttccatatggccttgttccctgcactatttaagtagatgcgtatcaacacacacttgtggtagaagaatggatttatcatcttaaatgaccactccaggccactcgaattgctgtctcattggcaggagaaagatatagtcacctcttcttctcctttatatactgtcaaggctttggagaaaagccaattttctgctttaatatacatattctctttctggtgttttccgcattctaaggtgctttcacgcctattaacagcattttaccttcataatagctcttttgagatgtgtgtaaaagtgttttgaataattgttgataaagtttcctgagaaataaatatttactgagtgccatttatgtgttaggcattgtgctgggagtggggacccaagggccagcaggactttgcagagactgacaagcagaggaccagtttccatgtcatggggcagatgctctgatggggctgggctgatgtttctacaggggaacataggaggcacctgtctcctggggggtgagggaggcagctaggaaatgtcttcatagacagggagagctaggcaggcaaggtggggttggtggttggcagtgtggacaaaaaaaacatgatctcagtctctcaaagaaaagagaacctgagaatctggcttactggaacaactgcaatgaattcactattgctagagaatcaggggtaaaggctgggcacagtggcccacgcctgtaatcccagcactttgggaggctgaggcaggaggattgcttgaggctaggaatttgaggccaacgtgggcaacatagcaagacatcatctctatgagaaattttaaaatggggccaagcactgtggctcatgcctgtaatcatagcgctttgggaggccgaggggctgatcatgtgaggtcaggagttcaagaccagcctggctaacatcttgaaaccctgtctctactaaaaatacaaaaaaattagccaggcgtggtggcacacacctgtattcccagctgctagggaggctgaggcaggaaaatcatttgaaccagggagatggaggttgcagtgagctgagatcgtgccactgtgctccagcctgggcaacagagtgagactccatctcgaaaacttaaaattaaaaaaaaaattaaaaataataataaaaattagctgggcatagtggtgtgcatgtgtagtcccaccttctcaggaggctgaggcaggaggactgcacgagcctgggaggccatggctccagtgagctgtgatcacgccactgtactccagcttgagtgacagagtaagaccctgtctcaaacattaaaaagaagatacggattgagaattgactgtgggatttagcaacatggtggtcatcagtgacctccactagagctgttttgttttatggaatggtaagaatgaaaatcaagacagagtagattcaggagtcagtgggagaagagaactggcagcagtgagtacagactactacctggggggttgattcagagcagtgaagaggagtgaggtttaactcttctctacaggggaacagacagtttcatttgactattattcttcttatttattttacccacatcttacaaggcgtggaatgttgttttttaggatgagagttgtctaagtatgtttgtatctgtattagtcccttctcatactgctaataaagatatacccaagtctgggtaatttgtaaaggaaagaggtttaatggattcacagtcccacatggctggggagacctcgcaatcatggcagaagacgaaggaaaagcaaagggacatcgtacatggcggcaggcaggagagagtgagaaccaagcgaaacggaaaacccctgataaaaccatcagatctcgtgagacgtattcactaccacgagaacagtatggaagaaaccgtccctgtgattcagtgatctcccaccaggtccctcccaccacacatggcaattatgggagctacaattcaagatgagatttgggtggagacacagccaaactgtatcagtattctaatgggaatgacacagcggagaggttgaaaagctgatcaactttttgcatacgttcctttatttaaatctcaaaatgctctttgaggtcaatatgacccctactccctaagtgagaactgcaagaatcagtgaatttagagattccacacttaagtcaatggcacagcaggggttcaaatccaggtctgttgaaccccaaaatgaacgctttccccactggtctaagtggaaaatattacagaacatactgcattgccttccttagattaaaaaactgatcaacatagaggtaatatagggtacagatcttaagttttgagcatgccctggctcaataagcccctgatgttctggaactcaggagatccgtcctggaaggagtcagattccaacatgacctgactatgatgcacttatttcagaccaagcagacagacaacctcctctgggaggaaagtcagaagtagaatgtactctaagagggcttgagggctgaagattgaaaagccgctatttagtctggcacctgggtggtacctggtgatctcagagccggcagtttcactgaaagcccccaaccgagatagtatagactgggccatgtatgttctggatttttttttttttttgagatggagtctcactctgtcacccaggctggagagcaatggcactatctcggttcactgcaacctctgcctcctgggttcaagcaattctcctgcctcagcctcccaagtagctaggattacagacatgtgccaccatgtccagctaatttttgtatttttagtagagacggagcatcatcatgttggccaggctggtctcgaactcctgacctcaagcgatcctcactcctcagcctcccaaagtgctgggattataggcatgagccactgtgcccagcccgttctagaattttaatagcagaaaggaactttgtttccttttgtgatgagtaggatgattgagggcacatatgtatgctgtaggggaggacttgggagctacagaaagactgcagataagagtgcccggaaattttactattgggcattatttcaatttaaagtattttttttaaaaattattattatttttgttctgataacttttttttttttttaaacagagggagggtgtcgttatgttgcccaggctgatctcaaactcctggccccaagttatcctccagcctcagcctcccaaagtgctgggattacaggggctgactgtgtccagtcccaatttaaagttttgattgtatgtagcagtgcaggcacacagcaagccaggagcatttacattttattttattattttattttattatttgagacagagtttcactctgccacccaagttggagtgcagtggcacaatctcagctcactgcaatctctgcctcccaggttcaagcgattctcctgtctcagcctcctgagaatctggaattacaggcacccaccatcacgcctggctaatttatgtatttttagtggaggtgaggtttcaccatgttggccagtctggtctcaaaactcgagacctcaggtgatccacccaccttggcctcccaaagtgctgggattacaggtgtgagccaccacacccagccctatactttatttttttgatagtcaatcccttcatctcccttcacgggagctttatgaattggtggggaggtggtgaaagcgaaatgagacaccgagagaagctctgaaattaatcatcttgtttctatcgcagccgaagacatggtctggatgctgaagtaatcaagcagccactctcggctttgatggacaattcactttcatcttctgtgagagaattttgatttacttctttcagaaagattgataggaggtgggtgggactgtgacttttaaatttttggttagatctaatatttttcttgactgtaagaatttatcattaatgattctggaaagacaaaaacgtgatgaaatctgatacaaaagcctaaaaaggaaataaagaggtttaaaaaaataaaacaaagacactcttttcgtagtaagcaactcagagatgaaatatttcactctgcaaaaaatcaaaccccaaaaaagacaccactctcaaaccttgacactctttctctaccccattacgatctgtcgcctgtactgatcactgcaaacctaaaatgccttcctcaacttacaaatggcaaatctcttaagtaacttcagttctcagacagattaatgcaattttccggtgagttagacaggcatgaagtgaggtgattctccggattttttgttttgtttttgaagaaggagaagaaactaggaatgttctcattttaagactgaaaaatttaggctgggtgctgtggctcacacctcgcactaagaaagtgcaggtttctgctgggcatggtggctcacacttctaatcccagcactttgggaggccgaagcaggcagatcacctggggtcaggagttcgagaccaacctggccaacatgatgaaaccccatctctattaaaaatacaaaaattagccaggcgtggtggcatgcacctgtaatcccagctacttgggaggctgaggcaggagaatctcttgaacctgggaggcagaagttgcagtgagcccagattgtgccattgcactccagcctaggtgacaagagtgaaactccatctcaaaaaaaaaaaaaaaaaagaaagaaagaaaaaaaaagaaaaagaaaaaaaaagaaagtgcagtaattaccaatctcttacatggtatattccatcatggtgaagtctgagattttaatggatccatcatcttaatagcgtacattgtacccaacaggtaatttttcaaatctcacctctcccaacctccccctttatggagtccccagtatctactgttcccctctgtttgtcaggtttcttgccctattctcatactggtcttgttaaaatgagcttattattagtttgatccattctctgtctcatgagactcttggcttcctccagttccctgtcttcattgtaagacacaacagacaactcagggaggcccctttgtgtagtcttcctatctgtcaaagaccttattggtccttcacaaagtaccaatagactaccaagtttgcccaggcacatgtggtatatacagttcctgggagaaggggaagctcattttcctttcctcaaaaggacttgcctctccacccatcttaggaaagttttccaaatatataaaaacagcaaagtctggattctccaatcctatgtttgcgatctccaagaaagaacaggacacacttccggacaacttgcgttgccatccttcagagctgaccacaatggtgctagccacattatgtggtctcttctgttagatttcatgttagctgcttgttcaaaatcaggcagaaaggcagctcctcctgcactgtgagacctgacccatcactgctaccttaacagactgagtctcccacccagcctcacaacagacattgcccagagttctttcttgactgacagatcagaccctcagatcactttccaacatgctgcctgacttctccgagtggctttccttatgacgggaaacctggagtatcaggctttcacatgcctgtattttgggtcacttgttagttataaaagataggcataggctgctcaattaaagcaaggatgttctggaagctgtggcactatcaaaggctaggagagaaagcaaactgaatggcttgcccctctccttttcaccagacttagtagcagtgaagcacctgtcatggtaggcagtgatgagtcaggtctcatggttcaggaggagcttcccttctgcctggtcttaaatgacaagctaacatgaaatctaatattcacataatgtggctagcaacattgtgatcagttctgaagtttggacaagttgtccagaagtgtgttctgttctttcttggagatcgcaaacacaggattggagaatccagacttggttgtttttatatatttggaaaactttcctaagatgggtgagaggcaagtccttttgaggaaaggaaaatgggcttccccttctcccaggaacatctaccaaaacgactatgttcctttcccagagcatagagcataggggtataccagttctcctgatgagttttaacatgatatagatagaagagacttggagtttaggacatctctacatattccagggttttgacttttttacctttccagcttttttttttttttaagtgggggaagggtatgtgtggtggatactttcagcaaaggtgagacacgatggtcacccagtcccaactccatcagcacaagaggacagtggtcagactccatggtgctcataggactagaatctatttctagttctagtctatttcaattcctgggcaaaccaaatgtgatgtctcttcacagttgtattcttttttaaaaatgcatatttaggccgggcacagtggctcaggcctgtaatcccagcactttgggaggccgaggcgggcagatcacctgaggtcaggagtttgagatcagtctggtcaacatggtgaaaccccatctctactaaaaatacaaaaattagctgggcgtggtggcgggcacctgtaatcccagctgctctagagactgagggaggagaatcattgaacccaggaggtggtggttgcagtgagtcaggatggcaccactgcactccagcctgggcaacagagagagactccatctcaaaaataaataaataaataaataaataaataaataaataaataaataaataaaataaaataaaaaaataaaataaaagcatatttagaggatacaaatgcaggtttcttacatgtatatattgcatcatgaacccatcatctggacagtgtacactgtacccaatagggaatttttcaaatcttacttccgtcccagcctctccctttatggagtccccagtatctatcattccctccgtacatccatctgtacccattgtttagctcgcatttgtaagtgagaacatgtggtatttgactttctgtttctgagctatttcactgaggatagtagcttccacttccatccgtgttgctgcagaagataatgattgcattcttttttatggctgagtagtattccatggtgtctatgtaccacattttctttatccattcctccactgatagatatttaggttgattccatatctttgctattgtgaatagtgctgcaacaaacataccagtgcaagtatctttttgatataatgatttctttcctggtagtgggattgctggattgaatggcagttctaattttagatcttttttaatagttatattcttccactctctacctccatgcaggtgcaaactcctacaccattacctggtcgtgatattaagactttttattttattctaatttaattgttttttgagacagagtcttactctgttgcccaggtggagtgcagtggctcaatctcagctcattgcaacctccacctcccaggttcaagcgattctcgtgcctcagcctcctgagtagctgggatcacaggcttgtgacaccacacctggctaatttttgtatttttagtagagatggggtttcaccatgtttcccaggctggtcttgaactcctgacctcaggtgatctgtttgccttggcctcccaaagtgctggaattacaggcatgagccactgctcataagactttttatcttaaatgaatttcacataatcagcaaagttactatcattgtcagtccaattagtctatacctataatacataaggtatctgaaagattacttctcattcatttattcacaatgccaggaactgtgccagatactgggtatacaatagcaaacaagacagacaaggaatcaaaccgagcttacatcccctcttctaaagacagatatttacatcctaatagaaatttccctaccaaatgtatttatacataaaacccagttctgttttaatgttagcacatgagatctagctgatgaaaatgttacctgtatttcccccttgggagtcagccccatagaccagtaattaccaatctcttttctgccataaaacccgtaatagattacgttcacttgtgtactgtactcccatgggtactgttacatgaaatctgcaaacttctttctctcactattaaaacaaacaaaaaggaataagaaaatgtgtgtgcgcaattctccatttgccatctccacaagccattccctccctgcacctctctgccctgggcccttggaaactgatctctgtagattgcatctcctagacaaacttgctgctagcttctgtttgggttaggccaattcagacaatggcaagaaattcaagggcagcagaagagagagggcagggtcctcctcccctgcatactttctgacaaaactctgctactctggcagtagctatgtctcttcacaagcctatttcccgctgagtggcacctcttccagacctcgtgaggttccagtaaccctttcccttcagcccttggagtgggaacaatttccagctattgtagcctcagggagcctcattatatcttgtttgttcctttcacctgcctaccctatgtccatcatctcttcatttgtatctgcgtattccgttttctcataaaacaagatgcaagtgcaagataggaaagttattataagaataaccttgtggccaggcacaatggctcacacctgcaatcccagcattttgagaggccaaggctggaggatcacttgaggccaggagtttgagaccagcttgggcaacacagcaagaccccatctctaaaaaaaaaaaaaaaagtttaaaaaatcagtcatgcctggtggcatgcacctgttgttccagctacttgagaggctgaggcaggaggatcacttgagcccaggagtttgaggctgcagtgagctatgatggcaccactgcactgcagcctgggtgaaagagagagacccagcctccaataaattaattaatgtgagcagaagccaattacctgtaacaaataccaataccgagtccatgctgcgaactgctggcaaaagccatgccatatttgagccctctgcatttgctaccgtttgaatggacattctggactatatagagagtgaatatttcccctcatctcaacctttcacactggtgagctcagggggctagaaagtgtgagactgactaagaagatttcaaattcccctagaaacctttcattatctaataccttttaaaattccactttgggtgccgtgaggagaagatttctcttccacatcttttctacaaattgctgaaagctttaaaccagttttatctacagtatgtcacagcaaatgtgggtcttttttccttctagtgcctgatctgtcaggaattgccaggccaaaaagaaaaaagacaatccctggtgagatgaacaaagtaacaaggaaaaatgaaatcagaagagatcagcgggatctcatcaattcaacgcttactcaaattctagtaaccttgaaagattcaagtataataaattctcatatataaggatctcagtttggccttcaaatactacaaagaggacaggtttaaacataggtatccaagatttgtaactggtatttaagttttggaatctcagttaccaggtaaacctggaaagtttactcttgctagtgtcacaaaattagggtcacctgtactaaacagtaagctctaagaaactttgttatttttattattattattatttttgagacagagtcttgctctgtcacccaggctggagtgcggcggcgcgatctcggctcactgcaacctccgactccctggttcaagcgattctcctgcctcagcctccagagtagctgggattacaggtgcacgccaccacgcccggctaatttttgtatttttagtagagacaaggtttcaccatgttggccaggatggtcttgatctccttacctcgtgatccacctgcctcagcctcccaaagtgctgggattacaggtgtgagccactgtgcccagcccacacagctcatgtttgtatttttagtagagacagggttttgccatgttggccaggctggtcttgaactcctgacctcaaatgatccgcccaccttggcctcccaaagtgctgggattacaggtatgagccaccgtgcccagcctaggaaactttttctcttctttttttcttatcgtctctccttggtccccaaattccactttttttcccttacccccttggtcaccactttatatgttttatatgtaatactgatacatgtactgcaataatagattacacttattagcacttattctatattttaaatgctacacgtacattaactcatcaaatctggatagcaatgcaatgagattatcaccattttgcaaatgggaaaactgaggcacaaaaattaagtaactcatctaacataagaggtaaatagtggagctgggattaggacctatgaagtttggctgaggaattcatattcttatcccctctgatatactgtccccaaaatatgtcttgttttcaatgtccgtgtatttaaacataaatgtttcctgctatgaatctcattgtttcttttttgactaaagggagcattgttaaggtttatccacactgctatgtatgtacatctgaactgttgctaagtatgtcatatcatatactttggcttacgcattcccctacggatggacactgaaatgggagtgttcctttatcccccgtcacaggatgtgcgacagggttgtgactcttctttgctgccctgctgctcaaactcctaaggaagcatgcagacaggcaggtgtaggggtcgtggggagcatttttgggctctgaccccacagcagtgtctaagggtgagtgtttacagctcctgaagccttggtgggcgtctgttacagtgtgctctttcagctttgccgtctgcagacagcttgtgttaatgagctcaattagaccctctgcttatcgcaaggacagagggctttctgtatcctgggttcttgccctagtgtactggaaaacttggatcacatgtgggcttggagaatgagtgtaaggttttattgagtggtggagatagctctcagcaagatcattaatatcattttcaaaagaacaaccggctgggcgcagtggctcacgctgagatcacgccactgcactccagcctggcaacagagcgagactctgtctcaaaaaaaaaccaaaccaaaacaaaacaaaaaaaggaacaaccctttatttcattccaaagtatagatatatttaacttattgaacacttcattaaaaatgcatgcctgtttccctctgtataaatgataagtctgggctttgcaagaaatgttgggaatgagatgggctttgggtaagagtcttccaatactgaccaatgtaatgttctatcagtccatgaagaaatctgtaaggaatagatggtttcactgacttgggctgagctcacaatcagcaccttaaaaacactgccagactttgagttagtagagaccgtttttgaggattcaggggaaaataagaatgttttctggctcacgttttatttttaactttttaattttggagacatggtctcactctgtcccccaggctagagtgcagtggtgccatcgtagctcactgcagcctctacctcttgtgttcaagtcatcctcctgcctccaccttccaagtagctgagaacacaggcacatgtcaccccacccagctaaactttttattattctttatagaaacagagtcttgttatgttgcccaggctggtctcaaactcctgggctcaggtgatcctcccgcctcagcctcccaaagtactaagatgacaggtgtgagccaccatgcccagcctcactttttaaaaagtatccctttaattgtttagatactaagatactacttttggaaaagcacaatctttagtgtgagtcctagaaagaaggtgccaaccttctgtaaggaaaactaaaagcttcctctcacttgcagatgacataattttatactcataagccaggagtgactttaataggtatctcattcattctacaaagaagggcttcagagctgctatttgaaaaacagtaacaacaaacaaacaaacaaacaaacaaacattaaatgcacttaaatggtgtatagctaaattcctacatagggacttaccttattcatttaaaagagatccatttttcaactgatatggtatatgcacaaccaaaagatatattggtgaaagttcaaagttaggcatatggtagtgaccacttaaaatatttcacaatttaaaattattgcagctatgttctggggcataaaaagatgccccagtatcactcaattgagtgattcctaaataatttacaaagataacttagtatttaaaagcctagaggatctttcttggtcttcttcctgtagaaaaggacagtagcggtgcttcttagagcttttcactgttgaaatatggagttttgcaaaaccatcaacaccacacttctgccctccaagtactaccagggagtataatcttgcattcaatctacacaatactcaatagaaaaatcagctgagacaatttctattttgcaggttaacctgaaggatatacagtctgtctatgctcctgtgcaagaccagataacaaatagttctggtgctccttgtagtttctatcccaacaattcaactctacagtcaactctgtcaccataaagcaagcagccatggacaatacaaattagtgtggctatgttgcagtataactttacttgcaaaataagtggcaagctggacatggcctgtgaaccttggtctgtggaatcctgccctaggtcaatgtttgatatggtttggatctgtgtccccacccaagtctcatgttcaattgtaatcctcagtgatggaggtggggtggtgggaggtggctggatcatgggggtggatttcttatgaatgatttagcatcatccttctggtactgtcctcttgatagtgagttctcatgacatctggtcatttaaaagtgtgtggcacctccctcctctctctctgtctcctgctcctggtcctgccatgtaagatgcacctgcttcctctttgccttctgccattattgtaagtttcctgaggctttttcagaagctcagcagattccagcatcatgcttcccgtacagcctgcagaatcaagagccaattaaacctctcttctttatatattacccagtctcaggtatttacagcaatacaagaacagactaataccatggttcttaacgttttggggagcaagtggtggtcactacccccattgaaagcctaatgaaaattatagttcttctcttccagaaaatttaaagctagattaattttacatgcaactttgtaagttgtaaatccccccaaatgaagaggctttctctagacactctaaaatttatcattgaattctgtcagaacaacagaaagatatgtccttgttcagcttccccagtagaagctgtttctggaatattctttgccatgatgtcattggtttttattgagaactgtttaggaaacatatctttgaaacccattcacttgtttattccaataacgtagtggataaacagttcaaaatggaaacaacttaaatattaaacctaaaactataaaatatacagaagaaaacagagaaagcctttatctaggcaaagattttttagataagatgcataaagcatgaataatgaaggagagaaatagcaaactgaacttcacaataactgaaaacttttattttcaaaaatcactgttaagataatgaacacacgagatataatatggcagaaaatatcacaaaacaaatacctgttaaagaaacctgactaggtgtgatgactcatgtctgtaatcctagggctttgggaaaccaagtcaggatggctttaactcaggagttccagaccagcctgggaaacatagcaagaccttgtctctactaaaaatcaaacaaattaactgagctcagtggtgcatgcctgtagtcccagttactcaggaggctgaggtggaaaaatcgcttgagcccaagtcaaggctgcagtgacccgtgatcgtgtcactgcactccagcctgggcgacagagtgagaccctgtttcaaaaaaaaaaaaaaaaagaaagaaaagaaaagaaaagaaaaaagtctgtgcccagaataaagaatataaagaactttcaaactcaataataagaaagcaatcaatacaatttaaaaaggggaagatttgagcatacatattactaaagaatttactaaagtaaatgaaaagaaagcaaacaaaaaccacaatgagatgccactgtagacttattaaacaggctaaaatttaaaagcgaacaaaagaagctaagaatatctattgctagcaaagatgtaaagcaactggaactctcatatattgctggtaggaattaaaaatggtatcaccactttggaaaacattttggcatctctgtataaagttaaacatacatttctcattttattcagtaatcccacacctaggtatttacttgagagaaatgaaaatatatgcccacacaaatgcctgtacatgaatatttatagcgactctattcatagttactccaaactggaaacaagtcaaatgtctactaactagtgaagggataaatgcacagagtgtaagctatggtagtacactcctgaacaaaaaaaagaaacagactcgtaatacacacatccacactgatgaatcttgaaagcattatactgaatgaaaaaaagccaggccaaaaggttatatactgtttcattctatttctgtggcattttgaaaaatgcaaaactacaagaagtgagatcagaccagcagttcctaggggctgggactagggctactgactccaaaggtacatgaggccttctttggagtgacagaaatactctcttttattttcgagatgaagtcttgctctgtctcccaggctggagtgcaatggtgcaatgttggctaactgcaccctccgcctgccgggttccagcaattctcgtgcctcagtttcccaagaggctgggattacaggtttcaccatgctggccaggctggtattgaactcctgacctcaagtgatctgcccatctccgcctcccaaagtgctgggattacaggtgtgagccaccgtgccgggacccggggtgatggaaatattctctatctttaatgtagtgctagttagatgagtgcataagttttatcaaaatacatagaagtggctggctgtggtggctcacacctgtaatcccagcactttgggaggctgaggtgagaggattgcttgagtccaggagttcaagaccagcctaggcaacacagcaagaccacacctctacaattttttttttttttaattagccagttatagtggcactcacctgtagtcccagctacttgggaggctaaggcagggggattgcttgagcccaggaggttgaggctgcagtgaactatgattgtaccactacattccagtctcggtgacagagtgagcctctatctcaaaagaaaaaaaaaatcatagaactgcacacctaaaggatgaattttggaaattatatctccaaatacttcattcagtctccccttcatgtggagtcaaagaagaaacgtttcagcaccagaaatggttatacagcacttctcttgagtactggagttgtttttatcttttgcagcctgtgaaccctgtaactaattagtgttaccctttgcccaggctcttagcaagcagggcactgggtgtctgacatgcattctcggtattaaccttctcctcagcatcatcttactttcctactttcatttgccttttgtcctgatttctttctaacaaaccgttttatcttaatgtggtctagatacttgtcagagactaagtatttttttaatcaaggtacagtgtacataaccgaatacatacatacataaataaatcatgacagtgtctcctcctgacacatattaataaacattcaagccataaaaacataattcattaaggcttactatcatgcagaatctaccatgctttattcaatttgggatgtttctttgtatgaggaataaggatctgaacatagcattatcagaaaaaggtaaacaggatggtacttagggaacagggaagtttatcccggagaagagaaagagagacagtgaaaacacaaaagctttctttaaatattttatgagttgtcaggtagaagggaagtaaattaattctgacttgtcccattgaattaggtgtggggccaatgggtacaggctactgtaggaccatttttttttttttttgagacagggtctcactctgtcacccaggctggagtgcagtggtatgatcttggctcactgcaacctctgcctcctgggctcaagtgatcctcccacctcagccttccaagtagctgagacaacaggctcatgccaccactcccagctaattttttgatttttggtagagagagggtctcaccatgttgcctagactggtctcaaactcttggactcaactgatcctgaactcttggactcaactgatcctcctgccttggcctccgaaagtgctaggattacaggcatgagccaccacgcccggcccagcaacccattcctaatggggcacagaacagatacaatgtactgtccgagaaaagacagagtttctaggcagtggttatcactatatatacaggttggatagtcatttgagaaggatctcctataaagattcatttagataaatgattgcttccttccaatcccaagacttaacagttacttaatcctgcgagaaaacagtacccttctgatatgaaactaacttattctgactaagcaaacaccctcattttcttacttatcaacttacgttattatattaagttatatcacaatcccagcatatttgaccaagtagcaatgaaaaggctataccaagaagacattcttatactcattttaggctttggccgttaagaaatccaatgcaaaatggcaactaggctttttgggacttgtatctgcaaaatataccttttttttttttttgcagccagctacccttttatgccctccagaaataggcaggcaatacaacattctctgaatggaagttaaagtgatttcccacttcgtccccgcgctttaacacttaggcaataaagctcgtgacattttcaataaggagcagagaagggaagtgctccttattcacaaaagggctcaagtcatcaccatcccagcgttttcctatttgacaaggcccagttactgccaaatggcaagacctacaatttaaaaaccactttgatcagcaccagggatctgaggctgataggttcagcaaaattgagagccaatttcaggctggcttgaacacctagattccaagcctgtgcaggttcactcggcattcccagcggaggcaagaaagatcctgaaggcatcttaggtgtgattatgacactaggaaccagtaaaggaaagagcaaaagcaatactgcaatatgactgagaattacaggcacacagccacaaaagaggactggtaaatagggagtaatgagtgtgtctgctggaaggcacgctataaaaagaggccaaagaaaggagatgaggccaggcgtggtggctcatgcctgtaatcccagcgctttgggaggccaaggcgggcaaatcacctgacgtcaggagttcaagaccagcctggccaacatggtgaaaccccgtctctactaaaaatacaaaaaattagctgggcatggtggcagatgcctgtaatcccagctacttgggaggctgaggcaggagaatcgcttgaacctgggaggcagaggttgaagtgagctgagatcgtgccactgcactccagcctgggcaacaagagcgaaactctgcctcaaaaacaaacaaacaaacaaacaaaaaaccccgaatatttactgagacccttgtatgtgcaaagtatgaaactaagtattctatatgcattatctcatttgattgtcacatctgcaagaagcaaggtcatattattattctcattacacaggtgaagaaatacagggccgtgtatgatggctcacacctgtaatctcaccgttttgagaggccaacgcagggggatcacttgagcctgggactttgagaacagcccgggcaacatggtaaaaccccgtctctacaaaaaagtaaaaaattagccaagtatggtagcatacacctctggtcccagctactcaggaggctgagatgggaggatcaccagagcctgggaggctgaggctgcattgagctgtgattgctcatagctccattcacagtcactccaaactggaaccactgcactccagcctgagcaacagagtgggaccctgtctcaaaaaaaaaaaaaaaaaaaaaaaaaagaaagaaagaaagaaagaaagaaagaaagaaagaaagagaaagaaagaaaaaaagaaagaaaagaaagaaagaaagaaagacacactcagagttgacgctatttgctcaagctcaacccaactaaaaagaggtgaatacggacgtagtacccacgaatagacaagtaaatgaatacacaataccctccagacatctggaccctgatatgtttaaatttgcatctctctctgaaaccttcagccttctaggggtccacaggcccaaagcttaatgatgacattcaattcgttctgaacaccccacaggatttttcaatagtgggcgtttgcattttgttgcacgctcagggagaagaaacttcgtgtatatctgactcgaaaattgtgtgggccaaaagacttctggttatagaatggcggcctttgtgagaaatgatcctttggaggtctgatccattttttgttttagtttatatctgaaaggagaatatttttaccttctcttttatgttcatctgctaagagagcgtgcaatacttccacacaggcagaaagaacagacctaaagtgggataatttggccaaaggtgtatcctcttttcctttggtattttgtcgcaagtgataaatgatgtcagacaaagctgtcagatgagatttagatggtgtgcagagagacagcaatcaatttccaacttaggaaatttaatggattttaatgagccactctctgttgattaccatgcagctttcagcttcgtgcgtgcttcattcacacgtgtgcttggcagtgattgatgggccgttaagctcccctcatttgattcctgtatagcaatcaaggctgtctcagctgtaaccaggagaggctgatgttgagacctgcaaggcgtgtgggcagagtgtgatctcttgcgatcttttgtttgttccccatattttgcagcttggaacagtcacctgatgttcactcatgaaaagagggacagttctataaacattgagccccaggaattgccagccaggtgagagaattgtcctccaaagccctcacaccatcccctcactggagggtgggttctttgagggcaaacgctgatctattccagttgatggtctcattaacagcaacataagtaggtgctctctatttttgaaaaaataatcctgcactacttaacaggcacattccctgaaaattgaattctgttttgggttttttttttccctttttttaagacacagttctcactctgttgccctggctggagtgcagtggcacaatctcggctcactgcaacctctgcctcccgggttcaagcgattctcctgcctcagcctcccaagtagctgggattacatgtgcgcaccatcacgccgagctaatttttgtatttttagtagagacggggttttgccatgttggccaggctggtctcaaactcctgacctcaggtgttccatccgtctcggcctcccaaagtactgggattagaggcgtgagccaccttgcccagcctgaattctggtttgagtattccttgcttctgatgtttgcaccatagaaataatgggtaagccagaagatacgtatctgtgagccaatatatggttatctcaccgcgtggcaagagcagaaatgtgtcttctccttgcttaagatgaggcttttaaaaccagagacgtgtttatgaactgtaaaccctcattaagaattttagatttggcacatttaagatgcatgataatttgatgaggggagggcctaagtcttcatctccattatcactgaaaatgagctcccttgccaaacaaagggtaaataaaatgacgcagctacgtttaagtgacttaagtaaaaagaaaacttccagagactttggcgttttaattgagggtataaaaggatgctctaattatcaatgtgtctcagagattccatttaaaaatactttttaaaagtagcagttagtttcaattaccttcgatatacaaaaatgtggggatgtgctgtaataaagccccatttcttcaaaatgtctaaataatgaggtatctctaagtagtccaggctggccttccctgcatagtctgaattgatgtaattcaaccaaatatatggtaaacaaaatgatgatctttattaacttggatcatccttgcaataaagacacagcttggctgggcatggtggttcacgcctgtaatcccagcactttgggaggccgaggcaggtggatcacctgaggtcaggagttcgagaccagcctggccaacatggcaaaaccctgtgtttactaaaactacaaaacttagccaggcatggtggtacgtgcctgtgatcccagctactcaggagattgaggcaggagaattgcttgaactcgggagggggaagttgcagggagctgacatcatgccactgcactccagcttgggtgacagagcaagactccatctcaaaaaaaaaaaaaaaaaaaaaaaaaggaaaaagaaaaagaaaaaaaaaccccacacagcttatattgctatctagtcctttttagaaaagaatacacaggctaggtgcctgttccaccaccccttgaggtgttttcttctgctacgatgcttactgaccattctgtccttgaagattctgggcagaaagcagtagactatagtgacaatctgtgatctggatgaattgacaagcattaagtgggcaggtattggcaagttctggggaacaaaccatccgcagagatgtctgtgacttggaaagtgcagccacagacgttcttttcccctggccctgctgtcagttggaacaaactttctggcactctgggaaggaagacggtcaccacctggcctacggctctgtagctccgaggttggactggtgcaattccgctcggattagcaattaggttggaagccagcacaggctccatttgggcaatagttctgggagatgagatgaaggcccctgagatgttttgctctctgttctcattaaccttctgtctggggaaagaaggtcctgtccttaagccaggaagccacagcagggcggcacatcagtcaccaaatcccacccaaccagctggggctttcaccaaatccaattagtcactggctgtgtttcttctcatcagcaagaagggtgctgtgcagggacagatactcttctctgggcaaacccatcccagcaaacaagcccagagacaggtcctgcaacagaggcacatttagggagggatgtgagccccgtgctagcctcttgttccaccaatttgacattcattcctctggtgggtggcatctgtgtcctcagtcataaaaaacaataaagtttaaatccaatggcagaatcaatatttgtagtctctatcccatccaccacctcccttgttaattttcctggcacaatccatatccaatatcttccatgtgcttcatggaacatacctgtgctctttcatttttatttttatattttttaaagaagggggtcttgttctgttgcccgggctagagtgcagcagtgcaatcatagctcactgcagcctccaactcctgggctcaggaaatcctcctgcctcagcctccacagtagctgggactacagacatgcaccaccacaaccagctaattttttatttttatttttctagagataggatcttgctttgtgacccaggctggtcttgatttctggcctcaagtgatcctcttacctcagcttccaaaagcgctgggatgataggtgtgagccaccacacccggcctcttttttatttagttttttaatgagatcacaccaataattatttttaaccatgaagacccatgccccttaatcctccctccatgcactaactttcactctcttgctcttccatcctcttttcatgataccagtttcagtacaaaacacattaggttaggttggtgccaaagtaatggcagcttttgccattacttttgatggcaaaaactgcaattactttggcaccaacctaatagtattaccagctatattaaggcttttaaaatttgagatctcgagtacactctaattatgccagactccggtctccacaagagacaatttccaaccattcacaccagactgagaggattctcaagacaaacatttatttctggtcactggtcttgggtccaccattgactttatttgaacaatgatttcggtcaagaaccaaagaacttcagaggatacactgatgtaaaacacatgggggtagatcccaaggctggccatctggtcatggcaatgactgaaaggtgatgaatcacgtaacatccccaagcagggtggactgagaaccagagagaaaggcaaatatgatagctggacgtgaccttccagggacccttcctttgtggagctaggtcatggggatggtcttgggccacacattcccagcactgagcctggctccttctcccagagattctccctccccaaatgcagaaatgggagcagcctgtgtcctggagcatagatggcctctacagactcttgcacggaaccctagcctaggttctgtccagagacaggagcgctgggcgcagggatggctgagatgttcccagagatgggaaatgaacgaggtcctccctttgatccttatcctattgaaaatggataggctgcttgaaaggctgcgtgcagtgactcacgctgaaactgtgcccccaaagagttaaaagaaaccaaaagtgaatggaaattcttgagtctgcaggatggcagatagaaaaagaaacaactggctgaaactccctctgcttatgagataaaagaactgactgaaatcgattggaaccaagatggctggctggagtttgcacagaaggagcctgctgatgtcacaacctgaatttcccctgcctgtttcagactaactccccctgcaatttgcacgtgcaacccgtgagctaacatgaagagataactgcgcatgcccaaggactttccagagcactttctttccaccaatcacctaatctcaaaatccacccgaaccttttctaataaaaatactgccttgaagccaaccacaaacagacgaatttgatcttgacacttctgtctgcttatgagttgactttccatataaagcttttcttttctaaaaaacctgatgtcatagaactgattttggtcaaaaaccaaaatcaattctagtgcattgggcacccttttgcttgataacaatgtctctaatctcagtgctttgggaggccaagggaagagtctgaaaccagcctcggcaacatagcgagaccctatctctaccaagaaaaagaaaaaaatcagctggcacagcggcatgcacctgtatagtcccaggaacttgggaggctgaggtgggaggatcacttaagccaaggagttcaaggctgcagtgagctttgatggcaccactgcactccagtctgggcaacacagcaagaccctgtttcaaaatttttaaataaataaataaaaatgaaaacgtgagtttgatgagaatttagaccagacagtgttgcacctgcttcctctcatcagattttacaatcagaggggctagtgcctggcactcagccacacaggtctgtctcatgggctatggacacctgctgggagtttacctgagacacatgtctccacagtgcttacaaaaagcaatgcaaagagccaggtgtggtggctcacacctgtaatcccagcactttgagagactgaggccagtggatcacctgaggtcaggagttcaagaccagcctggccaacatggtgaaaccccatctctactaaaaatataaaaattaaccgtgcatggtggcgggcgactgtaatcccagctagttgggaggttgaggaaggagaatcgcttgaacctgggaagcagacgttgcagtgagctgagattgtgccactgcactccagcctgggagacagagtgagactctgtctttaaaaaaaaaaaaaaaaaaagcaatgcaaagaaaaccaaaatcatccctcttcatgcccaccagctcctgaagcaaaagcagactaacacacatcttagcagctgccaaagatatgtgtccaagcaaagtgtaggctcaagatctgcattcctttcttacgtctgggagcttccccaccataagagtcttggtgggaatttgagccacttctgagaataaaccctcaaacaagtcagcttctatgcctaaggatcgtccaaccagatgcaggcaatcacgatgctgaatcttgagtcagtattgcaaaaactcagggactctagagaattctttttttttttttttttttttttttttgagggggagtcttgctctgtcacccaggctggagggcaatggcgctatctcggctcactgcaagctccgcctcctgggttcacgccattctcctgcctcagcctcccaagtagctgggactacaggcacccccccaccacgcccagctaattttttttgtatttttagtagagacggggtttcaccgtgttagccaggatggtcttgatctcctgacctcgtgatccgcccacctcagcctcccaaagtgctgggattacaggcatgaattctttacggtgctggccgaagaacagtagcagccttagcactgagggcaggggcagcgccagctgtggctccaggtgttgtcacgagacctattgttgacaggcttttgcctggtcctattacttcccattgtgcatatagagagagaccaaacttccctgaattgactgcagtttatcccagagtcataggcaacactagagatccatcctccatctctggtgactattatgctttcactatatcctatcactgtagtacatttatgcacataatgaaactgcggaaaagacttattgagcaactatttgttggaagacaattctctgtggatctcttacatttctgtatgtcttataagcacaggcaccaaatgcttttgttcagtactgtcttttcaaggatgtttgcagagagaacagcctttgaagccacagtgtctccctccagagaaagtgcaaatttaattactgcccagtatggtagagatgatgtctccctccaggactgaggtcaggcaagcctactgccccttagctaaggggtcctcccctataattttatgcagatgacactgtgtcctctgagcatcactctatggtagtggtccccaacttggcaccagggactggtttcatggaagacaatttttcctaggactggggagaggggatggttttggggatgattcaagcacattatatttattgtgcactttacttctattattattagattgtaatatataatgaaacaattatacatctcatcataatgtaaaatcagtgggagccctgggcttgtttccctgtaactagacagtctcatctgggggtgatgggagacagtgacagatcatcaggcattagattctcataaggagcgtgcaacctagatccctcacatgcgcagttcacaatagggtttatgcttctatgagactctaacgctgccgctgatctggcaggaggcagagctcaggcaggaatgagagggacagggagaggctgtaaatacagatgaatcttcactgactcacccacctctcacctcttgctgtgcagcctgcttcctaacaggtcatggaccattactgctccacggccggggggttggggacccctgctctatgggaactggggctcaggggaccaactaaaaataatgatactctgcctactgctatggcttgaggaataaagttctttgtataatttaggtgtctcatgtcttctgctagcatccagaaaaccatggcaggtcactggttagcatgcaagtagtataaaatctcagacacatcaggattcttttttttttttttttttttttttttgagacagagtctcactctgttgcccaagctggagtgcagtggtacaatctctgctcactgcaacatttacctctcaggttcaagggattcttctgcctcagcctcccatatagctgggattacaggtgtgtgccaccacatccagttagtttttgtatttttagaagagacaggtttttaccatgttggccaggctggtctcaaactcttgacctcaggtgattctcttgtctcagactcccaaagtgcaggattacgggcgtgagccaccatgcctggcctcttctttttctttttttttttttttttgagacagagtctcactctcttgcccaggctggagcacagtggtactatttctgctcactgcaaccttcacctcccaggttcaagtgattcttctgcctcagcctcctgtgtagctgggattacaggtgtgcaccaccacgtccagttaatttttgtatttttagtagagacagggttttaccatgttggccaggctggtctcaaactcctgatctcaggtgattctcctgtctctcggactcccacaagtgctgggattacaggtgtgagccaccacgcccagccaacacatcagaattcttgacaccactttacaatggcatagtgttcctcatagggatatagaaatgaaatactttaaatggttcttatcctcaagtaactcaggatctagcagcagtacaccagtccagtgggcgatagaagggcctgctctgagcaccacttccacgccctctgcaacataaataagggaaagacactgtccatttaaagaacaaagtaatcatttctataggccaaaaacggaacccaaatgtaatgcagaaaattgccctgaaactgaaggcctgctgacttcgggtacagaaacagagagaggtagcggggtgctcctcccctcctgtggaaagatgtctaaaattgccccctacaaaatgagacacctgggctcagctcattccttgaaagcaggtgctgagagcaggctcctcgactcaggaaaagaggccacagggttctttccaaccctggggctgacatggagctgatcttaagaaggccacaggaagcagaaaaaccacacaccaggacaccgccacactgcccgtggctccctggctaagactacaggagtctacagtgggaatgtggacaccgggaatcattcaccgcagtgctatgatatatattagtttttatccatggttcctggtccataactcccttagccctcgttatagtcttttgttataatatttagtgtgttagatcttaggaacaagtctcaggagacagaatctctctgattttcccctgcccccctttcatctgcccaaaggcaggactctaatcttcccctgcctttctgattgtgggtcttaagaccctttccagagagggtcctcccctataccctgggggacaaaatgctgacatcgtgaggcatccataaaaacccaagaggggctgggggtggtggttcatgcctgcaatcccagcactttgggaggctgaggcggaaggatcacctgaggtcaagagtttgagaccagcatggtgaaactctgcctctactaaaaatacaaaaattagccaggcacacctgtagtcccaactactcaggaggatgaggcacaataatcgcttgaacctgggaggcggaggaggttacagtgagcagacatcacaccactgcactacagcttgagcgacagagcgagaccctgtctgaaatgaaaaaacaaaaccaaaaaaaaaaacaagaggacagggttcagtttggggagcttctggatagctgaacacgtggaagttcctggagggtggaactacctacctctctctaggtagatagtgtcagaatggaattgaaggactcccggcttgtgtctgctgcttggtgtgggaggaaaacccctgcgcatctggtcacagaagtcttcctctgtgttgacagttgtggtggtggtggtacgagagtcgaggaaaaacacagctgaagagtttttctgaaacactcactcttttcctgcaatgggaaacactgcaggctcccagctcatcccagccaggcacgctgcctggcttccctcgccttgcctttggtgttttctcactttttagttgacttctagctttctctcttaggtgatctattcagtatgtgattatcgactggctgttttggttcttctttgtgaaggaggtgagtaccagatgcctctggtcagccaatgtgaagcccctctgtctccctgcctctgtgatattatcagggtcacccaaaaaatcaagaaaaaatgaaggtggcggtggccacagagatgctgaataattaattttgaacttcattaaaacattttaaaagatattaaaatgcaagggtcggccgggcacagtggcttacgcctgtaatcccagcaatttgggaggcggaggcaggtggatcacctgaggtcaggagttcaagaccaccctggccaacatggcaaaaccctgtctctactaaaaatataaaattagctgggcatggcagtaggtgcctgtaatcccagctactctggaggctgaggcaggagaatcacttgaaccggggaggcagaggttgcagtgagtcaagatcacgccattgcactccagcctgggccataggagtgaaactctgtcgcaaaacaaaacagaataaaaaataaatgcaagggtaacctctaaattaacagaaatacaatttatagcttccaaaccaaggaagtgaaataggagttaagaagaaatgatttgggcagatagtgagggtaaggaagtcctcagtaaagtcttcctttcagtggaaagcagcccccaaatcatttccttttctaacaaacagcagcctgtaaaactgagctgcagacatagaaaggcaggccagaagcttgcatgggtgaatgccggcagttgtaccagtaggaaaggggctacctgggactaggcatgtccaacatggcggctccatcttcccttctctttgccaaccacgtgtgcagtaaggagcagacaacctggtgcaggccaagtgaaagcccatttgcataataagattagggtggggcagccagcttcccctcacactatataaacatcacacctggtccaaccaatctgtgggccctatgtaaatcatgcactgcctcctcaagcctgtctataaaatccagtgcagtctgctgccagctgggagtcccactcaggcacccttctctctcgagaagagcaagctattctcctttctctttcttttgcctattaaaccttcactcttaaactcacttcttgtgtgtgtctgtgtccttgatttcctcggcatgaggcatgaacctcaggtatttacctcggacaatgatgccaattcagaaggaaacaaaatgagaagagggttaatctactcaacaggtaaagaatgcaacctaaccaatgatatagaaaacacaaaataaggatagtacaaatgagtccaacagtgtctctattcacacatacacacacccacatatgtgcacacacatacacacagaggaagtggattaaactgatctctttaaaggcaaagactatctgattggatgctttttttttctttttttgagacggaattttgcgagtgttgccgaggtgggagtgcaatgctgtgatcttggctcactgcagcctctgcctcctggttccaagcaattctcctgcctcagcctcctgagtagctgggattacaggtgcccgctaccatgcctggctaatttttgtatttttagtagaaacggggtttcgccatgttggccaggctggtctcgcactcctgacctcaggtgatccacccacctcggcctcccaaagtgctgggattacaggcatgagccaccacacccagctgattggatgcttttaaatccagctatatgctacttacaaagacaaacccaagtaaaaacacacagaaatgctgaaaataaatataatcaaactatattaaagagacattaataaattatgatcgaaaaaaacagaggagatgataaccgcgccaaaagataatagtttgtaaagactaataatatagatggacctctagctaatctaaaaaatatatataaactcttaagagtaaataattaatcaaaagaatactctcttacaaaggaggaaagaaaagatgatggctttctagctagcgaggttaattcaggtgaaacagcacagatgagccaaaaaaacactctttctctttgcatagtggagggtggaagagagagagtgaggggggaacaggcagaagtgtgaaatgattgggagcctttgaccatttaaatgagaaggccaagaaagtagtaggaagccagccaagtagaattaaatgcttgatcaaagtcgcaaggtgtgtaagccactcctggttgctttagaatcagaatctactcatctcatgaaataaacggtaatttgaagagagatgtagtgtatcatccttcaaagtcacaataaccaaaatagcaagaatgatgttatccaggtgaagaatttgagtcatgtatagaagagttaacttgcccccacgcactggagagaacatttggaccatgctgactggttccagcctccagtgactcatgaacatgtggaggtgcttattctctccctcttcaatcctgccccaccatgtgaacatcactggaggggtacaggagacccatggcaggggctggtacccttctggagagatatgggagacccatggcaggagttgggtcttgccacccaaggccatcccagaccagctgcagagtaaatgcacctgacagcaataactttagcatacacttagagtaaccctgtatggcaaacacacctgaatgactctggctaagcttatgtaggaaatgaaccatggagttgcagattcacgcaattaagtatccacacatggttggctgttatcctcattcattactgcccagattcttctacttggcaaagatggaagttctttctctctcctggggacgtagcaagttggcttgagtttggagccgtccaggcagactgtagcttgagttattatttctctgcttgctactgcccaggagcactgagttactccatgtaagagtacaacaatgaatcaaaacaaagaagaaaaagacacaccaccaaattgaaaaacctggcaaagacgatgaacaggcaagctacaaaagagagaacccaactggccaataaagacggggaaatgttcagcctctctgaagtgaaaagcagagcaaatcaaaacgactatgaaatatcatttcacactctgcgtattggcaaagattaagttaccaaggatgcaggtaagtgggagctttcataaggtattgatgagattgtgcattgaaacaaagctctttagaaagcaacgcagcaggctgggtgcagtagttcatgcctgtaatcccagtactttgggaagccgaggtggaaggattgaatgagcccagcagttgaagaccagcctggacaacatagcaagaccccatctctactttaaaaacaaagagagaacaacttaccaattcttaatggaactaaagatatgtattcccaataacacagtcctaaagaaactcatgctgtacaggtagttttctttttttttttttttttttttttgagatggagtattgctctgttgcccaggctggagtgcagtggctcagtatcagctcactgtaacccctgcctcccaggttcaagcgattctcctgcctcagcctcctgagtagctgggattacaggtgcacactactatgccctgctaatttttgtatttttgatagagacaggatttctctgtgttggccaggctggtcttgaactcctgatctcagatgatccacccaccttggcctcccaaagtgctgggattacaggtgtgagccactgtacctggccagtagttatgatttcaatagcaacatgacttgtaataataaaaatttggaagcaatctaaatgatccatggtatgagactggatgtattgatgatggtataatgaaatattctgcagcatttaaaataatctatattgacacgcatcaacatggataaatctttctcttttttttttgagacagagtcttgctctgcacctaggctggagtgcagtggcactatctcagctcactgcaacctcctcctccctggttcaagcaattctcctgcgtcagcctcccgagcagctgggaccacaggcatgtgccaccacacccaactaatttttgtatttttagtagagatggggtttcaccatgttggtcatgctggtctcgaactcctgatctcaggtgatccacctgacttggcctcccaaggcctgcctcaggcctcaaacctgaggattacaggtgtgagccactgtgcctggccagataaatcttaaaaagcatcttgatgcttaaaaatataaacccagctcattgcagtcttacaccatttagataaaattatacaagatattctcaacacgcacagtgtgggtgaacagaaactggctgagcagaataaaggtcttgatcttcagctgcagacatcacctttcattgatgccttttatgtaaagcacattactgtttacactacacacctacatagaaaaacagaaaaatgtggttagaaaagataaaagccaatgtggcccagtgggaaaaagagaagaacttaaaaccgggaagaaaactaagaggacacagatctacaatatttcacctctttagaaattctgaagcaaatgctgcatagtttaacatttgttcagtacaggtgatttgttatataacatggtgtttcctatatttgctctgtactttgttgtaggagtaaaatatttagttcttaaaagtcttgtggggccaggcacgatggctcatgcctgtaatcccagcactttgggagactgaggcaggcagatcacttgagaccaggggtttgagaccagcctggccaatataacaaaacaccgtctctattaaaattacaaaaattagccgggcggtagtatacgcctgtaatcccagctactcgggaggtggaggcaggagaatcacttgaacctgggaggcagaggttgcagtgagccgagatcccgctactgcactccagcctcggtgacagagcgaagcttcgtgtcaaaaaaaaaaaaaaatctcctccacactgaagtcacaggcctgccagaattttcacctagggacaaagtgacatttctctgatgggatacattttaaaggggcaacagaaggaaacaaatataaaagttgtgctttgattatgtcacgagttgtgcttattcagtgtctgtgaacacgaggaaccactggcttcaggacaggggcccgtgtgctatttcacaagtccatgcgggggctgtgaggacacaggagcagggcccccaggggtgggctaggcagtctgcttccccagcaagccctgactactaagcagcctatgaatgcatgatgcaggcattagcttcagggaggagagcagaaagggaggggcccatgggcacagggaagagccactgggcaagtgtggaggtgcgaggacatgtgttgggaccatgagtaatttgggaggttttcagggtaggcttgtgaaagtgttacgcaacccccatgagaggggactgggcttaggaggcagatcatgaagggtttcggaatttgcactgtcctcagggagaagtggagtctttgaaagattttgagcagaggcgtgaccttgaaggatcatgcagttcagtctcttgcctgcaggcagataaatgtctaaatctttccggatagcaggctcgtctcttttttattgtctctaaggacaggctctagagtctccatcctttatcttttttagtgttgggcatatatagctgggagtggagaaggtgactgcacagtgcaggacagatggggaagggaatgagacctcactcctcgaatccagcgggtccagggacacagactggagagcagtgggggaagggaggccgtgtcagtcaggcagcagggcacagagtgcccaggtgtgacaacaggtgtcagcaaacagtctgcagcaagagacaatgtctgatgacaacgacaaggatggccatcttcatcatcatcatcatcaccaccatcattgtcgtcatcacagcagacactgatacagtacttgtcatgtgtcaggaagtgtttaatgctttgcacagttccatcaaccctaggaggtgtgtaaatcatatccccactttaaagatgaaggaaatgaagcaaaaataaggagaagaagttgactgtgcttccacagcttgtaaggggcatctggcactcagaagcagccagttggctccagcatctatgagcctaaccacaacaccatatcgtatctccaaaggtgtgtgcgcgcatcctgccaggcacagaaactgcggcagaggcggctctcaggaaggcatagccggtgccccaagcccacagtcatgtggaatagactcagagagcatacttgttggtttcattctacatcctttctccgacacatggctgaattagtggaaattcctcccagatataggcctgtggtcatcttttatctccaggtcacagttggcactgactatatttttaatttatttctgtgtgtattcttctgggaaattaggagaagtctccacgtatgagacgctaaaagcagggccctagctatgagaatgagatccaggcacagacgctgacccgggccatcgatcagagctggttcacaagaaatctgatgcttgctgtttccatgtagagcactacatgggaataggagggaggggactggacacacagtgagtgacagtgtgtccagcatctcagatgtggtctctcatttcatcctcacaatgaccttgtcatgcagacattcctatgagagctaaggaagcaggctcagaggggcacaataacaggctcacagtcccacagcaaacaggaggcacagctgggagtaagtttatttgcctcaaagccctgtgcttttttctattactcctcactgggaattttgcaagtatcagccaattgcatgctggcccagagtcaaaccagatttccttgctaatttcccagaagaatacacaaagaaataaaaaagatagtgccaactgtgaactatagataagagatgactggctgggcacggtggctcatacctctattcccaacactttgggaggctgaggtgggtggatcacctgaggtcacgagttcgagaggagcctggccaacatggtgaaaccccgtctctactaaaaacacaaaaattagctgggcgtgatggcatgtgcctgtagtcccagctactcaggaggctgaggcaagagaactgcctgaagccaggaggcggaggtttgcagtgagcagaggtcgcatcactgtactccagcctgggcaacggagtgagattccatctattaaaaaaaaaaaaaaaaagatgatcacaaggccaatatctgggaggaatttccactaattcagctatgtgtctaattcagccgtgtgtctgagaaacgatgtagaaagaaaccaccaagtacactctctgagccacaagaagacaaacagccccaaagaaattggaaaaccaagatagataacctttgcactttgcgacaaatcgcaggatactgggaaaatacggatccggggcgagggttggaggggagttagcacaatagttttgaaaaggaaatgaaggaaaataaacattatcctgattagaggagaaaaacaactccaaaaatcactgttagcaaacaaagatggtgctttaacacagcttagtgtcttaaaaaaaatccaggcacactatggaacagaagcaggaggagaagaaattgaaaagggaatgaagccgaaagggattcaagaaagacagaagaagatactaggaaaataaaaaaccaagagcaaaatcaaaattacgttgtaggttgtgtaggctttgaaaccagggtgactccatcttgaataggggctggataaaatgaggctgagacctactgggctgcattcccaggaggttaagtcattctaagtcacaggatgagattggagtttggcacaaaatacaggtcacaaagatgttgctgataaaacaggatgccatgaagaagctggccgaaacccactaaaaccaaaatggcgatgaaagtgacccctggtcgtcctcactgctcatcatatgctaattataatagataagcatgctaaacgacactcccaccagcaccatgacagtttacaaatgccatggcaatgtcatatggcctaaaaaggggaggaaccctcagttccaagaattgcccacacctttcctggaaaactcatgaataatccatccgtcgtttagcatatcatcaagaaataactataagaatactcaatcgagcagcccatgccactgctctgcctgtggtgtagccattctttaattcatttacttttttttttttctccattctgtcacctaggctggagtccagtggcgtaatctcggctcactataacctctgcctcccaggttcaagcaattctcctgcctcagcctcctcagtaactgtgattacaggtatgcatcaccacgcccggctaagttttgtatttttagcagagatggggtttcaccatgttggccaggctggtctcaaactcctgacctcaagtgatccaccagtcttggcctcccaaagtgatgggattacaggtgtgagccaccacgcccagcctattcccttactttcttaataacgttattttactttgttaataaacttgctcttactttactctaaggactcgcaccaaattctttcttgtgcgaggtccaagaaccatctctttggggtctggattggggcccgtttctggttaacagtttcatacagcacaacatacactccagaaatcaaggagtactaacgcagaggaccaacattagaatctctctaaatcaggagtactaacgcagaggaccaacatcagaatgtctctgaattcagatggaaaaggtatgaaacagtgagggggggggtcgacaaatatgaaggaagagaacagaagtaagaattcgatgtgttgcacaggagaaaaccataaggctgagtaagaacaaaacgaaagcataagcaagaattaaaaaagaaaataataggccaggcaagttggctcacacctgtaatcccagcaatttgggaggccaaggcgggcagatcatctgcagtcaggagtttgagaccagcttggccaacgtggtgaaaccccgtctctactaaaaatacaaaaattagccagatgtggtggtgggtgcctgtaatcccagctactcgggaggctgtgacaggagaatcacttgaacccaggaggcagagctttcgatgagctaagatcatgctactgcactgcagtctgggcaacagagtgagattctgtctcaaaaaaaaaaaaagagaatagcagaaaactgcactggatggaaggcctgtgcctacattttagaagtgcaaagcaaagtaataaagatgaaccattctgaccaatcaatctataacatgattttaaacaaataagaaaaaaaaatcataagcaccaggcaggttgtacaaaacagattctctacaaggaatataatcaagccaagttcaaacttattttctacaaagaacaagaaaacaagggacagatacttaaaagtagttccagtgaggcattctgcctacaattttacttagaggaaggttgtggctggtgccatttgtggtatggccagaagccactcacttcccctcttcctttcttaaaaaacaaaacaaaacaaaaaactgatttgatttgataataatgagttgtaaaaataagtaattcaaaatctaagctgttggaactttaaaatactttgacccttaagggcatgtgattatgggaactgagtcacataaacaggcagctgtaacctaggcagctataacctttgtttgtatgattatagattattcttcttccttacctgttaatacattgttttagaaattgtaaatgatgaaagcacatcagggaagaccccttctctgttcactgtttatcttcattatagattaacttcccacttacctttctaacacaaagacattatgactatcacattgtctaagatggaatgttaaatacacttgtttaaattggaaaggaaatgaaaacaagctgcatagaaaagaaaataaactgtaactaactaaattgctgcagctcataaactagccttgtataagaaaatgttataattctactaaattcctttgtttactgcctatataagcaagactttcacatttttttttactattatttttcttagagaaagagcctcattgttgcccaggctgggatgcagtggtgcaatcatggctcactgcagcctcaaactccttggcttgagccatcctcccacctcagcctcctgagtagctgggactacaggtgcacatcaccatgcccgctaagttttaaatttttcttgcagagatggggtcttcctatgttgcccaggtttgtctcaaactcctggcttcaagcaatcctccagccttgaccttccaaaccaatgggattatatgtgtaagccatcgcacccagcaaagaccttaacttttaacttgagagcactgaccccatttctctggagtttgtgtttcctgaatggctattcttacctttgggctgcaataaactctatacttaatcatattttcgagaccagccgaaatatcgttattaaatctcgttacttaaggttgacagactccagcaccaagggtggatcatagcagatctaagccaatcacgatcactggcctcttttcctattttctcagcttctcttgctgctaagagtaggcataccattctgatcttgctgatgaaacttacagggaaaagctgctaggagatttctgagaaagagttcccttcgctcataagaaagagaaccattggagaagaaagagaaccattggagaagaaaggcttttttttgctaccacccccaccccattccaaatatagttctggtgtctgaggctgtagcagcccttttgtagccagaaggcaacatggatgaggatgtacttcctacaggctgaggatgtaaagtggaagacggaggtgcagaggcccaggaagacatatcaccagcctctgttgccaccttgactgcccatttttgttaggtctgtgtctttagtatttaagtcattgtcaagttctcttttagatataagtaagtgctcacttattatatctcttagtggatggtgtgtgcctgtagtcctagctacttgggaggctgaggtgggaggatcactcaagccaaggagtttgaggctgcagtgagctatgattgcaccgctgcaccccagcctgggcaacaatgaggctttttttttttttttgtctgtcatggagtctcactctgtcacccaggctggagtgcagtggtacaatctcggctcactgcaacctctgcctcccgggttcaagcgattctcctgcctccacctcctgagtagctgggattacaggtgtgtgtcaacacacccagctaatttttgtatttttagtagagatggtgtttcaccatgttgggcaggctggtctcgaactcctgggctcaagtaatccacctgccttcgcctcccaaagtgctgggattacaggcgtgagccactgtgcccagcctgaggatataaatattaacaggaaaagcacaccacacaaaaattccatcatcatcattttatcacttgagacacgatacgctaaacaaaattaaacaaccttctcaaatgaaggccttaattaaactaatgtacattatgaacctgcaagagatgaactgatatgaagcatttttactacaaaaaatgttgaattatacgactgaaatttaaatgttgtgaccccaaactctatattcagtcctattttaattttattcataaagttaatggaataatattttcagatctgcaaaggcctagaaaaatatgtctcttgagtaatacccaacccctactataaaaatttttaagaaatgtttaaatttttaaaaattttatgagattaattataattaacaattcagatgtaagaaatttaaagtacaaaggaatgacaatgtaaataaaaactgtttacagatagtaaaattgggccaggcacggtggcccatgcctataatcccagcactttgggagactgaggcaggcggatcacctgaggtcaggagttcaaggccagcctggccaacatggcaaaactccgtctctactaaaaatacaaaaattagctgggcatggtggtgggtacctgtaatcccagctacttgggaggctgaggcaggagaatcatttgaacctgggaggcagaggttgccgtgagccgagatcgtgccactgcactccaccctgggcgacagagcaagacttcatctcaaaaaaaaaaaaaaaaaaaaaacagtgatagtaaaattgaagtggtgttattcatctggagtaatacatgagattcgttgcctcatgctaaggaaattaaggataccaacacaccagagtgaggttaagagcaaaagtttaataggcgaaagaaagaggagagccctctgtacagagaggggtcctggagaaagatgagttgccagttctgtgctgaaatgcagaaggtttcatagagtagcttaaggaggtggtgtctgatttacatagaggacgaaagattggttggaccaggtgtgccatctgcatagctcacgaagaacctggctgccccttcctattttttttttttttttttcgagacggagtctggctctgtcccccaggctggagtgcagtggcgcgatctcagctcactgcaggctccgcctcccaggttcacgccattctcctgcctcagcctcctgagtagctgggactacaggcgcccgccaccacacctggctaattttttatattttcagtagagacggggtttcaccgtggtagtcaggatggtcttgatctcctgacctcatgatccgcctgcctcggcctcccaaagtgctgggattacaggtctgagccactgcgcctggcgccccttcctaattttttattacgcacatgggttctctacctgcccagggccatgttgcctggtccttactgtacacgtgatgaagagagaagggaagacagagcctccgtgctgaacgcacctggcttccaggttcctcctttattagcacagctgctgtcattcacccgtgcaagctttagcctgctgatttatgtttgcagctggagtttttaggctgctctttgttagaaaagaaattattttggggctgctttttgttaaaagggaaaccttgctgagaattcctttagcctcactatctgcctaagtaatttctttctagctcctgtatcaaaattaactgttgtaaatatgatacaaaactaaacacaaggccggctgccgtggctcacacctgtaatcccagcactttgagaggccgaggtgggtgaatcacctgaggtcaggagtttgagagcagccccagacaaaccccacatgacaggcaaggaggatctattggaataccactaacagtaaaaagctaagggaggtgctttccttccctggcaggcctgaaatctccctctctcaccaaaatataacacgacagccccagcaaggtagatctccaccaaaacaaacagcctgatccttgtggttgaatccactatactgttgcccagagattggaggcaacagtatagtggattcaaccacaagtgcgtggcctggggaatgctctgttccccacagcagaggagaatctcgtcataaaaagcacttggcttaggaagcctccttgttcctgcttaagaatctcctcccgcaaagagatacacctgccatctttgcctaagaaaatcttttctgccccgtcaagaagcaccaggaggaaccactgggaccccagcagccctgtataaaccaggctggctaatagagcaccataaaggcactgcaaacaagttctcattgcaaccatagtccgcaaaagtataccagaatctaaacctaaacgaggtgactaaacctaaacatgactaaacctaaacaagataactgcctactaaaagaaaagatttaaatagaatccagagtccatgaagctaccagatgaaatatctgcgataataatagaaaatcactcatcacatcaagaaccaagaaactcacaacttgaatgagaaaagacacttaactgacttcaatactgagatgagtcagacattgaaatcatccacaaaggattttaaagaaaccatcatgccccagtgagtgttgttcccctccctgtgtccatgtgttctcattgttcagctcccacctataagtgagaacatgtggtgtttggttttctgtacctgagttagttagctgaggataatggcttccagctccagctatgtccctgcaaaggacatgatctcattctgttttatgtctgcatagtattccgtggtgtatatgtaccactttctttatccagtctgtcaggagagcaagggggagggagagcatcaggataaatagctaatgcatgcagggcttattaccctggatgatgggttgatatagccaccatggcacatgtttacctatgtaacaaacctgcactgtcctgcacatgtatccttaaaataaaataaaattaaattaaaaaaagaagtcaccatgatgtttcaacaatcaattaaaaagtctactgaaacaaatgaaacataagaaaatctcaacaagtaaataagagttataaaaaagaaccagctgggcttggtggtgcaagtaaataggagttataaaaaagaaccagctgggcttggtggcgcacatctataatcccagtactttggggaggccaaggtgggaggattgcttgaggccaggagttcaagaccagcctggaaaacacagtgagactttatttctacaaaaacaaatttaaattagctggttgtggtggcatgcactgatagtcccagctactcatgcgagtgactgaggcaggaggatggcttgagcccaggatttgggggttgcagtgaactatgactgcaccactgctctccagcctgggctacagagcaagatcctgtctctaaaaaaaaaaagaaagaaagaaagaatcaaatggaaccaaatggaaattacaaaactgaaaaaaatcaaaatgtactggataggagagtagaggacagatgacagatgtcaaaatcagtgattgtgaggacagatcaataaaattcactcattatgaacaccagaaagaaaatagatgaaatgatataaacagatcctcaggggcaattaaaaaattcaacgctcatcagagtcccagaaggagaggagacacaaaatggtgctaaagagtattcaaagaaggaatagccaaaaatctccaaatttggtgaaaaacacaaaccaaagatgcaacaagctgatcaaacctcatacagaaaaaatccaaataagcctatgcaaaaacatgttacaattgaacttctgatgataactaaaaactcagaaaaattctagaaagcatccagaaagaaatgatgcattacttataggcaaaaaaaattcaaatgacaataatgtccctatctgaaattatggaggccagaagtggcacaacattcttcaagttgtgaaaaataaaaataatttttatttatgaatttaattttattatttatttagttttgagatggagtttcgctcttgtccccctggctggagtgcaatggtgtgatctcagctcactgcaaactctgcctccagggttcaagcgactcttgtgcctcagcctcccaagtagctggaattacaggtgcacgccactgtgcttggcttatttttgtatttttagtaaagatggagtttcaccatcttggccaggctggtctgaaactcctgacctccctaggtgcctccacctgcctcagcctcccaaagtgctgggattatagtcgtcagccatggtgcccagcccatctatgaattttacatctggcaaaattattctctagaaatgaggggaaataaaaacattcttggataaagaaaaaccaaaaaatttaccatgatcagatttacccttaaaaactgccctaaaagaagttcttcaaacagaaaagaaatgggaagagaatcaagcttggggcatcaaggaggaggaagaaataagaggaacagtagcaatctgggtacatacaatagactatccttttccttctaaattgtgtaaattatatttaatgattgagacacaaattattaacaacctcttgtactcaagacaatgatatttaagagcagggaaggtaatggttctaaaaggaaatgcggttttcatgttccacttgaagaggcaaaatgtcgataccagtaaagtctgatgtcacagagcaaccactacaaaaactatacgaacagatatactttttttttttttttgagacagtctcactctgttccccaggctggagtgcagtggcatgatcttggctcactgcaacctctacctccccagttcaagcaattatcatgcctcagcctcccaagtagcgtacaccaacatgcccagctaatttttgtatttttagtagagatgaggtttcaccatgttgcccagactggtcttgaactcctggactcaagcaatcgcctgccttggtctcccaaagtgctgggattgcaggtgtgagccaccgcacccaaagagatatactttaaaatgcaatgaaaaaatcaagatggaatcctaaaagctgttcaagtaccctacatgaaaagaaaaacagaggaacaagaatccaaggaaccaaacagaaaaaaattaataaaatggtagacttacatagataattaacttaaatgtaaatggtctaagtacaccaataaaaaaacagattggcaaagtggacagagacacaatccaattttatgctgtttacaagaaactgacttcaaattcaacaacataggcagaatggaaaattatataacctgaaaatattaattttaagaagcagcagtggctacatcaatacaaataaagtcaacttcagagcaaagaaaatcactatttaatagaagcaaagagggacattatataatagtcaaaggatcaatccaccaggatgatatgcaatcttaaatatggccacatcaaaaagcttcacaatacatgaagcaaaaacagagttaacagggaaaacagacaaattcacaattatagttggaaacctgaacagccacctctcagcaaaggacagaactactagggagaacaatcagtatgtatacagagaactacatagcagaatcaaccagcaggatctagctcatatacacagaacactccatccaacagcagcatatgcattttttttttttgagttggaatctcactctgtcacccaggctggagtgcagtggcataatcttggctcacttgcaacctctgcattctgcctcccaagttactctcctgcctcagcctcccaagtagctgggattacaggcatacaccaccacaccctgctaatttttctatttttagtagagacaggttttgccgtcggccaggctggtcgcaaacttctgacctcaagtgatccaccagcctcagcctcccaaagtgctgagattacaggcatgagacactgtgcccagccatatgcattttttttaaatgactacggaacattcaccaagacagataatataaaggctataaaacaaaccacaaagatataaataactgaaatcacacagaatatgttacctggccataatgaaatcaaactagaaactagcaacagaaagacaccaggaaaacctctaaatacctggaaaattaataacacgctgctgaactcaaggttcaaagaagtctcaaagtaaataaaaatacagagaactgaaagaaagtgagcgtggaatgtcaatcaataatcgaagttcctatctcaagaaactaaaaaaagaacaatacaaaacaaaaagctacaaagcaggtggaaagaagcaaatagtaagctaagagcagaaaacaatgaaattggatatagaaaaataagagaaaaatcattgaaacaaaagcatatttttcaaaaaaaaagaataaaattgacacacctctagcaacagtgacagaaaacagccacagaaaacacaaatcaccaatatcagaaatgaaacagggaatattattatatatcctgcaaccattaagaagagaataggggaatactatgaataattttatactcataaattcaacaacttagaagaattggaccaattcctggaaaaccacaaacccctaaaacagatgaaatagataatctgaatgatgctacaccattaaagaaattgatttcataatttaaaagattttgaaaaaaagaaaaaatctccaagcctaaatagttacattggaaaattctaccatttaaatatgaattaaaaaccattttataccatctctcccataaacagttttacacaactccccacaaaataaaagaaatagaaacacttactaattcattttacaaggcctcataacaaaaccagacagcacaaaacaaacaaacaaacaaaaattgcagaccctatctctcatgaacttagatgtaagaatcttaacaaaatactagcaaactgaatccagtaatgtataaaaagaatcatacaccatgactgttacagtaggtagtcaggcagacatcagcagggccggagagggttccctctcgaccaggaatgtcagaagaccatcaggtgatgggcaggtagttgttaagttgtctctctaaaatagtaattggtcatagctagcaccagggaaaggcagtctcccaataggtagaaaaacctgaagcaggtgatcaacttctcaataagatctcaggagttgggtgaatggactcatgtatatgcactaaataacagtaattggttgtagccagcatcagggaaaggcagtctctaaacaggtagaaaaacctgaaactggtgatcagcttctcaataagatctcaggagttgggtgaatggactcatgtatatgcactaagtaacagtaattggttgtagccagcatcagggaaaggcagtctctaaacaggtagaaaaacctgaaactggtgatcagcttctcaataagatctcaggagttgggtgaatgggctcgtgtatgtgcactaagtggcaaagtggcagagtttaacaggtgcatgaccttctaggagcatccaactcaagagagcatgagtgcaactccagtacacccatgtgtactgtacactgtatacacatgtggcctctcctaggtgctggcaggccactgtgcatgtggacagcccaccccaaggggagaataaggggagaagggacacaagaccctggaagtatgccaacatataaaaccctaagtcaaaggtcaaaccacgcacttgatagctcacactgcccacttggccttcttccaagtggactttacttccttttgttcctgttctaaagctgtttaataaactttcactcctgccttaaaatttgcctcagtctctcactctgccttatgccccttggttgaattctttcttctgagaaggcaagaattgtggttgctgcagacccatacagattggccactggtaacatgacaaagtcagattcatgtcaggtaagcatgtctggttcaacagccaaaaatcaatcaatttagtcatatttaacattttaaaagtcaatcaacataatccaccatatcaacaaactaaagaagaaaatcatataaccatatcaagtgaaacagaaaaaacatctgacaaaatacaacacccattcatgataaaaactttcagaaattaaagaagagaagaattaactgaacttggtaaagaacaactacaaaaattctacagctaatgtgaaggactgaaaaaattgaatgctttctctataagattgggaaggagccaagaatatttactcccaccactgctagtcaacatcatacagatgctccttgagttatgatgagatttgatcctgaaaaaccactgtaaattgcaaatatggttaagtggaaaatgcatttaatacacctaatatactgaacatcctagtttagcctaacctaccttaaacatgctcagaacatttatgttagcatacagttggacaaaaatcacctaacacaaagcctattttataataaaatgttgaccatctcatataatttattaaatactatactgaaagttaaaaagcaaagcagatatatgggtaattgaagtacagtttctagtgaatacatatcacttttgcatcattataaagttgaaaaattgtaagttgaacaaccataagtcaggaaatgttggtaccagaagtgctagccagctcaataaaataagaaaaataaaaggtatacagattggaaaagaaggaattaaatggtctttatttgaagatgacatcaactttgatgtagaaaatcccaagaaatctacaaacgaatccctcctagaactaagtgagatcagtaaggttacaagacagtattatattcagcttttaaaaagaaggaaatcctgtcatctctgacaatatggatgaacttggaggacattatgctaaatgaaaaataaaccaggcaagcactccatgatctcacttatatgtagaatctaaaaaagttgaaatcacaaaaacagagaataaaattacagttatcagggactgaggagttgtgaggtggggagatattgaggaaaggatacacaatttcagttatgcagtaggagaaagttcaggagatctattatataatatggtggctatagctaacagtctattgtacacttgaaattcctgagagattagattttaaatgatctcagtaagtatgtgaagtaattgatatgttaattagcttgatttagccattccacaatgtatacagatatcaaaacatcatgtaactataaatctatacaatttttatttgcctatttgaaaaattaatcctattaattaacacaaaaaatcacatttctatttactaacaataaacatgttacattcactccaaagaagatgaaatacttaggtatacccttgtcaagacaagtataggatctttattcttaaaattacaaaatgtgggtgaaagaaatcagtgacttaatgaaaggagagacatattgctttcatggatgaaaacaggtgtccccaactcccgggccatggaccggtaccagatagcaagaggtgagcggtggttaggaactggactgcacagcagagggagaacggcaggctagagagagaagcttcatctgtgtttacagctgcttcccatcgctcgcattaccacctgagctccacctcctgtcagatcagcagtagcattagattctcatagaagtgtgaatgttattgtgaactacacatgtgagggatctaggttgtatgctccttaggagaatctaatgcctgatgatctgtcactatctcccatcacccttagatgggactgtctagttgcaggaaaacaagctcagggttcccactgattccacattatggtgagttgtataattatttcattatacattacaatgtaataataatagaaataaagtgcataatcaatgtgatgtgcttgaatgatcccgaaaccatcccccaccttggtccatggaaaaattgtcttccacgaaaccagtctctggtgccagaaaggtgatgacgctattcctagaccactggactagaagactcaacataataaagatgccaattctcccaagttgacttataggtttaaggcaattcttatcaatatcctggtgaattttagtaggcacagacaagtttattctataatttacatggaaatacacagatcttagaagagttaaaacaatcttgacaggaaagaataaagtacaagaaatcacttaactgatattaagtcttactatatagttacagtaatcaaaatagtgtagaattggcagcaggacagacacatggatcaatgaaacagaacagagaacccagaaatacacccacataaatatgcccaattgatttttggcaaagtcatcaaagtaattcaatggagaaaggacagccctttcaacaaatgatgctggggtaagtggatatttgtaggtaagaaaatgaatcttgacctaaaggtgtgaaccttatccaaaaattaactaaattctggatcatggacttaaatgtaaaacatagaactataaaacttttagaagaaaaaaataggagaaaatcttcagtatctagggctaggcagagttcttagacttgacactaaaatcacagtccatactgggaaaaatcgaaaagctagaccacatcaaaattaaaagcttttgttcttccaaaggttgtaagaagagaatgaaaagataaactacacacttgcagaagacatttgcaaacaacatatctgaccaaggagtagtatacaaaatatataaagaattctcaaaactcaagaacaaaacaaaacaaaacaaaacaaaacaaaaacaactaaccaatttgcaaacaacatatctggccaaggagtagtatacaaaatatataaagacttctcaaaactcaagagcaaaacaaaacaaaacacaaaaacaactaaccaattagaatatgggcaaaagacatcaacagacatttcacagaagaggacatacagatggtaaatgatcactgttaaagattagccatcagagaaatgcaaaactgcagttgagagatcactccacacctaccagaatggctaaaatataaaatagtgacataccaaagctggtgagaatcagaaaacctgaatcactcatacattgctggtgagaatgtaaaatgctaccatcactgtggaaaaaaaatagcagtttcttataaaacaaaacatgcagttatgataccaacctgcaagtgcatttgagctcttttatcctggagaaatggaaacatgtttacacaaaagcctgcatacaaatggtcgcagcagctttattcataaaaaccaaaaacttgagacagcctaggtgtccatcaacacgtgagtgggttaaataagtttcataccatgaaacagttcatcctgtaaaatactactcagcagtaaaaagaagcaaactgttttttctgttttgagacagggtctcgctctttcacccaggctggagttcagtggcgtgatcacggctcactacagcctggaactcccaggctgaagccaccctcccacctcagcttcccaggtagctgggactacaggcacacaccaccatgcccagctaacttatgcattttttaaatagagatggggtttctgccatgtttcccaggctggtctcaaactcctgggctcaagcaatccccccacctcagcctcccaagtgctaggcttatggacatgagccacccatgcctggcccagagcaaattattgatacaacaatttgaatgaatctcaagcatattatgatggaagaaaaacgcccactccaaaattacatagtatgtgactccatttatatacaatttttgcaatggcaaaattttagactttttagaaaaccaagacctagttgacagagttaggggtgggggtgggaatgaggagatgttgtcattaaagggcaacaggggtgatggaattgttcaatagcttgattgtggtggtagacacagaaacctacacacatgtgataaaactgtatggaagtcaacacactttcacatgtgagtacaagcaaaactggggaactccgaagactattagcagtttgtatcaatatcaaaatctcagttatgatattgtattatggttttggaaaatgttaccattaggagaaaattgggtggagtgtacatgggatctttctgaatgatttcctacaactgcatgtgagtctacagccatttcaataacttaaaaaaatccagcttgcatagtgccagatttaacagacattgggaagtaaatggggaaagtaaatataagccaaattttcttccaggaaaaataagaggttagtttttcctttgaatttaatattcagacaaatataattttaaatacatatttcatgaaggtaaagaaaatcagtaaaaggcttctaacaagaagagctattgttccatttaatttaggagataaaatatacaaaacaatcaatagagcaaaagatggaaaataaaatagcttaaaagcaaaaagaataatatggggccactgaactgtgaacaagcaacagttataacaggattgccaatggattaaaccactctattaaaagacaaattctctcagactggcttataaaaataattctgacacgatgatttttatagagagggacatctaaaaaagtagattttttttaaagaaaaaggatgaatgaggttatacccagtgaaaacaaataaagagaaaatgagatgaggttagtattaatattagaaaaggaggattcaagaaaaaaataatggatggaccacgaaggctatttataggtataaatggtaatcatggatgcataatggaagtgccatatattaatttaatgaacagctgtaattcaaatataaagctcatgtctgttccttacacaccatctcagctcctccaaccctagtccgagtcatccgcatgcctcccagactcctaaaataacttcataactgggtccccatttccattctagcccctacactccttcacacagcaaccaatgatgtactttgcatacagattaaatcaatccactcaagttcttaaaacactccaatgagaactgcttgtacatgaaatcatatccaaactccacacactgatgagatgagagacagttcttcctcacgtgtcaattcaccctttcttaatggcaaccaaatccccaatttttaaaattcttggaccaggactgttcggaataaagacgacatttcccagcttcccttgctgccacgtatggcacgtgactgacttccaccagccacgtgactaacatctggccggggaacataagtagaagtgatgcttgcaacttcttaaagaacttgtgtccaggtgaagtggcttgcgcttgcaatcccagcactttggtaggccgaagtgggcagattacctgaggttaggagttcaaggctagcctggcaaacatggagaaaccctgtctctactaaacatacaaaaaattagctgggtatggtggcgggcacctgtagtcccagctacttgggaggctgaagcaggagaatcacttgaacccaggaggcagagattgcaatgagcctggatcgcataactgcactctagcctgggcaagagagcgagactctgtctcaaaacacaaaacaaaacgaacaaaacaacttaatattatctgaaatttccttattcattatcaatttatttaatgcctatctttctcctaccccttacactaaaatgtaaattccatgagtgcgagagccttgtttattgatcaccacaacatctgcgctctatgcaagagactttttaaaaattattttgttaaaaaacaatagagatggggttttgctatgttacccaggctagtcttgagctcctggcctcaagtgatcctactgcctgggcctcccaaagtgctgggattatagccatgagtcactgggcccaacctcaaaagactttcaataagcctctgttgaatgaatgaatgaatcaatcaaataatggcaggcaatatcaaatacacacagacacacacaaagagaaagtgtcagaaacagaattgagacaaatgttaacactatcagtctaagccagtgagtagataaaaaataaatgaggacattcatgattttaatgtaatttttagtggaaaggggtcatggatcagtagctctatttcttataaattgtgcaagcaatctattcaattaccatattatgtttgcagaaatcaaacacatattgagacacaataaatggatacaataaatagtatgaagatattatatatctgacattctatgattatgcaaaaaaatgaaaaaccaataacaagtatttaaacaaggtattcagtaacattctcccaaataactattgagtgaatgaaaatattatctacaattatagaccatatagtaagtgatcacaatacatataaaaatctccagaatggtaaagctatacgaagaagaaaatttatatctaaattatttcattaataaaaaagaaaactaaataaaataatttacacaaattattattataaatgataataaatgatcagaacaagaagcaagagaagggaaatgaagagaaaagctgaaaatactagaatgaaaacagagaaaaaaggattattcattaaatagaagcatagattttccccaaaatcactaaaatagacaatcatctggcatatcaaattaattcaaaccatggtatgagaagactttcaattttttttttttttttttgagacagtttcacgcttttgcccaggctggggtgaggcagtgtgatttcggctcactgcaacctccgcctcccgggttcaagtgattctcctgcctcagcctcctatgtagctgggattacaggtgcccgccaccacgcccatctaatttttgtatttttagtggagacggggtttcaccatgttggccaggctggtctcaaacaactgacctcaggtgatccacccgcctccgcctcccaacgtgccaggattacaggcgtgagccactgtgcccggcctcaaataaatttttaaacaatgttatatgtaagtaaatgctaataaactaagtaattttgaggaattggtaacctgaagataatataagttttcaaaatagactgaagaacaattaacttctaatatttatcaaataatcacctcaaaaaaatgagaacaaaacaaaaaagcagtttatgaactagcaagcctaaagtcaaagttataaatcaattccatactgtacagaatttattatacatcacagaaaataatataaagcaaacaaattaatttcatcatgctaggttaactatgtttcaagaactaacaatgacacttgtaattttgtataaactataggtcacttttatttataaatatgaataaaaaataaaaatggcaaatcaaattcaaaacttacactacaaattcaaattgcattaagaaaatgggctaccatgacaactaatattaaccctaagaatacaaaaatgatttaataataggaaatctattaattatcacatcttgtccaaacaagaataatcacatgatcctattattatagattcaaaggccatttgagaaaaagctatcatatattcatggtttttaaaatgttggtaagttagatatggtttggctgtgtccccacccaaatctcatcttgaattgaagctcccatcattcccatgtgttgtgggagggaccatccctgggggagatcattgaatcataggggtggtttcccccatactgttctcatgatagtgaacaagtcttacaagatctgatggttttataacgggtttccctttcatttggctctcattctctcttgtctgccaccatgtaagacatgcctttcaccttctgccatgattgtgaggcctccccagccacgtggaaacgtaagtccattaaacctcttttactttataaattacccagtctcgggtatgtctttatcagcagcatgaaaacagactaatacagtaggtaagaggttaatttcctaaaatcaactatcacccttactgtttattagtaataaataggtgtcagtcaacacaaatgggataaaatatacactgctgaaaggaaggtaacaaaattgctgcaatttgtagacaaagtcattgcagggataaagagcctaagaaaatcactggaaaaatccatgactgctgtctgtgttttcccaaaattcatatactgaaatcctaacccccattgtgatggtattaggaagcgggccctttgagagctgattagatcctgaaagtggagactcataaaaaggattaatccccttatcccaagggatgaagggataaaaggacccaaggaaatcagttgatattctgcaatctgggagagggccttcaccagaaccttctagaactgtaagcaatgcatttctcttgtttataagctacctggtctgtagtatttagttactgcagccgaaaccacctagactcttgctaatgagagaattcaataaggcagccagatgaagcccaaaattccaaagccattttccatcatactggcagaaaggggttagaaacatttaatgaaaaattaaaatcaggtgcggtggctcacatctgtaatctcagcactttgggaggccgaggtgggcgaatcacctgcattcaggagttcaagaccagcctgaccaatatggtgaaactccatctctactaaaaatacaaaaattagccagcatgtggtggcgcgtgtctgtaatcccagctactcaggaagctgaggtagaaaaattgcttgaacccaggaggcggagattgcagtgagccaagatcgcgtcactgcgctccagccacagaggagaccctgtctcaaaaaaaaaaaagaaaagaaaagaaaagaaaaagaaaaagaaaagaaaaggaaaggaaaggaaaattagccaggcgtggtggctaatgcctgtaatcccagcactttgggaggctgaggtgggcggatcatggggtcaagagatcaagaccatcctggccaacacagtgaaaccttgtctcttctaaaaatacaaaaattagctgggcgtgttggcacgcacctgtagtcccagctacttgggaggctgaggcaggagaactgcttgaacccgggaggcagaggttgcagtgagccgagatggcgccactgcactccagcctggcgacagagtgagattccgtcaaaaaaaaaagaaaaaaaacaaaaaagaaagaaggaaaattaaaatcctattcaccatggcaatataggaaaaaacaaaaaaaaacaaaaacaaaaaaccagacagcagtacctccacaagacagtatagggcctgctccccagtgtctggctgggaggaggtcaggagtgtggggatcagggcccactgaccagagagtcaggtggctgtagccacctccctggtctcttggctgcaccgttgaacctctgaactctgcgctgtgggtcaagagcattggagccgtggtcagaggctcctccaggacaccatccctgaagcacaggaagacccctgttccctctcctgaacctgcctttgatcacttctggtttggggtttgaagggatttacctgactgaccccaagaggtccccatcagcttccatgcctgtctcgctcctttctctgcttcctctgaagtttaacaagttcagggccaagattctacttctgatagcatccatcctaatcatctttcctttctctcctgtttgcttcattgagagagagtctcactctgacacccaggctggagtgcagtggcacgatcctagtgatcctcccacctcagcctcccaagtagctgggaccacaggtatgcaccaccagacccagctaatttttaggttttttttgtagagacaaaaaaatgttgcccacactggtcttgaactctgaactcaaacagttctcagcctctccaagtgctgggattacaggcatgagtcaccatactcagcccatttagataactttcaatgaaaattctgcaccttcctgggcgtctacagttcacatcataccctatgggttaaacacttgaggataagtagattgaataaaaaaaatacttttaaatataatttgggaaggttctatggaacagagatatgaaaccagtggtgccaggactttcccgataatgtgaccagtgatttttctcttctccccacctacagccgctggtcagctcatctcagctacaggctgaagtaccagccatgaggttattttgaagcaattttttaaaattacttttaatcggccgggcacggtggctcaaacctataatcccagcactttgggaggccgaggcaggcggatcatgaggtcctcttgagaccatcctggccaacatggtgaaatcccatttctactaaaaatacaaaaattagctgggtgtggtggcgggtgcctgtagtgccagctactcaggaggctgaggcaagagaatcacttgacccaggaggcggagggtgcagtgagccgaggtcgtgccactgcactccagcctggcaacagagtgagactccgtctcaaaaaacaaaacaaaacaaaaattacatttaatcaatttattttttgtgatcataaaatcatttcagactttttcccaaaatatgagttttcagcatattaactggacataaggctggtatgtggagagcagcatctgtgacagtcctgccttgcgcctcctgcagcctctgcagcagagggtcatacagtggctttgggtgacagctgccactcagtggtctccagtgagttcttttcctcctggcagctggcagctgcattaattttgattttaggctttatttatttattgattgattttgagacagagtccccttccgtcacccaggctggagtgcaagggcgtgatcttggctcactgtaacctccgcctccggggttcaagcaattctcctgtctcagcctcctgagttgctgggattacaggtgcacgccaccacgcttggctgatttttttgtatttttagtagagacagggttttaccataatggtcaggctggtctctaactcctgacctcaggtgatccacctgcctcggcctcccaaagcactgggattaaaggcatgagccactgtacccggccggcttttatactctcatatcaactttgtgctccatttaccataaccatgggcgtgtgaactagaaatgctttaaattccaatcacttctcccctttttgtttttgcccctgaaaacaattgttggataatgtaattttgctaatttgagattttttttttttttttttttttttgagacaggatctggctgtcacccaggctggagtgcagtgacgtgatcatggctcactgcagcctcaacctccttggctcaagtgatcctcctgcctcaacctccccagtagttgggaccacaggtgcatgacaccacacccagctaatttttttatttttggtagagacagagtctcactatgtcgcctaggctcctgtcaaactcctgggctcaactgatcctcctgtcttagcctcccaacgtgttggaattacagacaggagataccatgcccagactaatttgagattttgttaactttactgaataataacagaatagaccgtatagcctaatacaaacaagtataaagaaaaaattattcacttttgtgccagtcaaaataagtacaatcagaattttttccatttttttctatgactataaatggatgcataatagattaatataatgggcataatagatgtaggatggtaatgtaattatactgtaaattccatctctatcttggcttttccatttactataaagtgaaaatattatttctaacaattatataatattttatctttataattgcattttcctacatctctgactgattttatatggtagattactaaatgtagaaaattattttaaatcacagggtttgaacatattttaaattatagggctttaaaaattatggccaagtgtcaccaaatagttttctgaaaagttgtatgatttacaaatttacatttctacaaagaaattgtaaatacatttctttctatttacatttctatcagtgttatatgagttggctcttttttttttttttttttttagatggagtttcactctattgcctaggctggagtacagtggcttggtctcagctcactgcagcctccgtcccctgggctccggtgattcccctgcctcagcctcccaggtagctgggactacagatgtgcgccaccacgcccagctaatttttgtatttttagtagatacagggtttcaccatgttggccaggctggtctcaaactcctgacctcaggtgatccgcccacctcagcttcccaaagtgctgggattacaggcgtgagccactgcaaccagctgagtttgcctattttatcttgctcctgacaactttgagtattacatgatttattttccattctgagaagataactgttaaccaatccctattttaattaacatttctaagatttccggtgaggtcgagctgttttaatgtttatttcaaatgtctatcagttgtctattgctctttatcccatttattgtcaagaggtttcacatagctttagaaatgttctgtacctgtgttttattctacaaattgccatatttttgccagtttgttagcttttctgtttgtttactttttgagacagggtctcgctctgttgtctaggctggagtgcagtggcatgatcatggctccctgcagcctcgacctcccaggctaaattgatcctcccacctcagcctccctagtacctgggactacaggcatgtcccaccatgtctggctaatttttgtatttgtttgtagagtcaggatcttgctttgttacccaggctggtctcaaactcctgggctgaagcgatcctccgcctcagcctcccaaagtgctgggattacaggcgtgagacactgcgtccagcctttgttagctttttaaatattcttataatctaatagtataagttagtattatttgattgttccattgcctccaatgcttagaaaattatttcctacttagaaattagctacatattgataggtaatttctccaccttttcaaaacagtttaaaattatagtgttaaatagactaaagatcaattacacttatgaataaggataactaaaagaaaaacccaaattaccaagcctggaaggaagcaagggtcagaaccagatcagtaaaactaactcgctgccttgtcccaaatgtcaggctcattaaaatcctgtaactaagtggatctcaaactcaagccagcgttgacgtcacccagagggctaatagaaacagattgctgggccataggcctggagtttctgattcaacaggtcagtattgaatattcaatttaataggtggggcccaggagtttgcatttctttctttctttttttttttttttctctttttgagacaggctctcactcttgtcgcccaggctggagtgaggtggtgcaatcatggctcactgcagcctcaactgcctggattccgacaatgtcctcacctcagcctccagaataactgggactacaggcatgtgccaccacgccaggctaattttttaaattattatttctagagatggggttttgctatgttgcccatactggtcttgaacccctgtgctcaagagagcctcccacctctgcctcctaaagtgctgggattataggtgtgagtcacttgctgggccagaattcccatttctaacaagttccaggtattactaatgctgctggtccaggaaccacactttgagaaccactgttaacatgaatgcttcccatattccatttttccacacttggtaagatccctgtggggaatgaaggcttgctgtcagtctagcaggccttgatatagacatcactgctgaaaactattaaggttccattagatgattaagaatggaagagaggccaggcacggtggctcacacctgtaatcccagaactttgggaggctgaggccggcacatcacctgaggtcaggagttccagaccagcctggccaacacggtgaaaccccgtctctaacaaaaacacaaaaattagctgggtatggtggtgggcgtctgtaatcccagctacttgggaggcagaggcaggagaattgcttgaacccaggaggtggaggttgcagtgagctgagattgcgcccctgcactccagcctgggcaacggagtgagactccatctcaaaaaaaaaaaaaaaaaaagtcactgtcaatgattgaatatatttccttccagtctttttatgcataacagatttgcagtcacattgtattatagctttttgtatgtaatatttccttcacatgtcacaaccatgaaatgcaaatgctctcaactgtccatgggtcaagaattttatttattttattattattattattattttttgagacagaatctccctctgttgaccaggcaagagtgcagtggcatgattatagctcactgcagcctcaacctcctgggctcaggcaatcctcctgcctcagcctcccgagtagctggaactacaggtatgtaccaccatgcctcgctaatttttgaattttttgtaaagaaagggtgtcactcattgcctgggctgctcttaaactcctgctttggcctcctgaagtgctgggattataggtatgagccactgtgccaggcctaaagtcagtaattttaaaaccaaaccacctgcccatctctgccatcacggtgggaccagcttataaaatgtcccagacaaaagcctgggcctgggctgggaagaactaggttttgcatgaggacctgagacagagatcaagattcctagaccaggctgggcacggtggctcatgcctgtaatcccaacactttgggaggccaaggtgagtggatcacttgaggccaggagctcaagaccagcctggccaaggtggcaaaaccccgtgtttactaaaaatacaaaaaaaaaaaaaaaaaaagctgggtatggtggcacacacctgtagtcccagctacttgggaggctgaagcatgagaatcacttgaacccgggagatggaggctgcagtgagccgagatgatgtaactgcactcctgcctgggcaacagagagagactctgtctcaaaaattaaaaaaaaaaaaaaaaaaaaagagtccaggaccaaagcagaaatggaaagccacaggagacacgagaccacagcaagaactgggatggagagacaaaaggtaaagcctttccggaaaggtttctggggagtagatgcaggtattttactgcacctgctgcatattctcccaccagatgagtgaggattggacagcagcagacctatgattgataaccagggagaggcaaagcaagtcagcgtggcaaacagactttcatcccaaccaaattggggaacgagtaccctatgcactttcaggctagggtaatttacaatgtcttgcacattgcacacagctgtgggataaacaagctattctaaagaccagcttgcagaatggctccctggacttcgtgtgtgctcgggagtattgcccaaaagtcctgagcatgcaaaaagaccagggagctattatgggcttcttgtctcccgacctttagccccggactcattccaacacgaccagcaccatccaatgagcagatctatttgctcacaaactgtgaatatttcatttcttaaaacagaaagtctaaattagtgaagtcttcatgaataaggtttgattgtgaataagattaaaaatgtgagcaaaggaacccagttctacatgagatgttttcggcgtcactctggccgaggtgttcttgaacctcacggtggcaaaagtaagacacacaaacagctcagctctcctcaccaagtgtgggactcatttctctgtttcttcagagggaaaagaggttaacagaagtgttggctggcccccaggactggcagacctgtttaatctcccatgatcctttcacatatgctctctatagcttgctgtctgcaaactcatggcagaacacggttgcacggggcttgaggtcaagcagaagaaaatgaaaaaggctgctggggtaaattcatgaaaacaccatgataaaatagcagggctctttcctctgccacttggggacatctactgtatcataagcctcttattcttggatacaagtaggcacatgatgtgtggcgtaaataaatggtggaaaagcagggaccctgaggaccgtgcttgacttcttggcaggtgcaattaacctgcagcattgagcaggaagcctaccccccagtcctgagtctcagccccgctcagtcccttccttccctcctctcctctctgccattcccatataccatatcctaaggctgactccatacacagtttcacatttcctcagcaaatataccactgcagtaacaaaaaaacacacagaagcttgatgaacgaagactaagaacacaatcacagctttacaacttatgcataggaaagcggttctgaactggctgccaagagtctcacacccagagggctgagcgtatgccgggaggactggagaccctggggcatgactctcagaccatcctccccggaaaggaagccgcatttgtagccaactatattcccccttcactgttaatcaatttcctgcaaagagccaggggctcataacttttgcgactagtaccaaccaataaatagctgtttttgctgaatcccatttgattttattctacccttggcactataggctagaacaccagtaaggaaagcactggaaaaaaattattttatttatttatttatttttgagacagggtcttgctctgtcacccaggctggagtgcagtggctcgatctcagctcactgcaacctccacctcccagaatcagatgattctcatgcttcagcctcctgagtagctgggattacaggcgattaccaccatatccagctaattttttttttttgtatttttttttttcagtagagatgaggtttcaccatgttggccaggctggtctcaaactccccgcctcaactgatccgcccacctcggcctccctaagtgctgggattataggcataagccaccctgtctggcctggaagaaggattttattaggaaaaggcacctagtgcttgataggattgcttctcagtgatacagagaatagccttggttataggtttcctctaaggtaggaagaaacccaagcctggggaaaatggaaggcttggggcagcaatgtcagatcagaagttgaagtccaattacagaatctttaccctttatggtagctagcctccaaagtgatccacaatggctcctgcctcctggcattcaccgggaggctgttctctcccacacttaatagggatgacctgtgtaaccaagagaatattgcagaaatgattgtgtccaacttgatagctagggcataaaagatatcattgctcttgcctagcactgtcctggatcactggctttgagggaaactggctgccatgtcaggaggacactcaagcagcattgtggcaaggtctgtgcagtagggacctgagggctcccgtcaaccaccagcgtcaccttgccagccaggtgagtgagccaccaggaagcacatcttccagtccagtcaagcccaaggctggtcacagctccagccagcatcttggctgcaactggattagagaccctgagctagaaccacccagctcagccagctttcaaattcccaacccacagaaactaagtgagatagaaaatatttagtgttgttttctggccctagattttggtgtaatgtattatgcagccaaagaccacaaatatatacccttctagaagtagtctcaggtctgtttccacggaaaactgactatgtcactgatgggaagccttgctagagtctcttaagtaggatggtcttctttcaaggatatcagtacctcctaagatcaatatcttctgcctggatatctggaggtgaaaagctacttttcctattttttatttttgttttattttttgagacaggtctcagtctgtcagccaggatggagtgcagtggcacaatcacagctcactgcagcctcaaactcctggcctcaagcaatcctcctgcctcagctccagagcagctaggactacaggtgcataacaccatgcccagctaatttttcaatctgctttagagacaggctctcactgtgttgggaaagcaacctttctgcttcttttttgtatattatcttcaatcacttcaaggaaggaaacacacatgtatatatatgtgcacacacacacatgcacacactcagctttcttctaaacctgaaaaaccacccaagcactgggaacctgaactcttttccagaaacaagccaatgctgtagaagttttaagtaccattttttcacgctgtctctgaaggggcaggcagtcgcagggggaagaaggggaggctgattactgagaattgatggatgtttttgttcttgcttgctagtcgtaaaattctgagctgggtgagcactagcaggagaggaaagccacagccactaagtctgtgacttccagcattgatttaaatatttcaagatggaattttccctcctttctccagcctatcttttcaccctgagtggggaagaaaatcttgagtaagacaaaaacatggagactttgtgagcattatagcatgtctgaattaagctacaggcagtccatatattgtaagagatatatttccttgcagtgtacacgctctactgtgatgaacctggaagacaggaggagtaggagtgtagattaagtagccatagctccttctcatccagatgagggccagaaagaagaatgcttagaactcacaaggccttggaacattctccttagttggccctaaggatggaggtaaagagtaggaagcattcaggggctcaggtgccatggctcactcctgtaaactcagcactttaggaggccaaggcaggaagattgcttgaggctaggagtttgagaccagcctgggcaacatagcaagacaccatatctaccaaaaaacacagaaaaatatagcagggtatggtggcttgcacctgtggtcccagccacttggaaggctgaagtgggaggatcacttgagtccaggagttcaaggctgcagtgagctatggttgcatcactaccctccagcctaggtgacggaatgaaaccctatctctaaaatacacaaaaaacaagcaaaaaggcattcaggagaatagatggagaatgagagaaagaagaaggagaaacgcccaggggagaagcaactcgccaaggcccatcatcagagtggacctccatgggtcaaaagatggccagatgggaaacaatattccttcatcttctgaactctggggtcatttcttatttccaccaggggactctacctattggtccttgcaagtgtcaagtcataactgaaggttccatgagcactgcaatattctccttgcatggtgagtagggtcctggagatgttctggatcctaacaacagttcagggagatggcgttttcctgtcagcagtgggggattcacgagcccctgtctcactctcccctgatcctggatgtcctctgggaccaggtcccatctctctgctcatcctcttttatgcaccttccctcggtgagctcatccttgcctataattttacccaccagctctcatgaatctcaatccggtgttccagccccaactgatttcagctgtgcatagacttcctccctttacttggctgcttgaccctcaccttctactcagcatgtccaattgaggattcaaccccacaagacttctctgttgctccatgatctgacccctgccaataacagcaagttgggaactctggaatcagcctcacctcttctgtttcttcaggccctaaatccattctgccagtgggttttgaggtcttgcccttcaaacggtatcttagtcatggtcaatgacttccccatgccaaccccttttcaaactctcatcatggcagaactgaaatgccctcttttctttctttgcatttaattccacccatacttcaaggttcaaagcaagtgtcacattccctaaattcttttctgacccttcaagactgtattttcctcctttcttgcccttccattcatctattgaaacaaatagttattgagggcttgctgtgtacagcatgcacagagtgagctacaactctgaagccctgtgcttcaaggagttacagtctagtgaccatcacactaattaatcacttgtttgttttccctctcttaattgtgtttccctagccaaattattatttttgtttgtttgtttgagacagggtcttgctctgttgcccatgctagagtgcagtggtgtgatcatagctcactgcagctttgaactcctgggctcaagcgatcttcctccctcagcctcaagagtagctgggactacaggcatgcgccatcacatttggctaattttaaaaattgtttgcagagacgggatctcgctatgttacccagactggtcttgaactcctggcctcaagcgatcctcctgtcttggcctcccaaagcactggaactacaggcatgagccaccaaattcagcttccccagccaaattgtgaaatagctaggtctgagtcttaaatgccttttgtaaaacccacaagcactgatagattatagcatatgtaagttcttactaaatacttgttggttctatgcaagatgggtacctgaataagactagaaagacacaccaactgcaacccttatctaggttagagaaatctcctggtgaagggaaaaaacaaaaaataaaataaataaaattaaaaaaaaaaaaaaaagaaatttaaaaaaaagaaaaatcatgctgtgtctgaatggcgttttacgtgtctaactggtaatttaatttaatttgacagacaacttacgtgattcaaattttttaaaataatgattgataacccactccctaaattttataatcataaaataattgtcacattttaagagtagagaactaatataaaaatgatttcattatactttaataattacaatgttagatgtttggaatttcctaagagattttacaagatagaaacaggagctaattgagaagcactgaatacacattcttagacaaaaccattctctctcattaagtgcaaggatattgacgggatccaaatgtaccaggcaaccatgccattctctcagcaaagatatcccggaactggggtcaaacacagaaccggttcagataatatcagtgtgcccctttgaagtgtccccaggaaaaagacttttgtgaatgtgcagtagaataatttcatttttccctaatgcaaaaaaaaattgctacaagaaaaaaatggggagatatttcactcctccaaaccctaaaaaagtagttgttttgattctttgttctggaacatatgtcgctcagcccagaagagatcttcacgtgccaaatagaagttcaagaattcagtcaaaagttagtctcagacacatttactgtcaaacttagtctgaaaaaaaatattcttactcacctgccagaatatgctgtctatcgtgttcccaagaaaaccatcgcgaccttctgaagacaccagtttggggccaagaatggtcatgaattcatcaaaatccacctggccatcccctgcaaggagaagatgtaaatatgagttgcaaacaagctgaacttgacctaccgtacctgatgcaataaacacctctacgcttttcttcttggcatgacctcaatcaatgaagaagagctggtaacattacttaaaactgttcaatgttcttcaatgactgaaagtaccacaagaaactggcaattattagtacaaccaaaaccacatattcctaaacatttgacagtatttctagctaaatgtccaaccatcacttcccacttaacatggttatacctcacccctgcttctccttttactccgaattgcccagttgtacatgatggaagtggcagcttcaccccatctcttccaccatccttgtcacccacatatacatgtagtcatcaagccttcttgatttcacctcttaagtatctgtggttgctgtatcttcctcattactcaatggctagttcccttttcaaccatgaaggtgagaaaatccttctaagaattaatgttcctagctacgattctgttatgagtagcacggcttttacactcttaccttcgcagtctcttctatgcagttctgagtttaattccccaagaccaaatctcatcatgctttctatatttgaacagcactttttttgttgtttttgagatggtgtcttgctctgttgcccaggctggagtgcaatggcgtgatctcggctcactgcaacctctgcctcctgggttcaagtgattctcatgcctcagcctccagagtagctgggattacaggagcaagccaccaagcctggctaatttttgtatttttagtagagacagggtttcaccatgttgcccaggctggcctcaaactcctgacctcaagtgatccgcctgccttggcctctcaaagtgctgggattacaggagtgagccaccatgcccggcctgaacagcacctttgactgaaaatagggataccacctcagcatagtgttcaagcctcactatctcttttgcatcaatttgtccccaacctttgcataaaatacaagctcctttacacctctgcgtgcatgtgtatgcctatccctctgtccgggatgccttccctcacttgtctatctggtgaattctctttctctaagacggagctgaaatgtcatgttctctttttgttttgttcctgatctcattaggcagaactggtcgaactttttttctctctctcctactaactccatgtgtacctactgtagaatttaaaaccatgtatcctggccaggtgcggtggctcatgcctgtaatcccagcactttggaaggccgaggtgggtggatgacctgaggtcaggagttcttgaccagcctgaccaacatggtgaaaccctgtctctactaaaagtacaaaattagctgggtgtggttgtccatgcctgtaatcccagctacttgggaggctgaggcaggagaatcgcttgaatctgggaggcggaggttgcagtgagccaagatcgcactgctgcactccagcctgggcaataagagcaagactccatctaaaaaaataataataataaaacaataaaataaaataaaaccttatatcccagtcactgatttgcatgcctatctcacaagcaaaagattgtcagttctgcaaggtcaaggacttggtctgaaacatctttgtatattgaacaccaaagcaggcattcagtatgtacttgtacaatgaatgaatgatgtctcttgctcgttctttctttgttcaattcagcatctgctggatctttcatgctagagctgacagtaatcagaaggtggacttgagccaactcaacagacaagagcgaaccttcaaggcattgttgggtcctccaggagtcatcagtgtagcattctgcaccctctgaactgctcaaaagggcaactccatcaaaagttcaccacatccctaccttggctgcagccagcacagacagccaggtgtctgcacacaagagtttgtccaaatgcccacacataaatcaatgccctctcagagtgcattcaccttcaaagaatattcattcaaaacctatttcacaatgccaagcagatgtgagcatcaagatgccaataattcagaacagattgtccaggaacagattgtccaggaacagatcccagcagaggtaaaatttcctaaaggattagggaggcgtggcaagtcaatgggaaagggaggatttaaccaccaaatgaagaggggcagtcggtggcctctggagaagaaattgatttatcttatcatccaacaagataagtctaaaatttcactcttgctggtaatcgtaagaaagctaattcaagcaacgagttaccatcttgccttcaaaattatcaaatacttccaaaagcacactagtcgatgctgccagaaatacagagagatcacctctataatgcattcctggtgtacttgtcccagatatagacaggaagtaccaatcaagatcctgtaaagtgctgtttcctttggatctaacaatgcacttaacaaaatagaggggggttgggtgaggtggctcacacctgtaatcccaacactttgggaggccgaggcaggtggatcacctgaggtcaggagttcgagaccagtctggccaacatggtgaaaccccatctctacaaaaaatacaataattagctgggtctggtggcaggtgcctgtaatcccagcgattcgggaggctgaggcaggagaatcgctgaacccaggaggcagaggttgcagtgagccaaggtaagaccactgcactccagcctgggcgacagagcaagactctgtctggggaaaaaaaaaatagagagggggtcttgctatgttgcccaggctggtcttgatctcctgggctcaagtgatcctccttcctcagcctcccaaagtgctgggattacaggcatgagccaccatacctgaccttaataacttcatttttagagaaaaaataaaacaacatttatcttgaatatagaacaagatatttgcctacagatagatactcaactggtatttgtaaaagtgaaaagtagaaagctagagggaaaggagaatggcccagtctacctagaatttgacacctctgaaagctaactccacgtggctccacgtcttggatagacatgcttgttacatttgtgcagtaactctctgctcaccccaaatcacctccactagtcacaggtggggctggatggccaaacagtcttgaactaaactatacattctcaagagtgacagtatcacccacaatggggtgaaaatggcttcttagggaacaaaataacattagccaatgttagatattacaatggcttgcggctcttctagggctacagtacataatacacagtgtatctgtacaaaatttcaagagggtgggacaactagaaaaatgcatatctgaaaaggttcttgggaggtgcttatttaaaaaaagaagaggaaggttaagaagcactggactaggagacgccccaagtactgtggttcttttgcccaggtactccctctggaatgtcggtctatcagcagtgggcatcatctcactatctgcacccacagtgaggtctaactgttcatagaggcttagaagctcaaggacacgaatctatttttgcaaagacatcatgagggccaggtgcagtggctcatgcctgtaatcctagcactttgggaggccgaggagggtggatcacttaaggccaggagtttgagaccagcttgggcaacatggtgaaaccccatctctactaaaaatacaaaaattagccaggtgtggtggcgggcacctgtagtcccagctacgtgggacgcagaagcaggaaaatcacttgagcctgggaggcagaggttgcagtgagctaagatggcaccactgcactccagcctgggttgacagagtgagaccctgtctcaaaacaaacaaacaaacacacacacacacacacacacacacacacacaaaaacacatgagacctggccgggcgcggtggctcacgcctgtaatcccagcactttgggaggccgaggtgggcggatcacgaggtcaggagatcgagaccatcctggctaacacagtgaaaccccgtctctactaaaaaacacaaaaaaattagccgggcgtggtggcgggcgcctgtagtcccagctacgtgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaacacatgagacctgatctaagatatgcccaccaggctgctcctgaccgtgatataatgggcaccattctctcccacttgggaacctcatagtttacgagatgtggcaaaacccatgcttgccagcaccaggagaacgaggctgtctttgaacagtgcaccttcaaggtagcaagaggagcaagaccacccacctctgaaacctcgactcagggtgcagggagcgcagcagtttggaactggtgcatttcacaggtccacatggagctctgggccaaatcatcacagtaccaggcagtgctcacagatggtgcacttggctgggaactacagaccaaaagctgacaagcagaaatgatgcttctgaaacacatcttggtcctggcaaagggagcagctcatttgctattccaaattgttggccagagaagaagcgatggagaagggcactcaggatcctatgggcagggccaactatggcgtggagtacacgtgacttggcagaagaggtacagatcatggaaatatttgcttctagtcatttaggagaggacgtttggaattccagattggccaatgtatgtttttcgcttgtgatactttgatttataataagaaatgcatattggccaggcgcagtggctcatgctgtaatcccaacactttgggaggccgagatgggtgggtcacttgaggtcaggagtttgagaccagcctggccaacatggtgaaaccctatgtctaccaaaaatacaaaaattagctgggtgtggtggtacaaacctgtaatcccagctacttggtaggctgaggcaggagaatcgcttaagtctgggaggtggaggttgcagtgagctgagatgatgccattggcctccagcctgggtgaaagagcaagactccatctcaaatatatacatacagatagacagacagatatagctatagaaatctttgtctctgtttcctggtacacagctcataaaacactgataattccctaagtaatagagttgcaaagagcatcttttgttctaatatttggtctttttttttctttttgagacagagtctcactctgttgcccaggctggagtgcagtggcacgatctcagctcactgcaagctccgcctcccgggttcacgccattctcctgcctcagcctcctgagtagcccaccaccacacccagcgaattgtttgtatttttggtagagatggggtttcactgtattagccagtgaagattagccaatcttctgacctcgtgatccgcccacctcagcctcccaaagtgctgggattacaggtgtgagccaccgtgcctggccaatatttgatctttgaccccatttcctggccagaactcctaaatcctttggaattccctgggtgataggaatgtcttttgttctaatgaagcacttcttggtgggcttccagtgggagatgatcaccagaaacaccaaaccatgattagaaccttggaaatttcagtgccatctccccaacctccagggaggaaagaggagctgaagactaggttcataatcaatcaggcgcacatgatgaaatctgcataaaaatccctaatgtatgaggttcagacagttttcaggttggtgaacacatggagatgctgggaggatggagctctcagagagggcgtggaagctgcatgtaccactcccattaccttacgcctctctgcctttccctgagttgtattcttttctaacaaatgggtaataattagtaaagtgctttcctgagttatgtgaactgctctagtaaatgaatgaacccaaggagggaacctctgatttatggtcagaagcacaggtggccacgtggactttgaaatggtgtcctaagtgggagcaatcttgtgggactgagcccttgacctgagggacctgatgcaaatggaaattgtctaaacaggtgctcctcaaataatgttaactccagatagatagtaacagatagtaacggaattcaatttaattgtaggacatccagtccagtgtttgcagataattggggaatttcttggtgagggagaaaaacccacactttggtatattttgtcttgagcgttagagtattgggaaaacagtcttcttttctcatgcactctctttgttactcaatgagcaaagggggatgtctccaggcccatggttggaggaacaatcaggataggtcccccatatctccagctgtctcccgatatttctcagctctggttcctaagtatgtaaggacacagcacattttctgcagaccttcagtaaatgaagactcttccctctaatctacaattctataccaaccctactggtaacataaacattcagatttagactacagaaatgacctctttaccagattttaatttaacagacaaacagggctgggaataccccccaaaagttatcagcattgtacccagaggtctgatccctatgcccccacaccctcaaccttaggggaacggaaacaaatagaatctcagaggtaggttttacactaagtccctaaaaaccactcccaagctgccaggctgaagcaaggtccaggaaacctgataatcataataatatctaacatttactgggcacgcacaacgtggtggacatggttttttaaaatacccacacaatttttttttttttcttagaggcagggtcttgctctgtcacctaggctggagtgcagtggtgccatcatagctcactgcagccccaaactcctcggctgaagggatcctcctgcctcagcttctggagtacctggaactacaggagcatgccatcacacttggccaatcttttaaaattttttcagagacaaggtcttgctatgttgcccaggctggcctcaagcaatctacctgccaccgcctcccaaagtgctgggacatatactaattcatttacatcttcctgctgcccatttgacaaatgagaaaactgaggctcaaagaggttcagtagcttgcagaagcttacgcagggagtagagctgagattccagccccagcagtctgcctgtgctttttgtgacctttcaaaaggtcactcactgacatggtctgtctggatcactgtctcctgatcccagcttttcttaccaagcgagtgctatggcgaccaggtacacagagtcaaactgaaatctaaatggctccctgtggtctagctcttgcatctcaggtcagccaccagaggccattcttcatcatttcagagagtaataataaataataggaactacttatttaacacttgctatgtgccaggcactgagctcagggctttacatgtattcccttgttgaattccatgccaacactataaataggttctccccttccacatcttatcaatgagataacttagaaaaaaagaggttaagaataactgtatcaaggccatgcagctaccatgaggcagagtgggggctcagctcagaatcttaattgttttgttttctgttttgctagagacaggatctcactctgtcacccagaagtgcagtggtgcaatcatagctcactgcagctttgaactcctgggttcgagtgatcttcccacctcagcctcacgagtagctaggaccacagttatgtgccaccacgcctggctaatttttttttttttttttttttttttgagacagaaactcgctctgtcatccaggctgaagtgcaatggcatgatcttggctgatcgcaacctccgccttccgggttcaagtgattctcctgcctcagcctcccaagtagctgtgattacaggcacccaccaccatgcccagctcattttttgtatttttagtaaagacagggttttgccatgttggccaggctggtctcaaactcctgacttcaggtgatccgtccgccctcctccacctcccaaagtgctgggattacaggcgtgagccaccacacctggctcctggcttttttttttttttttttttttttgagacagagtctcactctgtcacccaggctggagtgcagtggcacgatctcagctcactgcaagctctgcctcctgggttcacgccattctcctgcctcagcctcctgagtagctgggactacaggcgcccaccactgcgcccagctaattttttgtatttttagcagagatggggtttcatcgtggtctcgatctcctgacctcgtgatccgcccgccttggcctcccaaagtgctgggattacaggcatgagccaccgcgcccagctactcctggctaatttttaaattttttgtagagacagggtctcactatgttgcccaggctagtcttgaactcctggcctcatgtgatcctcccacctcagcttcccaaagcactgggattacaagcgtgatccactgcacccgacaagaaccctggtattaacccccgtattgtactgccttcccttgatatcagagaccccagcccttggtcctggcataggatcacaggatctcaagctcttttcaaagtttgagagttatagtatgttttcctatctgggtgtttaggaagaaagttagtgggaaattgggagagatagctatcaggagctttaatgcaaatggcaattgtcaaaacagatgctccttaaatcgcctctttgtctgcagtcaggatcttagtaattctctatgggtgctccattcccagggaggggatacaggtcgttcacagagaaccctgcacacgtctgaagtctcttccaccagaaaagaattggtctgatgaacaaaacctgttcaggccctgcagggtcccatcaaactgccattacagaatcacatgcccccaaaagacaatggtgagtctcttcctagatctgcaacctttcatggaatgcaggaggtcctaaatgcaaaagctttgattaaattcttttatcactcttgaatgagcaagtagctgcaggaagaaagaatgtaattcactcagaccaggcctcattttcccttctctagcttccaaatatcatgatccacttagcaagaagcacagaaagctagcctgccaaggactgtgtctcgtggtttccccactgctatgtgagtcaaagtaatgaacttgaactagggcaggaagctgcaggagtgccaggactgtacaacattcattaagaccaaccagccaaaattctcataaggaggtaaaataatccttaaaaaaatcactgcaaaataaaagggaggagaggaatatacaggaaaagtgggtgggcttcaaagggtaacaagaagaaaaaatgtctatctgagactccattcaaattagttgatgaaatctccaaagcataaggcgcagcttagcttccaggggcttgcaatccattactcaaggcagaatgaagggagtgctataattgacctaaaagcattgtgttaaggcaggacaaagtcaggaacgcagggtccagacaggtcattttccatgattttgcagtgagcctttaaaagagggaaggattctaatgaattgcaaagggagataagctgagtggcctgagcaatggtgaggatgccaggaaggagggaaggtgaccgaccacccttcatgctggatagaggatccccataggaagagagcaggacaagctgggcccagaaggtcaaggcaggctgaggggctcatcttcgatgcagagtcagtagaacctgcccaggcttgggtatgaaagcgccagaactttgctcaccaaagatcaatctggggacagtatgaaggttagacttggtggggtagagctgactggggaaagggtcttagttaagacaatagggaaggcagccagtgtggaggatggggattggagaagtctggataaaagaaaagggcatttcagatggaactaacgagacatggcaactgactggaagggcaggaggcaagagtgatgctgaggtgtctggtttgcgacaccaaagggaccatgaaactaattaggaacaacaggccaggtgcggtggctcacgcctgtaatcccagcactttgggaggccgaggtgggcgtatcacaaggtcaggagattgagaccatcctggctaacacggtggaaccccgtctctactaaaaatacaaaaaaattagctgggcgtggtggcgggcgcctgtagtcccagctactggggaggctgaggcacgagaatggcgtgaacccaggaggcggagcttgcagtgagccgagattgtgccactgcactccagcctgggtgacagagcaagactctgtctcaaaaaaaaaaaaaaaaagaaaagaaaagaaactaggaacaacaaagaagtcaggaggaggacgtactggggaaatgctggtttcaaggtgcaggcaggatggtgtcaaggagtgcctgacagctaaaaaaatgtggatttgaaagtctccaggatgtgcccgggaacggtggctcacccctgtaatctcaacactttgggaggccgatcagacagatcacttgaggctaggagatcgagaccagcctggccaagatggcaaaccccatctactaaaacacaaaaattagccaggcatggtggtgcttgcctgtaattccagctactcaggaggctaaggcatgagaatcgcttgaacctgggaggcggagattgtggtgagctgtgatcatgccaatgcacttcagcctgggcgacagaatgacagagtgagactctgtctcaaaaaaaaaaaaaaaaaaaaaaaagtctccaggatctataggaagatccctaagatcttcaagatagcttctcaagttgaagaagcaaggtacagaactgtattttagtatgctacaatttggttaaaaaaatggggaggtcaaggagaatatatagtctgatttctctgcataagtatttatataaaaatatccagacatgtacccactcccgaaaaactaataatagcaatttattcattggcacgtctggcaggtggggcataggaatagtagagcatgttctcatgacagctccttcttttttcttttagtaaaatatacataatataaaatgtaccatcacaaccatttttaggtgtgcaggtctagtattaaatgcattcataatgttgtgtaaccattaccaccaccatccatcctctgaattcttttcttcttgcaaaactgaaacccccacccatgaaaccatagctcctcattccccctaccctccagcccctgatgaccaccattctactttctctcggattttgactactccaagtatctcatgcaagtagaatcatgtcctttttgtgtctggcttatttcatgcataaagtccctcaaggttcatccatgttgtagcatatgccagcatttccttccttttttagactaataaggaggaacttacttctgtcattttcctatttgtttccacatgccttaaggcttttggttcctcattttctgcattgctgtattcttttgtgtgtagttgatctttttgtagtgaaatatttaaattcctttctcatttcctttttgtgtatattttatatctattttctttgtagttaccatggggattacatttaatatactaaagttatacactctaatttggatttataccagcttaactgcaataacatacaaaaatactactcctttacatttccattcccactcctttcaattgttgatgtcacaaaattacctctttatacattacatggcccaaaccacaaactagtaatttttgaaaacgcattaatgtcttaaattatgtagaaaacaaaatgtagagttacaaaccaatgttacaataatattagcttttatgattgcccacataattgcacctttattgtgatctttattgcttcatatggcttcaagttactgtctagtgtccgtaaatttcagcctgaaggactctccttagcctctgttgcagggcaagtctagtcataacaaactccctcagatttttgtttatctaaaaatgtcttaatttctccctcacctttgaaggacagttttgctggatattccattcttgattgacaggtatttttttcttttatcattttgaacatatcagcccactgccttctggcatccaaagtttctggtgagaaacatgctgacaatcttactgacaatctcatatgtgatgagacacctctctcttacggctacaaagattctctttgtctttgtcttttgaaagctgataatgtgtcttgctgtgggtctctttgagttcatcttacctggatattgtcaatctccttgaatgtttaatatttttcatcaaatttaggaagtgttcaaccattctttcttcaaatattccctctgctccctcccctatcttctcttcctctgggactcccacaataggtcaattggtccacttgatggacacgattccttaggttttgttcacgttccttcaatcttttttctttcatttccccagtcttggtaatttcctttgtcctatcttcaagtttactgattgttccttctgcctgtttgaacccttctagtgagtttttcatttccattattatactttttggctttagaatttctcttatgtttcattttaggttttctatctctttactgatataaacttacttcaaaattattttcttgactttctcaatgtctttctttattctttgtgtattcgatctgctatcaggtctttttcaggaacagcttatttttttttcctttgaatgggccattctttcttgtttcttttatgctttgtgattttttttttgctgaaaactggatatgttaatgtaataagtggtatctctggaaatcagattctcccctctcccaaggatttattttttgttattatttttgtcattttttatttgttttcatttacttgtattgttttagtttttgtttactgttttggttgttgcccaggctggagtgcagtggtgtgatcacagctcactgtaaactcaaactcctggcctcaagccatcctcccaaagtgctaggagctaggactataggtgtgagccaccctgcctagccttaaatatcttttcataattttttttttttgagacgcagtctcgcactgtcacccaggctggagtgcaatggcgcaatctcggctcactgcaagccccacctcctgggttcgcactattatcctgcctcagcctcccgagtagctgggaccacaggtgcctgctaccaccgcagctaatttttttgtatttttagtagagatggggtttcactgtgttagccaggatggtctccatctcctgaccttgtgatccacccgcctcggcctcccaaagtgctgggattacaggcatgagctattgcacccagcctcctttcataatttttgatagtcgaaccatatcatttattacctgtttaaaaaataaataaaatgtaaagactaaacaatgaattcagttgtttgtatccagccagatgaactcatcaaggttcagaggaaggaaacactgcaatcatcagtgaccagaacacagatccctgatatttcgaggacaggatgtttttatttaacctagttcttggaaactgtgtgcaagctactcctggaatgcatacacagcttcctgaaacactagtacagggttgtgggtggggaatggggagctgtctttaccacccaagcctgaatatcttgtctctatgccaatgatcaatctgactaaactgaatgtcttctcaggtcttttctgtgcctgtacatttccctgggcctgtgtagtcactttctagcgttccttgtagaggcaattgcttttgaatgtcccactccttaatgtctggctccccacagggggaaaataaaagtggagaagttggggaaggcgagatggaggaacaggatactggaccttaaaatcccctgaaagcaacttcaaccagaggggaaggggcttgcaatagggggccaggtgcaccaccaatggcttccagcctctttgtctgcacctctgtagtcagaaccactgatcagtggtcagaacacacgtccctgatatttggagaacaggatgtttttatttaaccgagtctcgcaaattgtgtgcaagctactcctggaatgcatacacagcttcctggaacacaagtacagtgttgtaggtggggaatggggagctgcctttaccccacccccaaagcttctcctggaagtttcaggtctccatggactccagaattcccattacatcagcatggcaaaaactgcaattacttttgcaccaacctagtatctatttttttttttttcttttttgagatagggccttgttctgtcacccaggctggagtgcagtggtgtgatcacagctcactgtaactttgaactcctgacctcaagccaccctcccacctcagtctcccagagtgctagtgtcagaggtgtttgaaccagagcaactccatcttgaataggagctgggtaaaataaggctgaaaccctctgtgctgcatttccagatggtgaggcattctaagtcacaggatgaaataggaggtcggcacaagatacaggtcataaagaccttgctgataaaacagattgcagtaaagaaaccagccaaagcccaccaaaaccaagatggcaacgagagtgacctctggtcctcctcactgctacactcccaccagtgccatgacagtttacaaatgtcatggcaacatcaagaagttaccctatagggtctaaaaaggggaggcataaataatccacccctggtttagcgtatcatcaagaaataaccataaaaatgggcaaccagcagccctcatggctgctctgcctatggagtagccgttcttttattcctttactttcctaataaacttgctttcactttactctatggactcaccccacaatctttcttaagtgagatccaagaaccatctcttggggtctggatcaggacccctttcctgtaacactatgagctagaactacaggtgtgagccaccctgcctaaccttaaatatcttttcacaattttggatatttgaaccatatgactttttacctgttcaaaaagtaaataaaatttaaaaattaaacagtgaattcagttgttcgtatctagccagatgaactcatcaagagcaaaggaaggaaaggaccaaggcagggaagagaagaggactcagcaaagggcttgaggagcagctatgtaggtggcgtgttggatgagctagactccacaggatgcaagcagaaacactttgctctttctcacaactccctgttcgagcttccctgtctcatatctttccctggagagagtactgggctggtcccattgctttgttataaactcttaaggaatcaaaagtcatccagtaacttttagataataaaagattccgtgcaggctactaatcacattacagacttccttcctttgaaagaaaacaccttccttcttttgacttgggtttgacccagtctagtaaacctagagtggggaagaggaatagatcagggtctcccccaccaccaccaccactcttattgagtccacctccttccccactgtgcagctgtggtttctagccacaccatagttggacaggcttagaaggaggagtaagggaaaagggggcccaggcctctcacccttttggctactgaaaatgtcctccccaaacctctgggcttctgaaggtctctccctcctctggggcaacattagcactctaggaggtcctgaagacccccccaagcaggctcctccattgccccatgtgtcattgagatggcagctcttccaaagccagccctctcctgctctgcttggttactaaactcaacagcagctccagctccagcccaggcctttaaactttttgcaggtggctgaaacataagctgcctttatgctttatactgcagcaatcacaagtcaatctctacaaatggctcttaggaaacacctttagctcaaattgaatgagaaaacaccccttccccaccctgagaaggttaggaaaaaattcaactatttcccaaggaaattcttttgcctaatcctttaatgtcaacctcttaaaaagtgttatgaggctgggcatgggtggttcatgcttgtaatctcatcactttcagaggctgaggcaggaggatcccttgagcccaggagtttgagacctgcctgggcaacatagtgagagctcatccttacaaaaattacaataaaaaaaaaaaaatagccagctgtgatggtgtgtgcttttagtcccagctactcagaaggctgagacaggaagatcgcttgatcctgggaagttgtggctgtagtgggctatgatcatgccactgcaccccagtatgggcaacagagaaagaccctgtctcaaaaaataaattaattaaatacagttgaattaaatttaaaaagtgttatggactgaattgggtcccatcaaagttgataggttaattcccaatatggttgtatttggagacaaggcctttaaggaagaaattaaggttaaattgtctcataactatggagccctaatccatatgcacacatgcgcagagaaaatgtccaagtgagggcactgataaaacgtggccatgtgcaaaccaaggagagaggcctcagtagaaaccaacccaaccagcatcttgaggttgggcttccagccttcagaactgcaaaaagtggtcatgtgcaagacaggaagagaggcttcagtagaaaccaaccaaaccagcatcttgaggttgggctttcagccttcagaactacaaaaaaataaacaaatttctgctgatgaagccaccaggtctgtggtatcttggtgtagcagcccaagcacactgagccatagagaagaacaatgggatagtggcagcagagctgatgccatcttagcttgagggtggtctagcatgtacttctaggaggaaaacttggcatctactgtattattcttcagctttatggcctaaaattgaggcaaaagagtgcccttttgatatcctgttgcactctacataagaggcaggagacaaaggacaatgggaacaaaatagtctgagaagagaaccaagagagaggcatgtgcctgagagatcaagggacacctccaatcaagggcaggtggttagtctctagtaatgttcaatgccacagagggccaagtaggatgaagactgagaaagggacactgtggggctgataactggagtgaggggatgggggtgtgatatattttggctgtgtccctgtccccgcccaaattttttttattttttttatttttgagacagcatctggctctgttgcccaggctagagtgcagtggtacgatttcggctcactgcaccctctgcctcctgggttcaagcaattctcctgcctcagcctcccaagtagctgggataacaggtgcacaccaccatactcagctaatttttgtatttttagtagagacagcgtttcatcatgttggccaagctggtctcaaactcctgacctcaggtgatctgcccacctcagcctcccaaagtgctgggattacaggtgtgagccaccacacctggcgcaaatctcatcttgaattgtagctcccgtaattcccacgtgtcatgggagggacccagtgggaggtaattggatcatgggggtgggtctttctcgtgctgttctcaaaacagtgaataagtctcatgagatctgatgatccgataaaggggagttcccctgcacatggcctctccttctttgcctgccaccatgtaagacgtggctttgctcctccttgccttctgccgtgattgtgaggcctccccagccatgtggaactatgagtccattaaagctatttcctttataaattacctagtctctcgggtatgtctttattagcagcatgagaacaaactaatacagagtagcaaggtggcaaaaaccatgttcttgtcctgacagcagcaccagaatttttataaaagggacttagcagtagcaacttggtttgaaggggactgaaggctttcagatgggttatgcattggagaaattaaggttaaattgtccagtgtaacccacctaacccacgttaggtgggtgggccatgtgttggaggaacccccaagacccattaccatgttcaatagtttggtacaagtcctcccaagactgagcatacagttgtatgtgtagctatgatttaccatggagaaagaatacaacacacaatcttctgaaggatccagagtgtggggcaaaatctagaggaaaccaggctcaagatttcagaatcctctcccagtggcatccacaggacatgcttcactcccctaacaacgagtagcggcaatagatgtgaaatgctgctcaccaggaaagttcatttgagaatgaatgtccaaggttttcattgggagctggtcatgcaggcactctctgcctggcatgtactcaaattcaagactctcaaacaggggcaggagcagtggatcacacgtacgtataaccccagcactttgggaggctgaggctgcaggattgcttgaggccaacagattgaggctgcagtgaactctgattgtgtcactgcactccagcctgggcaccagagtgagactttaccacttaaaaataaataaataagactcccaaaaggaaaaagggtgcttagcataaaccatattgtttgaacaaacagtttggccttgatgaaccactcttaaaagttttaggaatggtgggacccctccaaaactccaattctccagaaaccagctaagggccaaccttgcaaatgtgccatcctaaggatatcttgctaggccaacacttctgcacacacccccactctcactctcagttcctgagtcattcagccaaggccacaaaaatttatagaaataaacatttcgacctagagcaggaatagatgcatggcttctcgtggttcagaggccctaatatagatcttgcagctgctggtgacacaaggtagggtccttccagatctgggatgtttaactctgtgcagtgcaagggtgctgctgttattctgaaagaactagcacagtctcgtcattctcttgcttctgttcatggaattttacattcagcaggctctcctagttcctgaactaccttatcctcacacagctggtcaaagtaaaacaaaggtctggacaacccagagaggttcattgccttcagcagtccagaacccccaggaagcccatttcccaggggagcagaacaacaagcacaaagtttgtatatgtattacataatgcagaacaataaaaatagaaaaaaatgcttttatgcacactttacattagaatgaaaaatatcagttaaccatagcagagtaagaaaatcaagccaggcatggtggctcatgcctataatcccaataagttgtgaggctgagctgggaagattgcttgaggccaggagtttgaaaccagcttggacaacatagccagacctcatctttacaaaaaataaaaaaaacttggccaggcatgatgtcactatgctttggtcccagccactctggaggtcgaggcagaaggatcgcttgagcccaggagtttcaggctgcagttgtccggtctagacaacagagtgagaccctgtctctcaaataaaaaagaggtaaaggggttgtattagttcgttttcatgctgctgataaagacacacatgagactgggcaatttacaaaagaaagaagtttaattggacttacagttccacatggctggggaggcctcacaatcatggcggaaggcaaaggaggagcaagttacatggatgttggcaggcaaaggagagggcttgtgtagaggaacacctctttttaaaaccatcagatcttgtgagacttcttcactattacaagaacagcataggaaagtccccccacccccaccatgattcaattacctcccaccgggtccctcccacaacacgcgggaattcaagatgagatttgggtggggacacaaccaaaccacatcaggttgaatatgagagttggggtaggctgattgcacttcctagtgctgctattgccccctctctcccctctcctccaaatagcagaacaggaggagcaaatcagattgggttggctctcaggatgtgctcaaagtttgtgctcagagctgaagcccatttctggtcatgtttctcatctatgtggtaggttcatccagagccggcctcctcatagtaggccaagccacctcacccctgtcttcttttctgcatggggagatgggggatgagcaaggcagatacaaagggggactttatttcccattccaacttctcctatacacacacctctctcagggatccatatggaagagaaattatccaggcaagagagaaacaggcctctcaattgcatcaaacctccccttctatctactccgacggttgcagggtattttttaaccttcagagaataatttccgcttaaaacttttttttttttttttttttttttttttttgaggcagagtgttgctctgtcacccaggctagaatgcagtgatacaatcacagctcattgcaggctcgaactcctgggttcaagtgaacctcctgcttcaggttcctgagtagccaggactacaggggtgcgccaccatgcctggctaattttttatttatttagttattcgaagagatggggtctcactatgttccccaggccgatctccacctcctggcctcaagcaatcctcccacctcagcctcccaaagcaatgggattagaggcgtgagccactgcacccagctacagcctaaaacttctgatctgaaatatgttaggcattttgagaatatggatgcaatgactgcagaataatcttgacttcaggattaagaggcaaggagataccaatttctgatgtgtttttgctcaacttctcacggaagtctccatgcaactagaaaaagacacaaagtcacagcggtcctagaagctgaagatagtcatccatttgaatgaatctggggaaacgtacactcaccatggctccagtgaagcggatggagaaataaagctggtggtctctgcaggcactactagaaagcacctgccaggaaagggtaggaagagtcgtgaacagcatgtgctgcctgctccaagctgggagacccaggtctgcaaaatccaggcacccagacaaccagctcctgactatgtgtgcttggattactaggaagtctggcatcttgtcccccttcccttttatccatttcctctcccttcctggtgcctctgttttgatcttgaattgcaggaacaaccccagcatattacatgggaagaagtttcagcacctgcaagtaatgcaatgagtgagagccacaggcagctccctccacaggctctcctgttttcttccttttctttttttggagacagggtctctttctgttgcccaggctggagtgcagtgacacaatcacagctgactgcagcttccaattccaaggctaaggcaattctcctgcctcagcctcctaagtagctgggactacaggcacacaacaccatgcctgattcattttttaattttttcgtagagagaccaggtgtggtggctcacacctgtaatcccaacactttgggaggcagaggtgggtggatcacctgaggtcaggagtttgataccagcctggccaacatggtgaaaccctgtctctactaaaaatacaaaaattagctgggtgtggtggcagttgcctgtaatcctgctactcgggaggctaaggcagaagaatcactcgaacctgggaggcagaggttgcagtgagctgagatcgtgccattgcactccagcctgggcaacagcgagactccctctcaaaaaaaaaaaaaaaaaaaaggattcagaactaaggccaggtgcaggagctcacccctataatcccagcactttgggaggctgaggcaggagaattgcttgagcccaggagtttgagaccagcctgggcaacccagcaaaaccctgtctctataagaaatacaaaaataagctgggcatgggggtacatgccgacagtcacaggtactcagaaagctgaggtggaagcctcaggctccagtttccttctttttttggagacaaggtctctttttcttgcccaggccggagtgcagtggcacaatcatagctcactgcagctgcagcttccaattccgaggctaaggcaattctcctgcctcaacctcctgagtagctgagactacaggcacacaccaccatgcctaattcattttttaatttttttgtagagaggctgggtgtggtggctcatgcctgtaatcccaacactttgggaggcagaggcaggtggatcacctgaggtcaggagtttgagaccagcatggccaacatggtgaaaccccgtctctactaaaaatacaaaaattagctgggtgttggcaggtgcctgtaatctcagctactcaggaggctgaggcagaagtatcacttgaacccaggaggcagaggttgcagtgagccgagatcacgccattgtactccagcctgggcaacagagcgagactccctcttaaaaaaaaaaaaaaaaaaaaaaaaaaaaaggattgaaaactaaggccaggtgcggtagctcacacctataatcccagcactctgggaggctgagaattgcatgagcccaggagtctgagaccagtctgggcaacctagcaaaatcctatctctacaagaaatacaaaaatctagcaaaaccctgtctctacaagaaatataaacattagctgggcacggtggcacgtgcctatagtcacaggtactcagaaagctgaggtggcaaaatcacctgagcccagggaagtcaaggctgcagtgagccaagattgtgctgctacactctagcctggacaacagagtgaaactgtctcaaaaaaataaataaataaaaatgaaaactagtggggaaacgtaaggtttaatccagcagagaagggaagcactgccctttaatgtacaaaaacaaaattaactcctccaaattattcactatcagagacagaagaaaggttaagaaacacctgctttgtgttagatatggccaatgaaagccttccacaaagaagatttgtccacaaatagacatacgaagatgaaaagacaagaggctgaaacaggaacggaaggaggctgagagtcgtggctacctgtaatttcagcactttgggagatcgaggtgagaggctgggagtttgagaccagcctggacaacatagcaagaccccatctctacaaaacaaataaaaaattagctgggtgtggtggtgagtgcctgtagtcccagctacttgggaggctgaggcaagaggattgcttgagcccaggacttagagactgcactgagctatgatcacaccactgcaccgcagtcagagtaacggagcaaaaccttgtctcaataagataaaatagaaaagaaaatgagcctggcttcagtgaggagaacaaacaagaacaatgacaatgcaccagcaaagtcaaagcctacctgggacgcgctggcagggaactgcaacttctaactcatgtcaataaatatttacccaaacccatgacgtggcagccatcgtgctcggccttggggatactgcagtgaacagggggcatgtgggcactgccctctaggaaattaagagtgcagctgcaaacagagacaaccaaggactcacaagggtgtgtgtgttaaaaacgggaaagtgctgcagaaggaaaatgcagggaaattggatattgtctgggacagtggtctccatgatgtgagcaaagtaagagatgctcataagcatctaacacagtgtgggcacagatttcagaggcttcattcattcatattgcttcttcttcttcttcttttttttttttttttgagacagagtcttgctcagtcacccaggctggagtgcagtggcatgatcttggctcactgcaacctccgcctcccaggttcaagcgattcccctgcctcaacctcccaagtagctgggagtacaggtgtatgccatcgcacccggctaatttttgtattttagtagagaccaggtttcaccctgttggccaggcaggacttgaactcttgagctcaagtgatccacccgcctcggcctccaaaaatgctgggattacaggcgtgagccaccacacccagcccatatctcttcttaatcatccttttcaatttgttttttgggtatgcattataagggccgccatgtgtgagtagagcagcacctgcatgtgacatgataaagaaataacagggaaggggtaggacacaggacctgggaagggcagaaagagaagccattgtgtaatggaaaagttgaaatctgcatgatatgaactttttacttatacacttagacttcatatactcctctgttatgttacttaaaatagcatattagtatattaattttatagaggtaaatataagtgctttctgaaaaatataatttccttccttttcctccctcccttccctccttccttgtctgcctccccttcttcctcccttctttcctttttccctcttctttccttcctttcttctctgcctccttccttcctttcctccctgcctttttccctcccttcctccttccttttttccttccttccttctctttctttcgacagggtctcactgtgttgcccaggctggagtgcagtgccgtgccatgattatagctctctgcagccacctcaacattttcggcccaagcaatcctcccacttcagcctcccaagtagctagaactacaggtgcacaccaccatgcccagctacttttatttttttgtagatacagggtcttgctatgttactcaggctgctctagaacttccaggttcaagcaatcctcccaccttggcctcctaaagtgctgggattatcggtgtgagccaccgcacccagccagaaaatatgatatcatattacctggtgggtggggggagaacaattccagaagcataataaatagcaacagccacagcacagataatcacatcaataacctacagccccaacctagtctagacagggaaaataaaaaagaggtaaaatgatgagagaaagataatacatgaaacacagaaattggagacttgaactttacaagagagaaagacaaaaggatccgagaatactagaaggtatagtaatgagacattttttttggagctaagaaagggaagactttcatgtgctatcaatcactagcagatcaaataagcaaatattaataacatcactcactgtgatgaactatagggcaggcacattgttaagctattttacttatgatagcaataaggtaggatttatttatttagagatgaaatttcactcttgttgcccagtctggagtgcagtggcaccatcttggctcactgcaacccctgcctcccaggttcaagcgattctcctgcctcagcctcctgagtagctgggattacaggcatgcgccaccacgcccggctattttttgtgtttttagtagggatggggtttcaccacgctggtcaggctggtctcgaactcctgacctcaggtgatccacctgcctcggtctgccaaagtgctgggattacaggtgtgagcacccgggccaagtctatttcttttttttttttttgagatgcagtctcactctgtcacccaggatagagtgcagtggtgcaatctcggctcactgcaacctctgcctcccaagttcgagtgattctcctgcctcaggctcgtgagtagctgggactaggggctcacactaccactcctggctatacttttttttttttgtatgtttagtggagacggggtttcaccatgttggtcaggctggtcttgaactcctgaccacaaatgatcctcctgcctcggcctcccaaagtgctggggtttcaggcgtgaggcccctcgcccggccgaaggtaggtattaattgatgtccctgttttaataaggcataagggaggttcagatattaggtgacctctgtaagattatgccactaattgtaataaaattcagttttgaaccctgatttaccttcactctaaaacattctttccattatgccatgttgtctttcaagatgaaaatttcagtagtacaattgcaattactagattattaaccatacacacagaaaataacagataatatacagaatgctgtaggaaaaaaaggctgtacctcttaaaacattcatgaaacatttataaaaacaggattatatggtagatcgcaaaaaatcaactaatttttcaaagctgaaataagcagacctcattctcctactcaaacccaaagaaactaggatttaatattaatagtaaacattgaagcagagccctagatcactccgaaatggaaaacactctcctgatcaatgaagaatacaaatgcaagatagtatcttttaaagaaaatgacagtgagaaaattacataactcaaatatgtaagtattaatcaaacttgttttcagatgtaattcataacattaaaataatttcattattttgggctgggtttggtggctcacgcctgtaatcccagcactttgggaggccaaggtgggaagttcatttgaggtcaggagtttgagaccagccgggctaacatggtgaaacctcatttctactacaaaagtacaaaaattagccaagcatggtataatcccagctacttgggaggctgagacaggagaatcgcatgaacccaggaggtggaggttgcagcgagccacggttgtgccactactgcattccagcctgggtgacagagcaagactccaccacaataaataaataaataaataaataaataaataaataaataaataaatattttgttatttggaaaggaaaaaataaaacatttttaaaactttagaaaagttagacttaaaggtaataggggtaatgatataattagggtgatggtagaattagttaattgggaaattcacaaatagatatgatatgcattgtatcaaaaagagagttatttgagaaaactataaaatatatgaatgattgacaaatcgaatccagaaagaagaaaatataattacaactgagaaaagctatgcagccacaaatacagaagagataaaaattatgaaatactgtactttgtataaccaaaagctaatctatttcaaattttttgtgaaactattgactttattaaaaaagattattacagatttaagaaaatgcagaaaatcaacaaaatcagatttctaaaactgataacctatttttaaaaaatacctgaaaagcttctcaaattaggaaaaattatatctgagttttttcctgttgttgagaaatagacactcctcatgttatattaactgttccaggatgaagaaaaagtggaaaagctaatataactctcatacaaaaatacacaaaagaaaaccaaccaacacatctcacatgcaaaaacgctaaagctggaactggaaaatctaatttaaaatatgctccaaacatagctgaccacagccaagtacagatcattccagaacttgagtacaatttaatactagaaaaatcaatccatgtatgaaatcaaatcaatagacacaataaaaagtgtggtggtctctatggaagctgcaaacagtgctggggaaaatactagattccttcaggactttttagaacaaggacaagaataatcctttctcgacaaagtaagagtgatctatctcaaggcagaagcatattctcctacaccagaggaatttccattaacataagcaatgccccaaggatgcttgttatcatttttattcaatgttgttttctgtgttctggccaatattatgacttgagatacaagtgagaaagatgactaaaggaattcatgagacaagatgatcactattcaggagatggtatgattgtctatctagaaaaaaagaaatgactccatcgtaattctgggaatttactaacagtggctgggtcctggacaaacatttaaaaaatcaatcgtttccttgtgtggcagcaataaccatttagaaaatggagtaaatgcggagttaaggggctgtgaatatataacagcaagaactcctgatctgccgtcccgacaagtcgcctccggagtggacaccggccagggaaggcaggtctctggagggaaggtagagagaagatacggaggatctgccccttccccaggaagctccccgagaaagggccacaactgtttactccagcaggctctggggggattcaggcttgggggtgatggtcttgacctcactgactactgaccacccgaagaaaatctgctctatagcccgtgtctcctgctcctgggtgggatgtaccctaaagagagggggcttcctccttgacctcaggaaggaggcacacttgtttctggtcaggtgaacatgaaaaccaccgggcttcccctaacctgttggtgtgcctttgccctgacttggcagagaaggcggatggaaatctacagccaggcagagaaatgacaactcacttcagtctcagaaatgacaactcaccccgtctcagtgaccagagacagggtgactcaatgagcctttgaagcacttggttcccactgactacaactaaagaaagaagacttaggtaagaacttagagggtggccaggtgtggtggctcacgcctgtaatgccagcactttgggaggccaaggccaggtgtggtggctcacgcctgtaatcccagcactttgagaggccaaggccaggtgcggtggctcacgcctgtaatccaagcactttgggaggccaaggagggaggatcacctgaggacaggagttcaagaccagcctggccaatatggtgaaacccagtctctactaaaaatacaaaaattggccagacgtggtgacgggagcctgtaatcccagctactcgggaggctgaagcaggagaatcgcttgagcccaggaggtggagtttgcagtgagccatgatctcaccactgcactccagcctgggtgacagagcgagactctgtctcaaaaaacaaacaaacaaaggaatatgtgctcccaaagagtggaatcagagtacaccaaagactcccagaaagtaaaaagcatgattttcaaatatgcagattcatagacactctgaaattaccggctggtaggtgataggaactgagacagtagcctggaaccactgcacagaacaacaactcagagcacatacccagtaatgggagtgctgggttgaatggcagttctgtttttagctctttgaggaatcgccacactgcctttcgcaagggctgaactgatttacactcccaccaacatatatgagtgttccctttactccccaaccttaccagcatgtgtcattttttttttaagatctatgtagcaactttggttttctttcgcaatctttatcaaagtttatctattttttttattttatttttccataagttactggggtacaggtggtatttgattacgagtaagctttttagagatttgtgagaacatggtgtacccatcacccagcagtatacactgcaccatatttgttgtcttttatccctcacccccctcccacccttccccccaggtccccaaagtccatcgtatcattcttatgccatcgcgtcctcatagcttagctcttacgtatcggtgagaacatacgatgcttagtcttccattcctgagttacttcacttagaataatagtctctaatctcatccaggtcattgcaaatgctgttaattcattcctttttttggctgagtagtattccatcgtatatatagatatataccacaatttctttatccactcattgattgatgggcatttgggttggtgccatgattttgctattgcgaattgtgctgctataaacacgcatgtgcaagtaccttttttgtataatgacttcttttcctctgggtagatacccagcagtgggattgctggattgaatggtagttctacatttagttctttaaggaatctccacactgttttccgtagcggctgtactagtttacattcccaccagcagtgtagttatttttgactttttcatagtagccattcttactggtgtaagatgatatctcattgtggttttgatttacatttttctaatggtcagtgatactgagctttttctgtatgcttgttggctgcatatatgtacatatatatatatatacgtgtatatatacacgtatatatatatatacatatatatacatatatatacatatatacatacatatatatatacatatatacatatatatacatatatatacatatatacatacatatatatatacatatatatatatatataatggaatactatgcagccatgaaaaagaatgagatcatgtcttttgcaggaacatgaatggagctggaagctgttatccttagcaaactaatgcaggaatagaaaaccaaatactgcatgttcttacttagaagtgggagctaaatgatgagaacacatggatgcgaagaggggaacaacagatactggggcctacttgaaggtgaaggagggacagtaccccaaataattattgggtactaggcttagtacatgggtgacaaaataatccgtatgacaaacccctgtgataggagtttccctattataacaaacctgcacatgtgctctggaaactaaaataaaaacaaaacaaaacaaaacaaaacacacagagctagagactgggaggtaaaagctgagagacctggagactaagatccctgaggtctaacctgatgaggacaggaattccaaagaaagaacaaaagaacggatggaagagaaatgctgttcatgatcgctgacatccacagagcattttttatctgccaggcatcatagtacatgagttaactcatttaatcctcacaccacactaacgaggtagatattattactatttcatgtcctaaatcaggaagtggaaatcagaagagcttatgctcaatttgcatgggccagacctggggctgggtggggcagggtgaggcgggggttctgaatttggcagtctaactccagagtccatcattttaaccaagctggtaaagattaacagaggctgattaaacaaataatagaaaaagtaaccccaatgcaaataaagacataaatagcaaagaaattaaaacttagaaaagttaaacataaatatggtaataggggtaatgatagaattaggggaaaggcagaattagttaactgggaaatacacaaatagatatggtaatcatcgttgcaaaaaaaagaggattctttgagaaaactataaaacatatgaataattaacaaatctaacccagaaagattcaaataaaattgcaacagacaaaaactatgtagcaacaaatacagaggagataaaaattatgaaatactgtactttatatagctgaaagcaaatacattttaaaacttttgtgaaatgagtaattttattgaaaaattactagtttatgacatttagcaccaagctgagtggctcacatctgtaatgctaacgctctggggggctgaggagtgaggattgcttgaggctagaagtttgaaaccagcctaggcaacatagcaagacctcatttccacaaataacaaaaaaataaaaaaaattagccagtcttggtggcacacacccatagtcccaactactcaggaggctgaggcaggaggattgcttgagctcagcagctgaggctgcagtgagctatgatcgcaccactgtaatccagctggggcaacagagcaagatcctgtctcaattaaaaaataaaagacatttaggacccatatgaagaaacctatacaactttagtgatatatttttaaagcctttaaaagaaaacataaaagaataccatgcttcctggtagaaggattactctaacaattttatacttcttaaatgaatggatatgtttaatgcaatttcaggataaatccctatggaatttttttggaaatgtcccagtgaattggtcatttggaagaatgagcaggaaagaaaacctctaaaaggaattaaggacagtaatgctatatctagtaataaaatctattataaaaccacaataaaaaagtactgatgaaggttaagtaggagataaacaaaacagggcaattcagaaataagccctagtaaataaagataataaacataaaaaatcgaatggaaaaaaggaggcttagttaacaaatggtgctgaaaagacaggtaaagaacttgaaaggaaaaatcgattttattcctcacttggcattttactctagaacatgaattagaggataaaaaattagagaaatatataggtaaaatgaagaaaatcctatctaagcttaaaatcaataaaggaataacaaaaaaatagagattcacagacttgctaacatactctgcatgttaaaaacatcagggactaaattaaatatttagcaataatctaggaaaactctatgcaatgaatatggcaaaagaatagcattcttcaaatacgaagaaattcattaaaagatgaatactaaaagataaaaacagataatccacaaaagacaaacacaaatattaaacatgtagaaaatgttcaacttcaataatatgaaaataaatgcaaattaaagcaatagtgagctagcattttccacatccccagtatgcaatgttatttcatttttgttgttgttgttgttttgtttgttttaaaaacaaggtctcactctgttgcttaggccggagtgcagcggcatgatcatagatcattacagcctccaatttctggcctcaagtgcccctcctgcctcagcctccccagtagctaggattacaagcacatgccaccaagcccacctgttttttaaaaaaaaaaagtttgtagagatggggtctcaccatgttgcccagactagtcttgaacgcccggcctgaagtaatcctcccagtttggcctcccaaaatgctggaattacaagcttgagccatgaagcctggccagattttaagtgaaaagacagagtacacagtttgctgagtcttctcactaatactgatggtaacagacatgagcatagactttctggatactaatttggcaatggcatttagataaaaagttcctttttaaatgttctttttttttttttttttttttgattcagtaattccttttctggaatctgtcccaatgaagtgttcagaaatttggtcatagatttctgcatcatgctgtttatcataacattatttgtaacagtgagaaatggaaaagaataaggaatataaataggaaatgaaaaatcaacccatcgcccagaagtaacatacgtgtattttttcttcattttcttctaagcaaataaacaaaataattaaaattatgttttccagtcctttttacttgatattgtattgtgaagattacatgttattaaaactctttacaataatgagtgtagaagacttattgggaaaaaaaaacctcttcataataaaattagttgtatgacatcttacagaaagccatagatttctccattgatcccctattttggtgtggtcttatcgtttctgtattggcatgaaatatgtttgtaatggaacaggaagttgtttctctttttcaagtcttcaagcgtctacatgaaagcgttcttgaggggtaatggttctggcaagcgaatactgcagctgaatgctgataatttcctctgtggaacacgtagcacagttttctaagtcgtgcagaagttaaaatgtcacttggcaccagcccatattatccagaatgttatacaaccaccatccggatcatttcacgcaaaattagaattgtatagaaaattgctcttctggggccccaccactataccacatatattaaataatcacgccacgttaaacacctacacgtgctaccaagtcttatccagatgagaccctggatgatcgtaagtgcaattgtttcacctccagaaattaacttgcttgagtaaaaagtgggagtaaatatctcttagtggctgctgggggttgctacaagctgcaacaagctggaatctttttttttttttttttttttttttgagacggagtctcgcactgttgcccaggctggagtgcagtggcgccatctcggctcactgcaacctccacctcccgggttcaagagattctcctgcctcagcctcccaagtagctgggattacaggtgcccaccaccacactcagctatttttttgtatttttagtagagatggggtttcaccatgttggtcaggctgatctcaaactcctgacctcaggtgatctgcctgcctcggcctcccaaagtgctgggattacaggcacaagcgaccatgcctggtcaacaagctggaatctttagagaacacccaagagtgtctgtccacaccctgggcagagggccaagggggcaggactttggaagatggtaagctctgaactgaaatagtggagaagaataacttcacaaagctctctatgaaaaatacgcctttgccccatatagatcatagacactggggatgctgagttgcaatgcagtgcaaaaggacagtgacgtgcaaaagaagccatggtattctgcattaaaaaaacaaaagtcgaaaacgaagaacgctgtctggctttaaaacccagctgtcaacaggaggaagtgtaatcattttgacatgtttccgtttcgttgaagattcaaggttttaaacttggacttaaacctaaatgttatgcttcctggattgtgaacatccaatttcatttatatttttaaactaaaactttagaaatggattaagcagttgaaaacttctgggattcacaagagatgtacagaatatattccttttaaatcgtcagtttcagaaacctttatcaaggaaaattaacaaaccactcttaggaatgtcattccatctatggtcttcaaaatctgtctccatctttccaagatctagacctcctaaaagtaggtcagagggattactttttcctgccacttacctggtcttcattagcaatggtatgatagggatggtatattaaaggaatgctcaaatgacaacagtagggatgaagatttcttcaataacccatgtcaagaaaatatgggcagattgaagcaaaccctgacaatccctcatacttaggaactcccaaccctcattcttgccttggcaaaagttttctgaaaaaaaaagccagtaagtcaatacttcaggctaaatttaaaggaaactacttggaaattaccttgctctgaaatcttgttagaagcataatatttccaaaaagaaattgaactataataggtttcagagcttagctttcaaggttgcaaatgaccgtcaattgtgaactcagggtacccacagcaaaagactcatgacagctgatctccctatattttggtgaatccttacagcattcactcagtattttataatcccagtcctcctgtaatttcccataacttagttatagtgacctcatttatgatgaaacattcaattaaccacttaggttgaaaaaaaactgtgaaaaatttctgagaggttctgatgatgggtagaggaagcaacactctaccctgcttctttccactgctggcagctgtggaacatgcagagaacgcatggaacagctatttggggattctgagaagtaagttgtagtagcaggtgatttggagaagacctgaatttaaagtaccaccaaaccagcaaagagtttgctacagtttttcctcgagtacccccagctagatgcaatgctaaagaccccgggcagtgggcattggtgtgggtggtgagagctccaggaagcctctagttttggcttgaggggtaggaaaagggtctctaacattcagagagagtgggggaaatacttcctgtcttttcatttcaccatttcttcatgcctcaacccatggtaacctgcaggtgcttacatgctctgaaggagaacctttccttctgatcagtggaaccattgtctcgagtaggaacaaatgcctgatgcctttttctctttctcttctcttgtagcttggatcaggaagctgatacagccaaggaaagtatgcataagagtaggacaaataaagcctcagcttgctggacataggaatgaaaaatagagtcctaaataaatggtagtaccaaggaggtcttggagagtgaagaggttggcaaagctaccccgccattttgtgtatgaaatcctgggctcacctgtaagttgttcatgcctgtctaaccctaaacagtctgccctagactctgaaaactggaaaacatgtgagatggtttggatatttgtccccttcaaatctcatgttggaatgtgagccccaatgttgaacttggggcctgtgggagatgttggatcatggtgatagatccttcataaatggcttggtgctctccccaccgtgatgcatggtagtgagttcacgcaagatctggctgtttagaagagtctgggatctcccccgtctctcatgctttgtgacacaccagctctacttcccttctgccatgactgaaagcttcctgaggcctcaccagaagctgagcagatgtgggtgtcacgcttcttgtatagcctacagaactgtgagccaaataaacctgttttctttataaattactcagtttcaggtatttctccataccaaggcaaactcctccatagcaacaactaactcaatgggacaaaatactacacagctcccagaatggccaacgggtggagcacgagcagaacagatctgaatagtgttgcaaagccttggaaaactgaacagaccacaatccaaagaaagctggtcagaattttcagcctacacccaaccaactcaatctgcctgctcaaacaaaaatatcaacattctctggaggatttaaagaagagccgggatctcataacgtaatattcaaaatgtccagacgataatacaaaattaatcagcatatgaagaagcaggaaaatttgacctgtataagaaaacacaatcaccagacgctacagacacagttgttggaattatctgaaaaagatgttaatgaaaccattaacactgtgttcttatttatatcacttatttctttgttgagaggtttttatctttttctatctttccactcctctcatttgcaaatcctctcgagaggaatgggaaaatagaaagtctagacaaagaaataaatgatataaacaagactacaatgaaaatttcagaactaaaaaaaaaaaaacagtaacagcaaagaagctctatagaggggctcaatgtagaaatggaggtgatagaagagctagtgaatttgaagataggtcaataaaaaatgtgagtctttctcctcttcttctatgattaatgttcctactatcagaggcataaaaggagatgagaaaggctgcagagaagaaaaaatatttaaagaaataatagccaaaaactttctaaatttctcaatagaaataaaacggcctgggcgacagagcaagactctgtctcaaaaaaaaaaaaaaaaaaaaaagaaataaaccaacagattcaccaagcccctaaagccccaaatgggatgaacctaaaataatacatcctcaaacatatcacaatcaaattgctgaagaataaagacaaagaaaaacatcttacaatcagacagaaataaatgacgcattaccaacagaaagcaatgattccaatgactatagatttctcatcataaaacactgagaccagaaggaagtggaacaacattgttaaagagccaagagataaaaaactgtcaacccagaattctacatccagtggaaacatccttcaggaatgcagtcaaaatgaagacattttccaatgaagaaaagtaaagaaattcattgtcagcacacctgctctaaaaaaaattttaaaggatgttctccagaaagaaataaaatgataccagggctgggcacagtggctcacgcctgtgatcccagcactttggccaaggtgggtggatcacttgaggttaggagtttgagaccagtctggccaacatggtgaagcctcatctctactaaaaaatacgaaaattagctggatgtggtggtgtatgcctgtagtcccagctacttgggaggctgaggcaggagaatctcttgaaccagggaagtggaggttgcagtgagccaagatcatgccactgcactcaagcctggacgacagagtgagactctatctcaaaaaaaaaaaaaaaaaaagaaaaaaaataaataaataaaatgataccagaagggaacttagaacataagaaatgccaaatatatgggtaaatataagattattcttaccctgtttggttctttaaaaatgttctatggttgaaaacaaaaattataacattgtctcatgtggttttcaatgtaggttgatataacatctaaacctttaactagaatgacaaaggaaatggattgattcttcagataatacaaaactcaccaacgaagaaagacacatcctaaatagtcctattaaagaaattgcattcacagtttaaaactttccaaaaaagaaatcttgaggcccagatggcttccttggcaaattctaccaaaacatttaaagaatttttttctttatggataaataatgccaattttacacaatctcttccagaaaataaaagaggaaggaacacatctcagtttatttgataaggttaacattgtcctgataccaaaaccaaagacattacaagaaaaaacaaacaaaaaaacacctagagtctaatacctctcatgaacttagacacaaagacataaggttttctttggtgtcaaaacctgatcaaaaaaaaggatcaagctgttcttgagctgtatcttgaatgtgctgacctgtacatgtatatgaatttacacgtgttaaaattcacagaacggtacaccctcaaatgtcaattgtatgttaattcaaaatttaaattttaaatctaaaaatgttttagggccataactctcagattgcattaagaagccagtttcaacatctgcaaagccatacaataatctttcaaaatggtatgacatgcaatgccataagtctcttgggaaagttttcctctctcttaaaaggggacagccctggctttgcatattgtcctgtgaagatgcaatatatagcagccatcctgtatccacagggagaagccaagagaactgcagagttgctgagctagatagaggcctggcatcttgagtggctgcattcaccagccaagagctcatcttatctccagacttgccatgagagccaacaaaaccaaatcattccatgtactggcagctgaaaaaagcaaaacttggatagtataactgaatatctatttgaattactttatacaggttgagtatccctaatcctaaaatctgaaatcagaaatgctaaacaatctgaaacattttgagtgacaacctgacgtggaaaggaaatgctcattggggcatttcagattttggattttgggattgtggatgcccaatcagtaagtataatacaaatattctcaaatccacacccccacccccaaaataaaatccaaaatccaaacacttctggtcccaggaatttcagataaggaatactcaacctgcatagcttttatggatgaattggacatatgccttcttgtaatagcaaatttaaaaacttctttttctggccaggcacggtggctcatgcctgtaatcccagcactttgggaggccaaggcaggcagatcacctgaggttaggagttcgagaccagcctgtccaacatggtgaaaccccgtctctacgtctctactacaaatacaaaaattagctggtcatggtggtacactcctgtaatcccagctactcaggaggctgaggcaggagaatcacttgaacccaggaggcagaggttgcagtgagctgagatcgtgccactgcactccagcctgggtgacagagtgagactccatctcaaaaaaaaaaaaaataattaattaaaaataagtaaaaataaaaatgaaaactcgtttttctctatgaagattctatgaccccctcaaggtgcaagtgaactttctgaggagaaaattactcaaaatcaattaaggtaaggcaaaactaatcacttttggcaggtgctctttgtcagccagatggacaattctaaacagctctattagattgggtaactgatccagttaggtggggaagggttttgtagccagcaaatcctgacaagctatcctgatataaccccagtaaaaatcatatattttgcaacaactattattttaacatagacagggatggttgttaaatcctgacatagaatcttctaactcaaggtcatctctttcatgatccatgatgcaagactcctagccttccagatttctgattttggattttttgattagggatgcacaaccagtaagtataatacatatattccaaaatccatcccccctcaaaaatccataatacttctggtcccaggcatttcagataagggacactcaacttgcatagcttttatggatgtattggtgcttgctcaggcatttaagctgatcctaggctgatctttttaaaaaaaaaaaatctgagctctgttattatgtggctctaggaccacttctgtgcagaaacatagctgcagtgcacttgggcacaaacagacatcaggctatttgtaaaatatattaatattctgaaatagtgatatacatgtaaaatatatttatatgttaatatatgtaaaatatatttatatgttaatattaatatatgtaaaatatatttatgttaatatatgtaaaatatatttatattttaaaatattaatattaaaatattaatattttaatgacctttatcacctagacatttgaaatccaacaaaacatgggctacctttaaatcaacaatgcatcatggccagcaatctcaactattagttgtactgtttgttcatactacagcccaatctgttgactgctgcaagttttagtagccacataactctactttccatcaaactcttgccttcacagcagtggcctccccgcccccctgcccctgccccagctggtccttgttatagtcttgagagccaccccagaaacagactcattcttcttttgcatgacaacccttcaaataccaagtggcaacctaaactgcttaaagacaactaccatatcttcacctattcttctctataaagcaagcatccccaatcccatctcggattcattacagtatgtattctggagtcccattgagatcccggttcttgcctccaaatgtcctctgtgggatctcaaggtgaggaaagcaggaccgaaccccacgcttcatctgtgtggaagtcaggagttcaagaccagcctggccaatgtggtgaaaccccatctccactaaaaatacaaaaaattagccaggcgtggaggcgggtgcctgtaatcccagctactcaggaggctgaggcaggagaatcacttgaacctgggaggcagaggttgcagtgagccaagatcacaccattgcactccagcctgggcaacaagagcaaaactccatctcaaaaaaagaaaagaaaagaaaaaaagaaacagcaaggataggaggataattacttattttgatatgatgcaatacctctaacagtgcagcctccaagtaaaattcgcattattgatagtcccatcattctgtggatccacatccaagctcaagtctgtcacctgcacctgtgctggaaactggtcctgctcttgtcacacttttcttctcttgtttttgtatagttgattgtttggatgcaaatgcaggaccttacaattgtttctgctaaatctcatcgtgttggattcggcctaattgtctcagcctgtcaagacctttttggatcttaattccatcaggcactggcttcagggaagcactgctaaaacttttcaacacaataaagtgggggacagagccctggggcacgttactgggagtcttcctttgggcataattattcacccagtcctacttctacctaattgcagtagcatccagctcatatttttctatcttaaccacacacataccaaattcgtcaatgtaaacttgtcaaatgctttggtgaaatccagattcactctgtctaaggcactcattttcctttttttcagtactttttttttttgataaaagtgaatgtttccaggaaccaactgtccctttctgcttactgctttacaaccaaatgcaaccgtacctgcttcgatctgcctttgtagacagctactatatgtatgactcttttttaagagacagggtctctttctgtcaatcaggctggagtacagtggcgccatcacggctcactgcagccttgaactccttggctcaagtaatcctcctgcctcagcctctgagtagctgagactgcaggcatgcaccaccaggcccagctattttattttattttttttttttgagacagagtctcactctgttgcccaagctagaatacagtggcacgaccttggctcactgcaacttctgcctcctgggctcaagatattctctcgcctcagcctccccagcagctgggattacaggcacgtgccaccatgcccagctaatttttttttttttgtattttagtagagatggggttttaccatgttgcccagggtggttttgaactcctgagctcaggcaatccacccacctcggcctcccaaagtgctgggattacaggtgtgagccaccacgcccagctggaactataattcttaagtacttactccccaagtaggatgggtctgaaatcaaaggaaaggcttcttccatgttttggtcaagtgacgcagagatgggaaaatagaggcagaaatttaggtagagcctgacatctacagagccaaaataggtttctccataccttttcttagacacaaggtctctctctgtcacccaggctggagtgcagtggtgtgatcatggctcactgcagcctccaccttccaggctcaagctatcctcctgcatcagcctccagagcaactgggactacagatgctatattaccatgcccagccaattttttctattattatttttaatacagacgaggttttgctatgttgcccaggctggtctcaaactcctggcctcaaatgatcctcctgcctcagcctccggaagtgttggaattacaggcatgagcaaccactctcagccactccataatttttctatgactctctcaagcctccagagcactctggaaagcagtatcttataaagaaaaatttaaaaaaatcagctatctctcaataaaaagttataggggaatctgtcaataagttacaaccaatcgctatgctaaggaggagtccagtgagctgactgctgatccaccgaatggcatgcctctctcatgtacctgggcagcggcacttggtatgcttgggccccaggtccagcaagggctgacctcagaccaccttctgctgtcctcttcatctgcatttggtggcagatacagaccaggaaggagtcacaggcaaggaaagtcagctgattctacacggccttgcaactttgcagaatgttttaatttttcaaagttattccctctgtatctgcttctgtgtgctttgtatcttagtcattatttacaagtctggcttggctaccagataatgaggtaaactaaactaattcagcaatctcattatcaccaaccaatttgtgcccacgtgttaatgcataaatatcatcctcaattaaagcttaaatagtcaatcttggctaaaatgaacaacgatggggcagggtgaggggagagcaatttccctactttttaaatgcaagcacctccaccagcaaaagattttaaaatatacatgacattcatttattcgcaaattatatacatacactatttactcatcaaatattaacagagatctattcttaattttagatgagaaatagatacgagaaggttctaatattttctttttataccccaatggatttttcccacaaccctttaactacacgcacaccactttgaatcccagtggtatcaaccatgatgaagttaaacaaatcctggattgtaatcatggcttattgacctaaaccaagtcattcctcctctttgggcctcctgttttgtttgtttgtttgagacggagtcttactctgttacccaagctggagtgcagtggcgagatctcagctcactgcaacctccacttcatgggttcaagcaattctcctgtctcagcctctcaagtagctaggataacagacgcccgccaccatgcccagctaatttttaaattatttttagcagacatggggtttcaccaggctagcgaggctggtctcgaactcctggcctcaagtgatctgcctgcctcggcctcccaaagtgctgggattacaggcatgagccaccgcactgggccgggcctcattttgcatattttttgttggattaataatactcacttagctacctgacacaagatgattaaagaaaaaatctcccaaatggttaaaccatcacatagatgtaaaataatgccatttttattattgtgattatcttattgattgaggacggtggaaaaactggaggaaataggtacactgaaaacacttggaagtagatatagactgattctaagttgcaggagagttcagaactgcttttgagtacaatgaaaattgctttcccatcaagaacaatttggatggccatccagaggagcagatgccagtgcacacagagagggcaagtgacactgcaaagtggctggagacgtccgtgcggaatcgcagacttcaggagaaccactgcaactgtcagaactctgacctcaggatgagatgtcacagccaggtaatgggtccccgctgctcaggcagacaccaacctaatgggacactggccttggtggatgggtgtaatgaggtgacatcttggactagtttcctgaggcagttgtagccaagtatcacccacctggtggctttaaaaaaacaaaacatgacctaaatgaatgatctcacagttctggaggccagaagtctgaaatcagtatcactggggccaaatctaaagcactccctctggaggctctagggagcataaattctttgcctcttccagcttgtggtgtctccagtatcctttggtttctggctacaccactccaatctctgctccatcttcacaaggccttcttttctctgtgtgtcaaatctccctgtgcctcccttgcagagggatacaggatggcaattagaacccaccctgattatccaggataatctccccccaaatccttaacttaaaaaggattgcaaagacctcttttccaaataaggtaacatttacaagttcaaagagggagagcttgatatctttgggaggccatttttcagcctaccatacccctacccaatctccctctatcttgagatactaggattctatggtttatgcataagcaacagtatttggtacgaataaagtaaagtgttacataagtggcataatgagtgcaaaagcagtcagaaaagggagggagagcccaactatgacctcttggggatgtcctgaggtcctcaccaggagtgtcccttcccaagaacaacatctgtccccaaactctatggggcacagaagagagagattcccagagcctgacagtctccaggcaactccctctagccttgatccatcctattctctattctacctaatattttctaattgctttaggaaaaatccttgtcactgcaaagaaaacagcctctctgtcaaaactagtttggtcagtcaactataacaacacatatgaaaagggagggcagaggaaggtgaaatgcctttgggaatgcagaatcattatggcattcccatctttctctctcccaaaacgtaaaaacttgcactaaaagaaaagttgcactaggtcctcgcttttacattgcttcctcaggagcaaggcagaatatatgaggtatgtcctgagtcagagaatgtgtccaactgctgcaggtccatgaggctctgcctggcccagcattctgttgtttacggaaacctcagagactcagctaggttctccttcctgatggcaacctcaaatattaaatatattccacctgctcttcataattattggtgattcatgaatctgcttgggcccttttagaatttatttatttctcccacttcgttcttcttcaagggatatgaagagttccctgactttattgtggctttatgaattaggatttaattttgtatccaaaacttctcattcaaggcaaaagggaccacaaggtattaatttccaaatctgacatatgattctgggcgaatgctctgtacttacaacattatagattttaatctcgtccccctgttagactttgccacttcagtctgaagggaccaaactttgcagtttttataaggtctcctcccctgtctataattcaatttcttaagtcctattggacatttggttcatgaggcctgctgtgaaataacatagaagagcttccaatgcaaaggcttaattgagttcacccagaaagtcaaaacaaaactggatggagaagatggcaaagcagagagcactaggaatctgtttccccacctggacaacaatcatgctggcagaatttgtcctgtgtgactattttgaaattccaggctattgaaggcttgcaacttccagggaaaggcttggttggtaaattgcagttaatttccatcaatttcagctcttagcacagtagccgctacccatcccctactcccaatcccatggcagggagatgtgcacatgttcctggagcagcttgcatgcagccagcaggaatcaggttgggcaaaaaagcaccctgtcctccaaatataggggttccgtgctctgaccagagaggtgcagacaaagaggcaggggccactgttgctacacctctgcccattgtataagctccaccccacccccaaccctgccctgcagctgaaatgatttccagaggatttagaggcagcactattttcccccgtttcatttttctctttccatcttttggaagtcagacatcaaagactaagatatttaaaagcaatcacacatacaggagaaataagaaaaaaaaatcatgcatatccatgaaaaggtgcaggctcagaaaagacctgagaagaccttacatttacacctcaaactgatcgttggcccaaagacagcctatgacaattaaaaaacaaacaaaaacaacaacaaatgctggagaatggggagaattcaatttccagaggtactccattattagcttcaaatgtttagttttctaacaaaacgtcacaagacatacaaagaaacaggaaagtatggtccattcaaaggaaaaaataataaatcaacaaaaactgtctttcaaaaagacctactggtggaattaatagacaaatactttaaaacaaccgtcttaaacatgctcaaagaaggaagacatagagaaagtcaagaaaacaatgttataaagaagatgggtgatttgagcaggcagaaggaaaaaaagatcagtgaacttgaagctagcttaaaggaaattatcacttcttcagagcagaaggaaaaaaagactgaagaaaagcaaacagaacataaagtatgtgtgagacatcatcaagtggaccaacatatacattatggaaacctgagaaagagaaaagggtaggggaatatctgaagatatagtggctggaaactcccccaatctgatgaaagatattaatatcaacatccaagaagctcaatgaacttcatctaagatgaactcaaagagacccacatcaagacatactatagtcaaactttcaaaagacaaagagaaaatcttgaaagtggtgagagagaagcatatttccacacaaattccccaacatgagtatgagcagatttctcaccaaaaactttagaggccagaaggcagtgggctgatatagccaatgtgctataagaaaaaaagcctgtcaaccaagaatccaatatccagcaaaactgtccttcaaaagtgagggagaaattaagacattcctaaacaaaagctgaggcagtttgttatcactagacttgccctgcaacagatactaaagggagtccttcagggtgaaatttaaggacactagacagtaacttgaagcgatatgaagaaataaagatcacaaaaaaatggtgcaattatgtgggcaattataaaatctagtattattgtaacattggtttgtaactctacattttgttttctacacaatttaagaggttaataattttttaaaagaaattatcaatttatagttttgcccatataatgtataaagaggtaattttgtgacatcaacatgtaaaagtggggatgaagttataaagcagcattttttatatgctattggagttaagctggtataaatccaaattagaatgtataactttagtatgttaaatataatccccatggtaactacaaagaaaatagacataaaatatatacaaaagagaaatgagaaaataatttaaatatttcactacaaaaagatcactacacacaaaagaagacagcaattcaggaaatgatggacaaaaagctttaagacacatgggaaacaaataggtgaatgacagaagtaattacctacttatcagtcaatctaaaaaaggaaggaaattctgacatgtgctacaatatgggagaaacttgaggattttatgataagtgaaataagccactcataaaaagacaaatattgcatgattccatttatatgagatacttacagagtagtcaaatgcatagagacagaaagtgtctatggttgacaggaactggggggaagggagaatggggttattgcttaatgagtacagtttcaattttccaagaagaaaaacgttatgaagatggacagtagtgatgcttattaaacaatatttacttgcttatttccactgaactatatacttcgaaatggttacaatggtaaaatttatattatgtttattttacacaataaacaaatggaaaacaaaaacagttgtagtgcctccagtaagatctgctttccttttgcttttctgtggcttcaaaaacctacaatttcagactacaagtgtggtgattaaacaccagcctggagaaaaaggggaggggaataataaaagtgtttatctgtgtggaattagggctgcatttagtcctttctttctttctttctctctgtctttttccttcctgtcttccttctcccctcccctcccctcccttctcctctcctctcctctcctttccttccttttcgggacaggatctcattctgtcacccaggctggagtgcagcagcacaaacatggctcactgcagtttcaactttctggactcaagtgatcctgtcacctcaacctcctgagtagctgggactacctgtgtatgccaccatgactggctaattttttaattgttttctagaaatgaggtcttaccatgttgtccaggtcagtcttgaattccccagctcaagcaatcctcctgccttggcctcacagagtgttgggattgcagggaaaagccaccatgcctggcctggtccctctttcaataaatatttgatcagcacctattaggtgcaaggagtcggataagaactggggagaatcaagtgtcaggtctctgccctgaagaaactaaccatcgtatagcaggttaaaacatgaacaaaactactgtattagtctttctagatcagacagtcaaaaccagccttcggttgattaattgagaaagcgaaccagtgaggagatataaaagatcatgttttgggttcagagaagaaaaatatcatattggacccatgaacgaaaatgtttccagagagaagacacagtctgatataggtctcagaggaaacacagtgccctagtcatagcggcaggacctctcagggccacctcaatgactctttgtgaccagttcccctctgccattaacagatgagcaaatataccttgtttttttgagacagggtctcgctctgtcaaccaggctagagtacagtggtgcaatcttggctcactgcaacctctgcctcccacgttcaagcgattctcctgcctcagcctcctgagtagctgggattacaggcacccaccaccactccagactaatttttgtatttttagtagagatggggttttgccgtgttggccaggctggtctcgaactcctgacctcagatgatccgcccaccttggcctcccaaagtgttgggattacaggcttaagccactgcacctggccccaaatctaccccttttacaggaaacctggcatcagattcagtgccctgacaacctacttgccaagcccacaaacattcacttactccactaatcaacaaatactcatgagatgtctaccatgtgtaggacatttaggctgggaacctggggaaccaaacataaatcggagtagatcacacttcgaagaagttaatagtctcatgagataagatctataaataaacagaagtcaaaaacttattaattaaatggtatgaaaacaaagaatggaagcattacttctagccacattggagacccaggagagctgatggtgtcattccagtccaaaagtctcaggagggctgaggcccaagaaaagccaagatttcagcttgagtccaaagtcaagaaaagactgaggtcccagctgaagcagtcaggcaggaggagctctctctaagtcaggggacggtcagccctttgttcagttcagaacttcaactggtaagatgaggcccacccactagtgggaagataatctgctttacacagtctacctatttaactgttaatctcatcctaaagcaccctcacagcaacatctagaataatgtttgaccaaatatctgggaacccggtggcccagtcaagttgacacataagattaaccacctcaagcaggaataaagacaatcaggctgaaagttaaaatgcataggctggaacatctcaccttttagttcagctgaaacaaagtctctatctttagagaattttggaacttacctagtttactgtagttttctgtctaccggttgaacctgtgccttactctacagcctaccctgaagggtgacggccacagagaaagtgctcagtaaacactttgtgggaaattaatgctcctcttccagcctgtgttgaccagctttgtccctgtcttggcctgggtgacaatgctcaagcccaaccctggccctgctcagctccatccctgcaccagcgtattcagattccctgtgacactggtggcttctcactgtcaagtttgctccttttgtctgatagctgcatctggccccctgccctatcttcaaagccctcaggccatgggaggttaggtttcaacaaatagagacatctgggtgtcaggggaagctaaacagcagagagaacaaatgtgctggggaggaagggtaaaagttctcaaggatctgagagtggatgtctctctggggcacagggcataggcactcatgggcatgggggagagggggtgtcaggaggagaggaaggataaagcccaggacagatgaggccaattcatttattccataaatacttcttgagcacctatgaaatgccaagctctgtcctaggctaatagagaagcaagctcagtgaaaatcttcaggggtgcaaagctcacagtggccaaggacctcatttcaaaatgtgaaactgcaacagccaaaaagagctaatgcatgctggacttaatacctagatcatgggttgataggtacagcaaaccaccatggcacacgttcacctaggtaacaaacctgcacatcctgcacatgtaccccggaacttaaaaaattaaaaattaaaaaaaaaaagcaggccaggtgcggtggctcactcctgtaatctcagcactttgggaggccgaggcgagcagatcacttgaggtcgggagttcgagaccagcctgaccaacatggagaaaccccgtctctactaaaaatacaaaattagccaggtgtggtggcgcatgcctgtaatcccagctacttgggaggctgaggcaggagaatcgcttgaacccgagaggcggaggttacagtcagccgagatcacgccactgcactctggcctggggaacaagagtgaaactccgtctagaaaaaaaaaagcaaaaaaaaaaaaaaaaaaaaaaaaaaaaaaaaaaaagcaaagacatgccctcctgctgtctgtccagttgacacccacttctccagaatgaaaacagtagtgggcagccactcctcagagactatctcctatcctttggaaaattcttttgcaaatctaaaaccaattccaggttgggtgaagggaactttgagaaggttactggattgggccaggatactagaccagcaaggaacagaaacaagttgaaaacacatcgttctaagtgtctccagtatcctttctctctcttttatttatttgttttgttttttattttttattttttttgagacagagtcttgctctgtcaccctggctggagtgcagtggtacctctttctctgcctcttgctacagcaaaaccaagaatcaaaaccaagggagaagtatttctttgatacacaaatttctttcctttggataaatacctagtagtagtggcattggtgggtggtatggtagttctgaccgttacaccttctatgcatgtaacaaaacatcaccaggactccatacgtatttgcaaatattatgtatccataaaaaataaaattggaattcacagttctgaaatcaaacaggaggacactagctggggcaaagaaggaatatttattttattttattttatttattttgagacggagtctcgctctgtcgcccaggctggagtgcagtggcacaatcttggctcacttgaatctctgcctcctgggttcaagcgattctcctgcctcagcctcctgagtagctgggattacaggcgtacaccatcacgcccagctaatttttgtatttttagtagagacagggtttctccatgttagccaggctggtctcgaacttctgacctcaagtgatctgcccgcctcggcctcccaaagtgctaagattacaggcatgagccactgtgcccagctcttttctctcttttttattctcttccttttcccaacccctgtctctcttcaaaggagtcttgttttccctggacaaaatctataggaatgtgtgtatatgtgtttgcaaaccaggatctcacacagataggtgtgtgtccaaggggacaaatgacactggtgaaataagaccacacccattgtgcttgcatttgatcatcgtgctcccagggacaagagaggcagtcagcaaaccaaagccatcactttgcagactattttccagcaagatgctttccttcctttctatgccaggtacctgataattgtcacttacagactgttggaaacatcgaggctcctcctgccccctgaaattctcctcacctgtcaaacgctgagagaggagcacaaggcttctagacagtttccaaaatgaagttgtgctaggcccacaggtctatgtctggaaggtacagttgccatagcaatcccggctaatgactaggtatgtaaatgagggaagaatctattcatcatttgccagttgttccaagtgcttgcccttttggaagcttaggggagcgaggagtggtgtgttagaaaagcatatgtttggtaaaatttttgaataaatgtttgctttcagagctccccatgagaaatgattattttgggtggtatcctcatagagtggtttactctgcagctaccccgagaagggaatgaggattaaccaaaaacacatacgacgatcccacctgtactctgggtccctctgggaaaactgcagccatcacttttatcacaagcagtgggtttttggtcctcttgggtagttgggagtcttaagtaaggcctcagagactcgcaagctgtccctggcagcagatgagcagtatctgacttctcctcccctgattcctaattaaaatgcccatgaaaatccataaacagacaaaaactggcaacagtaactgatactggagacaaccaaacactgaagcccagattcccagattgtcgagcaactctactgcccaggagaggaaccgagaagggcccctccgccttctgagtaagaacactgtcagggagggtcgggcgcagtggcttgtgcctgtaatctctgcactttgggaggtcaccaaggcgggcagaccacctgaggtcaggagatgaagaccagcctggccaacatggtgaaaccccacctctactaaaaatacaaaaattagttgggcgtggtggcaggcacctgtaatcccagctacttgggaggctgaggcaggagaatcgcctgaacctgggagatggaggttgccgtgatcacgccattgaactacagcctgggtgatagagtgagattccgtctcaaaaaacaaaacaaacaaacaaacaaaaaacagccagggagacaaagatgagaaaggaagctgcccgtctgtactggaagtcagtcctgttgagcacttgctttactcggctgctgcagtttcgcattttgaaatgaggtccttacgaaatgccaggctctattctaggctaatagagaaccaagctcagtgaattcttcaaggatgcaaagctcacaatggctgaggaccttcaaggatgcaaagccgagtaaagcaaagacatcattgttcagatcatactgggagacctcgggcaatcgacttaatttctctgtgcttccgtgttctcatctggaaatgagaacaataaaagaacctacttcctagggttactgtgtggataacatcgagttaagatatgtaagaggagtctattcccactagaatataaactccatataaaaccaaggtgttaatttgaccaggtcttcctgacctgcttgcttttggccacttgctttttattatttttgttacttttccttttgccacgtagctcacggccacacagctattaagttggtacgagagtaattggtgtttgccattttgaaagtaatggcaaaaaccgcaattactctcgcaccaacctaataaatgctgaaacttaatgaaggttaagtgaagactggctactgtacaggtcattcctacatttctgggtcaccatggtcgtagtcgcttctgttgttttttaggaacttgggccagctcctgaccagttcagactcactgaaaccactggcccttcaactaggcctgtgcaaatgcccaagaggttgcctttttccttttttttttttttttttttttttttggagacaaggcctcactccgtcgcccaggctggagtgctgtggcgtgatctcggctcactgcagcctccacctcctgggttcaaatgattctcctgcctcagcctcccgagtagctgggattacaggcatctgccacgatgcccagctaatttttgtatttttagtagagatggggttttgccatgttggccaggctggtctcgaactcctaacctcaggtgttctgctcgcctcggcctcccgaagtgctgggattacaggcgtaagccaccgcacctggcccaagaggttgccttttgacatcagtgggtgaaaaaccccaccttcagatcatactaatgccacgtttactgtaaacatgtcctatgaaatgccatgaacccaactacacctgtgcagaacgaacctgttacttcatttttttccccaccactaatcacttttccctatgccttaaaaccaccccacttgcctaactcacaaataatcctttagccttatctttggggaagtggatttggcagctgttctcctgcctcctcactccgtgcccttgcaaataaatcttttctcttttgcaaaacccgtgtcacagggattgatttactgcgtgcaggcagaacagacccggacctggcaggtaacacacagagggagggattttgtttgtttcatttgtggatctatgccaagtgcctgggatggcacatagagggtgttcaactaatgtctgtggaatgaacaagctggttgttaattgtgaatgtggggtgtagagggtagaagcaggataagacagtccctagtgtactgtgccctggggtatttgacagaaaaggaaagctgtcagcacaagaatgaggaagtgcctgctgaacaaggtgtgctaggaggggtgggtttccacacagactccaggcaggaaggcaccacgcaccctgtatgctctgataggtcagagaactgggcagaggtacctggaatgggaaagacgcctgctaagatcagcaaaccactcttttactagcccaggggaagctgatggctgttctcaacaggtttgagatcgtgttagtgtgcgtattacagagaaaggatactggagacacttaggtgcattttcagcttgtccctgtttgttgctggtctagtatccgggcccaatccagtgaccttcttaaagctcccttcgcctaatctggaattggtttcagatttgcaaatgagaactttccgagggatagctgaggacaatgcacccacgctcacttttcgcaattgatcatgtcaggcctggacatttgttcctcatttaaggactgatgtacagcagtgagagcattctatctgcagggtgtgtgaaggattttgctatggaaaaaaccatcttcagaaacagcatactcttgacacaaactgtaccacagaaaccaaaagaaacatagtagaaagggtctaggttatgttagcagaaacttctagaaaacatgaactgtgaaagacaagccaaaagaaactaggggaaattcaattacggttagaattgcaggaagtcacaagaccctatctccctcaccccaacaatgagaacagttggcataagatgcaaaatcatagggtgtgtgtgtgtgtgtgtttgtttttggtgtgtgtgttttttttctttgagacagaatcttgctctgttgcccaaatgcaatcatagctcactacagcctccaactcctgggatcaagcaatcctccctcctcaacctcctgagtagctgggactacaggtgtgcaccaccatgccgagctagtttttatctttttgtagagacgaggtctcaccaggttgcccaggctggtttcaaattcctaggctcacgtgatcctcctgtctcagcctcctaaagtgctgggattacaggtatgagccctgctaagaaacctactgagaacagccattagctcctccctggactagccagaactcatccagatggcttcttaattggagcgggcatctctcctaccccagatacctctgctgagcctgatttatctttctaatccatcaaagagctaagaaataaagaaatctaaaaaagataaattctgcaaagtgatgagtccttcctagcagagaagaggctcccagaggttttcattcatggtagacatgggcttcaagaggaggctgcctaacctggaacaaacctttttttttcttttgagacagagtcttgctctgttgcccaggctggagtgcagtggtgcagtctcggctcactgcaacctctgcctcctgggttcaagcgattctccagcctcagcctcccgagtagctgggattacaggcatgtgccaccgggccggctaatttttgtatttttagtagagacagggtttcaccacgttggtcaggcttatctcgaactcctgacctcaggtgatctgcccacctcaccctcccaaagtgttgggattacaggtgtgagccacctcgctccgccggaacaaacttttaacagctgctgtgacagagtcacattccaaaatgccgcagcggaacagcatgctgtacccaccactactttagtccttagaccttaactgggtgcaggcagttagtacggtgaaggttggatagggcaggagagctgagggaaatccctctgagaccctccctccatggctgaggtccctcctgcacctgctctttgaggactagaaacagaatggaaggagacctcctgaaaacccagaaaaccatggtggaactggacagaaaaagacagtgagcaaaatgtcagcatggttcagaaagcttggcagctccactataaagcataaagacatctgcagagttttctcattgctcgcatcacaagctctgcaaaacagaaagtcctgatgttaccctcgaaatctttgaagttgctgtgaaccaacttcaactaaagctgtaacagaactcctatccaactcaactacggattacattgcgtgaaagcctgactccagtgcctggcaggagggttctgccattctttggtgcgtagattttatttattttagacttgcagggttttcttacatgcagtatctggcattcaatcaggaattatgagaagatgcaagaaagcaggccaggtgtggtggctcatgcctgtaatcccagcactttgggaggctgaggagggcagtcacctgaggtcaggagttcgagaccagcctggccaacttggcgaaaccctgtctctattaaaaatacaaaaattagccaggtgtggtggcgggcgcctgtaatcccagctactcgggagactgaggtgggagaatcgcttgagcctgggaggcggaggatgcagtgagccgagatcgcaccactgcactccagcctgagaaacagacagagactctgtctcaaaaaaagatgcaagaaagtgtgactgatatgcaagagaaaatttcacagaagcagacttaaaagatggtccagatgttgtaaggatcagaatttaaaataagtatgataaatgtgccaaagatctcatggtgaaatacaaaatgtgaacaaattgggggtttgagcagagatatggaaattatttaaaaagaaatagtgagacccccatctctacaaaaattgtgtttaaaaatcagccaggtgaggtggcatgtgcctgtaatcctagtgctttgtaaggccgagacaggaggatcacttgagcccaggagcttgaggctgcatcgagctatgatcatgccactgcacttcagcctgggtggctgagcaagacctcatctataaaaaaaataaaaataaaaataaatgaaaatgcaaggaataaaaaatacatataggccaggcacagtggctcacacctgtaatcccagcactttgggaggccgaggcaggcagttcacgaggttaagagatcgagaccatcctggccaacatggtgaaaccccctctctactaaaaatacaaaaattagctgggcatggtggcatatgcctgtagtcccagctacttgggaggctgaggcaggagaatcgcttgaaccatatctaagtacagcacagactgccaaaaacttgcaaaaaaaaccttaaagacagtcaatgggaaagacatactacataacaatcgctgggtgtggtggctcacgcctgtaatcccagtactttgagagaccaaggtgggtggatcacttaaggtctggagctcaagaccagcctggctaacatagtgaaaccctgtctctactaaaaatacaaaaattagctgggcatggtggtgtgcacctgtagtcccagctactcaggaggctgaggcaggagaatcgcttgaacctgggaggcagaggttgcagtgagccaagatcacgccattgcactccagcctgggtaacagagtaagactccatctcaaaaagcaaaacaaaacaaaacaaaacagattacacttagaataactaaaactttgtacaggggaaaccaaacctcaacttctaccacactccacatatgaaaactaatttctaatggctcacagacctaaaagtaaaagctaaaaccataaatcttccagcagaaaatgtagtaaaattttttttttttttttctggcatgcagtgggctgatcttggctcacactgcaacctgcgcctcccgggttcaagcaattctcctgcctcggcctcccaagtagctgggattacaggcacccaccaccatgcccagctcatttttttgtatttttagtagagatggggtttcaccatgttggccaggctggtctcaaacttctgacctcatgtgatccacccgcctcggcctcccaatgtgctgggattacgatacttttgtaacattgatgcaggcagagatttttttcaacaggaaccaaagagtactgaacatgaaagaaaaaagtgataaactggatttaatcaaagtttcaaatgtctgctcatcaaaagatactacagtagttccccctcacctgtggattcactttctgcggcttcagttaccccttggttaactggtcaactgcggttggaaaatattaaatggaaaattccagatataaacaattcataagtcttcaactgcacactgttctgagtagcgtgataaaatctcatgccatcccactccaacttgccagagacgtgaatcactcctttgtccagcatatccaagctgtctatactacctgcccgttagtcactgctgccatctacttttgacattgtcatggctccatgatgaccaggatcaccgaagcacatgatcctctttctgacttacggtcagaaggtcaatagcagccaaacgctatgtcattatgcccacgccattcacctccatctcatcacaaaggcactttatcatctgacattatcacaagaagaacatggcagctcaagcctgtgatcccagcattttgggaggctgaggtgcaaggattgcttgagaccaggagtttcagaccagcctgggcaacactgcaagaccccatctctacaaattttttaaaaatattttaaaaaggggagtacagtataataagatatgttgacagaaagggaaatcacattcacatcctttttttacagtatattgttaagattgttctattttatcattagttattgtaatctcttactgcacctgatctataaatttaactttattataactatttatgtataggaaaaagcatagtatatacagggtttggtattatgcacagtttaaggcatctaatgaagctcatagggcatatgccccttggataaggaggggttattatattaagacatgaaatgtaagccacagagtgggaaaaattatttgtcaagggactacttggggtaatagaaatgttttatactttgtattggaataagtgttttactgctgtttataattgtcaaaattcatcaaactgaactcaagagctttacattttacggtatttgaattatgtctcacttaaaaagtaaaaaatcaggtggtacaggctgagatgaaaaagaggctgaagaaaacaaagaaaaaatacaacaaactagaataactcctagcagaattaaaatccacaatgcaaatcttccctccaaaaattgacctaacaccactattaatcaagacagtgatataattctctgggtaaaaatagatgtataaggaaaatcatctgaaagtcaggttacgaaaaaagagataaaaaaatatataaagttagagatctcaaagatgatatatttacagaattaaagaacattaaaatataaaagaatggcaagtatacatttatgttaatacatatgaaatccaaaagaaatcagtgatttctgaaatgaatagatcattggatccactaaagaaaatgatcacttgtgtacattaatgaacgtgacataaactaaatattgttaaagaactgtcctaaactgttttaagtttcatgtgatttcacagaaatatgtgttcaaatactcgaaaatggttattatgtaatctcttccagtgcaaaaaagatggaaaagtcccaaataccctatacatttcgcctaaccctggtattaaaaacctgaaaatggaaagaaaatgaaatggatcaattattgtagttgttattattattattattgttattattagagaggagtcttgctctgttgcccaggctggagtgcaatggcatgatcttggctcacagcaacctctgcctctggagttcaagcgattctcccacctctgcctcccaagtagctgggactaccggcccgtgccaccatgcctggctacattgtatttttttggtagagatgaggtttcagcatgttggtcaggcttgtctcaaactcctgacctcaagtgatccacctgcctcagcctcccaaagtgctgggatttttacacaggcgtgagccactgcacctggcccaattatttttatggatatatttgcaaaacctaaattaaaaaataaaaaaatagtcaaacttaacaggatatagagagagaagctcagctaaagagaagtaatccatgaactgtagcagtttttcaattatcgtaaattcaattaaataagggtcaaataataaaagtcaaataatgaaaagacctgacttcatcatgaagtcaaataataaaaattacatgattatctcaatagacgtcaaaaagttactcaaagttgttactgacttaaaaagaaaaaaagggtaaactacaagtaagatattaccctaaccataataaataatgtccatctcagacaacaatcgatgtaattttcaagtttaaactcagaactctggggaacagtactattaaagtcagaaacaaaagagcgtctgaaataacaattactattgttttgatctaaatgtttcacccactgaaataggccagaaatgaaaaataagaagtacctctcatagcacagacccagaacctcagggagcattttgttactacaagaaatgcctttgggaggccaaggcgggtggatcacgaggtcaggggtttgagaccagcctggccaacatggtgaaaccctgtctctactaaacgtacaaaaattagccgggcacgctggtgtgctcctataatcccagctacttgggaggctgaggcagccaccaccaatcaatcgtctgactcagcaactgcccagctctaaaacagatccaccaaagagtgttagaaaagtatctagtttatgtcctcgacaactaactaaaagatgtcacatcagccagattagaaaagcgacaagagataattccacagagaggagaaagcattgttacaaaaatgaaatccagtgatcagtagactactcactggaaaacctccaagtagtgaagcaggaaatatatgtatgagaatataaaaggctgaggaaaaacatagagaaagaacagctatgaggggtattggaaggccatagcccaggatctaagctgtggataaggctagtaagagagattgaaatatgtggagcaaaagcaaaaaacaaaaaagggttgaacaaatgttttccagaaagaaaactcggtctaaaaattgagagtgtacgctgggcgtgatggtgcacgcctgtaatcccagcactttgggaagcagagacaggaggatcacttgaaaccaggagtttggaaacagcctggaaaacacagtaagaccccgcctctaccaaaaagaaattgaaaaaatttgccaggtgtggttgcacgcgtctgtagtcccagctactctagaggctgaggcaggaagatcgcttgagcccaggagtttgaggttacagtgagctttgattgcaccactgcgctccagcctgggacacagagtcagaccctgtctctaaaaactgagagtgtgaatcatattccaaggaaccacaacaacaacataacaccaggcaccaccactactagaacacacagatgaatatgaactggtgacattttcaaacttcctggataatgattacatcctaagccaaattagattattcacaaggaaggaaaagcaggttatcacaaacttaacaatattaaaccctaacaataatgaaggagcactcgtagaccttcaaaagaaaagggttatgggccgggcgcagtggctcacacctgtaatcccagcacttagagaggcccaggcaggtggatcacctgaggtcaggagttggagaccagcctggccaacatgttgaaaccccatctgtactaagaatacaaaaattagccaggcatggtgacgcgtgcctgtaatccgacctactcgggaggctgaggcacaagaatcacttgaacccaggaggtggagtttgcagtgaaccaagatcataccactgcactccagcctgggagacagagtgagactccatctcaagaaaaaaaaaaaaaaaaagaaagaagaaagaagaaggaaggaagggaaggaaggaagagaaggaagagaagtaagagaaggaagggaaggaaggaaggaggttacggcccaagaattttttatctaacccatttgtttatgtgtgttaagatattctcagatctgtatgaatatgtgtgaaagatattctcagatttaatactaagaggattaatgcttgaagtagacttcctgaaaaataaaatgaaatttgggaaactttatgtcagaacaaatatatattaattaaaaataagaaacagaaaacgagttaagtatagctgagagtaagcactaaagacagatatagagacaagataagtgtttctaatattattataaaactgatattttttaaattgaaaataataaaagttgtaaaaaatgggaggaacatatttataaccaccttacattaaaattaacaaagaacagaaaagagaaagagataacatttaatttcttatcttccataaaaaaggtattaatcatttgtaactgatattagctgttagagataatctcacaaaaaattttacggccatcactaaagagggtaaaagtaagatatctaccttccacacagttgggtggataatataaaaaagaaaaacacaaccgtagtcacaaaataataacttcatactaggtacacaggagaacccccacaaaacaaaatgacggaattaagactcagccttaatgtgaaataaatataaaaggctaagtgtaccaataaaagggctctcagaataattaaaaatgacaacataatcacacatattgggtaaaagtttcacccctaacaaaatcacagaaaaaggtagggcatcgtgtaccgtattcctggaaggaaaagaaactgaataattgtgaacggtcccagtgaccactgcgcataaagataaatgttatgcaaacacaagcaaaaaggttatgtggcaaaaatcaacaggactcaaaagcatttaaagaacatttgcactgataaaaggtgaaatccactatgaggacagagcattgaaaattaaaatacaaactgttggaagtaaatccaggaagtaacataacatcaatacatcacaataatttatcttggacaaaacaaccaaaaatagggctacaaggcacatgggtaatgtgaagataacttctatgcacatacaaaaagccttgtagcatagagccagtaccttcatgaaagttcatcttattcttggttacagagaaaaatcttagcaaatatcaggttatacttactttgcataatgcaatgaaaatagaaaattggctcacgcctgtaatcccagcactttgggaggccaaggtgggcagatcgctggaggtcaggagttcgagactagcccggccaacatggtgaaaccccatgtctactaaaaaaaagtacaaaaattagccagacctggtggcgcatgcctgtagtcccagccacttgggaggctgaggcaggagaattgcttgaacctgggaggcagagattgcagtgagctgagatcgcgccactgcactccagcctgggtgacagagctccatccgaaaaagaaaggagaaaagtaaaatgtaaactagaaacttaaaaatcccagtgactcggaaattaaattgtaagatggttttctataaaatttatgaagtagcagagggaattttaaaaatacaataaaatattataatgaaaacatcaaaaccgtctattaaaatttgagagatattactgagacttttctcagtgtccaatttcccatcctagttgccttaattattaaataataaagaatttaaataagtaatctattgaagtagctagaaatggtaacaaatacacaacaaaaacccacaaaaacatcaattcccttatctgcactttcgtgtttacaacagcattattcacaatagctaagatatgaaatctatccaagtgtccatcaatggatgaatggattttttaaaatgtggcacatttacacagtggaatattagccataaaaggaaggaaatccttttacttgcaaccacatgggttgaactggaagacactatgttaagtgaaacaagccaagtgcagaaagacaaatatctcatgttctcactgatctatggtagcttaaaaaaaatattgaactcgtggagaaagagagtagaacgatgattataggggcaaggatgggtagtgggtgtggggtaagaagagatggctaatgggtataaaaatacagttattgagaaggaatgagacctagtgttcaggagcacaatagggtgattattattaacagtaatttactggcagggcgcggtggctcatgcctgtaatcccagcattttgggaggcagagggtgggcggatcacctgaggtttggaatttgaggccagactggccaacatggtgagactccctttctactaaaaatacaaaaaaaattagccaggcctggtggtgcacacctgtaatcctagctacttgggaggctgaggcaggagaatcgctggaactggtaggcaaaggtagcagtgagtcaagatctcaccattgcactccagtctgggtgacagagtgagactccgtctcaaacagacaaacaaacaaacaccccagtaatttattgtatatttcaaaataactaaaagagtgcaactgctatgttcctaacacaaagaaattgtgagcactttaggcgatggatacctcaatcaccctgatttgatcatcacacatcatatgcttgtatcaaaatatcacatgtaccccataaatatgtataacttatatccataaaaaataaaaattaaaaactagaaaaattaattccctataattaagggaaatgaggaatgaaaatagaatggtaaaatattcccttattgctggtctgtataggtagggttgcaaactctaaagcctatagagaccaagccagtccatcagtaggcaggcatagaacactaatgaacagtggagactgtggcagatgccgtacccagaggggatggccactcaactccaccaaattattgcaatgaaggaatgcaggtctagtcttgccaaattctccaatattttaacaggagaaatgtatatttttaatgtgagattttctgctttataaaatggtgtacggccaaatataacatggctatgagctgtatttggctggtaggctgcaagtatgcaacttctgatttagactattgacttcagcttgaaccaatttcaataatttacatttttccagaaaaatttccatttcatgtagatattcaagtgcattaatatgaaactgtatcaagtattctttttaaaaatctcccatatttacttttcatatctagtttattttagtggtaatgctttccttcttaattaaatatgctatctttgtgaatttgttgcttttcttttccacagaatcagtgcttggatctgttcatgagattgaaaggtttttggtttttaatttttaaatttccaagtgggtgggattcttattcaaacttttgttattaatttctcgtttattgtattgtagtcaaagaatgtgcctatattacttgttctttacgatttaattaggttgtctttgtagcctaatacatagtcatgttttatttaatgttccagaatcacttaaaaagtaagctgttctctttttaagggtacaaaatttataacacacacacacacccacacacacatatatacacacattccgtgtcattcaaattctgttactttgctttatccacttgatcaaatggaaaggaatgtgtagagtctcccataataattgtgtttcgcccttcttcatggtacttctaagaacttgccctgcaataaaacttttgcaatgaatattgtattctagtaaaaaaaaaaaaaaaaaaaaaaaaaggagaagcctaaaattctaaagttatcattagtgttgttcaccaagtatttctactttgttcccttctgggcatatagttgggttgtactcctcaacaccctttgataataatcatggccatgtgacttgctttagccagtgaaatgtgaatagaagtgacaaaacccttaagaatcactgtgtgattccccgggtctctttcccctgccttagctaacatggaaggagagacgggctggagtctctttctgccacaactcttgagtgaggatgtcacagagaaaagacccaaccaactcgcgatgacacacagtctgagtgacagctttaattttgtggttttaagccactgctatttgggggtatatttattgctgcagcataacttagcctatccttactgaaacagctctgaaaacaaagtacgcagcctgcaaaggggaaaaaaatgggtaaccaatcaatatatttaaaaaattcttcctctcacatactagttaaagcaaaatgaattgccacttttcaccatcatgttacttatgatttttaaaaattataatacttaatattggtcaaaatgttctaagacaggcattctcatacattccttttggtaaaccctgcctaagaaaatgttacttagcatgaagaattttagcaatttcctatatttcacatagaatctcacttctaggaatccagcacggtttctgcattgaagatggcaccgtacactcgtaccagggagaaaacaaacttcccaagtgggattctgagattggtttgcttgcctctaaccttaaatgaagtgctgacctccttgcccactgaaaaggggatactagtatctactgcatgcattagcattatgattaattaactgtcatctgtggtttcttgggatacaataattatttaaagtaaggctttggaagacctaagtggctccaaggtttgacctttatggtaacgatgatgactaccaggactgccagctgggatggctgcttctgaacacccttgtaagaacaaacaagctcagacctttaaactctcagctcaagtcacagagaactagattgcttctgcggtggttctaaaataatcacttatttcttataaccctgcagggaagatgccaaatttaactgtgtgctctgtagaattatcagttgaaatcacagactcatcaaatctcttatgtgaaatttcaggtcctgatggaaaaggagtgggacctgagattcagaacaggaatttttaggtggatttagaaaactgattcccaaagtctcccttacgtcctctcttacagctcagacaagatcaacttgaagaccatgaaggcctgtaataaacacaactaaggcagttgccttgataggggatgcctatttcttcaaggtctacccctaccaggtttgtctctaagcccatggctagaatcagattggcatatcccaagaggaaacattctaggtctgatgtgaatgaacagagaattgcaatcagcttacatctggggaataggtgtaacaatggactctaggtgttaaatcaaagaagatacactgtaatattggatgaggctgctcttattgaaataggtgcacataccagaattttttttttaactcttgttgcccaggtgggagtgcaatggcacaatctcagctcactgcaacctctgcctcctgggttcaagtgattctcctgccgccacctcccgagtagctgggaatacaggcgcacaccacaacacccagctaattctgtatttttagtagagatgaggtttttccctgttggtcaggctggtctcgaactcctgacctcaggtgatctgcctgcctcagcctcccaaagtgctgggattacaggcgtgagccaccatgcctggcccagaatttttttttaatatattggcttgaatagctagaagggactcaaatagtctagttagtcattggctgaaacttgaattcaacacggtcagtgttaataagatggagatggcataccttcctgggcatactgtagaagacagacttgcttagggagataggaatgttggagaggaactgccatgatcatccactaccattccatgtcccaagcaagtctgaagaattctcccttcaccaaaacaatgagaaacctaaagactgtcttcaattcacatcctctgctctcatacaaggatattttggggagtggctagggtctttcgcccaaccaaaggtaacctcatgagaaccccatgtttctagagactattttggaaagcaattggaagccaaaacattcacatataggtttgaaataccaaggtatttatgactcaggggcgtgtgtgtgtgtttttcagagtttcaatgtcctgttgtcaccctcagtgacctatatccactaaaattgcaaaaagaatactatatctaaaagctatctggttaagatcttagagtcatatggctcttactagtggcatgacctgtgcaagtttctagaaacctcggtacttcatttttctcatccacaaaatgagaatcataatagttagcacctatggcttttgtgaggactaagtaagttaataaataaagtgcttagaacagtctttggcccatgatgaaaactctgcatgcattagctagtattattgttatccagggttattattggggtcctggtgagcattacacaagtgttatttatcattaattacccagttaaaacttgccacagtaaagatcaaaagcacacaagccataattcactaacacagagtgaaatacaaaagagtttaatgctaattatgcttattcacaaatgcaggcatttgcagagacatttttctttagttgttcttcaccaacactagtggctttgtgaattatatcgtttgtaaacttacaaatctccaggcactgagctccctgcaggagactagggaggggcttcactccctagagagactctcaaagaaggaaacataattgggtttgctttccatttgtcaaagtgtgcctcagactagggtatctccaacttcaatgtgtatatgaaacatctgggaatcttggtaaaaggaaaattctgggccaagcctggtagctcacgccagtaacccaagcactttgggaggccaaggtgggagactgcttgaggccaggagttctacaccagcctgggcaacatagcaaaacttcattgctacaaataataaaaaataaaaattagccaggcatggtgacgacgcatgcctgtagtcccagcaactcgggaagctgaggcaggcggatggcttgagcccagggggcaaggctgcagtgagctatgatgacaccactgcattccagcctgggcaacagagcgagaccttgtctctaaaagatagatagatagatagatagatagatagatagatagatagatagataaagatagatagatagatagaaggaaaattctgattcagcaagtcaggggtagggcctgagttggagcatcttaaacatgcttccaagtgatgctgactctgcctgtccctggaccacacatggaggagagaggacaccaggtctctgcacatgcaagcactttgagggccacctgcattcagacaggggtgactgaacccctaaggacagactttacttccttcatcaggttttcaagggaaaaactcctcatcatctcacatgtatcttccactcagaccttcttgctcctgcaaatatccacaagctcaatgacttctctgtagccaaagagttttcttttaaccaagggtccccccgcccccacccaattgtgtcaatggacagattgctgcacaataacctgatgtgattgttaaaggatcaggctcatggccgggcatgatggctcacacctgtaatcccagccctttgggagaccgaggagggcccctgagctgccaagaacgcttcctggttcgactgtttcaggaaagcatttgcaaagctagctggattcactccagatgacctagtagtgtggttgtggagaaacaggaaaagttttacactgatggtgggactgtaaactagttcaaccattgtggaagacagtgtggcgattcctcaaggatctagaaccagaaataccatttgacccagcaatcccattactgggtatatacccaaaggattataaatcatgctgctataaagacacatgcacacatatgtttattgtggcactattcacaatagcaaagacctggaaccaacccaaatgtccatcaatgatagactggattaagaacatgtggcacacatacaccacggaatactatgcagccataaaaaaggatgagttcatatccttcgtagggacatggatgaagctggaaaccatcattctcagcaaactatcacaacgacagaaaatcaaacaccgtatgttctcactcataggtgggaattgaacaatgagaacacctggacacaggaaggggaatatcacacaccggggcctgtcgtggggtggggggagaggggagggatagcattaggagatatacctaatgtaaatgacgaattaataggtgcagcacaccaacatggcacgtgtacacatacataacaaacctgcacgttgtgcacatgtaccctagaacttaaagtgtaaaaaaaagaacactgaaaatgcagaaatcagtcaaatacatcccttaggtcttgaggatatcaagcctttattccccagtgaatgatgcaggaagctctgagatcacccaaacagctgctgtggggaccacagagctaaggggaacacacagggtgtagcacagcccacagtgacttcaagaagccattcttctcaacctgcttctataattcagctgtggctgggtgtggtggctcaagcctgtaatcccagcactttgggaagcggaggtgggagaatcacttgaagccagaagttcaagacagcctgagcaacaaagtgagaccccctatgtctacccaaaaaaaaaaaaaaaaattaaacagaatacagctttggagacaattttttgactatttttttttcttttatatatatattttttgagacagagtctcactaggacacccaggctggagtgcaatggcacaatctcggctcaccgcaacctctgactcccaggttcaagcaattctcctgcctcaacctgctgagcagctgggattacaggtgcctgccaccatgcccagctaatttttgtatttttattagagatggggtttcaccatattggccaggccggtctcaaactcctgacctcaagtgatccacccgcctcggcctcacaaagtgctgggattacaggcgtgagccaccacgcccggcctttaagtgactattttgtcaacgaatccaaggatgatacagaactaatacgatgcaggggatggaagtcgattcctgacatgcaaaggacaccttgggaattgggcttaaaggtctcaaggagcctggtggaaaagagctgcaggcttccagaatcagggctgatggagggatcctggcccccaaaaaaggcatccaggaaaggtgaatcttggtccccaactggtgcttggtaaaagtcactttagctgcagaggctgatgaaagagaaatggaagagtgaccacaagagaacaaagaactgagttaaagttccaagaaataacttttgcagtgatgagccaaggaggagaccccaggcactgggcagaagtttgggctttttgtttatttaactctgaatagttcaggctgtgcccagtggctcacatctgtaatcccaccacttagcgaggctaaggctggagaatcccttgaggccaggaacttgagaccaacctgggtaatagagtgagacttcatctctgcaaagaataataaaaaaacttagctgggtggggttgcacacacctgtagtcccagccatttgggaggctgaggtgggaggatagcttgaaaccaggattttgaggctgcactgatcaatgattgcatactactgcactccagcttgggtaacacagtaagaccctgcctctataaaaaataaaataaaataaaataactctgagcagttcagcccatttggcgcgcacacacacacacacacacacacacacacacacacacagccagtcccaccactgagggcaaactggctccaggccaggtgagcaatcccagaccctcctgcctgccttccattctgtcccctgggaatgtctggatggatccgtgtccaggaaatccaggcgagatccctaatccagggagatgactgttccatgtgtagccggcaaggcacccccgctcccagtgagccacctaatgaaaacctcatgtgtcaacttgagttgcacagacaaacccaggcgaattccagccgggcctcgtgccgaaggtatgacctcactgtcgggcaaagcggcagggaccccagagaaagaagactggtgtgtgggccagacctgcttctaatcacagccagatgggacggatggaggcaccactgccatcctgcctgcccagatactggggtgtacggaccaggaggcatggtcatcctacagcgaagaatcctaagctttgccccaaacactccttttttttttttttttttttggcatcatccacatactagtttggtgtgattacttttgcatcaacctaataaacatcactgccattccacatgttccacaccaaagagaaacttaattaggtaggctcgaatctctggaggattcccagttacagaagcgaggaaggaaggatataattagaatcttttttttttttttcttaacagaacagctcaaaaggccccactaaggacaattaaatgcagtcattccatccataaccagaacctggtacctgagaagtttactcattggcaacgtgaaatttgcaaaataccttcaagacacgcacttcaacctcagactgggcatttttcatttagctcttttcacacttagggactgtataaatttttgtggcagcaatacccgtagcctacactgatgcgttattttcatggattttgtactaaatcttttgtaggcaacaaaacaaaacttcaaggaagctgagcttcaaaaataaataaatgtgcttttacgtgatgggtcaccgtgaaatagttgatgacttgggtttttgttaaaggaacaaatagaaattcgctgcaagatttgctcagaagttctgctttcagcattggtagctgagtatgatgagttgcaaataaactggtgaaacttgtagtctcttaaaccgcataccagatgcctgagccctgatgagctctttgaacaatatcatcacataaagccccaagggactccaagctctcatgaaatcagggaggatttgcaataatctaaaaatttccccacaagctggggtccaatgagagaatatacaaacaagcatgaacttggggccgaagacgcttaaatcttttttttaatttttttgagtttttttgttttttttttagagataagggtctagctctgttacccgggctggagtgcagtggtacaatcatagcttactgcagtcttgaactcctaagctccagcaatcctcctccatcagtgtcaacaatcctcctgcctcagcctcccaagtagctgggattacagacgtgtaccactatgcccagctaattttttctgtttttgcagagatgggttctcactgtgttgcccagaccggtcttaaattcctggccttaagcagtcatcctaccttggcctcccgaagtgctgggattacaaaatgtgggccacggtacccagcaagatccttaaatcttataggaataactctcccacaattataagaataacttctgagccgggcgcagtggctcatgcctgtaatcccagaactttgggaggccgagacaggcagatcacgaggtcaggagatcaagaccatcctggctaacacagtgaaaccccatctctactgaaaatacaaagaaaactagccgggcgtggtggcgggtgcctgtagtcccagctacttgggaagctgaggcaggagaatggcgtgaacctgggaggcggagcttgcagtgagccaagatcgcgccactgcactccagcctgggcaacagagcgagactccgtctcacaaaaaaaaaaaaaaaaaaaagaataacttctggacataactaggaataacactctacaagaaaaatgagtccaacctatgtgtaaagaagttgctaattgctaattccattcacatttagtccatttgactaggatttttgtttgttttgtttgttttttgagacggagtcttgctttgtcacccaggctggagtgcagtggcgtgatctcagcttactgcaacctctgcctcctgggttcaagtgattctcgtgccttagcctcccgagtagctgagattacaggcacatggtaccatgcctggctaattgttttgtatttttagtagagacaggatttcactatgttggtgaggctggtctcaaactcctgacctcagatgatccgcctgcctcggcctccgataacaggtgcgattgactaggttttattacaagagttgtgtgagcagaatcaaagacccaaagccttcttagttccagaaacagacgtatagattaagacttttcttatttcaaggaggaaacttttttccctgcaaatgtatctctgaaataatgatggaagtcactggaagtgagatcttgctgtaaaaggtgtgctttgctccagcttttcagaaatatctctaaaatataaagcaacgtcaaatcaggcctacaaagacatggtgagtcaccatcaatcagaattgggagaacaagctgagaaccgctcacacaactgaataccctggataaaacatctctatcctgaaccagaaaataaatgtctacagctgcacttggcggttggccctagggtccattcaccatatggtcacccttattatcatcctcccaacaagtccggcaagataacaggctaaaaccacgctcttgcaactggcctgcaggccaagcaaacatctccttatcataaccttggtctgttcttccaaagagacttcctgcccatctcctctgtccttgcttcttggtgtatatctaatgctcaacctgggcacgccaaaagcccagtcctctcgtgcccgatgcctagaattaagctgcttttcagagggaaagggtatgtgttaacaaaacaaaacaaagaggcctccttcctggacctttatctaaggcaggatctagctggtttgggataaaacctagggttttagactagggaagaaacttaaagattatcaaatgcagtcatttttcaaagcttattttatttttaagatggagtttcactctttgtcacccaggctggagtacaatggcacgatcttggctcaccgcaacctccgcctcctgtgcccagtccatttttcaaagctttttaaacattacgagggctgggtgcagtagctcatgcctgtaatcccagcactttgggaggctgaggcaggcggatcacttgagctcaggagttcgagaccagcctggccaacatggtgaaaccccatctctactaaaaatacaaaaattagccgggcgtggtggcgcacgtctgtaaccccagctactcaggaggctgaggcaggagaatagcttcaatctgggagatggaggttgcagtgagccaagatcatgccactgcactgcagcctgggcgtaagacagagtgagactctgtcgcaaattttaaaaacactacaaagttgtattttttccagtgaggttgtatgcagaaactcagtaaatagaaaatagacataaaacaagctgttatgtccatacagtggaataggaatatggccatcaaaagaaatgaagtcatgataaatgctacaacacaggtgaaccttggaaacactatagtaagtgcaagaagctactcacaaaggaaggcaaattatatgattccattagtagaaaatgtccagcagaagcaactatagagacagaaaatagagaagtgcttgtgtagggcttggggaaatatggggattgagaggtgatggctaagaggtacaaggttttgtctgggtgtggtggctcacatctgtaattccagcactttgggaggccaaggcaggcggatcacaaggtcaagagatcgagaccatcctgcccaccatggtgaaaccctgtctgtactaaaaatatgaaaattagctgggcatggtggtgggcacctgtaggcccagctacttgggaggctgaggcaggagaattgcttaaacccgggaagcggaggttgcagtgagcagagattgtgccactgcactccagcctggtgacagagcgagactccgtcaaaaaaaaaaaaaaaaaaaaaaaaaaaaggaagtgcaaggtttctttttggagcaatgaaaatgttctaaaatcgactgtggtatgcgttgcacaaatctctgaatctagcctggcctggctgacctggcagaacccctacatactcctctcctggatatgcccaccaatcacctggatattgagaccatcgatatcctggaagacaccatcaatgagtttgagggtggtatgaagctagtcagctatgactctggactcattcagcaagtgaggtcctggccaggtgtgaggtacagcagagagtgtctaggtggttgggtggagcagtcatggcatatgaaggggcgtagtacttgcttactgaattaagaaaagaggctcagagtgtagacacaggtggcaaggaccagatcttacggctctacttatggggctactttgaaagtgttaaatgaaacacttcatttcttcagtagctacttggagatgttaaccaacttgggattgttgagccaaatggggcagagagttgggtagaaaacagggtgcttttgctactggtcccaggattcttcaatccaaaaacaggattctactaagaagggcgtggactagacaggggactgccactgtcactggagaataagctgcaggtcatttctctgaagctttggagaagatggaaatggagggggggggaaggaggctgagagtgaagcctctgaacagatctggacaatgggaacgtccagacagaaggaagtgacaatgggaatgacacagtagctccagcttagaaggctccaaagcttgcgggttatcgtgtccttgggatagaccatcccaaaaaacttagaggtagtgaggcagtgtgcaggatatgggcttgtggggtagggcaggaagataatgccattttcttccttagaatccccttccatcagtctgctgggcaagaatggggacagtgactgggccaggattaagtctaggatttgttttccaggttgcctaggaaatgtgtgtctgtgggaagcagagaatcaatgaatggcctggagacaccctggcccacagggaacacctcaagtccaagctggtagatgagaatccccagctcaccagaagaacatacaacacatgagccctctggtcttgggttaggacctccgtctggagaccaacaactgctacccattgaccagtctctcagacaacgtagaaaagtggttgcctagggcttgcagggacagggggattgggaggtgatggctaagagatgtggaattcctttttggagtgatgaaggtgttcttttattttccttcaacttttattttaagttctggggtccatgtgcaggatgtgcaggtttgttagataggtaaacatgtgccatggtggtttgctgcacagatcaacccatcaccttggtattaagcccagcacccattagctattcttcccaatgctctccctccccacccccaacaggccccagtgtgttgttccccactatgtgtttatgtgttctcatcatttaactcccacttataagtgagaaaaagcacaggtatcttggaacccaaaataatacacaatttaggccgggcgcgctggctcacacccgtaatcccagcactttgggaggccgaggtgggcagatcacgagatcaggagattgagaccatcctggccaacatggcgaaactccgtctctactaaaaacacaaaaattagtcagttgtggtggtgcatgcctctagtcccagctactctgaaaggctaaggcaagagaatcacttgaaccgggaggcggaggctgcagtgagttgagatcgcatcactgtactccagcctgggcgacagagagagactccgtctctaaaataaataataaataaaatacaattaaaaaaattaaatgaaaataagataaaaatgttaaaatagacctgtcatgaaaaaaaaaaaaggtgagaacatgtggtgcttggcgttctgctcctgtgttagtttgccgaggatagtggcttccaactaaaatccattgtggcgctggttttacaaatctgtgactctcgtctggctacactggggctacaccccggcactgctgcagcactgctcccctggctcctcccctgcccccgcacctgccttagctgcactcttaactacagcgggacagttacctgtttcatgtcctccttccacttatatttgtccatgtctggacttgactggctgttccctgcagcctcttgctggtgaacttttcctgagtgtgatgtagccagagacactgagggttagcccaggagcccaaggccaggctctagcccatggaggagcttaggattcttgtttgaggggttttggtgatgttggaggaacattccccaactcactgcccccattcctttttgcttctagtctggagctctggaccaagaccctggtcttggtcaatttttaaataatttctcaacaatgtaacttgtagatctgtgtgacatctacaaagcatccaataaagaaagaggaaacaaacaaacaaaaccctgcacatccactaagcaccactgaattgtgcactttaaatgtgtgaattttagagtatgtgaattctatctcaacaaagctgttatttagaagaggaggaggaggaagaggggcagggagaagaggaagaagaaggaggaggaggaggaggggggagggagggagggaggaggaggagggggagggagagggggatagggatggggatgagggagggggaagagggggatggggaggtgggaggggacaagaagggaaaaaacaagatgctgtaactgttccaccagccaggcctctttcctcaccccatcctatagtggccctgaaaccatctctacaggcccctagaactctatggaaagttactgaaaaagcctgttctagtccaagtttctgcttctcaaatgtaaaccaagtctctggatttaaaagtgcaaggccctgcataaaccgaaggtctcactgatgagaccggggcatgtctcaggggagaagctgcttgtccgggtcttaccgtccatgtccaagcgctgcatgatgatggccagctccacctcgcttggcatgtaccccaaagagcgcatggccatgcccagctcctgcttggagatgaagccgttcccatcccggtccagaacccgaaaggcctctcggatttctacaatggaaaagcaaagaaagtccagtggtcacatggctggctttattgcactgcagttattggtgattgcctactgagaactcctaactgctttaaaaacagtgatttgttaaaactctttaatcagataaaagggaggacagaagaagaacagaagaaaagaaacgaagaaaagaaaaaggaaagagaaaaaaggaaatggaagggagaggaggagaagggaaaatgagagaggaagaaaaagaaaaggaaagggagaaagggagagagaaaaagaggaaggtggaagggagagtggaagagaggaatgaagggaggaaaaaagagaaagaagaaaggaagggagggagggggaaaagggaaggagggagggagaaaggaaggaagaaagcaagggagggaggaagggagggagggaggaagggagggagggaggaagggagggaggaaggaagggagggaggaaggaagggagggaggaaggaagggagggaggaaggaagggagggaggaaggaagggagggaggaaggaagggagggaggggaggaggagggaaggaaggaggaaggaaggaaggaaaaaaggaaagaagaaagaaaaaggaaggaaggagggaagaaaggaacgcaggcagacaaggaaaaaaagaaaaagaaatgaagaaagggagaaagagagaaagaaagaaaggaaagaaagaaaaatagaaagaaagaaagagaaaaaaagaaaaagaaagaaagaaggaggaagggagggaggaggcagctcgacctgagcatcctccaactctggaggaggcacacaattagatggtggtcccagcagagaatcatgttaaccaaggacactttctgagcaaagatgaggatttggtttcagctgtgaggagaaagctgcctcttaactgcagtcctcaggaggaaaggagaatgcagctcccctctgcaggcatatttcagatccctgctgctgtaggagctgtgcagaaagctcttccagcctcataggaggagaagagttaagtatccggctgtttttgactcattctcctaatttacaggtgttttgtagatataaacaacctcagatcaataagagcatcgtgaaaactcaaaagatgcctttaatcactttgcccctgggctagcagagaacttgactctgcggtcagcaagggctgtttcacttggcaggcaatctctcctcttcccctaaaccagagttgctctaaattccacccagagtccccttctccagagccactgcagctgtcagtcctggattggatgtataacacaaggaattggaggtcacagtgtgaagatgaaaggttcgttaattgtttctgagcacaccagacctagagcagctttgacttttcatcaataaacccagtgcaagcccagatatgtcagctgccattattcaccatgccacgctagttgatagaaagtcaactagtattgactttctattccgtgagaagcacagtattaataaatacggaaaaataaaaatgatccaccaggcattggggttctcccactcagctcgactccactcaggatggtaagatgcatgcagaaaccttctatcactcttcaaacgcatacaagcccctcggttctgactcatttacttactaccgcactgaatatctgaccatgccctggcatgatcattaccacaaacttggtgatttaagacaatagaaatctattctctcacagtctggaggccaaaattccaaaatcagcatcattagatcacaatcatgatgtcagcagagctgtgctccccgtgaaggctctaagggaaaatccatttgtctcttccagctgccagaggctgccagcattccttggcttgcagccccatcactccaatctccatcttctcctcttctgtctgtaattctccctctgtcctgctcttaaaggacacttctgtttgcattagggaccactcagataatccaagataatctccccatctcaagattcttaacttcatcacatcttcaaagacttttctgtaagatagcatttataaatctcagagattaggatttgatatctttgggggctggttttgagattgctacactattgcatccagtgcttctgcctaaaatatcttcccttcttcttttccctgcccaaaattatatccatccttcaaggtcaagtgtggatgctaaagtgactccatcttggatgctaatctgccatgttgacttctgacaaactctaattctgggaatgcctcccaaatttctatgttatctactgttccttgtgtaagaccttgttcttaccatacaccctgcccttaggcagactcctgcctttccctacaatcgtctatacattccttccctatgatatataagtcctgggtctggtaggtgatggctgggggcatccaccatcttgtctcaccatgccgcaagacacagacatagcccaagtccctattaaatgtttctttctgacaagctagatatatcagcctcttttttcagcctctcagcttccttggactttgggagtaagtttgcatggacttgcccattgcaaaacaccaaaccaggggtcatggattccgcaaaactgtctttgctcaccatagccaagttatctccctttctgctgactgttcacagcaggtcattcattcctttcttgtgacatccagcatactccatctagaaatactaccattggcttcttttctgagcggtaagcacctcctacccttctttcatcttagtgtgttccccgcccacattgtaggaggcgctagacagatagctgttcaagggatgatgagtctgaatgggtaaggatcatatattagtagtaaattcattatcaatactaatccagcatgctgaattctttctgggaagaattgtgggccccagcagagagaagaccaccctgtgcaccaggaccctaggctcccagccaggcgtattagctaattaggtccacggccaaaccctggaggcctcagtttgttcatgcgtaaaatgagctgtgctggctgcatggatccctcaggtcctccagcccttctttctgtgcatccgtggacatcgttgaagtgtttaagtgaagaacaggaagcctgtgttctcttacacaccctattaatctgctgttcaacacctcctcccctttctttccatcaatggtatagaaacaaattttagtccaacccaaattctgaatcaaggcgtttgtctgcattttgagcttttcccatcaatgaaatatgcccaaggttacctaaaacagccatatgttttcctaccaagtcccgactggcctggaaggagcgtggagccactactcagcttgaggtcatggcacactgtgctcaaggacactgtggtggaggacatggcctcatgtggcctgagctcagatccccaattgccaaggatgggaggacgcagaggccaggcctcccgacgtgagagtcagcccatgaggcagccagcgccaagcgccagctctgctctgcaagctggtgcagccttccccctcagcctcaatttccccatctgaaaaaatgggttaggtgtgatgtccttccagcctctatagcagggttttacactggggccaggacatacgatgcaacagtaggaagtgtcagaggatgacaaggtctgcggctgcagttactggatagccagttgtaagctaagtcttgctcttagttctccggaaggctccttcccaaggcatcatctccacttcccattccttctgactcaatcctgaactctctgggttactgatatggctggacagggtgggtcccttccattgacagacctttgttcctgtggtcttcctgtatgccctagaccttacaggtaagcatcaacctacatccttacattgggcgacaccccagcgggccctagctgggggtgtttgagaacatggcctggaaatgaggacccggacagctgagcctttggacctccgagttgccccacctttggggctactggatttagcaagtcagaccatagatggaggtcactccagaacttccctcctctaaagggacctgctccttcgaagccttgaatgcctgtggcttactctgtagtctgtagcaaggctggcctcctccaaccaagcccaggacagcgcaggccacacatcagctcagggttctattttctgtggcatgcaggtaagtaggacaaagctgtccttctttattctctatttgcatagggagctcctggctcccacgtagagaattcgtgtgtgtgtctatgtgagtgtgtgtgtctgtctgtctgcagaagcagacaaacctcactaactttttttttttttttcaaaatagcagaaacaggaaaaaaaatacaaaactagaaatccataataggcacctcgggagagttaatgtttctagggtaaggaaagcccaggcaaaccgaggcttattagaaggaaatgggtcttgcagtctgggaaagacatgtgatgtgtgcctcattttatttttaatagcaaaacagggtgtgaaaaatatgcccgtaaaacccacggagacattggaacaggcaggatccctctggctctaggaggacggctcccagcattgagtgggctttggccactttcccatccttgggaactagggaccacagatcaagttttcaagaacaggcagtaatgttgtgtgcttttcaccgaaacgtactccttctttggcctaaagtctctggtgcgccagggctacgtgagcacgctgtatctttggtctttaattaaactttactcctccatctcatgcaacacgtgcacgttagacactagtatgccaattttaaccacctccaagatgtctttgtgggccacagaaatgctctctgcaatggtgataggaacctgtccaactgtcattgtgtggagtatgaaaagacacgtggcaacacgcatcgtctgaaaggactccagtctctgcaagcatatggagtcgcccagaatcaaagttggcgttcccacagggatctgagcccctcctccctaaagggaagcagagagtcttgagccaagcaaggacttggaaagaaataatcctgttattcagcccaagagatttacttctcattatgctggtaacttattttttttttctgagatagtcttgctctgttgcccaggctgaagtgcagtggcaccatgatagctcactgcagccttgagctcctgggctcaagagatcctcctgccttggcctcttgagtacacaccaccatgctcgactaattttttatttttcattttttgtagaaacagggtctcgccatgttgcccaggctggtctcaaacacccagcctcaagcagtccttctgcctcagcctcccaaagtgctgggattacaggcatgagctggtaactcttttttctttctttttttttttgttggagatggcgtctcgctctgtcacccaggctggagtgcagtggcatgagctcagctcactgcaacctccgcctccctggttcaagcaattttcctgcctcagcctcatgaatagctgggattacaggcgcccaccatcacgacggctaattttttgtatttttagtagagacggtgtttcactatgtcagccaggctggtcttgaactcctaacctcaggtgatccacccccctctgcttcccaaagtgctaggataacaggcatgagccaccgtgccaggctctcttttttcttaaaaaaaagtctgcattgggacctagtgccctctgagaatcaggcctcagctccatgatgcttcctaatgacacagccaattccaggcaggaacaacagcaaaagcacagctatcgcagggaggagactcatttctcaggcatcagataaagtccagacaccagccagcatcgatattagttggctgatgttctagctttgaagaatcaggtgaaatttacagtactaatttgccacctcaaattggtaatgaagaacaacaatttctcctatctcagtatgtgtacgatgcaaaatctgcttattcttcacagaaatatatcttcaggaagaatgtgggtcttcattgcataaagtgatggctttattaacaaagaagatgcgttgtgaggctagatggcattgagacactgcaaaactggagaaagatgcagttcagcgaggctaggcaaggcagttatttaaaagctatggaaatgcaccggaaaatgtaagatacaaacctagagttatttatgcaaaggaagaaattgggcagggactgagcctatgacaaagagatttagaaaggttttcaccttctctaagaaaggcaaaaaatgaatatttacagatgattaataagccattcattctgcaaagagttgctgtttacttatatgtcaggggctgtgccaggatagataagtagcaaaagaaactttccaggctgcaataaatctgtattacagttgaagagacagagaggtgaccagatgttcataagcaagaatgacaagtgctataatacaagtatacacaaaatcccacggaggtcgagatgttgaagggacaactctgaggaagggctgttggggttacgcttgaatcttttaaatctcaagtctatcaagagaagggtaaacaggcaggggtgggaaaatgtggcaagacacgggcatgtctacaattctggctgcccggtgggtggagaaacgagaaacactgagagatgagagtggagaattgcactagggcgatgctatagtttggatgttttttccccaaaatctcatgttgaaatttgatctccagtgttggaggtggagcctaatgggaggcctatgagccatggggccagatcctgcatgaacagatcaatactctctctgggaggaggaggaggggttgcatgagtcctcaattagttcctgcaagagttggttaaaagaaaagaacctggcacctccctctctctctcttgcttcctctcttaccatgggatctttgcacacactggctcccctttgcctttctccacgggtagaagcatcctgaggtcctcaccagcagccaagcaattgctggtgccatgcttcttatacagtccgcaaaccatgagccaaatatatattttctatataaattatctagcttcaggttttcctttatagcaacacaaaacagactatgacaggcaatattgcaatgggccttcacagccatctgggctctaccccgcaggccaggggttggcaaaggatggcctgtagccaagcctagctcaccaccttctttcacaaataaagttttattggaacacaaccatgcacatttgtttctatatgtctccactggttgtctattttctcctgtttttgtgctataccagcagaatggaataattgtgacaggaactgtggggcccacaaagactaaaatatttatactccggacttttctttttaaagtgtgtgaccctttcatgtaggccacagggagctcccagtggttttaaaatatatattttttaagggtgagatttttagaccaagagctcaggcatcagggtggctacagctggaatgacaagagataagaggctgtcacagagtctaaggggaagatgaggaactcagagctaagccagcatggtggcagaggacactgtggaaagaagagtttgagagacttttcagagatagagtggatggtgctcaaggagagctcagatgtcagagtctgggagagggatgatttgaaagacaatgctggagggctgggcacagtggctcacacctgtaatcccagcattttgggaggctgaggtgggtggaacacttgaggtcaggagtttgagtccagcttggtcaacatggtaaaacccaagaaagaagtaaagtaaaagtaaaaataaaagttgaagggaagggaagggaagggaagggaagggaagggaagggaagggaagggaagggaagggaagggaaggcaacactgtagtttacgtgatggcattaacaacaaacaattcaggagggactgcaggctgtcttggagggaagtgaggtttggccacactgaggataggtgtctgagtgataccctggtgattgcttctagcgagcagctgcaaatacttggcaagagtttggagacaggtgatgctgaaaatatgacaagaatggaaaatggggataaaatgatgatcgctgcatagaaaatgctggtttaatcccagggagggctttagtgtgaatgagttctgatttaattacaacctatcagtctgcaaataatgatcaactgacttcagaaattaggaaacatagaggtgaaagggacagagctacgaaggcagagggaagtgtgctagaaaaaggaggctggggctaggcatggcggctcatgcctgtaatccccacactttgggaagccgaggtgggcagatcacctgaggtcaggagttcaagaccagcctagccaacatggcgaaaccccgtctctactaaaaatacaaaaatgtgctgggcgtagtggcacatgcctgtaatcccagctacttgggaggctgagacaggagaatcacttgaacctgggaggcaggggttgcagtgagccaagatcatatcattgcactccagcctgggcaacaagagaaaaaggaggctgggcatgcaacaggagctcagaagtgttcccatttttagtaatgtgggacattatggacattacattatatatggacattacattatatatggacattatactatatatatagtataatatatatagtataatataaatatatagtataatgtccatgtcccacattattatatactgtatagtatatattatacaattatatatattaatgtataatatataatatatactatatataatatacagtgtataataataacatgggccacaggaacaagccacttagatggaggggtggatacactgctgctttgtataactcactttttagcaccatcatctccacctggatttttttttttttactttttcatggaaagatctattttattttttaatatttttaattaaggtcaaaaatataatttaccatctttgccactgttaagtgttcagttcagtaatgataaatacattacacatatacattctttttttttttttttttttttttttggagacacagtgactgtcacccaggctggagcacagtggtgcgatctcgactcactgcaacctccatctcctgggtccaagcaattctcatgcctcagtctcctaagtagctgggatcacaggtatgtgccaccagacctggctaatttttgtatttttagtagagccgggtttcgccacgttggccaggctggtctcaaactcctggccttgtgatctgcccgcctcagcctcccaaagtgctaggattacaggcgtgagtcaccgtgcccggccatatacattcttttttatttccatcccccaccttctctcccctccttccttacctctggtaaccagcaacctactctctattttcatgagatcctctttttttagctcccatatatgaatgataacatgcaatatttttctttctgtgctttacttatttcacttaacataatgacctccagttccatccatggtcctgcaaatgacaggatctcattcatttttatggctgaataacagtccattgtgtatatggactacatcctagtttttattttttctgggcacacttttaaaaagggattgtgactccttaggtgatttgctatttgaggtgtgactgcatctatttcaataaatactcattgaacgtgcctctactccaggctcagacttgaaaagaaggctcaagtgagacatggcagaggcacgcctgagccgagcccagtcctgaaggcacttcctgcttttgtttgttgaaatggaatcttatttcacaaagcattttaggcagtttcaaggacttaaatgagactagcctggacaacatagcaagaccctgtccctgtctttttaaaaaaaggcttaagatttacctaagggaaaaacatgcacaggagctggaggagagaaagatgaaatagaaatctctgaggaagtatacagggaggtgagatttagaggctgagagaggctgaggcttggaggaagcatggcagagaggcccttcaaagagggcacaacagggtacggaagcaggaggggactgagctggggctttgggcttctcctggatggcgccatgcaaaagggcacagctagcactagcggccagccatacctccaagttagctgcaagtattaatctggaactagtcactgcatctgtgctgttaagatgagaatctagtgtcgaacaggactcctgtaaatcagtaaattacccagcccagattcaccttggccagctaccacccagctattgaccaaaggagccaaactctgtaaaatatttaaagaggtttattctgagccaatatgaataaccatggctcaggtacagtctcaagaggtcctgagaaagtgcccgaggtagtcaagttatagtttaattttatacattttagggagataggaattataagcgaagacataaattaatacatggaaggtgaacattaattcagccagatatcttcaagtggaggtgcttacaggtcgtagggggattaaaagattttctgaggctgagtgcagcagctcatgcctgtaattccagcactttgggaggccaagacaggaggatcatttgagaccaggaattcaagactaacctgggcaacatagtgagaccccatctctacaaaaaattaaaaaccaaattaaccaggtgtattggtgcacacctgcagtcccagctactaaggaggctgagatgggaggattgcttgaacccaagagtttgaagctaaagtgagctatgatcataccacacttaagaagtcagaagaaaggaatgcttgagttaaaataaggggactgtcgaagccgaggtttttgttacgtagatgaagtctcatagatggcagccctcagagagcatgtgatgctataccggtcaggctggatttggtatgttattaccttaagacactgtttggtcagtcttatggtctgcattttaatcttaatgctggtcagttatgcctaaactctgaaagggaagggatataacaaggtgtgtgtgtgtgacctcccttcccatcatggccagaattcagtttttcagggtgcttgggggtccctttggcccaaactggggtctgttcagttggctgggggcctaggattttatttttggtttacattgcttaagaatgagtcactgttggccagacacggtggctcccacctgtaatctcagcactttgggaggccaagctgggcagatcacttgaggtcaggagtttgagaccagcctggccaacatggcgaaactccatctttactaaaaatacaaaaattagccaggcctggtggtgggtgcctgtaatcccagatactcaggaggctgaggcaggagaattgcttgaacccaggaggtggaggttgcagtgagccgagattgcgccactgtactccagcctgggcgacagtgcgagacaccgtctcaaaaaaaaaaaagaaaaaaaaaaaagaatcactgttgaccctgggaacagacagcaggcagtgttggggaaaaaggtgcacaggcccagtgctcagggctggtgggccattgataggatgaacctactatgcatctcagatgtccctgcatgtcacattcctggcctttctcattacctcatagccaaaaccacattttttaattaaaacatgaatctgactccttccctagctatcattcttaaagaagggcatttttgtaacttattaagtggtgaaattataccaacaaacactatctcaggttatgaaaaataataatttctttcatggtcaaaatcacatctttaatggaaaaattaagtcaactccttccctagctatcatactgaaagcagagcattttggtaactttatgaggtggtgaaattctactactcaggtcatgaaaagtatttctttcttaagctagaatggcacaagatagtcagaaagctagaggcatttctaagggtttaagaactagagcataaagttaatctgtccccaaacgttacacctggacagattaagctgaatcgattttagcatgccaggtaggttaaagctaatggaaaattcctcaacagtgaaagaacaaagcaaattagaacagaaacaaacaaagaaagcccagcccggccagagatactgaaagctccaggcagggccaaaaggaaaatgagtggatgagatttaaatatgtatgagagtgataatcactggagggtctccatacaaaatgacaaatgacaaaattctcagggctgacccctctgggaagatgtcaagtcagaaggaagggatctcgcattgctggaacacatcagttccatttgtctggaatggttctagactccactgctaggtcatcaacagctgcaagtccagaggatcaacaaggcaactgctcctccaaaaaagcatgaaaaactgttcagaatgggttttaaaaatcaaaagacagatttcaagcagtatctacgttgtgatcttattttagtaaaataaaaatgatatatattttggaagactgtaagaatagacatcaaaatattaacagtgaactttctgtgtggtgagattacagctgatgtttattttctttgctcatgggtattttcaaagtctctattgtaaacttgctgtattagtccattttcacgctgcttataaagacatacccaagactgagcaatttacaaaagaaagaggtttaattgacttacagttccacatggctggggaggcctcacaatcatggtagaaggtgaaaggcatgtcttacatggtggcagaaaagagaagagagaggacttatgcagggaaactctccatttaaaaactgtcagatctcatgaggcatattaactatcatgagaacagcgcaggaaagacctgaccccatatgattcattaacctcccaccgggtccctcccataacacattggaattcaagatgagatttgagtgaggacaaaaccaaaccatatcacttgcattatatggtaaaagaaaggaaaaaaaaaaaccagagctaaccctacataggatattgtattagtctgtttttacactgctgataaagacatacccaagactgggtaatttataaagaaaaaggggtttaatggactcacagatccacatggctggggaggccttacagtcatggtggaaggtgaaaggcatgtcttgcatggtggcggcaggcaagagagaacttgtgtagggaaactcccctttataaagccatcaaatcttgtgagacttgttcaccaccacaagaagagcatgggaaagacccatccctatgattcaaatacttctcaccaggtccctcccatgacatgtgggaattgtgggagctaaaattcaagatgagatttgggtgaggacacagccaaatcatatgagatatgctacattttccagattacatgtagttttttaaaagtaatttcaacttttactttagattcagggggtacatgtgcacgttcgttccatgggtatattgtgtgatgctgaggcttggggcaagaatgacgctgtcacccaggtagtgagcatagtgtctaataggtaattttccagcccttgacccccagtagtccccagtatctattgttcccatctttatctccaacacgtatttttcaatgaaaaatgtccccaaaatgtatatagaaaaaaaaattatctatatttcactggtctgcaataaccattactaacatattagcacatttcattccatactttttaatatgcaaatgttcttaattcaactaggatcatgctctctatatagctttatatcatttttttcacttaacacactcaattttcaatcttccatattggtaactagtctgcaaaacagcatttttgatggttgatcagtattccatcctatggccatagcaaaattgatttcaccaaactcctattgtgggatatttagataattcccaattttacataatgttgcaatggaaatctttgtacacaaattgtcatgcattttcatggccatttccttaagatgacttcctaggaatacaatcactgggtccaagggcagaaacacttttcagtcacttaatacacattgccaagttgccctcaaaaaggcagtatcaattacaccaccctctgcttcccatgaatttcaggcacagaaatatagtacccttggaaacacacctttcatccaactatctcttaggttttagttcttgacgttcaagatccagaggattacaaggctacgcttcaaggaaaaggaggcaattcagattatgtctgaaaaaggcctgcagggtgatcgtgggatggtgagtgaaccccacatgcagcacagggcctggcccaaaggaggtccccaagaaagacacacgagcatctgaatccaggtgaggggaccaggactcagtgaggggaaaagggctcccctgaaaagggagaaggtgaggtttgagtggggagaaagctactctcctaactcaaggaccaggactgttttgggggtggaacgctttatattatatacatattatctattatatatctatattataacttatatatgaattatatattatatataaaatctatatctattataatttatatatgaattatatattatatataaaatctatattatatataattatatattatgtattatattatatataattccatattatgtattatataactatataattaatatattataatacatatctattatatatctatattatataataatatataaattatataatttataaattaagtgaatatataaattaaataatatataaattatattatataattatgcaatatgatatataaattacgtattatataatatagatgttatataatatgtactatgtataatatagatatcatgttatataattatatatagtatagatatatataatatagatatataattatgttatttataatatataaaaatcaaaaatcaacacggacatgagtccctcagcttcctcctggactctgagccaggtcactgtctctttagaggaaatacaatatgatttgcgtgtgtgcacatgtgttctggaatagttggcttgctcttgtgattcgcttaggattacatttctgggtagacagaattatctatctacccagaaacatgtttgattattacagacatcaaatgtttattataataaaaatgttttgattactataaaggttttatcataatgattattataaataagcatattataatatgtgttttgattattgtaaacatggttggttattataaacctgtttatcattataatatctattatataattatatattaattataaattatatataatatatattttatatataaatatatattatattacatgtaatatataatagtttgttctacagaaagatcgaccttttcccatgttccagcaaactccacagcagcaggagagaagcctggcaccccctccacaaaatagtcattcgtcacacagccacaggcatcttctcagggaaaattagaccaaatgcctgccgaagacagaaagtaggaactgcatcatttggcccatacggcaatattggatgtgcctccaagtggcaaactgagtggaatgtatccgtgaacaacatggcaataatcaatacagttaatttgtcattagatcacactgttcctaagctgcaaacgttaatatacggagattagagactccttggcatctgaggaaacaaaatcattttgtggatttagcatagatatgcaggccagaagaacaaaatccaagttccagaaagaaactagagaaaaagtgaatggagagaagggagcaactctctcaggcatggcaccacctcccctgcccccagggtcttgagaatcctttcaagaagctacatttggctgggcatggtggctcacacctgtaatcccagtgatttgggaggccaaggtgtgaggatgacttgaggccaggagttcgagactaacctgggcaactatctctatgagaaatttaaaaaattagtcgggcatggtggcacatgcccgaagtccaagctactggggagactgaggtggggggatcacttgagcccagaagtttgaggctgcagtgaactgtgatcacgccgctgcactccagcctggatgacagagcaagacactgcctctaagaaacaagcaaacaaacaaagctaagtttatcttcggatcattcaattcaactcaattcaacaaacgtttcttaagcacctactgtatgtcaggcagcattctaggtgctaagaccaggtcccagaaaaccaaggtataaatagcaacaagacatctaagcagtactaaagaaaataattgttcaatgatactcgtgaaagcacaatcaggcagcctttaaatcagcaccacagcaatagctatagagaccacggcaatgggattttgttatgggggagagagactgggctcaactctgaatactgcatagccaagagagaattcagagccagggagcggactgggggtcacagctatttaccactgttgcagtgaccccgatagaacaagaggacagcgatggtcacacattcgcttgacttctcactcctaattcactcattttgtagtgtcttaaaccaagacagctcaggtgcctacaacagggtccaaagacttctagctgcctgctagaagtgagcagaaaactttttccttgtgtagctcagcccatgaaacaaaaaattcttctaaagccatctgtcaattaactcatggcactgaggtgtggaacaaaatgataaatggtgggagttggaggaactggttctaatctaaacaagaactcctcttctgttgtgtgatttttttcccattttaactcatatcaaccttgtccttcctgtcatcatgggcaagggcacgcgtaaacaccgcgccatgtcttgtttctaatttgcttgcaaatacgagaggccctggaatcgctatctgtaaaaagttagccagagagaatgcgagacaacttgagggtaaatcgtggaaaggattgagactggctcacggaagctcaggggaagcccagggaaccgctcccctctgtagctcatcaaatccctgcacaccagcactcccatttgttctctgctgcattatttttcagtccatttggccttcctgataattgataaagagctgactatgaaggaaattgttctccactgcagggtgcataaatatcccattatcaataggaagcaatttacttgcttaaaattgccgactctctcattttgttttaacacactgtttctctatcgaaataagtctacacctttgaaaaggctatctccaaagcctcacactggctccagcttgaaaaataaatctgaaatcagctgaggcagaatgacctcatcccagccctctgatatcaaaagggcagctcagaaaagtggaaaaattgctttaggaattctatctaccagaaatgtaatcctaagcaagttacaagacagtaggccaactatttcagaacacacgtgcacacacacaccaatcattccgtatttcccctaaagagacagcgacctggctcagagtccaggaggaagctgagcggctcatgtccgtgtggatttggggattctgaaggtaaatagtgtggtaaaggtaacactgcaatctattggagaaaacaggaagtactcaatacatagactacaatgaacagttaagaacttggaaaaaattaagttacaactgtgcatcacaccatagacccaaattcacttttggaaaattaaaaagcagagggaattaaaacaataataattagatgacacttcgggaggccaaggtgggagaatcactttgaggccaggagtttgagaccagcttgggtaacacagccagaacccgtttctataaagaattttaaaaattaactgggcatacaccaggcacataactgcgtgcctgtagtcccagctacttgggaggctgaagtgggaggattgcttaagcccagaagtttgaggctgcagtgaggtatgaccctaccactgcactctaacctgggagacagagcaagaacctttctctaaatagtaataataatataattagatgacaaaagatctttgtaaacaagaattggaggcagattgacatatcaaaaaaaaaagaaacaaagaaaaaaaaacatgaagataaagacaacctgaagaaaaaaaacaaatgaactgacctacagcaggcaaggaaatagtctttgatatgtgaaaagttttaccagaatgtcccaccagagcaatgcaaaagacaaacagattttccccaaaaggaaaaacacagatatgcaaaaattacataaaaaaagaattacaactcattatttttttttaactcacagtatttttttactattaattttctagttcaagtgaatatcaccataatataccatggtttttgttttgctttgttattttgttttgaaacggagtctcactttgtcacctgggctggcgtgcaatggtgcaaccttggctcactgcaacctctgcctcccaggttcaagcgattcctgtgcctcagcgtcctaaatacctgggactactcccagctaatctgtgtatttttttggtagagatggggtttcatcatgttggccaggctggtctcaaactcctggcctcaagtgatccgcctgcctcagcctcccaaaatgctgggattacaggcgtgagccaccacacccggcccaccatgttttatctatcagatgcaaatgcagccaataaatacttgctgattgtctcctatgtgccaggcactgttctaggagcaggatatggcagtgaacaaagcaaggatccctggcctgcgtgcttgccatccactaggggaagacagacgatgggcactttgtaaagtaaataacatggtgtatagaaaagtgataaatgctacagaaattttttttaaaaaaatggaagagtaaagtagacagcggtacagaattataggatggactaaggaacaggttacagtgttttaaaattttatttcaacagtttttggggaacaggtgggttttgttacatggataagttctttagtggtgatttctgagatctctggtgtacctgtcacccaagcagtgtacactgtactcaatatgtagtcttttacccctgccgcccccaccttcctgtcctccccaagtcccaagtccactgtatcattcttttttttttttttttttttgagacggagtcttgccctgtcgcccaggctagagtgcagtggcgtgatctcagctcactgcaaaccaccacctcccgggttcaagcgattctcctccctcagcctcccaagtagggattataggcgcgtgccaccacgcccagctaattttttgtatctttagtagagatgaggtttcaccatgttgaccaggctggcctcaaactcctgacctcatgatccgcccacctcggcctcccaaagtgctgggattacaggcgtgagccaccgcgcccagctcactgtatcattcttatgcctctgcatcctcatagcttagctcccacttataagtgagaacatacaatgtttggttttccattcctgagttgcttcacttagaataatggtctccaactccataaaagttgcttcaaaggccattatttcattccattttatggctattattccatggtgtatacataccacattttctttatccactcattggttgatgggcttttaggttggttccataattttgcaattttgacttctgctgctaaaatttcttccagttcctgactccagcaactggaagaaagatccacaaggcttgttggctgctataaacatgtgtgcgcatgtgtctttctcatacaatgacttcttttcctttgggtaggtacttcttttcctttggatagacacccaaaagaaaagtggtgatttctgagattctggtgcacctgtcaactgagcaatgtacactgtacccagtttgtagtcttttacccctcacccctttcccctacctttctcctgaatccccaaagtccattatatcatgtttatgcctttgcatcctcatagcttagctcacacttagaagtgagaacatatgatatttggttttccattcctgagttgcttcacttagaataatggtctccagctccatccaatttgctgcaaaggccattatttcattctcttttatggctgggagggtgggaggggttgagggatgaaagactataatacatattgggtacaatgtacactgcttgggtgacagatgcaccaagatctcagaaatcacccataaagaattaaatcaccactaaagaatgtatccatgtaaccgaaaaccacctgttccccaataactattgaaataaatatataaataaaattttaaaaaatcgtaacccgttccttgggcctccaagggtaaaaacccaaaggagaggaagtagtgtatttaagtggtaccattccatccagcaatcattccatccagcagattgctggatggaatggtaccatttaaatacagaggttagggtattgaggggacatctgagcaaagacttgaggtaagggtggtagccatgggctgtctagagaagagtgttccagacagaggaaacagtcagtgctaaatccctaggtagatgtatgcctgatgtgttggaggaacagcaaggatactgagtcactgggttggggtggagtgagtcaggcagggagagaaaaacaggtgagaagacccaagagggaatgggtgggaaggcagattatgcacattttgtgtttttactgtgaatgaggtgggagctctggcaggttacagagcagaggagtcacgggatctgacttgtgtattaaaaagatgcctctggctactggactatcctgagagcagagagaggctgcttctgaggtccaaaggatgacagcagcggaggagggaaaagtggtcaacgtatatatgggttttaaggtacagccagcagggtgttctgaaaactggggtttgggatgaaagaaaaggagggacatcaggagggctccaaggtttctgactccagcaactggaagaaaaatccagaaggtttgtttgatgatgtgcctggtatggtgtagggtgatggcaacatttgccgtgtgctagtgggagtgtaaattggtacaattgaacagtaactaataacagccttcaaaaatacagaccttgtttattcagagcaaatcttaaatgcacatttttgagataactagagaaatttaattatgagaaatatgctgatttaagctagagagagagactgatgtattttataaatgaaatgatatgacatatgggttttgcttcacaatattccatgaaaaaaaatggtgggggcaggagtgatcaatgaaatacaatcagcaaaatgttgaaaactgttgaaactcagtctttgggtatgtttgacaatatcaataataaaaatatttcttaagtgtgcacaccctggacccagcaattccattgtaggaattcatcctaaaaaagaagagatacatattaaaagatatttattacagcctcatttgtaataatgaaaataggaaaacacaagcaataggcgattagctaaataaataatatgaagccatttagctgaaaaatagtagaaagattagaaattggtctgtatgcatgcagaaatttagtatataacgagtgacacttcaaataatggggaaagatgaatccaaaaaataacgtggggacaactaagtagatacctggaaaaaagtaagaatgaaactgcactccacaatttataccaaaatacatcccaaaacaatcaaagattaagtatattaaaacaaactcataattcctattacaaaaacatgagaatttttaaataattttaagagtgaataagggaggaaacacgaaccaaaagccataaaataaaagacagtaagttctatataaatcttaaaacgggccaggtgcagtggctcatgcctgtaatcccagcactttgaaaggctgaggtgggcggatcacctgaggtcaggagttcgagaccagcctgcccaacatggcgaagccccatctctactaaaaatacaaaaaattagccaggtgtggtggcaggcatctataatcccagctactcaggaggctgaggcaggagaatcacttgaacccaggaggcagaggtttcagtgagctgagatcgggccgctgcacttcagcctgggcaacaagagcaaaactctgtctcaagataaataaaacttaaaacatttgtcagggcaaaaatcaggataagctaagtgaaaaatcagaaacaaagtaaacatgtttgtaatttatgttacaaaagaggagctaatttccctcacattaaaaaatttatatatatagcatcaataagaacaaaggccaacaagccaaaataaaaatggtcaaagaacaagagcagacagttcccaaggccagaattacatatggcttttaaacatataacaccaagttcagcccaactcataatcagagaaatgcaaattaaaagtacatttgtatacttatatttcacctagaaggcagataaagatcaaatggtttgataacacacagtgtggataagactgtgtgaaaacaggccctctcaaacattagtgatgggagtgtgtgttactataaattctttgacgtgcaatttggcaatttatactggttataaatgcatactttaactcaatgattccacctctagaaatgtattattcaagcatacaaacacatagaataatatatgaaccaggctagtggctgtaatattgtgcggtgtgtgtgtgcgttatagatagacagatagatgaattttaaagatcatatttaatgatactaaggaattattgttacacctgttaggagtgatattggttctgtggggtttcttaagtcctcatatttttggagatatatgctaaaataattacagacgaaatgatataatgtctgggatttgctctcaaataatataggaagaaggagggttggtagctaggagtgtaaataaaaatgcttggttcaagttaaagcttagtgatggcccccttagcattcatgacactcaaatcttcataataaaacctcaactattaaaaagctcagaatcaactcaaatagccattaatagaaaagttaaataaactatgatacacccaaacaatggaagagtattgctatggtttgaatatggttcatgatttgtctcctccaaacctcatgttgaaattttatccccagtgtgtcaatattggaaggtggggcctggtgggaggggtctcggtcacgagggcagatccttcatgaatagattaatgccctccctcaggggtgagtgagttcttgctttattagttctctcaacagctggttgttaaaaagaacctggcaccaacactcccccaccccccaccaggcttcctctctcaccatgtgatctctttgcacacatccgctccccttctgcttcttgccctgatttgacacaacctgaggctctcaccagaggctgatgcccaattttgaactttacagccaccagaatcatgagccatataaacctgttttctttataagctacctagtctcaggtattttgctacagcaacacaaaatggactaagagctgttaaaagagtaagctaagcggattttatatcctgatgtggaatgacctgcaagatgtattgttaaatgaagaagccagatgcaaacagtgtgcatcaaatgtttaccatttacttatgaaaaaaagaagaaagactagaccaacgtgcttgttagatgggtcggtggtatagtggggagcgtagctgccttccaatgtgcttgtaaatattaggttggtgcaaaagtaattgtggtttttgccattaaaagtatggacaaaaccgcaattgcttttgcaccaacctaacgtgtagagtatgtctggataatacataagaaacagatattcctgggttgcctctgcagagggaaaccaggtgatggtgataaggaggaggagggacaggtgttatgagggacactttcagtatatgcttttctacctgttgaaatttgtaccattaatgcattatctatccacacaagtaaaatttgtgattgtaaaagtacacactaaatcattaacagtggttattgctgaaggatgggattgtgggtgatttttattttcccagtattccacaaagcacatatttttcttaggtaatttgaataaacaggttatttttgaagaggcaaaaatcaggaaatgacttaatcaaagagcttgtctcaatcagcaaacagaaagtaacccactaattcctagttacaggacattgccacagccctcttcctttgacaatcacacctcttggtgtactaagcacccatgggtcatcaaggatggcgtaggtaaggacatgatgctgagtgagatctgtttctgcccttaaagcactcgtgaaggggcagagtggagagagaggcagaaaagccagcagaccattacagcacgaggagataagtactataatatccataactgaagaaatctgaagagggaggtgggaaggggtcatgggaggaaactgatttttcagcggggatgtacaagatccttaaagatgaatggtaattggattcaagatgctatggtgatgattctgtttagtgtcaatgataaaatggctgactccatttgtgaattgacctcccctgatgattcagcactgaaacggtgcctaataatttgcatggtcctccagtggggagctgagctaaatttatttatcgctgctcttcatgcttttaaacttttaccaggtatcagaacaaaaatcttgctccattcccagattttggttactgttctaagtgaattcaatacccgaactgattctctaacagctttacctccactccattcaagaaacccaacacatgggcaaattctggatcttgccctgacctaacattgttcacactctaaaatttttaactctaaaatttcagtctcatcccatgacctcgtatttgcccaaccctgccactcccaccatctgctcatcaacaatccaagactttgactcttcagcatttctctggattgtcagccttcgttgtcccttcccactcaacccaactagttacgttgcctggaaccactctctttccaaaaccctaactccattacctcctagctctctgtgaatctgttctgtgcctctaaggagtctttccactcctgtggccagacacaattctttccccatcccacatgattgttgttcaagatctgcattatcctcttcaaaccctcaatcccatttcccaaatccatccccaaactctcagtgaataatgaagtcctccagtcgctcaatgtatatgcaatatatgtttattgatatatacaaataactcaatctacacaaaaacatattgatcaatatcgctctatagatgccccctcaacttaggataaggttatgtctcagtaagctcattataagttgaaaacatcacaagtccaaaatgcatttaatacacctaacctactgaacatcatcccttagtctagcctctcttaaacatgcttaggacacttccatcagcctaccattgggcaaaaccatctaacataaggccaattttataataaagtgttgagtatctcatgtaatttctgcaataccgtactgaaagtgaaaaacagaatagttctatgggtactcgaagtatggtttctactgggtgtgtgtcgctctcacaccatcatgaagtcaaaaatgtgtaagtcaagccattggggaccatttgaagttagttcattttcattactatagaacattccatctccagttaactgacatataggttgcttaaaaaaattatatgaagaatgccaccacaataaatatatgtttgcatcttgcacaggcagtgtttctcgccggcagctgcacagccagtctaccaggtgggggcccagaaaaaattatatcaacatatgctgaatctgcacttatatgctactggagtgtgttaactccatttctgacaatattgtatgtccccggctaatcaaatgagggtattagcatgcaagacggctctctccaagacaatgtagcccatcagaaaagttaaagtaggggtccccaacccccaggctacggaccaatttcggtctgtagcctgttaggaaccgggctgcagagcaggaggtgagcagcgggcgagtgaacattactgcctgagctccatctcctatcagatcagcagcagcattggattctcataggagcgggtaccctattgcgaactacacaagctagggatctaggttgggcactctttatgagaatctaatgcttgatgatctgaggtggaacagtttcatcctgaaaccatccacccacaactatccatggaaaagatggtcttccatgacaccagaccccggtgccaaaaagggtggagaccaccgagttcaagcattaagttcatttgatggacactacacaatgactaaaaataatgcttatagactcctaatgacgcgagaaatgttcgtaatttattgtcaagtggaaatacagagtcatgtgaccatcactttgactaatgagattatgccaaaaggatttaagaaccagcttgaagaggctactactatattaaaataaacaataacggcagtagcttataatctgttgaataaaataggaattaaagagtccatactgatatgaatgaatgaataagacaaggctcttacttacagaataatgccaaaaaatgttgaaaagatggtggacttagaaaaactgttgtatgattatcatatggttacacatggtaaccactttagtaataactgattcaggcaaaaatcactaatggacgctaaacctagtgggtaaaagtttgacgattatggatattcatatagtttcaaagtattttcccactgaacactaattacaaagggggaaagagccactttagagtggaaaagcctggcggactccacctgaattcaacaatcaaagtcaacatgaacagtaatgggtcaaatcacccctacatatcacctgattaggttccaggacaaggatacatcattattacttctgtgatatttctgcaaaagctgtataacttaatataactatgaaggaacatcagacaaatccaaaatgaggaatatgttacaaaataactggcctgtaaccttaaaaaatatccaagtggtgaaagtgaaaagctaaatgctacagtttgagtatgttctcttcaaaattcttcaaaattcatgctgaaatttaatccccattgtggtggcattaaaaggcattaaaaggcctttggggaagtggttaagtgatgagggctctgccctcttgaatggattagtgccttctgagaaggctggagggacctagcttaggccctttttgctcttctgttcttctgccatatgaggacatggcattccttccctccagagaatgcagcaacagggcgccatcttggaaggagagaacagcccttgccagacaccattcctgctggcaccttgatcttagacttctcaacttccagaattgtgggaaataaatttctgttctttataaattacccagtaatccaaggtattttgttatagcagctccaaaggactgagacactaaacaaaacacaaaacctaaggaaacttttcagatgggagaaaacagaagagacatcacagatggatgctaaattcagacacacctcaaagatattgcaggtttggttctggactactacaataaagcaagtcacaccaatttcttggtttcccagtgcatataaaagttaaatttacattatacttttgtctattaagtgtgcagtagcattatatctttaaaaatgtacttttatttaaacatattttattgctaaaatatatgaacaatcatctgagcattcagcagttcataatcttttactggtagaaggtcttgtctaaatgctgatggctgctgactgatcaaggtggtggttgctgaagtctgaggtgcctgtggcaatttcttaaaataagacaacaatgaatttggccgcacatagatggactcttcatttcataaaaaaattaatctgtagcatgcaatgctgtttgacagcattttacccacagtagaacttatttcagaattggagtcaatccttttaagccttgccactgttttattatgtaaagaatatgctgatggaatattctacaacgttcacaatgccatttcaacaatgtttacaaagcatctttaccaggagtagattctatttcaagaaactactttcttagctcatccataagaagcaactccgcatccattcaagtttgatcatgagattgcagaaattcagttccatctttaggatccgcttttaactccccttctcttgctatttccaccacatctgcagcgacttcctccactgaagtcttgaacccctcaacatcatccatgaaggctggaatctacttcttccaaactcctgttaaatgttgatattttggcctcctcccatgaatcacaaatgttcttaatggtattgagaacagtgaaacctttccagaaggctttaaatttacattgcccagatctatcagaggaatcactacgtatggcagctatcgccttatgaaatgcgtttcttaaatattaagacttgaaagtttaaattttaactccttgatgtatgggctgcagaacggatgctgtgttagaaggcatgaaaacaacattcatctccttgtacatctccattagagctcttgggtgaccaggtgcattgtcaatgagcaggaatattttgaaaggagtcttttcttctgagcagtatttctcaacagtgagcttaaaatattcaataaaccatgctataaacagatgtgctgtcatccaggctttgttgtttcatgtctagagcataggcagaatagatttactatcattctgaaggtccttaagatttgggggatggtaaatgaacactggcttcagcttacagtcaccagctggactggcccctcacaagagtcaacctatcctttgaagttttgaagccaggcattgacttctcctacccagctatgaaagtcctagatggcatcttattccaatagaaggttgttttaggctgggtgcagtggctcatgcctgtaatcccagcactttgggaggccgaggtgggtggatcaccttatgtcaggagttcaagaccagcctggtcaacatagtaaaaccccatctctactaaaactacaaaaataagctgggcgtggtggtagatgcctgtaatcccagctacttgggaggctgaggcagggagaattgcttgaatccaggagggcagaggttgcagtgagccaagattgcaccactgcattccagcctgggcaacagaaaaagactctgtctcaaaaataaataaataaataaataaataaataaataaagggctggttttttctgcattgaaaaatctgttgttgagtgtagccaccttcatcaattttcttaactggaacttcttgataacttgctgctgcagcttctacatgagcacttgttgcttcaccttgtacttttatattatggagatgacttcttaaacctcatgaaccaacctttgctagcgtcaaactttttttctgcagcttcctttcctctctcagccttcatagaattgaaaagagttggggccttgctcactctggattaggttttggcttaagggaatgttgtggctggtttaattttctatccagacctctaaaactttctccatatcagcaataaggctgctttgctttcttatcatttgtgtgtccactagagtggcacttttaatttccttcaagtacttttcctttgcattcgcaacttggctaactctttggctcaggaggctagctttcagtttatctcagcttttgtcatgccttcctcactatgcttaatcatttccagtttttgatttaaagtgagagacatgagactcttcctttcacttgaacacttagaggccactgtagcattactaattggcctaatttcagtgttattgtatctcagggaatagggatccccaaggagagggagacagatagggaagggctggttggtggagcagtcagaacacacacaacatttattaagttcaccattttatatagatgtagtttgtggcctcaaaaaaatcacaatagtaacatcaaagatcactgatcacgatgtaagaattaaagaaagaggaaagaaacatgaaatgtggctcaacagttaaggacaggtttattttagagaaaacaaacctgagaggggcttctggccaagttaggtcagagagcccttctctcttacacactaagtatatttaagggttttggaaaggggggcttgtcataggtttggaatgtttctatgtgaaggaaagtttattgcagggttggagtgtctctggtcggaggggagcctatctcagggttggtatgtttctggtcagagaggggtttatcttagggttgggatgtttctagttatgctgacattagccattaggctgatgttttggggctggatttaggtggtttttaaagagaacttacaacggtggtgttttgttcaagatggcgatgctcctgctctgtcacacagatcatcctaacagatataataatgaaagcaaataatgaaaaagattgaaatatttgttggaatcaccaaaatgtgacccagaggcacgaagtgagcacatgctcttagaaaaatgatactgacagacttgcccaaccacagggttgccacaaacctttaatttgtaaaaaacaaacaaacaaaacaaaacaaaaaaacacagtatctgcaaggtgcaataaagtgaagtataaaatgtggtatgccagtatgatcctggattgaatgatttagctgtaaaagaaattatttggataactggggaaatttgaatagagtctgtggattaggtggtggtatatgatgttaagttttcttattctgatggttatagtatgcttatgctgtagcgtctttgtgaaaaatatactctagcatattcaacagtggaggacatcacgcctgctgcttactgtaaaaaagtttagaaaaagaacaaattttagtataaatgatataaatatagcatatctatttgagagagagagagaatgatacggaaatgtgctccaatgtctacaatcaggaaatctgggtgaaagacatataggatttctttgtactgttcatgcaactttctgctatttttgaaattatttaaagtaaaatagtaaaatgaaaatagactatgggatggcaacttaattatatccatgtggtgaaatattacacacattcaaaaaccacatttagtaaatgacatgagcaaatatgttttcttaagaaatcagtatataaaactatatgtgtaatatggcttaacctgtcaaaacatgtgcctaagggaaaaagacataaaggaaatatatgacatgtaaagatggaattatcatcaaatgatgctaattctagatgatcatgtatttttattttggatttttttttttaaacgtctccaggtgtctggctcttttaagaagaacaaaatgttattctacaaaatgaaaccaacaatgagtaaactggaggctcgaatacaagtgttctctccatgctggggagcattttcccgacgccatctgaagcctcagagtagaaatcttgtttcacaaaattcaaagcttctgttcttacacctgattcctcgggaaactcttttctcctacttgtattaaccaattcagctgtgaggagcaaaggagacggggactgcccttagctgggctctgaaggtgcgtattttagcaccggctgagaactgagttagctaatcttcaaagaggctgcctgccatcccattcaacaacataaaaagcaatttgtttacgggaagaaaagccatttcaacatgaaaattggtttcacgacaatatgcctgataaaacagcacatgaaagaaccattggtcggcctctctcccctgggtccccccacaatccccgcccttaccctttctttcagaactgtcaccataatggaaaaggaagttatctcaatggaaaaacatgctggaacacattttacctctggagtaatgggccaggactgcccacacattcaatgaaaaacaaaatatttggtcattctgctccttctacccgaacgcattcgaaagcttgcaatgccatcatctagcgttcaatctcaaaaattcatccttgactccttcccttcttgttgatggtacctccagcatccagagtggtgtgtcaaagacatcacgtctaatcacgctttgcttcagcttcaaatttctcactggctcccattcactcatatattcaacaagcaggttgctattccacaccaggccagagcccatgggcatccggcaaggtcacatccatcccctctttgatgtcccaggcgcttccagaactgggccatgtacaccttcttctaagcacctcagccccatgcctaccatcttctaagcacctcggccacacccaccctcttctacccacctcagccacgcccaacctcttctgcccacctccaccatgcccaccctgggtcttctactcatctcagccacgcccaccctcttctaagcacctcagccacgcccaccctcttctacccacctcagccacgcccaccctcttctaccaacttcagccacacccacccctcttctacccacctcagccatgcccaccctcttctaagcaccttggccatgtccaccccctcagccatgcccaccctcctctacccacatcggccacacccctttctaagcacctcagtcaagtctaccctcttctaagcctctcatccatgcccaccttcttctaagcacctcggccatgtccaccctcttctaagctcctcagccatgtccatcctcttctaagctcctcggtcacctccaccctctaggaacctcagtgctctgcccctccttaacccaccctacagagctgatggctgtatttggagcaggccttcactttcaggactatatactatgttgctacttcccttatctctctttgcaaatgacaaacacctatttattctttcagatttactgagtcaggtctcctactaagccctctttaggaagagggagaagaggcccctctcctctgtaatctcgttggaatatttcaccactgttgggggaggttaggaaagcatgctcagaagtgtcctgtaatctcagcaattcgggagactgaggtgggaggattgcttcaggccaggagtttgaaaccagcctgggcaacaaagtaacaccctgtctctgcaataaatttaaaaattagctgggagtggtgctgaacacttacagtcccagctactagggagactgaggcaagaggatcacttgagcccaggagttcaaggctgcagtgagtcatgattgcacaacttcactccagcctgggtgacagagtgagaccttgtctcaaaataagagagagagagagagagagagagagagaagaaagagaggaacagagaaagggagaaggaaggaagggagggagggagggagggagggagggagggagggagggaggatggaagaagcgaatgaaggaagcaagcagccagaaccagagtcccacctccttctgctgctcctgtggacctgcccagacaattttagcacacgcagctctacagtgagacccactcagaggaaatcttgctgaaagtatttccctctccctcctatcaaaggaagacaagggcagaagccccctcagggattacaccccaaccttggcaggcagggtgtggccagtctgggcctatgtggcctatgtctgttgaatggtaggataaatgaatgaacagaggcaaccctggttggctcttgagtggtgtgagctggtcctgtacccagatactggggtggccttggcagggccctggaaccaaatgagtgttcaagacaacctcctatcggagctcatcaacttccaggacaggagagaatgtgtcactgcctctctcatgcacagtcctgggggaaagctggcaagtacatcagggctgcctgcctgtccagcccagggcgctggggccttgctctgcagtcctgtggcagctggttccccacctgggaggaggaagacagccccattgtgaatgtctctaaaacaaaaggtagaagatactagcctcctagtgtggaccatggcagactcaagctatagcaactccatgggctaagcatgaactggtgctgtgctgtccctcaacccaaggccaaggtcactggctccagcctctctgcgtcctgagaaaagtagcaacaattatccaatagaaaaattaatctcactggatgcggtagctcatacctgtaattccagaaatttgggaggctgaggtgggagcatcacttgagcccaggaggttgcagtgagccatgattgcaccactgtactccagcctaagtgacagggcatgatcctgtcttaaaaaaagaaaagaaaaagaaaaaaaggccaggtgcagtggctcacacctgcaatcctagcactttgggaggctgaagcaagtggatcacctgaggtcaagagttcgagaccagccctggcaacatggtgaaacccagtctgtactaaaaatacaaaaattacctgggtgtgatggcactttgagaccaccgacccttcggctaggcctatgcacgtgtcccaaaacaaccttttgtgtccgagggctcaaaactccaccctcagatgatgctaacatcaccattttttttttcaagacggagtttccatcttgtcaatcaggtaggaatgcaatggtgtgatctcagatcactgcaacctccgtctcctgggttcaagcgattctcctgcttcagcctcctgaggagctaggattacaggcatgcatcaccatgcctggctaatttttgtatttttagtagagacagggtttcaccatgttggtcaggctggtctccaactcctgacctcaggtgatcctcccatcttggcctcccaaagtgctgggattacaggtgtgagtcactgtgccgggccaacatcaccactttctacagatgggccctatgtcaaaacatgaggcttgattacacctgcacagtgatctgttttggatgcttgtcccctccacatttcaggttgaaatatgatctgcaggggtggttccaagatggccgaataggaacagctccagtctacagctcccagcgtgagcgacgcagaagacaggtgatttctgcatttccaactgaggtaccgggttcatctcactggggattgtcagacagtgggtgcaggacagtgggtgcagtgcaccaagcatgagccgaagcagggtgaggcatcgcctgacctgggaagcacaaggggtcagggaattccccttcctagccaagggaagaagggacaaatggcacctggaaaatcgggtcactcccaccctaatactgtgcttttctgacggtcttagcaaacggcacaccaggagattatattccgtgcctggctcagaggatcctacacccatggagcctcactcattgctagcacagcagtctgagatcgaactacaacgcggcagcgagctgggggaggggcacctgccattgctgaggcttgagtaggtaaaaaaagtggccaggaagctcgaactgggtggatcccactgcagctcaaggaggcctgcctgcctgcctctggagactccacctctgggggcagggcatagccgaacaaaacgcagcagaaacttctgcagacttaaatgttccagtctgacatcttggaagagagtagtggttctcccagcacggagcttgagatctgagaatgaacagactgcctcctcaagtgggtccttgacccccgagtagcctaactgggaagcaccccccagtaggggcagactgacacctcacacggctgggtacccctctgagatgaaacttccagaggaacgatcaggcagcaacatttgctgttcaccaatattcgctgttctgcagcctccgctactgatacccaggcaaacaaggtctggagtggacctccagcaaactccaactgacctgcagctgagggtcctgactctcagaaggaaaactaacaaacagaaaggacatccacaccaaaaccctatctgtacgtcaccatcatcaaagaccaaaggtagataaaaccacaaagatggggaaaaaacagagcagaaaaactgaaaattctaaaaatcaaagtgcctctcctcctccaaaggaatgcagctcctcaccagcaacagaacaaagctggacagagaatgactttgacgagttgagagaagaaggctacagacgatcaaacttctccgagctaaaggaggaagtttgaacccaacgcaaagaagttaaaaaccttgaaaaaagatgagacgaatggcttactagaataaccaatgcagagaagtccttaaaggacctgatggagctgaaaaccatggcacgagaactacgtgaagaatgcacaagcttcagtagccgattcgatcaacgggaagaaagggtatcagtgaaggaagatcaaatgaatgaaatgaagctagaagagaactttagagaaaaaagaataaaaagaaatgaacaaagcctccaaaaaatatgggactatgtgaaaagaccaaatctacgactgattggtgtacctgaaagtgacggggagaatggaaccaagttggaaaacactctgcaggatattatccaggagaacttccccaatctagcaaggcaggccaacattcaaattcaggaaatacagagaacgctacaaagatactcctcgagaagagcaactccaagacacataattgtcagattcaccaaagttgaaatgaagaaaaaaatgttaagggcagccagagagaaaggtcgggttacccacaaagggaagcccatcagactaacagctgatctctcggcagaaactctacaagccagaagagagtggggaccaatattcaacattcttaaagaaaagaattttcaacccagaatttcatatccagccaaactaagcttcataagtgaaggagaaataaaatactttacagacaagcaaatgctgagagattttatcaccaccaggcctgccctacaagagctcctgaatgaagcactaaacatggaaaggaacaactggtactagccactgcaaaaacatgccaaactgtaaagaccatcgaggctaggaagaaactgcatcaactaacgagcaaaataaccagctaacatcataatgacaggatcagattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaagactttaaaccaacaaagattaaaagagacaaagaaggccattacataatggtaaagggatcaattcaacaagaagagctaactatcttaaatatatatgcacccaatacaggagcacccagattcataaagcaagtccttagagacctacaaagagattagactcccacataataataatgggagaatttaacactccactgtcaacatcagacagatcaacaagacagaaagttaacaaggatatccaggaattgaactcagctctgcaccaaacagacctaatagatatctacagaactctccacccaaaatcaacagactatacattcttctcagcaccacactgcacttactccaaaattgaccacatagttggaagtaaagcactcctcagcaaatgtaaaagaacagaaattataacaaactgtctctcagaccacagtgcaatcaaattagaacttaggattaagaaactcactcaaaaccgctcaactacacggaaacaacaacctgctcctgaatgactactgggttcataacggaatgaaggcagaaataaagatgttctttgaaaccaacgagaacaaagacacaacataccagaatctctgggacacatttaaagcagtgtgtagagggaaatttatagcactaaatgcccacaagagaaagcagggaagttctaaaaatgacaccctaacatcacaattaaaagaactagagaagcaagagcaaacacattcaaaagctagcagaaggcaagaaataactaagatcagagcagaactgaaggagacagagacaagaaaacccttcaaaaaatcaatgaatccaggagctggttttttgaaaagatcaacaaaattgatagattgctagcaagactaataaagaagcaaagagagaagaatcaaatagacacaataaaaaaagataaaggggatatcaccaccgatcccacagaaatacaaactaccatcagagaatactataaacacctctacacaaataaactagaaaatctagaagaaatcgataaattccttgacacatacactctcccaagactaaaccaggaagaagttgaatctctgaatagaccaataacaggctctgaagttgaggcaataattaatagcctaccaaccaaaaaaagtccaggaccagacagattcacagccgaattctaccagaggtacaaggaggagctggtaccattccttctgaaactattccaatcaatagaaaaagagggaatcctccctaactcattttatgaagccagcatcatcctgataccaaagcctggcagagacacaacaaaaaaagagaattttagaccaatatcccggatgaacatcgatgcaaaaatcctcaataaaatactggcaaaccgaatccagcagcacatcaaaaagcttatccaccatgatcaagtgggcttcatccctgggatgcaaggctggttcaacatatgcaaatcaataaatgtaatccagcatataaacagaatcaaggacaaaaaccacatgattatctcaatagatgcagaaaaggcctttgacaaaattcaacagcccttcgtgctaaaaactctcaataaattaggtattgatgggacgtatctcaaaataataagagctatctatgacaaacccacagccagtatcatactgaatgggcaaaaactggaagcattccctttgaaaactggcacaagacagggatgccctctctcaccactcctattcaacatagcgttggaagttctggccagggcaatcaggcaggagaaagaaataaagggtattcaattaggaaaagaggaagtcaaattgtccctctttgcagatgacatgattgtatatctagaaaaccccattgtctcagcccaaaatctccttaagctgataagcaactgcagcaaagtcccaggataaaaaatcaatgtgcaaaaatcacaagcatgcttatacaccaataacagacagagagccaaatcatgagtgaactcccattcacaattgcttcaaagagaataaaatacctaggaatccaacttacaagggatgtgaagacctcttcaaggagaactacaaaccactactcaacgaaataaaagaggatacaaataaatggaagaacattccatgctcatggataggaagaatcaatatcgtgaaaatggccatacagcctaaggtaatttatagattcaatgccatccccatcaagctactaatgactttcttcacagaattggaaaaaaactactttaaagttcatatggaaccaaaaaagagcccacattgccaagtcaatcctaactcaaaagaacaaagatggaggcatcacactacctgacttcaaactatactacaaggctacagtaaccaaaacagcatggtactggtaccaaaacaaagctatagaccaatggaacagaacagagccctcagaaataatccacacatctacaactatctgatctttgacaaacctgacaaaaacaagaaacggggaaaggattccctatttaacaaatggtgctgggaaaactggctagccatatgtagaaagctgaaactggatcccttccttacaccttatacaaaaattaattgaagatggattaaagacttacatgttagacctaaaaccataaaaaccctagaagaaaacctaggcaataccattcaggacataggcataggcaaggacttcatgtctaaaacaccaaaagcaatggcaacaaaagacaaaattgacaaatgggatctaattaaactcaagagcttctgcacagcaaaagaaactaccatcagagtgaacaggcaacctacagcacgggagaaaatttttgcaatctactcatctgacaaagggctaatatccagaatctacaaagaactcaaacaaatttacaagaaaaacacaaccccatcaacaagtgggcaaaggatatgaacagacacttctcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggtgttggagaggactgttacactgttggtgggactgtaaactggttcaaccattgtggaagacagtgttgcgattcctcagggatctacaactagaaataccatttgacccagctatcccattactgggtatatacccaaaggattataaatcatgctactataaagacacatgcacacatatgtttattgtggcactattcacaatagcaaagacctggaaccaacccaaatgtccaacaatgatagactggattaagaaaatgtggcacatatacaccatggaatactatgcagccataaaaaataatgagttcatgtcctttgtagggacatggatgaagctggaaaccatcattctcagtaaactatcgcaaggacaaaaaaccaaacatcgcatgttctcactcacaggtgggaattgaacattgacaacacttggacacaggaagggggacatcacacaccagggcctgttgtggggggaggggggagggatagcattaggagatatactaatgtaaatgacgagttaataggtgcagcacaccaacatggcacatgtatacatatgtaacaaacctgcatgttgtgcacacgtaccctagaacttaaagtataataaaaaaaaataaaaaaaaaaaacaaccaaccaaccaaccaaacaaacaaacagaaaaaaaaaaaagaaatatgatccacagtgttagagatggggcttggtagatgatgtttggatcgtgaatggattggtgcccatcccacagtaatgagttcacatcaaatgtggttgtttaaaaaaaaaaaaaaaaaagtctgggccaggtgcagtggctcacttgtaatcccagcactttgggaggccgaggtgggaggatcacttgagcccaggaattcgaggccagcctaggcaacatagcaagaccccatctctacaaaaaagtaaaaaaaagaaaaaaaagaaaaaagaaaaaaagaaaaaaaaatagccagctctggtgcctgtagtcccagctactacttgcaaggttgaggcaggaagattgcttgagcccaggagtttgggtctacagtgagccatcattgtgccactgcactccaccttgcagcctgggtgacaatgtgaggacctgtctcaaagaaaagaaaaaagaggctgggcatggtggctcacgcctgtaatcccagcactttgggaggctgaggcaggcggatcacctgaggtcaggtgttcgagactagccaggccaacatggcaaaaccccatctctattaaaaatacaaaaattagccagcaatggtgacaggcacctgtaatcccagttactcaggaggctgaggcaggagaatcattggaaccctgagatggaggttgcagtgagccaagatcataccactgcactccaggctgggtgacagagtaagacaccaccaaaaacaaaaaaaagaaagaaagaaagaaaaaaaagaaggaaggaaggaaggaaagaaggaagggagggagggagggagggaggaaggaaggaaataataattaaaatgagcctagcatctcctgctctttctcttgttccctctctcgctctgtgttatgctggtttcccttcaccttctgccataagtataagctccctgagtcctctccagaagcagatgctgacactatgcttcctgtacagcctgcagaaccatgagccaaataaacctctattcttggccaggcacagcggctcgcatctgtaatcccagcactttgggagaccgaggcgggtggatcacttgagaggtcaggaataccaaaccagcctggccaacgtggtaaaaccccgtctctactaaaaatacaaaaattagctgggcgtggtggcagtcgcctataatcccacctactagagaagctgaggcaggagtatcatttgaacccagaggtggaggatgcagtgagctgagatcacgccactgcactccaggctgggtgacagagtgagactgtgtctccaaaataaataaaattaaaattaaaaaacccctctattctctataaattacccagcctcagatatttctttatagcaacacaaaaacagattaacacacacagaaaccctgattagctcacctttcccaccctcccctcaccgttccccacactttagaccatgctgccttctatcccataatactcccattccctattttcagggaggcagatttgagatttgttctcctatctcctcacacagcactgcattgtgaaatcttttctcttttgcaaaaactcattaccacagtgattggcttcttgcacatgggcagaaaggacctggtcactaacaggcactgctataggagttaccaggacaggccaggcaccgtggctcatgcctgtaatcccagcactttgagacatggaggcgggcagatcacctgaggtcaggaattcgagaccagcctggccaacatggtgaaattcttgtctctactaaaaatacagaaaaaaaaaaattagccaggcatggtggcagatgcctataatccaagctactcaggaggctgagggcaggagaatcagttgaacccaggaggcaagaggttgcaatgagccgagatcgtgccacactacactccagcctaggcaacaagagtaaaactccatctcaaaaaaaaaaaaaaaaacagatagaagttaccaggacagacagtagctgccttctgttgagcagaagatcttcacgaatcttttgcatatgcaagatggagcccaagttccaatttgcttgagggggcctaaattatttgaatcaataaataaaaaggaaactgagttataaaatactttgtatgttttaggaatggatccagtgcctgggatagaggattgaagaagccaggcaaggtccctgttctcccaaaacttatgttctagggggtttactcacaagtaaacaagaagaatgtttcagatggcagcaagtgctattaaaaaaaacactgataaagcaggcagtgtgctgagatgaccgggagggtaagaggctctcccttgagataaacatcagggctgagactcatatagaaaagggagccagccatgtggaatggagtggcagagctgcctaggcagggaacaaccaatgcaaagatcttgagagggtgagcttgatattggcagagcagagagaacgtgagaggggctgagaaaggctacattgggcctctccacctaccagccatatatactcttgggcaagtttcttccttctgtgtgtctcagttttttcatttgtaaaatgggaatgttactaacatcaatcgtgtaagtttaaggactcagtaatgtaaaacatgcaaagtatacttgtccagcatagagtagatgctcaataactatttgctgtgatgatatgatgatgatgatgatgatgatgatgatgatggtgacgatgacactgttgtcatgagcctgcatcatgaggctgttcacaatgacaaaagccttaggcactatctaccagctggccatattatcacccttggccctcacactgccttcccgtccttgctatctccctggttagattctcacaagctcatcattgcctgtaagacgatcctgtatccatttgttagggctgccataacaaaggaccacaggccaggtggcttcaacaacagaagtctattgtctcactgttctgggggctagaatttgccatcaaggttatatgtagggttggtgccctccaagggccttgggcaagaatctgttccatgcctccctctgctcgcttcttggagtctgctggcaatctttagcgttccttggcttgtagatctctgccttcatcttcacgcaatcttctaatgttcttcctgtgtgtgtctctgtcccaatttccccttttataaggacactagtattagactagagccatcctaatagtctcattttacctcgattatctcagtaaagatcctatctctaaatgaggccacattctgatgtacttgagggttggggcgccaacatattattttttgggaggacacaattcaaccccgtaatagacccacacgtcacattcaggagtctatcatcagtgctgcctcccacttgggggaccctttccaatgcgctaccttctcccacatcctgctctcagccagggaacgttctgaatgtgcctgcaagactaaccagctaccttccacccatgtgcctgcccagcagatatcgtttttgttgttgttgttgttgttagagacagggtctcactccatggtgtaggctggagttcagtagcacagtcatagctcactgcagccttgaactcctgagctcaagagatcctttgatctcagcctcccgagtagctgggactacaggtgcatatcaccacacctggctatttttattttttatttttatttttattcttttctttttttttttttttcaagacagaatctcgctctgtcgcccaggctggagtgcagtggcgtgatttcggctcactgtaacctccatctcctgagttcaagtgattctcctgcctcagcctcccaggtagcttggattacaggcacccactactgcccagctaagttttgtattttagtagagatggggtttcaccatgttggccaggctggtcttgaatgcctgacctcaagtgagacgcctgccttggcctcccaaagtgctgggattacaggtgtgagccgccatccctggtctatacattctttccaaacccaaagctatgaagagatttcataggtctctgcctcccctatggggagaccagggttctctgtgaaaacaaaacaaaacaggatgttctgtttatgccaagatgactgtggcttcaaggccttccctctcacatctgcacccatttctgttggtgtctgatttcctgtgagagccctagagagctacgatcttcacatagctggagtttgcatggtgcgagagagcaacacatgaaagagatctttctagggcttcttcagtccattagcatctgatgactagtgaccagtttgatacaacctatctacctgccaggaaccacaggtctcagcagtccacaagcccagcaataggaacaacactgaggaatccatggttatggtcctagaagcagaaacttgagatgtttcccggccaaagctggtgcacattgccctccaggaaaattcaggtcctcagacttcaattcccagctaccagccgagagagaggcaccagagaggattagagtttttcctagtttttcttaggttctaaacgtgacaggaagcattccccaggctacagacttgttcctctaggctgtacaaaatctgattcaggtctttccaagctgggaaaggttatctgaggtcactccatgggggagaagaataaacaactccaaataaggcactgtttgtccccagactgttccttgccagttggacaaacacactcaaatacaaagctgttttgtcagtatctgagctatgtccctttcatggctgagtatcaatcaaagcaaccactagaacaggctagaacctcagtgttcacactgggctcccccggctaccagaatcaagccacttttcctataaatcagtcacaaacagtgaatgttaagactggcacttcttgcttagagacccaaattctgttccaagaagagtatttaaggatcttcctctaacaccccttggctgcagcaatcttacctgccaggggacattattacagcaagatcacacctacgcgtgggctgctccaccaaaaaatatgcccactgttccagtaggagagatcctgcctctctctgcccttggggaacctctagggcagacgtggtggcaggatcttggtcagaaattgtctacctgctgccagtactggatttctggaaagttgtcagccaggtgcattggctcactcctgtaatcccagcactttgggaggtcgaggtgggaggactgcttgaggcaaggagttcaagtccagcctgggtaatataacgagaccttgtctctacaaaattaaaaaaaaaaaaaatagccaaggatggtggtatgtgcctacagtcccagctactcgggaggctgaagcagaaggatcacttgagccggagttcaaggctgcagtgagccatgattcgtcactgcaccctagtctggccaacagagtgagaacctgtctctaaaaaaataaaaagaaaaaagaaaaagaaagttgttagaaaaaggccctctctgagtaaggggaggtctgtatggtgccctggcctttcatcgcaggacatccactgggtagtttctgccactgggcacttgaaggatgctttgaagcactctgcctagtatcagcctgggagctggtcctggctaacctgggctttggtggttagaatgatttttaaatgtgcccagtgctcttgacatgagactttcatttttccaaggcagcctgaaccactaacaattcgcatttcggggcagtggagtggacactggcccagagtaacttctctgtgaattggacactaggagggaggtctccaagactggatctcatgatgagatgtccctgcaatggtgttggaagcatcccttttaccaggaaagcctcaggctagatcacagaaggctgggattgggaaaatagaaatggcttcaactcctagaaagataaaataatgacctagggccagacaaactgcttcttttaactaaggagggaagtaaaattaaaaaaaaaaaaataggggcatactacgggattatggacaccttgtccagcgtcatgcaaaatgccttggccaagccaaacttgaacttgaacttaactctcaaagctcgccatctacatgtctgacgactggcccagaagaattcatttgccgtcagtgaaagactggccaaagatgcttgatgaaaagtcctcaaatatcccgaattagcctctgaagctctggattataaaagcagaaggtaaactcacatgggtaccatcttgaggataccaatgtgtcagcaatgtctctacacaacactcttatttgcaaagggcactgaacacccgagatgtaaatggcctgagaaacctttaccctttttgccctgatataaccacagagggcctctgtgtctccctctactaaaactcagatgttgaagtcctaacctccagcagggcttttaaggaggttatggggttaactaaggtcatagggtaaggcttaatccgataaggctggtgtccttaataagaagaggaagagagccaggcccagtgtctcatgcctgtaatcccaatgctttgggaggctgaagagaaaggaggattacttgagcctaggagttggagaccaactcaacataatgagagcaacataatgagatcctgtctctacaatttttttttttaattagctgggcatggtggtgtgtgcttttagtcccagctactcaggaggctgaggtgggaggattgcttgagcccaggagtcggaggctgcagtgagctatgatcacaccactgcactccagtttggacaacagggcatgatcatgtctctaaaaaaataatgataattaattaatttttaaaaagaaaaggaagaaacaccagggatctcactttctctccctgcatgcccagagggaaggacatttgagggcacagtgagaaatgaccatctgcaaggcagaaagagaggcttcaccagaaaccaatcttgccaacaccttgggcttccagcctccagaacagttagaaaatatgtgttgtttaacaaggtcaggagatcgagaccttcctggctaacacggtgaaatcctatctctactaaaaatacaaaaaattagccgggcgtggtggcaggtgcctgtagtcccagctactcgggaggctgaggcaggagaatggcttgaacctgggaggcggagcttgcaatgagccgagatcacgccactgcactccagcctgggcgacagagcaagactctgtctcaaaaaaaaaaaaaagagagagagaaaaagaaaaagaaaatgtgtgttgtttaagccacccattctgtgacacttggttatggcagcctgagcagacgcatagagcttcatttggagttccaaaagtgagtgatcctattggccagagaccctttgtactagggagggctataatgccaaccaaggggcaatatattagtttcccatttctgctgtaacaaattaccctaactctatggcttaaaaccacacaaatttgttatcctatagctctggatgtcagaggtccaaagtgagtcttatggggctcaaagcaaggtggtagctgggatggttccctctggaagctcagcaaataatccattccttgcctcttccagctcccagacaccaaccatggctccctcctccaccttcaatgccagctgaatagcattttttcctctctctaatctcctgcctcactcttataaggacccttgtggttacattaaacccactcagatactccaggagaatctcttaatcacatctgcaaagtcccttttgccatagaaggtaacatattcagaggttccaaggttaggacatgaacatctttgcaggggccatcattcagctaacataggcaactagtggtccaaaatcacccaatgagattctctagaagaggacaaaccaaggagaacctggaaggccatcagggtccagcaatggacttccatgtttaagcaaaaaaatggcatgggcttaccaaataatggaagattgttttcctaaggaaaccaagcaatagaaggattataggcaaaactgcttggataggacaggaccagctgctcagaaaggacccctgaatacagaatgctgtgaagagccccctgtatcttcagaccatggtgcaaagaggcactctccggcagcatctgcccaaatgtgggcacctgatggagagtaggcagtcgggcccacaacactaggacccaagccacaaagcctgactaatgctcacactgactggcctggaggcaagactccatcactgcctctgtgcctggaagccagcacagagccatcccttggggaagggccccatgagtccccatgtcaccaccgtagcgacctacaggcagagcttggtgcagctcaagctgggcatcccaacacattgggccatgctcaccaccatccagacataagcgccctactggggcaaagtgttctgtttgtatcataatctcctcactctgagggatgcacctcccgtggtgggagtgctctgggggacagagacacagaagccaccagttccttctaaagctgcttcaggatgatggggctgaatatcacaaccccacctgcaaaaacctcagaggcagagacttcaaatcacaaagcacttcatgcacttgtaagtctctgtgagtggtgatgctgagtgttgagaggatgccaggattactaccaagacataacctctgcctacagagagctgtgattgccatggttgagacagatgctcatgaaatgacataaacgccagtcaaattgatggaagtataaaacaatgtactaatttattaacaaataccagcagaatgtacaaaccaatcggttgagcccatctgtcctagtgggagatcttgatcgatgacatgggaactactggtcagagctcattcattcattcattcacttacccatttggcaaatatttgttgaatgcgttgcatgccaagtactgcacacaacaacgatatgcaaagatgaataagacatggtccatgtcctcaaaaattcctgatctaggaagatagacaagtaccttaaaatacgctggctgggtgcagtggctcacacctgtaatcccagcactttaagaggccaagacaggaggagcacttgaacccaggagtttgagaccaacctgtgctacgggaggactcaggggcttccaacaatgcctagtgagagaaaggtccggaaagtttcccagagaaggtgacatttccactgaaatgtgcttccagagaaggatttaatcatgtaaagtgagaaacaaaaagacttttaggaagacaggggaaaaaaaaaacagggtatttttgaaaaactgaagaaagttccagaaaactggaggagaggaggaaggagaagtggaaatggagggacagacctttccaatttccagaagatatgaattcacctcaggggcaaaggaaaaccatttgaaagttagtcagttagtttgtttgtttgtttgtttgtttttgaaagagttttgctcttgttgcccaggcaggagtgcagtggcacaatctcggctcactgcaacctgtgcctcccccattcaagcgattctcttgcctcagcctccagagtagctgggattacaggcacccgccaccatgcctggctaatattttttatgtttaatagagacagggtttcacaatgttggccaggctggtcttgaactcctgacctcagctgatccacccatctcggcctcccaaagtgctgtgattacaggtgtgagccactgcgcccagcccatttgaaggttttaagagaagattcacagaatcagatttatatttcactcattcagccagccaagacatatttagtaagtacctttgatgtgagaggctctgctctaggggataaaagcaggaacaaaacagacaaggtctcttccgtcatgtagtttacattatcatgagagatgctgacaataaataactaagcacataaattaatacaataattaaacactttggaaacatccccctggcagcagcaatgtggggagaatggattgaaaggaagcaagaccagaaacaaagagaaagagtaggaggccctggccgtagtccaggcaggagatgagtttgcatgaggcagatcatattgaatgcctcccccaaaatattccttccccactccacctctccaatccaaccttcgtcctggccagcagaacctgcttcccacaccaacagctgaaaatgccagaaactcactttcacagccttgtttagctacagtgtggagaagtgacccaatcatggccactgagacctgagagtaaggctacagagggccctcatgggtaggctttccttccccgtaaagagtgacatgacacagcaagacacatccctcttctttgcttgatgtgtatctgcaagtcgtgctgagaactgttgctggcatcttgtgatgctgaggactgaggcattaagggtagtggagcgagtagtttgaaagtacccgagtcttgatgccatttttgactcactaaatcagccctgtagctgccctatctcttacctcttattatgtgagatttatttatttatttgtttgtttgtttgtttttgagatggagtctcgctctgtcgcccagatccgagtacagtggtctcgactcactgcaacctctgcctcccaggttcaagcaattctcctgcctcagcctcctgagtagctgggattacaggcataagccactatgcctggctaatttttatatttttagtagagatggggtttctccatgttggccaggctggtctcaaactcctgacctcagatttccacccacctcaacctctcaaagtgctgggattacaggcatgagccactgagcctggctgttattatgtgagatttttaaagaaacaaacaaaaagcctctcactgatgaaggcacttttggttgggtattctgtttattgcaatcaataatggcttcagtgatatgctgtgcaatgctaggacacttgtggtagagatttaaagaactagagcctgggcaatatagcaagaccccatctcaaaatcattttttaaaaattagccaggcatgtggtgtgtgcctgtaatccagctacttcagaggctgaggcagggaggatcacttgaacccagaaggctgaggctgcagagaactatgaccacgccactgtactccagcctgggcaacagagcgagaccctgtctctaaaataaaataacacagccaggcatagtggcttatgcctgtaatcccagcactttgggaggccaaggcaggtggatcacctgaggtcaggagtttgagacccgcctggccaacatggtgaaaccccacctccactaaaaatacaaaaattagctacgcatggtggtgggcgcctgtgatcccagttactagggaggctgaggcaggaggatggcttgaacctgggaggcaaaggttgcagtgaaccaagatcacgccactgcactccagcctgggtggcagagtgagacttcatttaaaaaataataataaaataaaaagtgggtaggtgcaaaaaatatttagaaagaagaattgacagagctgagtgatttccactgaaggtgaaagaaacagatatctctgaagtctgtgaccagcagcccaacagacagaccattaatcactgtgtcagggaacacaaaaagaagagcagatgtggacaacttggaggttcccttgcgacttccaaagtgaaggcaggtgagaacagacagaaaggcaagggcttgtctgggcaaccaacccaaacaagtccatctggtattcccctatcctgtgggtctgcacactaagttacgtagtaacacagagaataacatggttattctactgagatgctagggagagattagattgccataaaatatgactccctgatgagttctcatgatggccacaggaaggaagagacatccgtcataatcatcagcattaaagaacactatttattttctttttagttttttttttttttttaaacagagtctcgttctgccacccaggctggagtgcagtagtgcaatctagtgccactgcaacctccagctcccaggttcaagcgatgcccctgcctcagccacccgagtagctgggattacaggcatgcgccaccatgcccagctaacttttgtagttttagtagagatggggtttcaccatgttggccaggctggtctcaaactcttgacctcaagtgatctgcccacctcgacccctcaaagtgctgggattacaggcatgagctaccatgcccagccagaacactttatttttatgcaacactaaagtaagcctctaacacttagtatttgcacaacatggatatttgtggatccattgcaaccctgataaataacagtgggttcatgaattcaaagctctgctatagtaaggagctacttattatctcagcttatcttagaatctcagctccctccagcctgatattctgaggactgggaggggcacgccgctgatggcaagcccctgcatggagaaaggttaccagcaccatggctgctgcagcactgtccccaagctagccctgcaaccattcccaaaatcttccttccataccggatagaaagctaggagaagtcaaatactcacttcccagcctcctttgtttgaagggatgaccacggaactcaatcttggtcaatgaaacctaaccaagttaaacagaagctggcagggagcttctgggatatcttgtgcttttctgatgaaaagggcagacagagctgggtccctccatgtcccttctacagagtcaggtcaccatggcaggagcttcaacagccattttttgaccatgaggagaaacgtaaactaactaactcaataaataagaggatgacataaggaggattccctgccttcacttgggaaatctcaagggaacctccaaattgtccacatctttctttctttctgtattccctgacatggtgattaatcatctacctgttgagctggtggtcatggacttcagaaatatctacctctttcaccttcagtgataatcacccagccctgtcaattctcctttctaaagaagaataaggtggagaaggatggaaagaggcctaaataatgtcataaatcagttgaatccaaggtagtggctttctaccccagatttctcatataaaacaatggcaaaaaaattctatttgcttaaggcactcaatttgtttacttacagctaaatatatcctaaattatctagaatttggtacctaaaatggtggctggaggaaacagaccctaaaatgtggaactctctgcctgaaggaggtagaatgctgggcaaagaagactcaactattttgagctagaaagttggcgattcttgtaccgcatgttctcacttgtaagtgggagctgaatgatgagaagacagggacacagggaggggagcaacacacacgggggcctgtagggggcagtggcgggtgggaagagggagagcatccggaagaatagctgatggatgctgggcttaatatctaggtgcagcaaaccaccataacacatgctcacctacgtaacaaacctgcatatcctgcacatgtagccctgagcttaaaacaaaacttgaacaaaaaaagaaaaaaagttggtgattcttgtaatgtcatggaggcaaatctaggaactgaatgatataatactttatatatatattatatatatatattaggattttggtatatgtcagttccttctagaagttttcaacaacattctataagacagagacaaacttagaatagaggtaactgatattatagcacagaaagaataaattacatctttgctactagaggctctctctgccttctacttggaaacaaaattcactgagagtcacataatctattaccttgagtcttaagagccaatttctgtgccctaaattaaatatataacaattgttggcagaaagtattggtttcagtaatggcagagtagctcttatcagactaaccctcctacagataacagcaataaattctaaacaaaatatggaaaataaatatttgaaggcataggatggtggccaaaagcagatagaaagtgaaggggatcagaatcttgggggttaaaaaacaaagaggatatatgggccaggcatggtggctcatagctgtggtcctggcactttgggagaccaaggtgggcagatcacttgaggacaggagttcgagatcagcctgggcaacatggtgaaacccagtttctactaaaaatacaaaaaaaaaattagccaggcatggtggtgcatgcctgtaatcctagctactcaggaggccgaggcaagagaatcacttgagcctgggaggcagagattgcagtgagccaagatcatgccactatactccaccttgggcaacagaacaagactctgtctcaaaacaaaaaaacaaaaacaaagaggacacatacatgtttatatggcttttcttctgaagatactcctctgtcagtatgagccatgaggtggttagaacttaaggataacttaaagtcttaatggatcaaggtgtcagatacaaagtttggggctgccagaagagttacaaatagaaaggaaatattccagaaaggagagagctgcacagggcaaagcctttcaaatccacagctgacctctgaactgctcaggcacaggagcacaaggggacagaattgccagaatgctgaaagtgctgagcagagatttcagctgccgccctccatagaggctggagagacagagtttggggttcaaatcttgtcaaattacagagattggcaaaacgtttggaatttcaattgaaactagaagggctagtcccttgaaataaaaactaagtcccaaaactgaggggttcatcctagaatcaaggacaaaatagaaaaatgccgtaaaagagcataagaacaaatttctataaagtcaaggtgtttggacaataactgcttttgagaataaaaacaacattattcaagaaaaagagcataattaagattctttacaaggcattatccacaatgtactacaagaaaaaaacttattggagattaaaaaaaaaaaaaaaaaacagaaaaacatgtcacatagtggaaaacacagtcaatagaaacagaccccaagatgactcgatattgaaattggcagataaggactttaaaagaggaattaaaatgaagttcaaagactcagaggaaaatatgtcctaataggtgactagatggagaacctctgcagagaaacaaaaactattacaatgaaccgaataaaaattctagaactaaacagtatgatatcagtaataaaaagttcactggatgggcttaacagaagattagagatggcagaagaatcaacgaatttgaagacagatcaatagaaatcatccaatctgaagaacagaaagaaaaagatacagaaacatattgatggagattcagtgacctgtgagacaatgagagatttaacatacatgtaatgaaaatccaaaagggaagacaacataaaagaagaaatatttgaatatataacaagtgaagatttcccaggcttcctgatgaatccatgatcagactaccacaaacaagataaaggcaaaaagaaagaagaaagaaagaaaaaatgtaaagaaaggagataaaagatcaagaaagaagaaacctatacacattaaagagagagaaaaaacggagtaggatggactctaatccaacaactggtatccttttaagaagatggccatatggaccaggtgcagtggctcacgcctgtaatcccagcactcagggaggccaaggtgggcaggccatctgaggtgaggagttcaagaccagcttggccaacatggctaaacctcatctctactaaaaatacaaaaattagccgggcatggtggcacatgcctataatcctagccactctggaggctgaagcagcagaatcacttgaacctgggagccaagatcacgccattgcactccagcctgggtgacaagagcaacactccgtcaaaaaaaaaaaaaaaaaaagaagaagaagaagacagagacacataggaagaacgccatgtgataataagggcagaaaatggaattatactcttatatgccaatgaatggcaaagattgctgaaaaccactagaagacagaaagaggcaagaaagtagaacgttctccctgcaggtgttagaggaaccacagcccagctgacaccttcatttcgaacatccatcctttagaactgtgagaaaataaactgacactgttttaagccactcagttcatagtacactttgtgatggcagcccagaaacatggttacatgagtatatacattttttgtgtatttgtttcagagacagggtttccctctgtcacccaggctggagggcagtggcatgatcatggttcattgtaaccttgaatttctcctcccacctcagcctcctgagcagctaggaatacaggtgcgtaccaccatgcctggctaatttgttaatttgggtggtattttttagggtttttgtttgttttttgtagagacagggtctcgctatgttgcccaaactgacctcagactcccggcctcaagggatcctcctgcctcagtcttccaaagtcctgggattacaggcataagccactgcacccagccaagtatatacttttaagtggttacataggcatatacatttaccaaattcatcaaattgtgcaccaaagccctatgcatttcactgtttctaaattgtaaattttaaagtgtaaacaaggaagcagatgttttaccaagatataagattaaagaccctggtagcaaagaacaagttcaccatggtatctgcccaccagaacccagaacctaccgtttcaaatttcttcaaggcaactgcccatacatttaggtgtaagaaggatggtagaaactagaagtggcggccaggcatggtgactggcttctgtaatctcagcactttgagaagccgaggcgggcagatcaagttgaggtcatgagtttgagaccagcctggccaacagggtgagactgcgttcctactaaaaatacaataaattagccaggcatggtggtgcatgcctctaatcccagcaccccagctactcaggaggctgagacaggagaatcgcttaaacccaggaggatcgcttaaacccaggacgcagagtatgcagcaagttgagatcacaccactgcactccagcctggccaacagggccaaaaactctgtctccaacaacaacaaacaaacaaacaagcaaacaaagaaaagcgaaaatgggaagggaaaagaattatcaaattttaaaaatggagcctaaataatctctttatccatggtactaacatttaaaattgcccagaaataaataaaacttaagccatgagggctgtctccttgaggaaggttgagtgtatactagataaaatgcagggaagaaggaaatgaattgtgtttgtaatgccaggtagccaggttaaacaatttatatgcattgcactgcattttatcaattcagatggaaacccttgaaccgtgatgttgccaagaaactgcaccagtaggcatgttaggatcaaccaactatgtggggctgctacccaaattgtgtaatagacctttttaggtggctgacccagcaattttccgaacctccttctcctttctcatgctttgctacagaggctagagaactaaacatttactgttccagcctcacttgcagtgagcactagccatgtattacagtcctggctaataaaaacattagaagaaagcttatattttcaaacaaaggtgtctcaggaggtgaaggtgttttgccctggttcaggtttctgttttttgtttgtttgtttgtttttgagacaggttctcgctgttacccaagctggagtacagtggcatgatcatagctcactgcagcctctaactcctaggctcaagcaatcctcctacttcagcctctggagtatctgggactacaagtatgagccatcatgcctatcacggtcttgctgtgtcttgcaacggtgttgcccaggctggtcttgaactcctggtctcaagtgatccttccacctcagccccctcaaagtgctgggatcacaggcatgagccaacacaccaaggtgaaatttcttattaagtgagcagtgattgtctttgtgacaagccactgttcatcaatatttctattacttgctacaaaatgcattcctaattgataaaactaacaactacctccctcctacctaacagtcctaacaaacaagagcaaaatatgggaaacagagtggagtggcaaacggattatgtaaatataccaagcattcttcaaaggctatgaatagatcagagtttacttgttggctacctctagcataaaaataccaaggtagtccaggcgcggtggtggctcacgccagtaatcccagcactttgggaggccaaggtgggtggatcatttgaggccaggagttcaagaccagcttgggcaacatggtgaaaccccatctctactacaaatacacaaattagcctggcatggtggtggcatgcacctatagtctcagctgaggaattagaattgcttaaactgggaaggtgaaggttgtagtgagccgagatcatgccactgcactccagcctgggcgacagagcaagaccctgtctcaaggaaaaaaaaagaaaaagaaaaagaaaataccaaggcaaaaataaagcagttaataataaaagaaggagaagaagtaaaataagaattgttaacattcattgatggctttctaggttctaagtaatttacatgcattgtgttattaattcagatggaaacccttgcaccatgatgctgctgagaaacaataccagtaggcatgttgggtcaaccaagtacgtggggctgctacccaaattgtgtaatgagaaaacaatagtagattgagaatcagtagactaacattctagtttcttttttgttgttggttttgtttttgtttttttgagacagcgtctttctctgttgcccagcttggaatacagtgatgcgatctaggctcactacaacctctgcctcccagattcaagcaattctcctgcgtcagccttcccagtagctgggactacaggagcccgccaccatgctcagctaattttcgtaattttagtagagatgaggtttcaccatgttggccaggctggtcttgagctcctgacctcaagtgatccaccctcctcagcctcccaaagtgctgggattacaggcataagccaccgtgcgcagctacattctacttttcacactgctagtcacatgctctgtgaatttgaagaatcatttaatatctctgagatggtttttcttcccttaaagacagacgttggagaaaattatttgtaggatgcacttgacatcaaacatcctaatttccaacctatttagtttggctgaagtaatttggctggatttgtaacaattcatggaatatttatgaaacatcacagtcatgtcaagagagcaacagcaattgattatcccaagctccaaagacttggcagaaatagtcaaagcaggatacggaagatagaattctgctaataaagataacttcctaagcactctcaacaagcttatacagtagctgtgaacttaataaaggaattattgcctgggcaagatgtgaatttgttgccaaatttatgcaatctatgttaatggccagaaactatgtttaactgactcagggatacagtgatggcttattttgggttttctccaaaagcaaaatttcccttcaaaattatttctcccctgaagctagcattaaaattcatttacattttctcaacacatacttaatttttgcaaacaagcaaaaaaaaaaaaaaagaaataacttgggaagaggatctgagtttgaaatattcacatagacagtccaacgatctataatctgtagggtggagaatcaaaggttgattatttgtgaactagactgtgaataaattttttaaaaagttattcaagatgcagaaaattgcatgcatacgtatttatgtttggcatcagtagtaaaattacattttctaatgaatctacagctcagggctttaaaatgtggatcttttaaaatgcaccaagcaaaattccaagcattacaagaaatgttttatttataatgtttgtgtgaagctagacgtggcacccatctgtctcttccaatatattttcacaactggatttatagactgtaactaaaaaagtaaaagagacagtgttctgactcctgtgtagtctaattcagtctattatcataattttatttgttataagctgtcaatacaatatgccatactacccttcctctgccagtttcatggcagtaagttttgtgtcccctttctgagaaacacttcaaggatgcctgcttattattattattattatttttttttttttttttgagatggagtttcactcttctcaaccaggctggagtgcagtgatgacactgcggctcattgcaacctccgcctcccaggttcaagcgattctcctgcctcagcctcccgagtagctgggattacaggtgccccccaacacgctcagctaatttttgtatttttagtagagacgggattttaccatgttgaccaggctggtctcgaactcctgacctcaggtgatccacccgccttggcctcccaaagtgctgggacttcaggcatgagccaccacatctagccctatttatttctttatcgccttcttccctacatttacacatacttgatgtggcaggagataagtaagtattgaatgaaggaccagaactctcactgcaccacataaaaagaacttaagacaaaaaaaaagctccaaaaaagtaaaatttttcatgcactctccttggccctcacttgcctcttgtttttatctttttgctttgttagtttttatggttttgtttttggtttggagacagagtctcactctgtcatccaagctggagtacagtggtgtgatcatacctcactgcagcctcgagctcctggggtcaagtgattctcctgtctcagcttcccaagtagctaggactacaggtgcatgccaccacacccagctgattatttttttttttttttcagatacagaatctttctatgttgcccaggctggtcctgaactcctagcctcaggtgatttttttgcctcagcctctcaaagtgctgaggttacaggcttgagccaccacgcagccttgcttcttgcttataccctcattctccctctaaggctttaattttttttgttattttctttttcttttttccttttcttttcccccaagacaaagtctcactgtgtcacccaggctggagtacaatcgcgcgatctcggctcactgcaacttccacctcctgggttcaagcaattctccctgcctcagcctccccagtagctaggattacaggtgcccagcaccacacccggctagtttttgtatctttttagtagagacagggtgttgccatattggccaggctggtcttgaactcctgacctcaggtgatccacctgccttggcctcccgaagtgctgggattacgggcgtgagacaccgcacctggccaatttttattgttattttcttagggacaggatcacactctgtcacccaggctggagtgcaatggtgcataatcacagctcactgcagcctggaacacctaggctcaagcaatcctccctcccaagtaactaggacatgcctcagctaattatttttttctttttacattttgtagagacaggatcttactatgttgtccaggctgatctcaagctcctagcctcatgtgatcctgctcaacccttcaagtggctgggactacaggtgtgtgccatcgtgcctggctacctctctaactctttattttgctggcatttagttctactctcttgtctatttatggccttaataactctgatgctactttagaaagcatttcctattcatttttagcaatcaccattcagtcttcgatcgtgacaaggtcctatataagtcaaccagatgagcagcagctgcaaccacttgcaaaacaatcttcaaaaagacaaaaaagaagtgaatgaccatttttacataacttggttaaagtcgcaggaatttcaacctggacgttagggccagtggcattgccccaccttcctccagagaacagagaacatcaggcacgcacataaagagagtcctacatcctaagctccaagatggggttcctgagtcattctctgcctaatttaggtcatctgtcattgtcatgtctttatcaaagtttcaaaacaactaagaaaccagattttttgagcaaagtcattcagagagagagaccagttatttggtatattctaccatagatttgagatgaattgaattaagcactagaaactcatacttgtggatacttttaaacaggatgctgaacaatgaatatgatttcacagagtcagccaggcatggtggctcatgcctgtaattccaacaatttgggaggccaaggcgggtggatcacattgagtccaggagtttaagaccagcgtgggcaacatggcaagactctgtgttacaaaatatacaaaaattagctgggcatggcggtgtatgcctatagtcccaaccactcggggggctgaggtgggaggatagcttgagcccttgagagttcgaggttgcagtgagccagactgcaccactgcactccagcctgggtgacagagtgagagtcagtctcaaaacaaaacaaaaaaaagatttcacagagtcaaaattaggtattggctggtttaaacttttcacgcctaaaagataagctgacttccaatcaaatccaacttgaaagccaaggacttgggtattaactagagctctacacctccaaataatcaaagtcttttaaaatacattcctaaaatgtgtagccaggtgtggtggtacacacctataaatccagtgtcttgacaggctcagagaggaggactgcttgaggcaggagtttgagaccagcctggccaacatagtgagaccccatttttcttaaaaaaataaaaattaaaaattcctaaaatgcatggtgactgatataatttgtaacaaatggctgacaaatgaacaaataaatcaatgaaggaaaaacatctgaaaacctgtattatttagcctcgtatgttctcagtacaaacttgttcacctgcaaaaaagaggcccacatccaggactaacatgtgaagtaggagaggggagaaaaaaagagatttttgaagatctttgtaccaggtcctgttcatttatttttagcttgaaaataatactgtgggatcctcattttacgtattattatatttattttagagatcagtaaactaaggatcagagcatttaaattttgaaatagtaataatgtttaccatttaaacacacacacaggtccacacacacacccatctttgattcttacaacctttcaagtaatgtgtcgccatcccattttaaaggcaaagaaactggggtccagaaagatcacaggtcatgtagcgatcaagtagcacagccagaaccataatgagaattgatgaaagcaggaaacctcccagcagcatctctatctgctggtcgttttgcaattatctgtctttgccattgtcacaaacaggctcatcaacaaaagagtaatccaccagggaacagacccatggggtccagcctgattgtgactaagcaagagccatggaacctgtggaaaagttgaaccaaagagtctgagtttttaacagccattgttcagactccctgtccacctcttagtttttcaaggcttttcgagagtaaaaatgaagtcatccttgcctgagaagatgccataaagatgcatgagatgtctaccagggagtgctttgataccttctcagtcacattcagaccatttgtacctccttcacagcaaccagtgatggagaagacttagagccagaaggctcactagtcagtcttgcatagccctggtgctttgtgttcaagagtgaaatggaccaaaaagcagacaaaacaatgataagaaaagaaaactccagaccaataactctagtgaacaaagatgccgaaatccttattacagtattagcaaattaaaccagtcatctacagaaatatatcaaaaggtacataacacatcatgactaagtagggtttattccaggaatgcaagcctggttcaacatttctttaaaaagagataattcactacttcaactgaataagttgaaaattcttacgaccatttcaatgactgtagaaaaaaatacttgacaaaatttaacaactattcatggtataatctctcagcaaattagaaatagtgggtaatttcctcagtctgataaaatctgttatatatgaaagacctgtatctcacatcatccttgccagtgaaagactgaagacttcccccctaaaattggggacaaagcacaaagcaaatatgtccactgttaccacttctatttaccactgtattgtatcctaggtcttagccattgcaataaggcaagaaaaaaaagagataaatatcttttttttttgaagatcttaaaataagtaaaatgatctcttatttgcagatgaatgtttgtatagaaatgtacaagatatctacaaaacaatttctaaaaagaataaataaatttaacaaggtcataggatacaaggtttatatgaaaacaattgctgtacttctatataggagcagaacaaaaatgaagctataaaaatcaattccatctgcagtagtattaaaaaaagaaaaataaagtacatatgaataaaactaatcaaaagttatacaaaatctcgaagttgaaggttataatttaacgttatttgggccttaaggaagacctaaatgaatatatatatatatcatgtttatgggttaaaatattccatattgttaagagattaatttccccaattgattacagagttaatgcaattactatcaaaatttaaccagacttatgcagacattgacaatttggattctaaaatttacatataaaggctaaatgctataaaaagccaaagaaatggtttaaaagaacaaagtgaaaaggacttaactgcagctgatctcaagacttattctgaaggcccagtcaaaaggacagacttctagataactgaacagaatacagagtcaagaaatagagatacatataaatggatattttacaaaggtgctaaggtaattcagtggcaaaagaaaggtggttttgtttgtttgtttttaataaatgatgctagaatgcctaaatatccacatgagaaagaaataaacaaccattttttcatcttgtatgtaaaaatgaactcaaaattgataatagatctaaatagaaaaacaaaaactataaaacattgggaacaaaagacaagagaaatctctgtgagcatgaaataaagattatctagatagcacacaaaaagtatgaatcataacacaaaatactgatacatctaattttataaaaaataaaaatgtctggtctttaaaggccactgttgagaaaataaaaaggcaaaccacagactgggagaatatatttgcaacatgcatgcaaacaaagaacttatatctagtatatataaagaatttatatagctaaaaaataaaagaggcttcaaaaatgaagaaatacaaatagccaataaacacaggaaaaggtacacatcattagtcattaggaaaaggcaaatagaaacaacagttatataccaccacacttcagcagaatggttaaaattagacatagtatcaggattggcaaggatgtagagcaactggaactctcatacaccaatggtgggagtgcaaaagagtacaactactttgaaacacagtttggcaatgtcttaaaaagtcaaatatccatctatcatgcaacccacccactccactcttagctatttacccaagagaaatggaaacatatgtccacaggaagatttgtataaaaacattcaaagaagctttattacatttttgactattacttataatagtcaaaaactagctaaacaaaaaacacaaacgtccatcaacaggtggatggataaattgtggaatatccacaccatagaatatcacccaacaataaaaaacaaactacagatacataacaacacagatgaatctcaaaataatatgctaagagaaagaagccagacacaagagtatatatattgtatgatcacatttctataaaatttcagaaaacaaaaactgaactgtagtgatagaatgcagatcagtttgggacagggaggtgacaacatggaggaaggaaggaattgcaaggaccatcatggaattttggggtgtgatggaaatctttggtctctttattgggtggtagtattataggtatatgcttagtcaaaattcaacaaattgcacactttaaatatgtgcagtgtactgtatgtaaactatacctcaatataatcaattttttttttttttgagacggagtctcgctctgtctttggtctctttattgggtggtagtattataggtatatacttagtcaaaactcaacaaattgcacaatttaaatatgtgcagtgtactgtatgtaaactatacctcaatataatcaatttttttttttttgagacagagtctcactctgtcacccaggctggagtgcagtggcgcaatctcggctcactgcaagctccgcctcccaggttcacgccattctcctgcctcagcctcccgagtagctgagactacaggcgcccgccaccacacccagctaattttttgtatttttagtagagacagggtttcaccgtgttagccaggatggtctcgatctcctgacctcatgatctgcccgcctcggcctcccaaagtgttgggattatgggagtgagccaaatcattttttaaataagaataaaccagagcaaattcagaatacagtaagtggggtaagaaagcatgcaatctgagacacgagtgaagattcttgaggagcatcatgactgtcctcagatgtccatcagaaacaagagtcagcttctggacaacctcactgcaaggaccaggatatactggtggcatttggagatggcaaacttcatctggggatagagaacaatttcctaaccaggaagaataatccactgctaaaactggctgccacgctggagagggtattccttggtactggaggtattcatggagaagtaggcagaccagggctttggaggaactttgtgagaacaaacgccgccactttaagttccagctccctttctaacctcatgcatttcaaggaaattacttctcttctaacaacaagcagcctgaaagaacagacagtaaatcacaaataaaacagctcaggcacagaggaagagggaaagtctcttaggtaaccaccaaacttcacattcatacaatgggccccagtaaaacagtgggccctaataagcatattcctttccctttaagtgcactaaaataaaaaaaaaactaaatgcaaactcagagggtatgcctgcaactgcaaaaaaaatgtatgggaacagacacaaaactctccctcccagataagcaagacaaagacacacagaaacattctgagtctgtgataagctcttccaccctgaacccttaaaaactcttaatctgtaagagagagcacctgacctagcttggccagacgctcctctcaggtttattctccaaaataaacctgtctttgactgttaagctacttttcgtgtttccttcctctttctttaattcttacaggcagaccagggctttggaagaactttgtgggaaaggtaaggcctcttccagcctgaagatgctagaattctgcaagactaggcattccctgctgtttgctgttggcatatgatagagtttggatgtttgtccccttcaaatctcttgttgaaatatgattcccagtgttggaggtgacgcctgcttggaggtgtttgggtcatgggggcggatccctcatgaatgtcttagtgctggccttgataatgagatctggttattaaaaagtctgtggcacctcctccttctctttctcccactctcgccatgtaacatgctggctcctcatcaccttccctccatgactggaagcttcctgaggcctcaccagaagcagatgcaggcatcacacttcatgtacagcctgtagaaccataagccaattaaacttctttataaattaccaaacttcaggcctttcttcctagtgatgcaggaacagcctactacagcataggaaagcccaaagttcaatagagtctccctttcccagacaattttctctaaagaaaattcaaatgtcaggatggaaatgaagaggaattttccaccctgtcttatttggtgccagatccccttctttctgttggcccaagaacacttacactgaagatggatgatttttaggcttgctcccttccaaaacctcatcctgtaatgactaattagtctgaagttagcacaaacagtagcggctgagtggaaacacctattgtaatttctggtgtgctggctcccaaagccatcctcatattacatctaactcatagccttcgtctcctgctgaaacagtgaggaggcgggatgcgtgggtgtaatccttaaaagtgatgacaaaccagttgagctacaagagctcattcactcattcatctgtgcattcattcaatgagcacgagcattctgatgcaccagaacactgtctcccctgctgcaactgtgtagccccttcttattgttatttcaagtgcttaccctgacttagagaggaggacacttggaggaggagacagatttaaggaaggtaaacagaaataagacatcccgggctatgtcatgactcttaagcaggcctggccagagggtctatgtaagactgatcagcagctcagggtttttgttaattaatttttgattattctcaaagagctcagggttcttattttctacaccaagctttatattacaataggacatttgggcggggcaatgtggttcatgcctgtaatcccagcacttggggaggctgagaagggcggatcacttgaagtcaggagttcgagaccagcctggccaacatggtgaaacctcatctctaccaaaaatacaaaaattagctgggcgtggtggtgcatgactgtaatcccaactacttggaaggctgaggcaggaggatcacttgaacctgagaggcagaagctgcagtgagctgaaattgcaccacttcactccagcctgggcgacagagggaaaaaaaaaaaaaaaaaaggacatttggtggcgatttggcacttctgaagagtcattccacaggctccagggaccatggcaaccaggctatttgctccttatttcccttctagcattctcctttgtaacatgttcgcgtcccttagcacctccacccggtgctgatccagggcaacaataaaagaactcactctggtccaaccaccttgccaagtgctcttgctcaaagagccaaggcagaagctcatttggtagaagttgaatctgaggccttttattaccattaatctaacctgtcccaatttgaaaggatgaggaaggtgtgtttgcattcaactcaaatcacatcccgaaaaatgggggaaaaaatttgtaagcaattcagaaggagaataaggcccaatgtgtattgcataaaggaataaaactctgaacaatagtgctgtcagaaacaggaaggaagacctctttccacaaatccagatgagactaattcagcatggagaattatttcagcttgacattaaagggaaattctgagaaagaaaaggcaatgggaagtataactgttggaaaaggctgcacttgtgcaagaggtcgaatggagtagcattcgatacataatcactgtaactgctaactaaaaaagggttccttgggccaggagcggtggctcatgtctgtaatcccagcactttgggaggctgaggtaggtgaatcacgaggtcaggagttcgagaccagcctgaccaacatggtgaaaccctctttactgaaaagacaaaaattagccaggcgtggtggcacgcacctgtaatcccagctactcaggagactgaggcaggagaatcatttgaactcgggaggcggaggttgcagtgagccgagatcgcactaatgcactccagcccagacgacagagagagactccatgtcaaaaaaaaaaaagaaagaaagaaaaggttatttgacaaactcccgctttatttttcacttgggtaatatttttacgcatattgtagatgtctatttcaattaggaactacaaatgtcattttgtcagatttagaccccattgaaaaataaacagcaaattttgaaatgctttgttcttgtattttatatcaagtttatttgataaagtctgaagtctgggttttccgtgttttcaatatttgtggtctttaggcatcatggcttactttaaaaggctaacccccaataatatttggtttcctttgtaacatgcgagatattaaatgaaaactggtgatttttttggactaaaattagcaaaggtaaaacttagatattttctcacatgcaagcaagttttcagttgaactcatatctcacactaattgggtgaaaagttgatctaaattagagatgctttaaattcagtattatgactttcaagggcattcagtaacaaaacgaagtagataagaaaaacattctatttatacgtctaaccaggacagctctgagaggctaaataagtttcacgggtaattaacatcatttgcatgaggactaatatgcttgagattaaaagttcttttttaaatgtcatacaatttttttgactgttcccatcttgacttagagtaatggctagcgctggcaaatacatctgcccccaaagaccaaacaggttaaggcaagtgtcactaaacacttatgtctgcatcggagtttccatcagccaaaaccagcaagttttctctaatggagaatcttgtctcattatacattggtagactatgtaacttatcatcatgaaaattaaaactgaagaagaaaataataaatatatatatatgaatataagcacatgtgtgtacatatatatgtgtaacttcatatatccacctaattgtcaaacttgctcaaaatgacagataactaaatgaatcgccatataaccataactcagcttcaacaattagcaatattttgccacatttgcttcatctttttccccctttcttgctaaaatattttaaagcacttctcagacatcatgtcatttcacccctacgcactgcaatgcacatctattaaaaaaattacattttcttatgtaaaaaagttatatactgactcatattaacaaaggacatatactgtttgcttattaacaaaagacataataattctcaggattaaaaatatctcatctgatagtcatccatgatcccacctccctaattgtctcacaaaggtcattttacatgatccgtccgcatcaggatacaaacaaggcacacatgttgcttatctctaatgtgccccaccctccccagctgctcattcttttcaagtcattgacttgtcgcagaaaccgtgtcagctgtcctgaagactgtcctacattccagaagcccacggggtatcatttagtttgttcctctgtccctcatatttcctgcaaatggaagttggccctagagctttgaatagattcatattcagcttttcatgaagacaacttcatatgggatgctgtgagcttcaggttgtactacattgggaccccaccctacctagatatgccaactatagtgacaactagcaggttcagggggtgacagcccaaaatgtgcattgtcaagttctccataaacctttcatctcatggtttctttcatcacagagccttgcttgatgcaaacaccgtatttcattcttggtggcaaactggtgatttccaagtgcaattaatttcttccacaattattcattgacatcttcatacagaaggtgtcctttttttttttttttttaatcaacttgggctatttggttactgttacttgggctatttgaaatactgtttatgcttttttttctttttttttttttttttagagacaggatctcacagtgtgggtcatgctggagtgcagtggcaccatcatagctcactgcaatatcaaactcccaggctcaagtgatcctccagcctcagcctcccacgtagctgaaggctaccacctaccacgccgggcttgtttatgctttttaagtgccaatctttggagtaaagatttggtacctggccaagcacggtggctcacacctataatccaagcactttgggaggccaagaagggcggatcacctgagatcaggcactcaagaccagcctggccaacacagtgaaaccccatctcttctaaaaatacaaaaaattatccagacatggtgcaggtgcctgtaatcccagctacttgggaggctggggcaggagaatcacttgaatctgggaggcggaagttgcagtgagccacgatcacgccactgcactccagcctgggcaacagagcgaaactgcataaccccccccccccccaaaaaaaaaaaaaatttttggtaccctataagcttttacccctaccatgttaaagtaccatggaagtaagtctatatatgtatgtattgttagaaacttattggaatatatataatatataaaatatatattataaacatatagtttttagtatatattacaaatatacaatatataaaatatgtaaaatgtttatatatgttatatgaatatatttttaatgtgttgctaccaattgcatttattatttttttactgcttaaatcattccattttgggcagtggaaatcctttcagtggcctccagttcttagataacctgttagtctttggacttagcacacactgcctagctcatagtaaggatttccataacttttttttttttttgagagtcttgctctgtcacccaggctggagtgctatggcatggtctcggctcattgcaaccttcacccccaggttcaagcgattctcctccctcagcctcctgagtagctgggattacaggtgtgagccaccatgctggctaatttttgtatttttagtagagtcatggtttcgccatgttggccaggctggtctcgaactcctgacctcgtgatccgtccatcttggcctcccaaagtgctgggattacgggcatgagccaccacacccagccgacttcggtaacttttatctattactatatgaaagtgaaacttacttccacataacaatgaccataagaacacaagtattcagcctatccaacatatctctatcacgagcatttactgggtccatactatgtaccagcactatccaaagtaactggactacaaagacaggtatagcatgttcagtgattatgggattacagactcgagcagctgtttataaacacagcattctagtgcacctgcacttcagggttaggtgagaagttagtcatgaatcatttatagcttgccttagagaagactagggataattgcaaatgacaggcttcttaaagaaataaatgagaagagattcaaggtgagccctagaatgccgctggtctcagtgtatctcaatattcagaaaaccagggagcagacgcagctggatcgctcagccttgcacaacgcagtgtgtcctgtatctgtgcatcattgatcaagtgtgtcatgctctgaaaaaaaaagctggtctaggaagagcaatgtgttaccagacaactataacacagtgggatgtgttctcacaatgccatcagaatagagatgagcatgtggttgaaaaaaaatctgtaggaagggaaatatcagttgggcttttaaaagatgactgaaattcatttttccagatgcagtagttcaaacctataatccaaccactttaggaggccgagaagagcagattacttgaggccaggagttcgagaccaacctgggcaacatggtgaaaccctgtctctacaaaaaatacaaaaattagttagacgtggtggcacacacctgtagtcccagctacttgggaggctgaggcgggagaatggcttgaacctgggaggtggaggttgcagtgagccgagatcgtgccactgcactccagcctgaattacagagtgagactctgtctccaacaaaacaaaaaatgaaaaaaaaatgacaaaaattctaccaatgttgtaaaaaaaaaaacaaacaaaaatagaaaagacgttctagataggaacactagcttctgtaaaggcacaaagttgtgacaattatatggacaactgtgacaggttttgtgtggccggaagacagaatatgcttgagaggtagcagaggaaggtcgaacgggaccaggtggtaaaggcattgaatgctatgaaaaggagtctacgtgtggtcaacaccagaagaaaccatccagttgtcaagcaaaagtaatatggtcagctctatggggcttttttgtttgtttttggggtgtttgttgtttgtctgtttgtttcagacagagcctcactctgtcacccaggctggaatgcagtggtgtgatctcggctcactgcaacctctgcctccctggttcaagcgattttcatgcctcagtctcccaagtagctgggattacaggcatgcgccaccacgcccagctaattttttgtatttttagtagagacggggtttcaccacgttggccaggctggaaatctatgttttttaaaagataacagaagaaggcaaggagggggagagggtagatggaccaaaagagagaaaaagtcaaaacaaaaagacgaattagaaatctacagtggcggagatgaaaaattatgagagtctagaagtataccttaaatctgccaggtagaaaaaaaggaggcagaaattcattcacaaagcttttcacaggtgaaatttacaggacttggtgactgctaaaatgcgagaagttatgaagaagaggaatgaaggatgactctcaggtttctgagtgtaaacaggaagtcgctgaaatgcaattccatttgctaactagccaaatcacagtgcaaattgattaagaattaatacatgacagagtgtattagcaaaacaggcaagttgcaaaagacatcttggagaaataaactcatcaggatttccattttaaaaacacatgcagggcaactcacatttatagcctctccatttttgaatgttaatgttctctggaaagtaaattatgaatgtccagtatgccaggatgccgtccttagcatcaaagatgagtcccaaatttgaggtataggttgcctagcaactaaagtcccctcgaacaaagaaaaactgacttttttttttctagtaaagtcgcttcatggatccaaagcaggagtagggggaaatgatcattaaaaattgaccttatgacgacagttcagttaagaaaattgaatttactcaaccagcagggggcatcccaccttctccaagaacctttgctaaagttctccgtacaggttatttcccatccttgaccaatctcagcaaatgataatctctccttcctctaaactcttacttcactgggatgaccctggaggcacagcgtggcatgatggttaatttttcaatcgtcgtcttcgaatacgttgacatatctggagccattatcttttacgtcatttattgactgtggacccggacagcctaagtttgaatcgtgactctagcccttactacctctgtggccttgagcaattgtgtaatgcctccatgcctcagtttccccatctttaaatgcaggcagtaatactaccctctctcatgttgtaagcattctatgtgtgatacacgaatttgtattttcatatttatgagttcatatttttatgtgtataatttatgacatgtgagcaatataggagttaacatagttaaggtgcttgacacagttctggcacataggaagcactcagtagtggttggctctgattagtattacatcatgttaccttgcatcctctgtcgtagctggaaaggtaaacatatagcatttattgtaaaagtgatgagtgattttctggttctttttccactgcttcctactttaatgttccattttgcaggaaaacactcgaatttatttcagagctccaaaggggcctcaggaattacctgagtattctgcaggtacttagggaggaatcagcccaaccaagacatcttttttttttctttttcttatttttttttagagacagccttactctgtcacccaggctggaatgcagtggtgcaatcatagctcgctgcagccttgaactcctggactcaagtgatcccccatctcagcctcttgagtagctgggactacaggtgcacatcaacaagcccggctaatttttattttattttaatttttttttgtagagatgaaggtctcactgtgttgtccaggctggtctcaaattcctgggctcaagcgatcatcccaccttggcctcccaaagtgctgggattacaggcttgagccaccacacccagcttaggcatctctgttgaattagtgtgagaaatttgcaatttgtgtgcagttgacttgaaggtccttcctctgggccaatcagctcacccaaagagtccaagcgtagaaaatgtacatgggaaaaatgtacatgggaaagagatccaatctctttcccatgtgcatccccatgaaaggaaggagcatttgctgggagatgctgaagtcagtctcaagaagaaaggaaaagaaaaagatgaatgagcttataacaaacaggtaggtggagaaaaaccagagatagacctgaaaacacagattgcgcaggaagctttcatggacaaggccctgggattcgcagaggaaggcacagaacttcccttttcaaggccagccaactaggttgtggtaagtagagtaatggccctccaaagatgtccatgtctataaatatgtcaccttacatgacaaatgggactttgcaggtgtgatcaagttaaggattttgatatagagagtgatatagtttagctctgtgtccccacccaaatctcatcttgaattgtactcccataattcccacgtgttgtgggagggacacagtgggagataattgaatcatgggggcggttttccccatgctgttcttgtggtagtgaataagtctcacaagatctgatggttttatcaaggggttctgctttcccgtcttcctcattctctctttgcctgctgccaagcatggaagacatgatttgctcctctttgccttcccccatgattgcgaggctttcacagccatgtggaactgtaatttcaattaaatctctttctcttttaaattgcccagtctcaggtgtgtctttatcagcagcatgaaaacaaactaatgcagagggattatcctgaattatctgggtgggtgcaatgtcattacaagagtccctaactaagaggaaggccggagggtgagagaaggagaggtaagggcagaggcatagccacagtgatgcatggccatgaaccatggagtgctggtcacctccaaaagcaggaaaaggcaaggaaaggattctccactagagcttccagaaggaatgcagccctgctgccccacccatcacttctgactttcagaactaaaagataatgaattcctgttattttaagccgctcaaatggtgactgtagttacagcagcaataggaaccgaatggacaggtgggaaaagggaggagtctgggagaaaatccacgtgccctccctcagataggcaaggagaagacagcaagagtggaagtggcaaagcaaacaaattagtgcctgtatcagcattttcctttgaatttttttaaactgtacattcgggggtacatgtgcaggtttgttacctgacgacatcgcatgatgctgagatttggtgaactgaaccccttacacaagcagtgaacacagggcccaacaggtagcttttcagcccttgcctccttcctccttccccactctggtagtctccagtgtccccatctttatgtccatgagtacccaatggttagctctcacttacaagtgagaacatccactatttggttttctgtttctgtgttacttaggataatggcctccaggtgcatttgtgtggctgcgaaggacatgattttgtccttttttacagttgtgtagtattctatggcgcacatgtaccaccttttctttatgcagtccaccactgatggacacctgtgttaattctctgactttgctattgtgaatagtgctgcaataaacatatgagtgcagagcttttttttttttttttttttttttgatagaatgatttcttttcctttgggttatatcagcattttctaaactgttctgtaagatgatattatgagtccccagaaagggacagggcaagtaggggagttcagaagatgatgaaagtggaaccaatttgacaatctgagactgatggaaatttggtaaaagaatatgattgctttagccagttaaaagttgcaagaaaggtattatcattattattattgtaaccattactattattatgactcttctgttttttgtgggaaaaacaggatgaatggatgaaatggatgaaaaagattcctgggtgtcttgtctgacacatttttccaggttatctcagcctttcatcctattacataatctgtaagtggtagaaaactactaagaatgcaaggaattcttgtccatagagatgcagattagtagcatctggtggaatgcaatcattgtctaggacagatgatctaagatgggtacaggtccacagcctgttaggaaccgggccacacagcaggaggtgagggaacattacctcctgagctctgcctcctgtaagatcagtggtggcattagattctcataggagcataagcccttttgtgaactgcacgtgcgagggatctaggttgcgtgttccttatgagaatctaatgcctaatgatccaaggtggaatagttttatcccaaaaccatccccgcctcaagtccatggaaaaattgtcttccatgaaactggtccctgctgccaaaagggttggagactgctggtctaggtgatagacccattttgcacccacttgtaaatccatgtcagcattcgctcttttcgtgtatacgtgtgattcttagtcttttccttggaacaagtcatatcaccttactggctctctcagtgaatgccttatataaaatttgtgatatatgttcatcctgtatctgtatgggagtcacaatttctcattttcaaaaacttatcctgcaggaaatgcaaatcaaaaccacaatgtaataccaccttactcccacaagaatggccattatcaaaaaaatcaaaaaacaatagatgttggtgtggatgcggtgaaaaggaaacacttctacactgctggtgggaatgtaaactaggacggccactatggaaaacagtgtggagatttcttaaagaactgaacgtaaaactaccatttgatccagcaatcccactactgcacatctgctcggaggaaaagaaatcatcatgcacaaaggatactggcacacgcatgtttacagcagcacgatttgcaattacaaaaatgtggaaccagcccaaatgtccatcaatcaacaggtggataaagaaactgagatatatatacatgtacataaatacacacatatgtacatgtatatatatctcagtttacgtatacatattctttatatacacatatatatatgatggaatactactcagccataaaaaggaatgaattaatagcatttgcagcaacatggatggaattggagactactagtctaagtgaagtaactcaggaatggaaaaccaaacatcgtatgttctcactcataagtgggagctaagctatgaggattgaaaggcataagaatgatacaatgaactctgggaacttgggggaaagggtgggaggggggtgaggaataaaaaattacaaattgggttcagtgtacactgctcaggtgatgggtgcaccaaaatcccacagatcaccactaaagaacttactcacgtaaccaaataccatccattccccaaaaatgtatggaaatagaaaatttaaaaataatcatcatataaattaaaaagcaaaaaagaaaacccatcctgcaatattttattaggatagagccgttgtgtagctaatatagtctgaaagcgtgtgtgtccgtctttctcccaccttctcaggagctgactcaggtaccacagtgatgcagcaaggccaggtacccgagaggtatccccaggccccaactccctacaccgcacacacacaaagctctccccatcttggtctaagagggactaagccttcctcctacgaggactctccctgccttcagaacggtggctcctccagtgaggaaaaagagagaagcagaaggaactgcaaagtggacccttggatgctgctatccaaaatcagagccaaaattaagagactcttaacccccgcaaaattatccaggttaaaaacatacgtgagcttcagaaagggtgaacatagccatggctgagaatcgttgtggattatcatgataggaaattgacatgcttatgggtgttctgtcctttggggttgatgtcagggagccaagtggttgcactatttctgctgtgtgtccgaatttctaaagtaatatccgtgtattgtttggagagcggacttttttgctttactcctacttttacagaaaagaattttgtttctcaagcaacaaaacatttggtctctggtgtcaaagaggactttattatattagaattataaagctttagttaggaataagtgttggacattattaaatcaagttactgcaggctgggcatggtggctcacgcctgtaatcccagccctttgggaggccaagactagtagtctccaattccattccatcacttgaggccatgagttcaagaccagtctggccattgtggtgaaactccgtctctactaaagacataaaaattagcatggtggcctgcacctataatcccagctactccggaggctgaggcaggagaatcacttgaatccaggaggcagaggctgcaatgagccaagatcctgccactgcactctagcctaggcgacagcgccagactttgtctcaaaaaaaaaaaaaaaaaaaatttactatgtatggagatgatttttcatcttttccttaaactagtcatacgatgtaccatgctaatgaattccttcctagcttctttactggggcataggatacaatactttgaatgcatatagccgaattctgtctgctagtagattattttagacttttgtgcctgtatcagcgttttttactgtccaggaagatgttagcatgtaccaatgtttaaaaaagggtttattctccaacttgagaagtaaaatggtgggtaaacaaacaaacaaaacaaaacaaactgccaggtgcagtggttcatgcctgtaatcccagcattttgggaggccgaggtgggcagatcacctaaggtcaggagttcgagatcagcctggccaacatggcaaaaccccgtctctactaaaaacatacaaattagctgggcacggtggcacatccagctacttaggaggctgagccaggagaatcgcctgaacccaggagggagaggttgcagtgagccgagccgagattgcaccgctgcactccagcctgggtgacagagcaagactccgtctcaaataacaagaaaaagcttcagcaggtctctgctgcatgaacactgagaagctgtaaccagctgatgtgcattgtaaatttcaagatgagggaagtgacagcagcatttcccagacttatttgactgtggacctttcccctggcacatctattcacatttcccagcacaccattctgcaaatcaccagtttccaaatgctagttaatacaaaagtgagtcttatttctgaaatacctttattgaggtttgagttcaagatcatgattgcctaaaacaaatttaatacattaatgtgtgcatgtttcagaaaaattattttttaatacaagagtcctttgagtcctttgtaccttgaatatttgaaagacttagctggcattttatcagatgcctcctgggagaggttagcatcagatacattttgtaaattctttctcagtcccaacttgctctgccctattcaagtgcctacatctgtacatcgatttattattattttttttcagttaaaaaatgtgtgtctttatttaaagctcaaaacctgattggcattcaatggtatgttttcatgtttacatttccttcatagctattgtcaaatacacattcccatttctaattctgttatatctttggcattcattcattgaccaagaaactcaaagcgactattgtacggcaagaaccaggcatgaaaaatggccaagacgtagttactgcttttgtgcaagtcatggtctagtgtgagagacagatgcgccaacgaataattacaacccgctgtaatgaaggatagaataaagtcatgcgagcaggctgggaagacaagaagaatgcgactgacagcctagaggaattggcaacttcaaagcctttggatcctacaagatgaacagagaacaacgtagcaatttaggcggaagctacagactgtgtaagaggaaggagaaatgaaggatggcagaggaggccagccatggtggctcacgactgtaatttccacactttgggagggcgacgcaggtggatcactttaggtcaggagttcgagaccagcctggccaacacagtgaaaccccgtctgtagtaaaaatacaaaaattagctgggtgtggtggcacatgcctataatctcaactacatgggaggctgaagcaggagaatcgcgggtacccaggaggcagaggtgagactccgtctcaaaaaaaaaaaaaaaaaaaaaaaaaagaatggcagaggaagaaaggaggaagagagtgcagagagaacatggaatggaggaaagcaggacatgaggctggtcaaatcaggttgaaccacaggtttgagtatgtgttaggttcccagggctgccatcacaaattcccacagacctagtggcttaaaaccacacaagttcattatctgactgttctagaagtcaaagtctgaaatgggtttcattatctggcttttctagaagttgaagtctgaagtgggtttcgctggatgaaatcaaggtgtcagcagagccgcacgctccccgctaggctagcacccgtttccttgccttttctattaggctggtgcaaaagtaactgcattttttgccattacctttaatggcaaaaaacttcgatggcgattacctttaacggcaaaaaccacagttacttttgcaccaatctgagagcttccagagtgcacctgaatttcttggcgtacggccccttcctccgcattcaaagccagtcatgttgcatcttctctttcctctgacctctgcagaaggtcggacatcatacagcattatttacataaacctagatagtctagcccactacacgtctaggctagatagtatatgctattgctcctagggtacaaacctgtacaacgtgttactggactgaatactgtaggcaactgtaacacaacagtaagcatctgtgtccctctgcttccatcatcacgtttccttctctgactctgctcctcctgcctcggtcttagaagacttgtcaaaacacagtaatatattcacaggttctgttctgagaattaggacgtgggaatctgtggatggggcgggcattgttctgtcaatctgcctagaggctggattttatacagcaggcaataaagagcagtgaaagatgtttatgcaggaaagttatcacgatggattgtgatagggaactctgacaggaatgcaaagaacagcctggagcaggggcagactggttttaggacccgctaaaataccctaggcaacattgggagatcccatttcttttattattattattattattattattattattattattattattattatactttaagttttagggtacatgtgcacattgtgcaggttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgttagggaaatcccatttctaccaaaaactttaaaaaaattttgccagggccaggaacagtggctcacgcctgtaatcccagcactctgggatgctgaaacaggcggatcacttgaggtcaggagttcgagaccagtctggccaacatggcaaaatcccatctctgctaaaattacaaaaattagccgggagtggtaccacatgcctctagtcccagctacttgggaggctgaagcaggagaaccgcttgaacacaggaagcagaggttgcagtgaatcaagattgtgccactacactctagcctgggtgacagagtgagactccatctcaaaaaaaaagaaaagagaaaaaaaaaaattagccatgtgtggtggtgcacaactgtggtcccagctacttgggaagctgaggtgggaggattgtttaagcctgggagatcgagcctgcagtgagccatgattgtaccactgtactccagcctgggcaacagagaagggtagaagactcagacatttctgtagaagattaagccattatccaagcttgaaaataataaagaattcactagggaacccatcaggtccagatgccattgtaggaagacacagacatgcatcacttaacattggggacacatcctgagaaatgtgtcattaggggattttgtggtcatgcaaatatcatagtctacttacagaaacctagatggcctagcccactacacatgtgggctagacggtatatgttattgctcctaggttacaaacctgttcaacatgctactggattgaatactgtaggcaattgtagcacagtggtaagcatctatgtatctcaatatatctaaacatataaaaggttcagtaaaaatattctatcagtcaatgagtggataaagaaattgtctatactattcagccataaaaaggaacaaaatagtggcattcgcagcaacctggatggaattggagaccattattctaagtgaagcgactcagggatggaaaatgatacattgtatcttctcactcgtaagtgaaagctaagctatgaggatgcaaaggcataagaataatacaataaactgaggacttgggggaaagggtgggagggggtgagagataagactacacattgggtacagtgtacactgctcaggtgatgggtgcaccaaaatctcagaaatcaccactcaagaacttagtcatctaaccaaaacccacctgttccccaaaaaatctattgaaataaataaatacaaagtattataatcttgcagaatcaccattgtttatgcagtccatccctaactaaaatgtcattccgcagtgtacaatggcatctctttgactgggtagatggctatgccattaaccaaggctaaaactcagtgcagtgtggtagctcatgcctgtaatcccagcacttcgggaggccgaggcaggtggatcatctgagttcaggagttgggaggtcagcctggccaacacggtgaaaccctgtgtctactaaaaatacaaaattagccaggtgtggtggtacatgcgtgtaatcccagctactcgggaggctgaggcaggagaatcactttagcctgggagagggaggttgcagtgagccaggatttcaccactgcacttcagcctgggcgacagagtaagaccctgtctcaaacaaaaacaaaaacagaaacagaaacaggtttgggcagaaggggatctcctaactggcctcttttttttttttttttttttgacagagtcttgctctgtcgccaggctggagtgcagtggcacgatcttggctcactgaaacctctgccccctgggttcaagcgattctcctgcctcggcctcccaagtagctgggattacaggtgccagccaccacggccagctgatttttgtatttttagtagagatggggtttcaccatgttggccaggatggtctcaatctcttgacctcatgatccatctgtctcggcctcccaaagtactgggattacaggtgtgagcctcttgccttttattcctcccctctattctgtcctccacaattctccctcactcttccacggtcccatatggtttaggttaagatcaactcctcattctaatatacaagacactttatggcctgacccctccccttgtctccagctgtattccttgcctctcgtcccatcctcaatcctcaacatgagcaagttcaagtcactttacagttcgtcatgtgaagcagcacattgccaagtgccttcatgcatcagctcagactcacaccactgcctgaagcgtctgtcttacagacactccactcacctaatatctgtgcagacacactcatcttttgagcccttgctcctctgtgcattctttgatgtccctgccagatagaataaccactgtcttctcctaccagtggacaggtatgggcttccattatttaaattcaggcacatatttaagtgcataactttcccacagctggaaaataagtattctgatgtcaattacaatctctctctttttttaagagactagatcttgctctgccaccccggctggagtgcggtgatgcaagtagctcactgcagccttgacttcctttgctcaagctatcctcctgcttcagcctcctgagtagctgggactataggcaggtactaacattcctggctaatttttaaaaaaatttttttaaggatggggtctcactatgttgtccaggctgctctctaactcctgggcctcaggcgatcctccctacttagcctcccaaagcactgggattacaggcatgagccactgtgcccagccaagaacaataccttattcatcaacccattcttggtggctaacacagcacttaacattttctagcttctaaataaatgtttggtgaaggaattaatcagtggagaaagatgaaaaataaaatgaagtcattagaagttacaaggtgtcattatttagtccacgaattgaaaaatggataaacaaaatattggtatatctatccaatggaatatgattcagccataaaaagaaatgaggtactgatacatgctacaacatgaaggaaacttgaaaacattacactcaatgaaagaatatttgatattattccatttatatgaaatgtccaaaataagcaaacagagagagacagaaagtagattagtggctgcctagggttgggagatatggcgagattggaggagtgaatgctaaggggtattaagtttctttttcttttcttttttttttttagacagggtctcgctttgtcacccaggctccagtggagcgcagtggcgagatctcggctcactgtgacctctgcctcgtggactcaagcagttctcctgcctcagcctcccaggtagctggggctacaggcgcataccgccatgcctgggtaactttttgtatttttgctagaaatgcggtttcgccatgttgcccaggctagtctcaaactcctgagctcaagcaacccaccctctctggcctcccaaagtgctagaattacaggcatgagccaccgctcctggccttcagtttctttatggagcaacaaaaatgttctaaaagtgattaccctgatggacacacagctacgggattgtacaaaaagtcatggaatttcatacattaagtgggtgaattgtatagtatgtgaacagctcaatcaagctgttaccaaaaaagaaaaagatgtcatatgtagattcaaatataattctttaacgaagaaaaagaaagatctagagaagcacactgggagataggcccaactgatggtggacatttatccaaggcagcagggagaaatcggaatgcaaatacgtgttcacatatattaagttctttttatgtgcttgccactatatcaaacaccttacctatgtaattatttcatcctcatgagttagatatttttattcctgatgagaaaactgggtcatttgcccagcagcccacagttagtatcatgaaaccagcacttgaacccaagacaactagctccaaaatccacactcttgaccttggctttgcttatgaacttggagggtacattaagattttccttttttgtttctttaaatgagggatagtctgaaaaactctctagagaaatgagtttattttctttaagaatggatgcacttaaaactatgaaattttacctctgggtaattttgagtgagtttggccagaagtcatttggattgccctaatttcttattgcttaatttgttttcctatatttaatttcctgttgtttgattttcattgtcaaatggaaggtttgcttttttttttttttttttttttttgagacagagtctcactctgtcacccagactggagtgcagtggcacgatctcagctcactgcaatctctggctcactgcaacctccgcctcccaggttcaagtgattcttctgcctcagccttctgagtagctgggattacaggcgcacaccaccacgcatggctaatttttgtatttttagtagagacggggttttgccatgttggtcgggctggtctcgaactcctgacctcgtgatccatctgccttggcctcccaaagcgctgggattacaggcgtgagccaccacacctggctggtttgcttctttaggctggtgttacattatggccgaagaatgtggcctggctggacatagtggctcatgcctgtaattgagcactttgggaggctgaggtggaaggatggcttgaagccaggagttcaagaccagcctagacaacaatgtgagttcttgtccctacaaaaaaataaataaataaataaacaaataaagatggaaaattagccaggcaagatggtgcacacctgtagtttttgctacctgggaggctgaggctggaggatcacttgagcccaggagttcagcactgcagtgaggtatgatcatgccactgcactctagcctggacaatacagaaagatcctgtctctgaaaaacagaaaaatacaaattaaaaatacataaaaataaatgtaaaaaagaacgtggcctgcagagtttctgcattgaggaatttaagacacctttcttcgtggtctaatctagaatcaggttttgtaaaactgcagaactcctgaaaaaaaaaggttcattccctctttggaggggaagtgcctagcgctccctgatatattaaatataagactttcataaaaggaaattccaatttcttcttaaattattttaaaaacagaatggccttctcaatagttaaatgtttaatgcaagcaacatgcttagaaggaagaggaggaagaatttgtctgagtaattcaaaaggccagaaagagctcagtcatttgtaatcagatatttcaatacttgcaaggctttttactttggcatgatgaatggccataaaaaactatacaccttcatgtaaaagacgttggcttcctctgctctttacataatcaatttgacatttgaattttggcaaaggatcgcaggtaccttgctttatttattacctgagattagataaaaacatcactgttatcaagccataccaggcttcttcctaaaatcatgtgcaatttttcaagtaaggatcactttgtcctgacatcgaactctcccaaacaggatttccaagtatattatacatagaagccacattctcctccctccctcccttctctttcccgtctgctataaccaccccccaccctttaaaataacccactcccagcaattctaccttctaccaactgtgacatttatagcatgggacccacctaaaaaagaaaaagggattactaaaggattcatcatcaaaactgggccagaaaagagaagcactctcaggcaccaactgtgtcactttgcacactatatgatcaatactgaaaggcagatgggtgccctaggaccacaggcttgctttcatttgggatgggaagatttttaacactgggaaagggctacagccagagaaaagcactgaggaggtcatcaagctctcactaatccctgtacttacctctgtgctctcaaaggcacccttaagaaaggatctgtccagaaccatctgaagaatgagtagaggtttaaaatggtaaattctggctgggcgcagtggctcatgcctgtaatcccagcacgttgggaggcagaggcaggtagatcacttgaggtcagcagttcgagatcagcttggccaacatggtgaaagcccatctctactaaaaatacaaaaactagctgggcgtggtggtgggcgcctgtaatccaagttacttgggaggtggaggcaggagaattgtttgaacctgagaggtgaaggttgcagtgagctgagattgcaccactgcactccagcctggatgacagagcgagaccctgtctcaaacaacacatcaatcaatcaatcaatcaataagttctaatgcccactctcccagtttcccatgaaaggctacaatccaaaaatacagaacctcagctctctctccaaaactaagccaatggtcaaacagcctaaatctagaaggaactggccaagcacagtggctcacaactgtaatcccagtgcttggcaggctgagccggggggcattgctcgagaccaggagttcgagacaaggagttcaagaccagcttgggcaacatagtgagaccacatctctacaaacaattaaaaagttagccacagtggtgcccgtctgtaatcccagctattcagaaggctgaagcaaaagaatcacttgagcccaggagttcgagcctgggcaacatagcaagaagctatctctacaaaatatttaaaaaattagccaggcgtagtggtgcaaacctgtagtcctagctacttgggaggatcgctggagcccaggaggtcaagatcacagctgcagtgagctgtgattgcaccactatactccagcctgggagacagagtcccaacaaacaaaacaacaacaacaaaatccacaactgagccaacggtcaaactatagcctaactctagatggaatccctatactgcagcccaaactataaggcttgtcctggttctacctcatgaaacaatgacgggcagcctgcaaggttagcagaattctcaagcgacctctactatgcccccttcaatcttcaaagaagaaatggactttgcagcttctatggcagtctgcaattccccttatcctaccgcctctccactatatctcacctttcttcataaatgttgatgccccgacaaatcaactcaaaaaaagccaaattaatatgaaattggggggagtggaggggagtggcaatgacacatttttgagacagcatgtatggtgacatgatggtgaagagcccagtctctctagtcagtcagccaggggtgaatcccagcgttaccacctactagctgtgcaacgatgggcaaataccttaacctctccaagcctccttcctctctgtgaactagaaatgttaatagtgcctacctcatattttaaaacatgtgaagtccttggaagaatgcttaaccatagtgagcactcagtttattatttctaggtttcaagcaccttacaaatagtgtctcgtattatttcatttaatcatcccaaagatgctttgagctccactgtgtggatgaacaaactgagacttagagtagctccataactagctcaaggtaatggagctggtggggtggagctggggcttgagctgagatctgccatcaaagcccaggttctaccagtgcaccatgctatgcccctgggggatgcggtctccatgaaaaaaaaacacacatggagacaaagaaaacaccaaccctggcagcagcaaacaatgatgatggctgtttttcaagtgctctgttggtttaaagcaaggaagaaccagacagtgggaaaagaacaggatgtcacatgtcaaagctgtagctatattatacactgggcttgtgaatttgtttctccctgaggaaagcaacttggagatttctcaaagagctaaaattagaattatcattccatccagcaatctcattactgggatatacccaaaggaaaataaatcattctaccaaaaagacacctgttactcacatgtttattgcagcactattcacaatagcaaagacatggaatcaacctaggtgcccatcaacagtggattggataatgtagtatatacacaccatgacatactatgcagctgtaaaaaagaatgaaatcatgtcctttgcaggcaacatgagtgcagctggaggccattatcctaagtgaattaactcaggaacagaaaaccaaatgctgcatattctcacttataagtaagaactaaatattaggtactcacagacacaaagatgggaacaagagatactggagactactggaggggttgggggaagggttgaaaaactattgtgcagggcacggtggctcacgtctgtaatctcagcactttgggaggccgaggtgggtggatcacttgaggtcagacattcaagaccagcctggtcaaaatagtgaaaccccatctctatttaaaatatgcaaaacttagccaggcatggtggtgcgcacctataatcccagctactcgggaggctgaggcaggaggatcgcttgaacctggtaggcaaaggctgcagtgagctgagattgtgccactccagccgggatgacagagtgagactccatttcggaaaaaaaaagaaagaaaaaaaagaaaaagaaaaactatttattgggtactatgctcactacctgggtgacagatcaattgtatcccaaacctcagcatcatgaatacatccatgtaacaaacatacccatgtacaaccttgaatctgattaaaaaaaaaaaaaaaaaaagcagtaactgtagtaagcaaaagccagctagaacctggaacctaaatttggaacatcatacatcaaactcccctctagccttagaagtggaactcaccatacatcacccaagaggacagaagacgcagcctggagcaacccacactccctatctgttggcaagaactacgtccggacagaccttgctttgaaataaagcgggaaactgacatggagatgcgtaaaaccctttcaaaaccatatcacaaagtctcagtgggaggagcaagcctcaaaacaattcaaggacacgtggacttcatgaaatgtgagtaaacatctatagtgagagagcctcctaaaggaaaaatgaaatggaaggagataaaaagggatacaagtaacataagatttgcaagaaaccaaaaagcatttaaatatccacatggagatatttatcagcaagactgataccgcaggaaaatcaaatcagtgatattaagaatacacttgagaagttctccaagaatgtagaggaaaaggataaaagaatgaaagtaatgagaatgacagctctgtgaaatccaattttaaaactccaatataaatataataaatttttcagaatagagtagaacaaaaacaacaaactaatgaaaaaaagaaatagaaaacatcttttcttgacctttagaaaaatcatgttctataaaaagagatcctcacatagacatatcctggcagaatatgtattgaaatgctggaaaactttaaaccattgctggatctgagaaaagtacttagaactgaatgaaaatcagactgaccctggcttttcctctgtgatagaaagttcaggaaaacaccagaataccatctacacagttgaggggaagggttagaaacccaaggagtaaaccagagactttgaaaacacacttgtgtagtctgacatctgtgaaaataacatgcttggctgtttttgctttgagagtacatatcaccaataagcagcttaagaaaaatatcaccttagttccaccattatagaagacagtgtggcgattcctcaaggatctagaaccagaaatactattttacccagcatacccaaagggttataaatcattctactataaagacacatgcacacatgtttattgcagcactatttacaatagcaaagacttggaaccaacccaaatgcccatcgatgataaactggataaagaaaatgtggcacatatacaccatggaatactatgcagccataaaaaagaatgagttcgtgtcttttgcagggacatggataaaactggaaaccatccttctcagccaactaacacaggaacagaaaaccaaataccacatgttctcactcataagtgggagctgaacaatgagaacacatggacacagggaggggaacaccacacaccagggcctgtcggggggtgagggcaaggggagggagagcattaggacaaatacctaatgcatgcggggcttaaaatctagatcatgggttgatgagtgcagcaaaccaccatggcatatgtatacctatgtaacaaacctgcacattctgcacatgtatcccagaacttaaagtaaaataaaaaattaaaaaatcaccttaaatttacgcgaaacaatgagtaggtcataggtcatgctatttgtgggttttccttgaaaaatttagttcccaaactccggcaggtttggggtgggctaaggactgccaggatgtttctggggacctgcaatacttcccttgataactccccttctccctggtttctgccaacttccagaaaccagaaaccatgctccctggatcacatcctgactactacagtccacaccaagttttccaaccagttaaaacaatccctggtgcttctctatttcactctaattagcaagggctaaattatgtacactgctggatgctgtacgaaaattaatacaaagagctttattcctccttcccaaacagggcaacatcatttaaaaggtgtctttgttgccaagtaatttgaggtctgaattttctgtttattgtttaataacatttttttttctaagtgcaaaagtcatactagcccaatgcagaagatatacaaaagccagggggtaaaatatacccattatcccaattactaaagaaaaacattgttacctttcataatgttcttgcagcatttcccatgcatagccttcatataagaggcctctctcttttttttttttttttttttttttttttttgagacagagtctcactctgtcgcccaggctggagtgcagtggcgcaatctcagctcactgcaagctccacctcccgggtctacgccgttctgccttagcctccccagtagctgggactacaggcacctgtcaccacacctggctaatttttttttttttgtatttttattagagacggggtttcaccgtgttagccaggatggtctccatctcctgacctcgtgattctcccgcctcagcctcccaaagtgctgggattacaggtgtgagccaccgcacccagccaaagccaagaggactcttttttaatgttaattgtattcaactatacacagttcgttgttgcctttgttcataatgtatcaaatttccatgtgaaaaaaaatctccaacaatattattttcaatgaccatattgcattccagtccatgaataattgactcatgattaacacaaccaacccgatcattgaattttttaacattataaaaactatactacacattatacaatatactatgtaatgtggcaattaaaaacttagttcacgaggtaaaatttcctgagatcaaatcacttttccaccatttattagtcatgcaatgttgggcaaattaaacaatctgtgcctgtttcctcatgagcataatgggaatcacaacagtacttaactcacagagctgtgtggattaaatgaattatacatgtaaagactttagaacaatccctgcaacatggtaaacagcatatatttagcttgtttccagttctttgctacagtgtagaatgagcatccttctacatgtagttttttaaactaatacagttattttaaatataaaattcttaaaaatgaaattgctgggtcccaaggcaattcacgtttttaaactgctgtacacatattgtctaaattccataccaaaaaattctacaattttataatcccaacaataaagaatgaaaatgtccattttcacacagcattgccaacaatggatatctactttttctgtccaaccctgctaaaatagtggatagaaattgacattttgttgctttattttcaatttctattactaaaagttggggattcttctctgtaggcttattgatcaatttgatttttttttcattttgtgcaaaacctgttcacattctttcctcagtttttttgtttttatttttgcttttcttttgttttgtttttgagatagagtcttgctctgtcacccaggttggagtgcagtagtgtgatctcagctcaccgcaacctccgcctcccaggctcaagcatcttctgcctcagcctccctagtagctgggattacaggcatgtaccaccacacctggctaattttttgtatttttagtagagacagggtttcaccatgttaaccaggctggtctctaactcctgacctcaagttgatccacccaccttggcctttcaaactgctgggattacaggcatgagccaccacacccagcctttccccaatttttgtcagaagtatttttctcctgattgcaaaaaaaaaatatatatatatatatgtatatatatatatatatattcaggagaaacatttataatatatattggaaatatcttatctcaatttgtcaggctggtttataacgttttccttttttaatgctttaagttttgtaacatcaaatttatcaatttttcctttataccttatgactttggggttaaacttgaaaaagcattcccaaattcaagtttatatgtatttaacctacagtgcaatctctaacagctgtgatttcatattttatatttaactctttaatccaaattcaattaattgtatgctttagcataaggaaagaacccaacaattatcttcccaaatattaatacacttccccaatcatgtttactgaatccttttctcgctgattttggacttttgccatatactagccaaataaactcaaatatatcaccagcttctccactgtgctttactggtctccctgctttcatagcagcaccacttttcattattagagtttttaaagtgaatcctcaatatctggaagatcaagggctcactcaccattttgtttttgttttttgaataacgtaatgggctcttcacagccatttattcttcagacgaattttagaaacattttgtcacattccccaaaaaatgttcagtaggaattttgttattgttatatttgaaatgcagcatctgtcattggatttgttttggcctcttcttcgaaaatataaatggtccctctgttggatctttgctgtctgttctctgtacttatgacgtctcaaataacttttagtttcttgtcctcatcctatacattctagagcttctctcaaactcctcttcttttgactgcatagattcgctgtaatattacttctgcctcttactgcttctaatactatatgtgacttgcaattgcatgatttgcttctactctttgaaattttgccaaattaattttcatcttagtcagtgccttatcctacaagcttatctttttttgtattttgctcttgttttagagtctgtttccctttattgtgtttattcttttatttatttcttttcttgtttcattgcctaaaatcccttaagactagaacagatgcaggctaaaatttgtttttgttttcaaagaaaaaaaaatctgtttttaactatgccctttctttacttcttgaagaatatgtttatctcctttcacattgcagatttgtttatatatcccatattgaagatatggtttttcctgcttattcagcctttaataagaatggatttatcctttgatgagattcatcccacctggccacctggaagctgggacagctgcaacatgggaatctcattgaatgaggtaggtccctgtatttttataagaaccaaagactagtaatcttcccaaatatagacattatctgtcactgagctcctctatctttgctgtaaagctgttgaaacagtctctatatcatctctaacatcaatatcaatgataaaatatcaactattacaatttgccagaaagaaaaagatgctaatgaactactcaaaatgttggtaaaatctgcatttcatgacatgactagcaagggctcatttgagctggtctttctacatttacgcatcctcccactctctccccgattcactaggctccaaccactccggccctctgtctctttgtcggcgggagggaagaacttattcttatcttgagttttgggttgaagggagtgctctgcccctggatcttcccatggcaaatgacttcttgtttttcaagtctcccttcaaatgtccctcccttgaacaccctcattggccaactcctatgcggttcccaacctgccagcctgttttattttcttgagagcacttacaagtagctaaattcagccagtttgtttatttagtagtagtagtagtagtagtagtaatatttgagacagagtctcgctctgtcaccgaggctggagtgcagtggtgcaatctcggctcactgcaagatccgcctcctggtagtgctgggattacaggcatgagccactgcacccatcccgcttactttcttatatgtctcccctgccaaaaatataagccttgtaagaaggacattctctgtctttacattgctataaccccataattgagaacagtttcatataattaacagacacacaatgcatgtttgttaagtggataatggttatatatgacaggtggaactctgggcgacttttatttttctcttattattctttattcttcatactttgcaatgcatatatattacttttatagtaaaaaagtgcattttaagacaaaaaatctatacaaatttatctatggtattggttttcaaagtttttaacagcaaaacttttttacaaaatctctgtgaaactccagtataacagacataaaggcagtattttcttatcaatgtattgttaaactcagaagatcatgacagttgcctcttatacaatcaaccaataaaacagagaggctttttaaatgaaaaattcacattttaaattgagaaatagggaggaaagtttttatttaataaaagcctcagatggcattcacttattttaatttagctatttaatattgaggaaaatcctgattcacatagatgggtagctgcaaatgtagttttaataagtcacctggttttatgatattcttacgttgaataggacttacaagagaaaagttatttttaagtttacacaatcacaagttaaccaagatacacaaattttcacactggtggtttctaataagtttggtttctaatacatttgggtatcatttttatcacagctctaaatagagcagaatgtatttaaaatgctaaatatgaataaaacacttgcacagccactcaggcatgtccatggaagactgcagttgcatggatgatattttgaaaaccacatggatatgcctgctacaacaacagtttaacacttcataggcagagaaaaaaagagtaaaaaaatacatcaatatgtcaacagtggttccacctgggtggcagaatgcctggagacttttattccttcttcttgcttttccgtattttccagggacttttttttaatggatgtatattaatttgtaatgggaaaacaactatttttaaaaaagccagaagccatgctcgatacacaggaatgtcacaaatgtaatgttgagctaagaggccagacacaatagaccattttgttccttttacctaaaatgcaaaagcaggagaagtgaatacacagtgttagaagtaaaggtagtggctgctctccaggaaggctggggatttgaaaggcatcacacatcaccatttccaggactcagaaattccagtcatgttctgtttctttctttcttcctccctccctccctttccttccttttcctacttccttccttccttccctccttccctctttccttccttccctccttccttctctctctcctttttctccttccctccatcctgtcctctctccttcccttccctcctttcttgtgtcatttctctcttttttactccttccttctctccctctttcattccttccccccttctcccttgacttcttccttccctccttccctctttccttccctccttccctccttccttccctccttccctctttccttccctctttccttccctccttccctctttccttccctccttccctctttccttccctccttccctctttccttccctccttccctccttccctctttccttccctctttccttccctccttccctctttccttccctccttccctccttccctctttccttccctctttccttccctccttccctctttccttccctccttccctccttccttccttacatcctttcttcctcccttcccttctcccttccttccctgcttccttgcttttttcccttccctttcttccttccctccctctctccgccctccgttcctccctctctccctctctttctctttgcaaacaatcaatggtttttagtatattcacagacatgtgtatcactgcagtcaatattagaacattttcatcacctcagaaaaaaagaaaacaaaaaaccctctctacactttggctatcgggctctttattccccagccctaagcatccattactctaccagctgtctctatagacttgtctattcggggcatttcagagaaatggaatcctacatggccctttgtctctggattctctctcaagcaagcatgttttcaaggcttaggttctgtttcttgacctaggggctggttatcccacttggtgaaaattgtctgagctgtacaatatccttggtacacttttctgtacctatgggatacttcaatcaaaagttctagataataaaaattaaaacaaagtcataagagggtgttccagcagcatcccccgaagccctcgtttctgacggtggtctcccttctccacccttccaggcccttcccaggcttcccatcacctatccccttttgtcctatgaagaaggacaactgcagggacacagtttgcttttctcatcttcttccgtctcccccttccagccatccacctcctgcctcctaccaggctgctggggcttctccagaacggcctccccttgaggcatgcctgcagttccatttttcctgttcttccccaccccaccctaatcaagcttctctatggtgtactccatccctcgggagtgttggtgaatgtgaagaataaattattttgtgctaagattttgtgctgtcagagtaatctttctaaagtgaacatttaggctgggtgtggtggctcaaacctgtaaccccagcactttgggaggctgcattgtttcgttttcatactgctacaaagaactgcccaagactggtaatttataaaggaaagaggtttcattgcctcacggttcagcatggctggggaggcctcaggaaacttacaatcatgggggaaggcgaagggggagcaggcaccttattcacaaggaggtaggaaaaagactgaactcaggaggaactaccaaacacttaaaaaaacagcagatctcataagaactcactatcacaagaaaagtatggaggaaaccacccccatgtttcaattatttaatacctccacctggtctctcccttgacacgtcatgattatggggattacaatgcaagatgagatttgggatagggacagagccaaaccatatcagatgctgaggtgggaggatcccttgagcccaggagttcaagaccagcctgggaaagatgatgagccccggtctccagaaaaaaattaaaaaaaaaattagctgggatggtggtacaagcttgtggtcccagctacttgggaggctgaggcagggggatcctttaacccaggagttcaaggctgtagtgagctatgattgtaccactgcactctagcctggatgacagagcaagaccctatctctaaaaaaataagtaaaatgaactgaaatgaaaatttgattgtgacactcctaatgaaatcattcaaagggttcgtattgccaacaaaactaacttaggctccctatagcctaattctccaggctggccccaacctgaccctttcccacctctccagacctcagtctctgcacctcttttcccttcctttccaggctccagagaagctgggccaggtagagttcctcaaacccattactctgttgcacacaccactgcttttgctgtaactcttccttctgcctaaaacacttttcccgcccattcccttcctattaacaatgtgtgactcagctaaaatacatactgctgactctcagatggagctccattttgccttttatttcagcaagaaaggagagatcacatgcaaagcatctctcctgtgtctcctgactttgggcaaatgaacttactcctatcatagttcagggtacccatctgcaaaatgatgatgatccaagaaacgactcgataggtctgtagcaagaattaaattagataacacacctagagcacgaaaaacaaggcctggtacatcacgaatgttctatgaatgttagctatcgctgcaaaatatcattgcatgtgcttgttcctattgacggtccctgctgctaaaataggagtccttgagttatggcttattcatctaacttgccggcagatgaggtgacagccggtgatggggtcaggcctgggtttgaattaactttcttccacgtattagctgagccagtttctacatctctcaaatggaaatatgatagtgttgtgcagagaattaaagaagatgatgatagagagctcttggcacgttttctggcccacattaaaagcacaataaactgtttcatgtaagacttaagacccgactcgtaatagatgcttgatgaataaccgttttttatggctcctagatatctgattattttccaattcaaatccatgtttcctttgctgttaaataccagagaggggccgggcacggtgactcatgcctgtaatcccagcactttgggaggccaaggcgggcagataaggaggtcaggagatggagaccatcctggctaacagtgaaacccatcgctactaaaaatacaaaaaattaaccaggcgtggtggcaggcacctgtaatcccagctactcgggaggctgaggcaggggaattgcctgaacccacgaggtggaggactgcagtgagcggagactgtggcactgcactccagcctgggcaacagagcaacacaccgtctcaaaaaaaaaaaaaaaaaataccagaggggggaagaatctacccaatagatatgacatggaagaactgaaggactatgactaaggagagtcccagcccccattgaaactattccaaaatatcttcatcttcaatcaatgcattgggggtaccatagaagacgacctatcttaatattcagatatttctaggcctggcatagtagctcacgcctgcaatcccagtgctttaggaggctgacaggattgcttgaggccaggaactcaagaccagcaggggcagcaaagcgagactccatcactacaaagaataaaaaatgagccaggcctggtggcacacacctatagtcccagctactcaggaagctgaggctggaggatcacttgaacccaagagttggaggcctcaatgagttatgattataccactgcactccagcctgggcaacacagcaagactctgactcctaagaaaacataaaaataaagaaaaggtatttctaaataaccagtctatcaaccagtcagtagtgatgatgcaaaataccttaacacaaaactgcttgtgggccaccttccacatggagaaaatccttgagagaaacttttgattgtggagtccacaaaacagaaacgctcaagaaagcctcactctcaggaccctccttgctgtgggctctgccctcatttcacagggcttgtgatcaacctgctgacgaatttctgctcagaatgaaaatcactctgaagacgtgggtccgttctggcagtaaccctgctaccactaagacacattccatcctgcctcttataattgctaatgcattgcgtgtcctaattaaaaacaactaaacatttgttcagacgttatctttgttctccgctctagcaagttgtccgggacagtccactctggcctcaaagctggagacaggaagtggcagttcttggacatcaaggaattttctgaattatttgctgtgtgtcttaacctgggttccctaaacaaagaagcctcaggcaaaactttatgggtcagagaaggcacatctacagaagcagaaaatagattagtggttgcctggggctgggagtgagaacgggaaatgactgcaaatgggcttgaggatgtgtttttggggtgatggaaatctactcaaattggatttcggtgagggatgcgcattgctgtagattttatggtatgtaaatgatacttaataaattacacttcaataaagctgttgggggaaaaaaagaaaagtgtatgagctaatgtttatttggggaatagcattgcagaaaggcaagagtgatggtatagggttgagttggggacagaggggatggcagctctgagaagtgttgccacaaggctctgtgaccagctgtgtctactcagcaatgcactccactccagtgctgtgtgctccaaacagggagggagaaggatgcacccaccacgctcaggtccccctgcattattgggttatgcatgagcccagagagagctccgtagcttcttgcatttcaggggcaaccttaaagtgagagaccagggctacgaggcaaaggcgctgttgtggcatttgctcagcaagctgagggtggagtagagacccctgcagtgagcccttggtctaggcagggggtacccaacaagacagccacaggaggagcacaggcctcgctagctccaccccagcaagtgcaccaatctgggcagattccccagctcaaccctgtctactatgcaatgaatgatgcacaaacagtttggtgacaaggtgtttaccaccataactattgactagttaatgtgctaccttctttataaatatttgtatattaggctgggtgcagtggctcacgcctgtaatcccagcactttgggaggcctaggcagacggattgcctgaggtcaggagtttgacaccagcctggccaacatgatgaaaccctgtctctactaaaaatataagaattagctgggtgtggtggcacacgcctgtagtcctagctactcaggaggctgaggcaggagaatcacttcaaccaggaggtggaggctgcagtgagccaagatcgctccactgcactccagcctgggagacagagcaggactccatctcagaaaaaaaaagaaaaagaagagaaagaaaaaagaaatatctgcatattaagataggtcttttgaggactttgaggctgcagtgagctatgattgcaccactgcactccagcctgggtgacagagcgagatcttgtctcaagaaaagaaaaaaaaataggtcttctacaatcaggggtccccaaccaccaggcagtgacctattaggagccgagccgcacagcaggaggtgagtgaggggtgcagaagtgaagcttcatatctgtatttacagccactccccgccgctcgcattcccgcctgagctccacctcctgtcaaatcactgcagcattagattctcataggagcacaaaacctactgtgaactgtgcatgcaagggatctaggttgcacactccttatgaggatctaatgcctaatgatctgtcaccgtctcccatcactcccagataggactatctagttgcaggaaaacaagctcagggctcccactgattctacatgatgatgagttgtatgattatttcattatattaacaatgtaatcataatagaaataaagtgcacaataaatggaatgcacatgaatcatcccaaaaccatccgacatcccccactgctccatgggaaaaagcatcttccatgaaaccagtccctggtggcaaaagggctgcggaccactggtctacatgctaacatcaatgcatgactgaagatgaggattgcagatgtggctacatcaccacaccatgtcacctctccagaagcctgacccaggcagaaatgcaaacttgcctcaccacctctgttgaacattaaagacaaaggagaggccagaggcagtggctcacgcctgtaatcccagcactttgggaggccgaggtgggcagatcacctgaggtcaggagttcgagaccagcctggtcaacatggtgaaaccccgtctctaccaaaaatacaaaaattagccaggtatggtggcgcatgcctgtaatcccagctactctggaggctaaggcaggagaatcacttgaacccaagaagcagaggttgcagtgagctgagatcacgccactgcactctagctgggtgacaagagcgaaactcctgctcaaaaaaaaaaaaaaaaaaggcaaaggagaaaaaaggcagtgaagtcccaattttaatcatttcaatcccgtaatactgcaaaagacttgaaataaagacagctccacacggagctactgccttcgtacagcagctgtggatggacccagctaggatctccctgcaaaaaagaattccctgctgcacgaggcctttgggattcactcagtgttgagccacagccacgtcctccccaggcagcccccagccagtgactgggctggccatgggacttggtcccggccacttctacccaacacaggattcctctaatgggcaatctttgctgcagaggtaagcatgggtcggaccaaggctttgtcagatctgcatgggaatctgagactcctcctgttcagttctacttccaggccattcaatttcacagccattattataatacttcctccctccccaccaataaaccttgcacacttgatctcaacatctgcctccagaaagacccaactaacaaacttgttgaccttaaatatcactggggctgggcggggtagctcacatctataatcttaatgcattaggaggctgatgggggaggactgcttgaggccaggagttcgagaccagcttgggcaatacagtgagactctgactctacaaaaaataataataataaatttaacataactgagcgtggtggtgtgcacctgtagtcccagatactcgggaggcctaagcaggaggatcactggagcccagaagtctgagctatgattgtaccactgcactccagcctggatgacacaagaccctatgtctttaaaaaaaaacattaaagataaataaatacatatatctttcataggtctggggattaggaggtggcatctttggagaagccataattctgtgtatcatagggtgcatcccaagcgtaaggtaccctgaccctagggaggtggagaagagtcagcgtggggccagtggctctctaagctcttgtcaccttctgtccccttcacctgccttctcactcctgagttctagacatagagaacagttattgaaccagatacacctctgatcccaaaataaagcaggggacagtgaagctgagtggtcccctgagctctttctccaaaagagacaacttcacagcattgttttttggtgggggagacagggtcttgctctgtcacccaggctggagttcagtagcacaatcacggcttacagcagactcaacttctccacctgaagtgatcctcctgcctcagcctcctgagtagctgggagtacaggcacatgccaccacacccactgattttttttaagagatggggtcttgctatgttgcccagactggtctcaaactcctgggctcaagtgatcctctcacctcccaaagtgctgggattacaggtgtgagccatcacatccggccttcagcatttttaaacccatgtgtgaatgtgacaagatgttaagaggcaatagagaaaatacaagaaaggattaagaaaagtacctttttgggggtctgcttccccacggaccaaggtgcaggcattgtcccacacccaaactccccctaagggctctagtctctgctgtaggacgtggctaaatggacaagagggttcctggagaccaagcacaccccagccactcccctgtcctaggtagcacagcactgtaccccagtgagtaacaggactcaggagcctcggggtggaggcaggtctgggcctgggcatcttgcctcttggagtatgactaacaccagccccaaacatgattatagaaaacaactctataaagccctggtccatgccaataaagcgctctccctggccctgacatcaccgcttctatagcaaccagttactcttcaaagagcaaagtgtgggagagtgcaaaacagagtcaaaactgaagacactaagtcgtgccagatgaagaaatgggccagaaagctacatcagagttcagagattgtcatcagagaaggtctaggggaagaaggacgatttcacaggcatctctagggtccaaaccagaaagacccaactgacaaacttggtgaccttaaatatcactggggctgggtgtggtggctcacacctataatcctaatgctatgggaggcttaggtgggaggattgcttgaggccagaagttcgagatcagcttgggcaatatagcgagatcccccaactctacaaaaaaattaaataaattttttttttttttttttttttttttttgagatggagtcccgctgtttcatgcgggctggactgcagtggcactatctcggctcactgcaagctccacctcccagcttcacgccattctcctgcctcagcctcccgagtagctgggactacaggtgcctgccactgcgcccagatagttttttgtacttttagtagagacggggtttcaacatgttagccaggatggtcttgatctcctgacctcgtgatccgccctcctcggcctcccaaagtgctgggattacaggcgtgagccaccccgctccgccaaaattttttttaaataactgtgcaggccaggcgcagtggctcatgcttgcaatgccagcactttgagaggacgaggcaggcggatcaccaggtcaggagatcgaacccatcctggctaacatggtgaaaccccatctctactaaaaatacaaaaaattatccgggcatggtggcatgcacctgtagtcctagctactcaggaagctaaggcaggagaatcacttgaacccagcaggaggaggttgcagtgaactgagatcgtgccactgcactccagcctgggcaacagagcgagactccatctcaaaaaataaaataaaataaaataactgtgctttgggtaaccaaagcaacaatgaagtgcccagctcagtagcctgttattgtgatttgttgctttttctgttgtgtggggtgaggaattgagtgagaatctctaacctgaccatgtagaggacgccatgcttgaagaagtttccaaaaccgaaacatcactttgctttagtatacaatgtctaagtaaacataattgtccttcaaagaagagaaaaccattaatccactcaatgggaaccctgggagagtagggactaggtggtcattaagaccttcttatggacgttaatgaatgtgaccctataaaacaatgactggtaaagcactatgtccaaagcacggttttcctctgaaggagaagtgcctcattatccattctgtagcacctaggctatcttcatctaatctgatctggccggcaggtaaaaagtcatggagttcaggaaggggctgggtaggagagatgcaaattgtgtactcccaagagcgacagagtgcagggaactgcagatgccatgagaagcacacccctgaaacaggaaactgcaccctacctgaattaccccactcttgactctgacaactaacaacatgcattttttgggaatatgtattcattaaataagcactcagccattctatttctcaattacctctagtgaccctaagatctgaccacgggcatagaagaggaaaaattcttccctagtgacagccagctgtaactgagtcaaatgcccgtcattttttcttcattttcttaagagacaaggtcttgctctgttgcccaaggctggagtgcagtggcatgatcatatctcactgtaaccttaaaatcctgggctaaagtgatcctccaacttcagcctaatgagcagctaggactacaggtgcattccaccacaactggctaatttttctttttattttttgtagagatggggtcttgctgtgttgcccaggctgatctcaaactcctggcctcaagtgatcctcctgccccagcctctcaaagtgctggcattacaggcatgagccactgtacctgttaagatgctcttcatttaagagtcaactgaatttcagaatcaatcagaggtgcaacatgtagtactccttgatacaatttcccattaaaatccatgaagatacacatgcgcgcacacacacacacgcacacacacccttgcacacacatgcatacacatgcacacatgcaatgcacacacacgcacgtgcacacatacacacaagcatgcacgcacacacacacacagaggcagcagaataggaaactgcatataatagaatttcctatgcaaataggagacatttcaatggctgaactgtcaatagggtcagttcaagagacaaaatcctggaatgaacaagagctaccttctaaaccagaactgcatcgatgatatcaaaggatgcagaaaaacacattgattagcctcctataaaaaaaaattcaacctcactagtagtcaaagtaaaacaaaactccagtcttatttgaagcaaccaaattggcaacaattttttttttataattttttttgttttattattattatactttaagttttagggtacacgtgcacaatgtgcaggtttgttacatatgtatacatgtgccatgctggtgtgctgcacccattaactcgtcatttagcattaggtatatctccaaatgctatccctcccccctccccccaccccacaacagtccctggagtgtgatgttccccttcctgtgtccatgtgttctcattgttcaattcccacctatgagtgagaacatgtggtgtttggttttttgtccttgcgatagtttgctgagaatgatggtttccagtttcacccatgtccctacaaaggacacgaactcatcatttttttatggctgcatagtattccatggtgtatatgtgccacattttcttaatccagtctattgttgttggacatttgggttggttccaagtctttgctattgtgaatagtgctgcaataaacatacgtgtgcatgtgtctttatagcagcatgatttataatcctttgggtatatacccagtaatgggatggctgggtcaaatgggatttctagttctagatccctgaggaattgccacactgacttccacaatggttgaaccagtttacagtcccaccaacagtgtaaaagtgttcctatttctccacatcctctccagcacctgttgtttcctgactttttaatgattgccattctaactggtgtgagatggcatctcattgtggttttgatttgcatttctctgatggccagtgatgatgagcattttttcatgtgttttttggctgcataaatgtcttcttctgagaagtgtctgttcatgtccttcgcccactttttgatggggttgtttgtttttttcttgtaaatttgtttgagttcattgtagattctgggtattagccctttgtcagatgagtaggttgcaaaaattttctcccattttgtaggttgcctgttcactctgatggtagtttcttttgctgtgcagaagctctttagttcaattagatcccatttgtcaattttggcttttgttgccattgcttttggtgttttagacatgaaatccttgcaaatttgcaacaatttctaaaaccataaacatgatgttggcgaaagggtggtgaaaggggagtatttttcacacggttagtaggagtggaaacagaactgacctatcagggaagcaactggacaatctgttataagagccccgaaaacgtggagacgcgatgccccagtgttttcacttacacaagtcttggcttctttttttttttttttttttttttgagacggggtatctatctgttgcccaggctggagtgcagtggcgtgattttggctcactgcaagctccgcctcctggattcaagcaactctcctgcctcagcctcccgagtagttgggattacaggcacccgccatcgtgcctggctaatttttttgtgttaggtcacagctttaaaaaacaatcacaaagacaagcaaagatttgtttttccatagttcactacataactacttaggaccaggaaaaactggaaataaagctgagtggctgaggctggacgcagtggctcatgcctgtaatcgcagtactctggaaggcgaggagagcggatcacctgaggtcaggagttcgagaccagcctggccaacatggtgaaacccagtctctactaaaactacaaaaattagctgggcatggtggcatgtgcctgtaatcccagcaactcaggaggttgaggcagagaattgcttaaacccgggaggcggaggttgcagtgagctgagatcgtgccactgcactccagcctgggtgacagagagagactccatctcaaaaaaaaaagaagaaatacctgagactgggtaacctataaagaaaagagttttaggccaggtgcagtggctcacgcctgtaatcccagcactttgggaggccaaggcgggcggatcatttgggctcaggtgtttgagaccagcctggccaacatggtgaaaccctgtctctactaaaagtgcaaaaattagccaagtatgggggcacaagcctgtagtcccagctacttgggaggctgaggcaggagcatcgcttaaacctgagaggcagagattgcagtgagcttagactgtgcccctgcgctccagtctgggtaacagagcgagactccgtctcaaaaaaagaaaaaaaaaaagaaagaaagaaaaaaggaaagaaggtttaattggctggcaattctggagcctatactggaagtgtgatgctggcatctgcttggcttctggccaggcctcaggaaacttgcaatcatggcagaaggcaagggggaaagctggtatgtcacatggcaaaagcaggagcaagagagaggggagataccacacacttttaaactatcagatctcacgagaactcactcactgtcataaggacagtaccaaggaggatggtgctaaaccattcacaagaagtttgcccccatgatccaatcacatcctaccaggcccccctccaacactggggattacaattgaacatgagatttgggtgggggacacagatccaaaccatatcaggtgcctcatttggaggagtcagtgctggtttttcacccacctctcaggatcttgcttgacacaatcagagacccccgtggccagaaatcacaagctaaaaagaaagggagaaggccaggcgtggtggctcatacctgtaatcccagtgctttaggagaccaaagggcaaggactgcttaagcccaggagttcaagacaagcctgagcaacatagtgagatcctatcttgatcaaaaccatacaaattattcaggcacggtggtgtgcacctgtagtcccagctactcgggaggttgaggcaggaggatcgcttcagcccaggagttagaggctgcagtgagctatgattgcaccactgcaatccagtctgggtgacaaagcaagaccttgtctctaaaaatcaatgaaaaaagaaaaggagagggtagcccctgcttagggtgagctacaggctcctgttaaagcagttggcactgggacacaggcaagggagtggtggcaacaaaacataatcagaatgatgggctttccttgctatttatttaacgggccgcggtcaggcagaggagaagaggggttcccattcttctgacaacagagctgagcttaatctgaaattgaggtggagctgggcacatgggagaaataaaatctcccaggagaattaaagtctgaaggaatgacttccaagtcactggaggagggaaaatacaaaggaaacatcatttctaaaccaaaaacagggcccaaccagcatgaggaaatcgtgctccttcagcttctaactagtatggaaggtgattcattttttgatggatatggcttacagggtaaaaaaggaaccaagtggcttctctcaatgctagtgaactggaggatgacccagcagccactgcttaaaaagagcaggacattccctgcactttccctgaacttggtctctcataggcctgatgtggtccctcacaggcccccacaaaaggaagtcattaccaaaagcagaactaccatttgacccagcaaaaaaataaattgttctacccaattgttctattgaaaagccacccgcactagcatgtttattgcagcattattcacagtagcaaagacatgaaatccagacagatgaaatcaacagtggattgggtaaagaaaatgtggtgcatagacaccatggaatactatgcagccataaaaaagaaggaaatcgtgtcctcggcagcaacatggaagcagctggaggctatcatcctaagcaagttgatgcataaacagaaaaccaaatactgcatgttctgatgtatacatggagctcaagtattgggtacacgcagacatgaagatgggaacaacagacagtggggactactagagggaggatgtagggaggaaggcaagggttaaaaagctacctattgggtgctatgctcattacctgggtgacaggatcaatcgtaccccaatatcacacaatatacccttgtaatatatactcattatcacacaatatacccttgtaacaaactggcatatgtacccccttgaatctaaaataaaagttgaaattattttttaaattaaaaaataaaatcttctaggagaattaaaattggaagaaatgactttttcattcactagaggaggtaaaatgcaaaggaaacatcatctatataccaaagacagggcaacgccagcacaaggaaatagcattccttcagttcctaagtcatatggaaggcaaaattttttttggatggatatcacagggtcaaaaaggaaacaagtgacttcttttaatgctgttactcatgttcagaattaaaacccgtgaactaaaggaagacccagccgtgctgtttaaaaagagcaggatatggccagacatggtggctcacgtctgtaatctcagcactttgggaggccaaggcaggtgaattactttagatcaggagtttgagaccagccttgcaacatggtgtaacctgtctttactaaaaatacaaaattagctgggagtggtggccagtgcctgtaatcccagctactcgggaggctgagacacgagaatcgcttgaaccccggaggcagaggttgcaataagccaagattgcgccactgcactccagcctaggcaacaccgtgagaccctgtcaaaaaattaaaaaaaaagagcaggataaggccgggcacggtggctcacgcctgtaatcccagcactttgggaagtcgaggcaggtgaatcacgaggtcaggagattgaggccatcctggctaacatggtgaaacccggtctctactaaatacacacacacaaaaaaaaaattagctgggtgtggtggcgggcacctgtagtcccagctacttgggaggctgaggcaggagaacggcatgcatgaacccaggaggtggagcttgcagtgagcagagatcacgccactgcactctagcctgggtgacacagcgagactccatctcaaaaaaaaaaaagcacgatattccagcattttccctgcacttggtctctcataggcccaatgtggtgcttcacaggcccacaggaaggaagtcattttaccaaaagaggccgggctcggctttcacgtctcttcctcagggaagcttccttcactgagcaccaggttcctgtctgagacagcaggacacaccttagcagggtgtcctcctgtgtgtccccaattctgtaagcaccctgcttcggttctttttccaactgactcgatacttaagtgccaattaccattccctggcacgggggaggggcaacgataccccaaaaagggccacttacaaagaagtgagcagggctttccgccgtgttggtcaagcttcaaaaggagtggccaatggggaaaagaggtcattttcagttttctgtgccaaagacaagcagctagacggaaagatcacacacagctcggtctctgaagactgataattccacgtgtattctattttaaagcgaagccctcggcgctaccttgatgattttgtagaatttacactgaaagggcataaaatgtcacgccatcttgtgtgttcctcacttccatgtgctctttgcgagaaaatcaaactcagctgtttctgagctcctagcgagtacccacaatgtctaaggcttacaatttcaactgtgcatatcttctgcaaggcaaaagggtgcagggaaagaaatagcagtggatcaggcctgtaatcccagcactttgggaggccgaggcaggcagatcatgaggtcaagagatcaaaaccatcctggccaacatggtgaaactccgtctctactaaaaatacaaaaattagccgggtgtggtggcacacacctgtagtcccagctactcgggaggctgaggcaggagaatcacttgaacccgggaggcaggggttgcagtgagccgagattgcgccactgcactccagcctggtgacagagcgagactccacccaaaaaaaaaaaaaaaaaattagccgggcatggtggtgcacgctaagaaggctgaggcaggagaatcgcttgaatccgggagatggaggttgcagtgagctaagatcacagcattgcactccaacctgggtgacaagagtgaaaatctgtctcaaaataataattaaaaaaagaaagaaagaattagcaatggaaaactgttcatgccaccgagatgcttctctgaaccatgatttccccaactgcaaaatgaggctaactctgcctacctggcaggggtgacataatgacccaatgcatagtctagcccataggagtccttgctcttcccctctttgggcctcagtttcctcacctagaaagcagcagggaagggtcaagaaagtaggcaacttcataagatgacccagcttcaacaccccacattgttaggacttcctctaagacatatcactgaaggtcagctttcgctatcccagtgctttcaagggttacatggacaggataaaagttatgatccccaaacacatcttcctacactgtagagataagaaagagggctgacattatcctaggcaaactgatgcagaaacaaaatcaaataccgcacgttctcatttacagatgggagcattgggttcacatggacaggaaaatgggaaccataagtctggccacagtggctcacacctgtaattccagcactttgggaggccaaggtgagcagatgccttgaggtcaggagttcgagaccagcctggccaacatggtgacacccatctctacaaaaaacaattagccacgcatgatggcgcatgtctatagttccagctacctgggaggtaaggcaggagaatcacttgaacccggaagacagagactgcagtgagctgagattacaccactgcactccagcctgggccacagagcaagactccatctcaaaaacaagacagaaaagtaaagatgggaacaatagacattggggaaacagggatggacggcaagggttgaaagactacttattgggtactgtgctcgctacctgggcgacagtttcaatcgtatctcaaacttcagcatcatgcaatatacctttgtaacaaatctgcacagtaccctctgaatctaaaattaaaagcttaaaaaaaaaaaaaaagagggcagccgggagtggtggcctacgtctgtaatctcagaactttgagaggccaaggtaagcagataactaaaggtcaggagttcaagaccggcctggccaacatggcaaaaccctgtctctattaaaaatacaaaaattagctgggagtggtgacgggcgcctgtaatcccagctacttgggaggctgaggcaggagaactgcttgaacctgggaggtaaagattgcagtgagccgagatggcaccaccgcactccagcctgggtgacagagaaagactccgtctcaaaaaaaaaagaaaaaaaagaaaaaagaaaaaaggtggtaacaatagacattgggttgtggggggtgggcaaaggttaaaaaactatctgttgggtactatgctcactacctgagtgagaggtccaatcacatcccaagcttcagcatcatgcaatatacccttgcaacaaatctgcacaagtaccctctgaatctaaaataaaaagttacaaaaaaggagaatcactcgaacctgggaggcgggggttgcagtgagccgagactgcaccactgcactctgaatcattatgaagatgagaagtagaggcaccagaaacccaggagagcgttccccaagctacactgtagacaccatcccgaaggtcttccaccagctagcaagtactctgtcccaggacctatgccttctccaagcaacttccagctccacaatccctactctcatttctgctaagctcctccaatgtcggatttcaggttcacggcaaagcagaacggttctgaacaggtttgggaatactgaaccaagtgctgctgtctgtgcctatcaatgtagctcttctttctttgtcgtgggaacttccatccacacacagctgcttaacggggactgggcttgtcaatgagatgcctgtgatcccaatgtgtttctctcatctaattagtttggtcaaagagagaatgtagtgtttccagggactagaagacttaccttaatcttcccttcactcaacattctgtcctctgcttgcctagaatgcatgtaactccactcctgagcttagcatatcacataacaattagtttaaatgtctggcttccccactgggttgagagctcctcaccgggtttctctggggtgataaaatgtgttctaaaactgaatcacagtgatgtgtgcacagctccgtaagattatgaaaaatcattgaactgtacacttaatgcaggtaatttgatggtatataaactattcctcaataaagttatttttaaaaatactccagcattcattggtgcatggctgtgggcaaattactctctgagcctcagtttccttatctgtaaactggaacaacaataactgatgttgtacaatagtcgcaaggtttaagtaaaggtgacgatggaaagaaggtgcttaatgcagggcctggaatacagcaagcactccacaagtgttggctaccttatttatatatttatttatttatttatttatttatttatttatttattgagacaaggtcttgctctatagtccaggctggagtgcactgatgcaatcatagctcactgcaacctcaacctcctgggtttacatgatcctcccacctcagcctcctgagtagctgggactacaggcacatgccaccatgcctggcaattttttttttttttgtagagatgttggtggtggggggcggggatctcactatgttgtccaggctggtcttgaactcctgggctcaagtgatcctcctgaagtgctagaattacaggtatgggccaccacacccagcccatttttaattattattatttgtccagcactaaagatacaatcagggaaaagggaaaaacgaacatggaagaaaagctgggtgctgtgggaggcagaaaaaagcctctccaaagatgaccatgtcctggtccccagaacctgtgaatctgttacctcagataacaaagagactttgcagatgtaaaaagagatcttgagatgggggtattatcctgttttatctgggtgagcccaatgtaatcacaaaggctcttaaaaagatggaagaggaaagcagagcatggtggctcatgcctgtaatcccagcacttgggaggctgaggcaagaggatcgcttaccatttgacccaacaatcctattactgggtgtgtacccaaatgattataaatcattctactataaagacacatgcacacgtatgtttactgcagcactatttacaatgggaaagacttggaaccaatccaaatgcccatcaatgataaactggaaacagaaaatatggcatatatacaccatggaatactatgcagccataaagaagaatgagttcatgtcctttgcagggacacagatgaagctggaaaccatcattctcagccaactaacacaggaacagaaaaccaaacaccgcatgttctcactcataagtggaagttgaacaatgagaacacatggacacagggaggggaacatcacacaccggggcctgtcggagggtggggagcaaggggaaggagagcattaggacaaatacataatgcatttgcagggcttaaaacctagatgacaggggccgggcacagtggctcatacctgtaatctcagcactttgggaggctgagccgcgcggatcatgaggtcaggagatcgagaccatcctggctaacagggtgaaaccccgtctctacaaaaatacaaaaaattagctgggcgtggtggtgggcgcctgtagttccagctactcaggaggctgaggcaggggaatggcgtgaacccaggaggcagagcttgcagtgagccgagactgcaccactgcactccagcctgggcaacagagcaagactccgtctcaaaaaacaaaaacaaaaacaaaaaacaaaacctagatgacaggttgataggtgcagcaaaccaccatggcacatgtatacctaggtaacaaacctgcacgttctgcacatgtatcccagaacttaaagtaaaattttaaaaatattttaaaaacagatcagcctgggcaatgtggcgaaactctgtctctacaatagatactaaaaaaaaaaaaaaattagctgggtgtggtagcatacacctgcagttccacctacttgggaggctgaagtgggaggatcacctgagcccaggtaggtcaaggctgcagtgagtcatgatcacgccgctgcaccccagcctgggcaaaagagtgaggccctgtcttgagaaaaaaaaaaaaagatggaagaggacagtaggagagtcagagagagagatctgaagatgctccactgctgcctttgaagatggaagaggagatatgagctaaggaatgcaggcagactctatagaagttcgacaaagcaaggaaacagattctgccccagcatctccaaaggaatgtagccctgataatatccctattttatcccagtaagatgcattccaaactccgacctccagaattgaaagataataaattcgtattctgttaagccgctaagttagtgataattggttacagcaaccacagaaaactaatataggcacagtcgtttccccatcacccacagcgtcactttctgcagtttcagttacctgagttcaaccacattccaaaaatatcagatggaaaattccagaaataaaaaattcatcagttttcatgtgcatgccattccaaggagcgtgatgaaatcttataccatcccaaactgccccacctgggggcatgaatcgtgcctttgtgtagcctagccacactgtctacactaccagtctgtcagtcactcagtagctgactgagctatcagatcaactgttgcagtacacgctttttttttttaatttttattttaagttctggtgtacatgcacaggatgtgcaggtttgttacataggtaaacatgcaccatggtggtttgctgcatctatcaacccaccacttaggtattaagcccagcaggcattagctatttttcctaatgctctccctcccccaacgcccctgtccaacaggccccagtgtgtgttgttccctttcctgtgtccatgtgttctcattgttcagcttccacttacaagtgagaacatgcagtgtttggttttctgttactgcattagactgctgaggataacggcttccagctccatccatgtctctgcaaaggacaggatctcattcttttttatggcttcatagtattccatggtatatgtaccacattttctttatctagtctatcactgatgggcatttgggttgattccatgtctttgctgttgtgaatagtgctgcaatgaacatacatgtgcatgtatctttgtaacagaatgatattttattgctattgttgttagtctctcactgtgcctaatttataaatgaaactttctcatacgtaggtacctataggaaaagatgtactaggtacagagctcagtgctatccgtgatttcaggcatccactgggggtcttggaactcctcccttgctgataaccccacccttactgtaccatgctgtggaatgcctgggctgtcagggtaagagtagactaaggaaaagagtgatcaactagagctatattttttgtaaaatcaatttgtttagcagcatgtaagttgcactggggggcaggagagaggcagcaagtgtcagaaaagacgctgttgtcttggacaagacagtgcattgagaaggagcctgacaggtgtgaaatgtgtgttgggatattggatgcataaaacatatgcaacttggagatcccctacaggctggggccaaaggagaagggtcaaagaagacaaaaggctggctcatgggaatcacagtgacaccattctaggggtcagaagaaactgcctcagcagggggagcagagaggatgtaggagcatgcatcagctccggcaaggggtttagatttgggccaagagcttagaactgcagtcagaactaaagatcccattgtagaaccgtcatcgcagaggtgaaagccaaaagtaatccaggtccgggaagaagacaactaattgaacaactgcattgtacgtgataatactatttacaatagccaagcattggagagaaacaaaaatccaacaaataagagatggttaaataagttattgtcacttcatgcaatggactcgtagaaagctttcaaaaaaatttttttttaatttattttttgagacggagtctcactctgttgcccaggctgtagtgcagtggcaccatcttggctcactacaacctccgcttcccaggtacaagcgattctcctgcctcagcctcccaaacagctgggattacaagcacctgccaccatgctggctaattattatatttttagtacagacagggtttcgccatgttggccaggctggtcttgaactcctggcctcaggtgatctgcccatcttggcctcccaaagtgctgtgattacaggcatgagccaccacacctggcttaaaaagtattttttaaagaatagttaatggtttaggaaacatatgatatattgaaatttttttaatacaacataaaaagccaaattcctttaaaagactggaaggaaacaacagactttaacactatctatattgggtatagtgatgacagtgacaccttcttcttcataatttgctatatttttaatttagcataaattagcatgtttagcatgtaacatgtttagcatgtttccataacatggaaacacagttttcaataatatgcatataattttattgcacctgtttaaaagctttggctttattaagttctttctctgattgttgatgaaaaagtttagttcctttattttggtcacaagggactgtttttcgtcactatttttactgtttgacttcttgatacaataaagatcattctgtaaaaaggaaaaaaaaaaaaaaagaaggcactgtggagaaaggcatggaggagatcatttgagtaaaggacccactgcagggttggaaggaggaaaaaaagcaaccccaaggacagaataagagccaaaggagaagacggtctcggggagttgcctgtgaccctcagtgggatggagagttaaggggctaaggggagaagagaaggcagtgttcacaaagagatgtttcctttcaagagagagaaaaaggctgggtacaatggctcatgcctggaatcccaacaactcaggaggccaaggcaggaggatcacttgagaccaggagtttgagaccagcatcggcaacatagtgagaccccatttctacaaaaaaaaacagaaacattagccaggagtggtggtgagcacttatagtgtcagctacttggagggctgaggcaggaggattgtttgagcccaggagttggagggtgtggtgagctatggtcacaccactgggcaacagagcaaggccctttcttttaaaaactaaattaggccaggcatgctggctcacatctgtaatcccaacactttgaaaggtcgaggcaggcggataatctgaggtcaggagttcaagaccagcctgggcaacacagcaaaaccacatttctactaaaaatacaaaaatcagccaggcacagtggtgcacacctgtagtcccagctactcaggaggctgagacaggagaatcgcttgagcctgggagacagaggttgcagtgagtcaagatcacaccattgtactccagcctgggcaacagagcaagatgttgtctcaaaataaataaataaacaaacaaacaaacaaactaaattaagctagaaaaagagaaacaaagaggaaacataacaatagaaagacacactgatgtttacaaggaaacagtaaggttgagaagagtttgccatggacagtttcaatcttttaccacaaagatagaggcagtttgcaggtaattacaaggtaaagcaggattagaaccctacagagcacagagaaaagctgcgatctctgctttggatgtcaacaagagaagacaagaaacttccccgggagcccagccaagattagactctgcctagattcctccagccagcaaagtacctcccacagtctagcacatatgaggccattagttagggtggcctctgacatctcctgaatattgttggctttgttatttgttatctgaagtccacttgtctttttttgttttgttttgtttttttgtttttttgagatggagtctcgctctgtcaccgaggctggaatgccatggcgcgatctcggctcactgcaacctctgcctcccaggttcaagtgattcttctgcctcagcctcccaagtagctgggattacaggtgtgcaccaccacacgcagctaatttttgtattttagtagagatggggttttactatgttggccaggctggtctcgaactcctgactgcaagtgatccgcccgccttggtctcctaaagtggtgggactacaggcgtgagccaccgtgtccggacatgaagtccacttgtcttatcttcctaacttgtggagaacagaggccatctctaatttaatttggtatgttctccagatgctggatctcggtagatatcccctaagtacttaattatgggtggaaagcaatggaagagaagcaataatagcaaatgcttctagttgctattgctataatttcccaacatattgattaaaacttgctttaaagaaacacaacagataaaaacttataaaacagacctggtgtggtggctcatgcctgtaatcctaccactttgggaggccaaggtgagagaatcacttctggaagttcagaagtttgagaccaccctgagcaatatagcgagactctgtctctgccaaaaaaactaaaaattagccagtcatggtagcatgctcctgtagtcccagctactagggaggctgaggtgggaggatcacatgagcccaggagttggaggccacagtgagctatgatcacaccaccgcactccagcctggatgacacagtgagactctgtctcaaaaataaataaataaataaataaataagaaaaataaataattttccaaaaagttcaagcagatcaattagagtgtgtccacgccttatagaattcctttaaatactgcattagtattgtcctgggtgcattttaaaaagaatttgctacagggaaatctacattgaaggcaactcctaaagaaatagctccatagtgtaaaaatcatttaacgctagcacagacaggcttgcaaatgaaatccttcacagccccagcagaaagagtcccacacactctgctgtgcagcagagaaggatgtcaaagcagcccgtgttgattagactgtaaagggctcagaattccactccggggacctggcacatttctaaacatgtgggaaaactctccagcatcccccacccccgcccccctaaccttggactccatgacatctctccctctgctgtcttatgttgttattaagcctgtcaatcaaatctctgccccatcaccccttggccatgtagccctggaaggccaagttacaaccactgtccctttggttcttgcccacccggtaccccatccttatatacttgtacttgcaccctctgcaaagaaaataccccaagctccaaggtagcacagaactgctacctgaccaagaaccagccctggggtccaaataacctgatttcacattctgggccaggcacagtggctcatacctgtaatcccagctcttagggaggcagaggagggaggatagtttgagcccaggagttcgagacctgcctgggcaatataatgagcccattctccacaaaaaaaaaaaaaaaagaaagaaagaaaaaagaaaaagaacctgatttcacattccagtccaatttcttacaagctgaaaaccctcagaaaaatcacctaattattgggatagtgaccatcccaaccttgttattcacgcaacgtctctcacttacgtaaaggctcattaaggttgggtattatcattaagtgtttaaggaagagttgacttggcttgtaaggctgaaagagaacatataaaatactcaaagtcgaaattctcagtgttcagagccactcatcaagcccacccgccctccgaatcaactgcagaagaaaccaataaaatgggatggtctctcatcgagcaagttctactgacaacagtcaatatggaggctcatatatgttcgttaaaccaggaaatcagtgagaaaaacctgcccatagagatagcagcaaagacccaaggagaacctcaagtcctgccattcattggcatgcctgaaaaagttcagggttgcagaatttttttcctcttgcatcgtggtggaaaacgccaggctcatcgcaaaaatcaaattatccctacaatatgtgataattaatggttggattatctgaaccaaatgacatcccagagcaaactgtgctaactgttgggaggaggaaataaatgtgtcattgattttcagctttaatgatatagtacaggtatttgtgactatctgtcacatggaaaagactcaagacatgttggttattattatttcataagcaatgttcatggtctttggccaagggatagatttgtgtcctaggacacctccccatactgggagtctgcagaatttaattgatgtgttgaaggagcctgcagtgggaggtgaagtctgacctagttgggaacttttttttttctatttttatttttttttttttgagatggagtttccctcttgttgcccaagttggaatgcaatggtgcaatctcagctcactgcaacctctgcctcctgggttcaagcaattgtcctgcctcagcctcccgagtagctgagattacaggcatgtgccaccacacctggctaattttctatttttagtagagacggcgtttcaccaagttagccaggctggtctcaaactcctgacctcaggtgatccgcccggctcagcctcccaaagtgctaggattacaggcatgagccactacacctggccctggggaattcttattataccggtaagggaagatcaaatggatttgaggcatcactaaactgcaacatcacaaacatctgctgctctgaatcccacccccatggccagaagctgaaattgggaggtccttattccagataagggagacagggagagacgacagggccaaagaagtagactgcacctgtcactgagcagaggactagagagagcagcagaccaggagaggcagagacaggcacagaagccacagcgagggccaggagacagaagcagaaaaatgcattaaaccaaggagagtcttcactgcctgttagagcatttcaggttggctttttaaggttcttggggctgagttctgggagggctggtttcactcaagaaccatcagcccttactgagtcctccctctcttaggagttccccaaaatgaccaacacaaaagcaagacagagagaaacccttccttcttctagccccttcacaaatccagagtttctctggctactcaagaggaaatctataaggtgagattgcagacatcaagggaatgaggcatgtttaacaaggagtgccccagaaatgttaccatggaaaatggaagtgcctgcaacatcatggctctttctgcctggcactgttgacagcaaatgcataaaggacaagggttttggcaagttgatgaatgtataaatctagcatcttgaaggactccaaaaacagaggtggcattcagaagcttgtgaaggtaatgacccacaaaacaaggaagccctacagaagacagccgggttcaccaaagctccaggtgacagctaattgtttagggtctgcaggtgttcaccttgggaaacattgcaattgttgctcaggaataatactcttaaatgaaaaattcacaaaaggaaatcagtattctatgatagttacaagagcacatcaaaattaagttttaatatttccatttttttctttgatttttaaattttaactggagtcttctccatccagagaaacaaatgtctatgagaatgagttgcaaagagactgagctgctggctttattccctagaaattcatggtataatgaatttatttcctagaaatttattgaatgaattatttaatgagtataatttattatttaatgatttttttatttaatgaatttattccctagcaacactttattccctagaaattcatggaataatgagtgtctgatatggtttgactgtgtccccacccaaatctcatcttgaactgtagttcttgtaatccctacatgtcatgggagggacccagtgggaggtaattgaatcacagggagggttagctccatgttgttctcatgatagtgagtgagttctcacaagttctgatggttttttaaggggcttttcccctctttgctctgcacctctatttgctgccgccacgtgaagaagggcatgtttgcttccccttccaccatgattgtaagtttcctgagacctcctcagccctgtagaactgtaagtcaattaaacctctttcctttgtaaattacccagtctcaggtatgtctttattagcagcatgagaacaggctaatacagtgtcatagaaaaagaaaagattgtgacaagacagagacccagacctctcatgatcagacatcccccactaatgtggacaaagctaggaagcaggagagagggccctcagactcttgccccaccttaaacagcctgactcttcacactaatctgtgcctttacagccagtaagatgttgtactccgtgacttctaaaatacctcctggtgctttctattcaaatattctgtgatggctgggaaaagtggctcatgcctgtaatcccaacaatttgggaggccaagacaggaggatcactagaggccaggagcttgagaccagcctgggaagcacaccaagaccccacctttccaaaaaaataaataaattagccaggagtggtggcacgtccttgtattctcagctacgcaggaggctgaagcaggaggatcacttgagctcaggagtgaggctataataagctatgattgcaccaccgcactccagcctggacaacagaacaagaccttgtccctaaaaataaataaataaataaataaataaaccaaagattctgtgacgctctgctgtcttagcttctaaaccctcttgatgtgcagagatttttatttctattgtattctgcacatctgacacagcataaatatcaacatataataaaagtttagtatattcctgtatttaaatgtaaacagcaaaatcttcctaaattatctgggtataacttttctaaggtgttaatttcttaaatccccaaggtgcatgggtttgtagatcaagttaactcaacagaataacgtgggatgctacagaaaaaaaaaatgtggattttctaatgacacagaatgcccagcctctgccaggtagctcctacatgtgccctcgatcccaacagggttcagaagagagaatgtgcaccacttagtacacaatgcacagcttcgactgtgcattcccttactaaaaccaacagaaccactgtcaaagtgcctcccctcctgaaagcaggatagtcttgtacattgcatgccagcagagacaacacaagccaagggtggaagggcttaaggatttctattcgaccatgctgaaaccaagctttaagtttaaatatgagtgacattcttacaaccagctcattttgctgggtaaacaactcaacaatcctggagagaatcctagcctcaagttctagctgtaatgacttgagactaatgttttgaagagagactccaggagtgtgggggctactttgggaagtctcataggatccaccagtcctatagttctcgaaacacttggggaaatttctttttttttttttttaaataaagatggggtcttgctttgtagcccaagctggagcgcagtagagtgatcatagctcactgcacccttgaattcctgggctcaagctatcctcccacctcagccttctgagtatctgggactataaggacgtgccaccgtgccaggctagttttttaactttttgtagagttcgagtcttgctctgttgtacaggctgatcttgaactcctgacctcaagcaattctccagccttggcctcccaaagcgctggtgttacaggtatgagctgctgcgactgggggagatttgctgaatagcttccaaagccagtgtctaacaaacacagatcaacttgttactgcatgttcatacaaacattactgctagtttgatcaatcaactgctccacatgatttgactctaaactgccattctctgttgctaaaactaccctcatcttcagaagagaaggattcgttgctgttaagtttattcctgaggatgtctcaaggccctatagtcagctggcaaagaaatccagtcattcactgagtgtgggcagtgttcttggagaaagaatcactaatgtgtagggtccatcacttccactggtctgaattatgtttccaagtgacctatacaaatcagagtgtatcatgcttttctgctgttctctctacctggaaggccagtcccatgcctgtttacactggacaaatatttggtttttaaaagcattatttggccttctggaaccttccttgagtgctcccagccacctcctctaaaagcattacttactccccgcattatcagagtctatatctgcccctctcaatagactggagtggaatcaaactatctttgaaccatttcaattccaatctagcctttactacattctctggcacacagtagattcttagttaatatttgctgaatttgaatagttttagttcaagtaagttggcttgagaatcattcatgttagagtctgttttgcacaatgaaagtattcaccattcaacaggcatttattggtcactaaacttacaccagccatggactaggggaagggagagtcgtttcttagtgtcttttctcagacttgtgcactgcatttttggggtgtctttattttgttctgtttttaataatttttaaaagtcaagaatggtacgagcacattctgttttcccccccacacatttacttaaacaaaaaaggttcagaccgggtgcaggggctcacacctgtaatcccagcacttttggaggccaaggcgggcagatcacctgaggtcaggagttcgagagcagcctgaccaacatagagaaaccctgtctctactaaaaatacaaaattagccaggcgtggtggcgcatgcctgtaatcccagctacttgggaggctgaggcaggaaaatcgcttgaatccaggaggcagaggttgcagtgagccaagatcacgccattgcactccagcctgggcaataagagtgaaactccatctcaaaacaaaaaaaaaaaggttcaaatatatctgatgcaacacactcatgtctaaaacaacagataccataactcagccatgcctctttagtttgtctccaaacaaaagcagcccatgccatctaaaaagtaaaggccactaggatgaaagtttacgcatttaaaatccctctctctctctttttagtcatttaagcttttgagtatacagttcagtggcattaagtatattttcattattgggcaaccaccaccatccatcctcaggactttttcattatcccaaagtgaaattctacctattaaataactctgcacttgttaaacaaccctattcctcctcttctgagcccctggcaaccacccttctacttcctatgaatttagctattctagggacctcatagaaatggaatcatacagtatttgtccttttgtgtctggcttatttcacttaccatgctatcttcaaggtgcacccatgctgtagtgtgtgtcagaatgtccttcctttttaaggctgaataatattccattcaatggctataccacattctttccaccttttggctattgtgaataatgctgctatgaacatagatgtgcacatatctgtttgagtccctgctttccatcctttggggtataggcataaattgatggataatatggtaactttatgtttgggtttaaaaatcttaaattatttttaacctttgggagtaagagagaacaactcattattttttgtacacggttgggaaaataaaatccactctagtggaggatctggaaatgtcaggtttttacctactcataaacaattcaaaaaaagtaaatgatcataccttcagggactcctaaaagcattggctaaatatggttgaaatattaaaattaaggccaggcgcagtggctcaaacatgtaatcctaacactttaggaggctgaggtgggcagatcacttgaggtcaggagtttgagaccagcctgtccaacatggtgaaaccccatttctgctaaaaataaaaaaattatacaggcgtggtggcatgtgcctgtaatcccagctactcaggaggctgaggcaggagaattgcttcaacctgggaggcagagattgcagtaagccaatattacaacactgcacttcagcctgggtgacagagcaagaatccaactcaaaaataaaattaaaattaaaaaataaaaattaactggcttttaattattgccagaaaaataatactaaagttagcaaagacatttgatattatagatatggatgtagatattcccaaaacccaatttcactcaatgatctgaacctaaccagtaatccagataaagggaagtgatgcggagtgaatgcttgaagccttaattcccaatgtgatgatatttggaagtgggacctctgagaggtaattaggtttagatgaggtcatgagggaggagcccccgtgatggtatcagtgcccttatgaggaaaagaaaggactgagctctctctctctccatgtgaggacacagcaagaaggcagccatctgcaaaccaggaagagagccctcaagaactgaatcagctgccgtctttaatctagacttcctagccctttagaactatgagaaacaaacttttgttatttaagccacccaactgatggcatttctatagcagcccaaactgaccatgataagaagtaattttgattattttcctactcccaactgtctaacgtttgtttgttttttaaatcagtgagcttctttcggtgctaagtgctgacctagcaaaccttagctgcatccggggatgcagtgttggggactaagagaaacagccccaggcacaagaaggcgggaagagcacatgaaccagcgctccccactcctccgcccctgcccccagtactcactgtcaggacttagtggtttctcctgtctggagtgagtgaccttagacaaaacccctggcccttctgagccaatcaagctgctaggctgatctaatgagattctgtatgtggacagcaaagtgggccatagaactaactgtgagtcctcactggcccgaaggaaagaactcattctacctaagtgaatttctctacctaactaaagtccagagacaaagtccacttagtaagtttgaatggaaatactgctgaaacatatgacatacttctattccttctttttagtttttatttgctagctcaaggtcaccatgaatgccgactgttctacctctatctaccgtacaatggtctttccaggagctactgtcaagtctgtatattgaattctcccatcctgctgaatggaatgaggacttttctgaaggctgaatctccttgctgaaagctaaatctccttgctcaagaccatacacatagaaggtacaatgcatgggctgaccctgcaaggaactccagaaaagaacctaaagttacgtttttgaagaaatctctgattttaggcacagagacttcaactttttcatcactgcattcccagtgcctggcatatagcagatgttcaggaaacctttactagattccgataaaacgatagggtaaagatccctcaaactctgattatttcagaattctgggtatttggtttcaattatttcaatgcaaagctattcaagaagtccacaaataccatattaagttcctacaacgtacaagactgctgtaaacaggattgaaaaataagcgtgttcctgctctctaggatgtaatccagtagaggaactaaaatatataaacaagaaaacagaaaagttccacaatttattattgggatataaatgaggaataaaccaagttaaagcacagagaatgaattcctttttttttttttaaatcagctttctcaggttgaagagaatgaatttcatctagctgtagggtgattttagaaggttccataaaggatgtggcaattaaaatgggggttgagtaggaactcagcaggtgaagaacaagcagaaagggcttcccagacagagaaaatatagttataagtagcttgcaggcagaaaaatgtggttttatggcactaccaatggatagaaagaatgactattccctttctcaactccacagttagcaataacttacataacttggtgctcaacttcagagagagaggaaaagcaaattccaatttcctaaattgtaccaaatactaagacggccctaccctctgactccctctgacttttattccaactcctctaaatcgtggtgtggagagatggatgacatcatcaggcatcctacatctcacatgaggaaaacagaacaggaccattattcagcatcctcatcaccttgctccatcccaaaacatcgtaggtgatgagttctcttggaggaaaatattcaaatgaggtgacgtagacagaacaatccccgctggaggtgctatgtagggttttccctcctccctctgaactgttcaagttttcatgaatcatctgtgcaggcagcccagccccgccctggtaaggacaacatcatctgagccaccaattcctaggcaccagtaacgtgctgacttttcctgcaaccctacgtgcagtactgtgatgtgactcattttaaagctgtgtaaagtgggcctgggcacagtggctcacgcctataatcccagcactttgggaggctgaggcgggtggagcacctgaggtcaggagttcgagaccagcctgaccaacatggtgaaacccccatctctactaaaaatgcaaaattagccgggcatggtggtgggcacctgtaatcccagctactcaggaggctgaagcatgagaatcacttgacctgggaggcagaggttgcagtgagccgagattgcaccactgcactccagcctgggcaacaagaatgaaactccatctctaaataaataaataaataaataaataaataaataaataaataaagttgagtaaaacaagatcagagatagaattcacttcccagacatcacaccattggctagaggcaatgctgggattttcatccaggtatctgcgactccaaagcccatggtctttctttgctaggctgatgcctcagcaaaactcaaaagaccagttcttctttcaatagcgactgtgcaccagtgttctggtgccaccatttctagatgtgtttccattccaccagcaaagaaatgtagctggccacaaggtctcactgccctggcagcaatgcttacactgcaaggcgtcctccacatttttgaattgaaaaaaggtcactatgaaacaaaactcagacctaagatgtacccagcctcctttcttttctccctatgggattccctctctcttctctagttccagagtgccctcttatccgacaaaagtaatttccagacactttattatgataacatctttccagttccacttcctgtctgggtcttgggatgaaggaatcaactccttatgcaatgggacctctggatcatcaaacccttacctcagaaacaccccctttttcctctctcagatagaactgaggtttctttctttggcagaggataaaagctctcatttcaaaattagggactggccttaaaatgctgacaccattgtgaggggtgagggctcctgcagacacctctggactgactccaactcagaagactcgggctctgcggtctaagggacacacggtggcttggtgatgtcccttggagagtggtgtcctccctgggaagccccaggagctgccctgtcctgcccccagtgtcacctgccaggctaactttcagtaactctataattccgtgatcaaaactcatccaaggtataaatcagtattaccagattctctttcgagagaatgttttgctaagaaagtgatgaaaaaaaggagaatactactaaatgcctcaaagtggacaggagaaaaaaagacatagaaataaggacacggtcctttgaccatcttcttgttttgtccaggactatccgataccccatcctcacagttaggccaatgatcctcattcctaccagaacaattttttttttttttttttgagatggagtttcactcttcttgcccagactggggtgctgtggcgcaatctcagctcactgcaacctccgcctcccaggttcaagcagttctcatgcctcagcctcccaagtcgctggaattacaggcatgcgccaccatgcccggctaatttcatatttttagtagagacagggtttctccatgttggtcaggctagtctcgaactcccgacctcaggtgatctgcccgcctcggcctcccgaagtgctgggattacaggcaagagccactgtgcccggccagccctaccagaacaatttttatataatcacagacagcccagtgtatgccctgtggccaccttcctctactcaccctatccccacccagatagttacggagaaagctacaaggtatttcatgaacttcgtgggtccttggtctggcaagggttttcaacagaccattttctttctttttttttttttttttttttttttttttttttttttttgagatggagtctcactctgtcacccaggctggagtgcagtggcgcgacgttggctcactgcaagttccgcctcccggttcacgccattctcctgcctcaccctccagaatagctgggactacaggtgcccgccaccacgcccaactaattttttgtatttttagtagagacgggtttcaccatgttagccaggatggtctcaatctcctgaccttgtggaccttgtgatctgcccgcctcagcctcccaaagtgctgggattacaggcatgagccaccgtgcccgccctcaacaggccattttcttattaaagataaattatgattatcatgcccactttacagaagtggtaacatagtcccctggtagacatctgtatttgtttcctgtggttgctgcgaccagtgatcacaaagttagtggcttagaactatacaaatgtggccaggcatggaggctcatgcctgcaatcccaacactttgggaagccaaggcaacaggattgcttgaggcctggagttggagatgaccagcctgggcaatacagcaagaccccatctctacaaaaaatttaaaaattagccaggcatggtaggtaatgcatgcctgtagtcccagctacttggaaggctgagacaggaggatggcttgagccgggagttccaggttgcagtgagctacaatcacactactgcactccagcctgagcaacacagtgaggctctgtctttaaacaacaacaaagaaaaacacaaatgtatcatcttattgttctggaagtcagaagtcctgaagtcaagatattgggagggctgtattccttctggaggctctagtggataatctatttgccttttttcttttttagatggagttttgcttttgtcacccaggctggagtgcaatggcacgatcttggctcactgcaacttccacctcacaggttcaagcaattctcctgcctcagccttccaagtagctgggattacaagtgctcgccaccacacccagctaatttttgtatttttagtagcaatgggatttcaccatataggcccggctggtctagaactccacccaccttggcctcccaaagggctgggattacagtcatgaaccaccacgcccggcctctttgccttttctcacttccagaggtggcctgcattccttggctcatggccccttccaccatcttcaaagtcagcaatgcagcaacttccagccaatctctctctctctttctccttctttctctcttccattctctcttcttccatcatcatatggctttctgactctgaccctccagcctccctcttataaggacacttatcattacattattattcccacccagataacctcaaataatctctccatctcaacatcctaatgtagtcacatctgcaatgtactttttgccatataaagtaacatgttcacaagtgtcaggaattaggacacgcacatctttagggggatatctttgggggtacatctttcgggggacattgttcagccaaccacaacatctattaaatttcgatctagattttttttttcaaaaatataatctcaatcccattttgagaatcaggatagtctataatcgatcatgttttgttgctatgggaaacatttcaaaaggacattttaagttttagaatgttccaagatataagagaaaggcttaaaagaagtatttttaatcaagaagacaaaaggaaagcgaggcaaattaatttaaaaaatcacataagcagtgatggatcacgaatttcttcattaaagaaacactgaaaaaccacatgggttgtgctaaaaggcaactagacatcgcagagttctgactgacctgattagacacagacatgcagattcatcattctgccctgagtgaggacaagctcaggccacccctgcctggctcagtatcactgatgaaaaaaatcagacagattcaccagaccctccactccagtcgtgagcaacagaggtgtcatcttcctgtacaaagcaccagacacctgcccatacacagctcatgaaaccatcatcgcaacaccaccaggaagccaggcaagcatttccactctcctgtgtgaggtcaagaagtcagggctcaaggaagtcaagaaacttgcccaagatcacatgtttaatggctggtggaggcaggactagcccaggcaagaaggcacacttttcccccagatctatccacaggatcttcaacaagaaacagaccttcagcagggcatggtgggtcatgcctgtaatcacagcctttgggaggctgaggcagacagatcacttgagttcaggagtttgagaccagccctgccaacatggcaaaaccctgtctctacaaaaaatacaaaaattagctgggtgtggtggcaggtgactgtaatcccagctactcaggaggctgaagcaggcagatcacttgaggtcaggagttcgagaccagccttgtcaacatggctaaagcctgtctctacaaaaaatacaaaaattagctgggtgtggtggtgggcacctgtaatcacagctacttgggaggctgaggcaggagaatcacttgaacccaggaggtggaggttgcagtgagccaagatcacaccactgcactccagcctgggtgacagagtgagaccctatctcaaaacaaaccaaaaaaaaaaaaaagagagagagagagagagagaaatagaccctcagtgaaccatgctgatcctgctaagaccgctcctttaactcagatgggctctttcacaattccataattccctgcagtcttcattccaaatctttactatccttcacccaacaccactctttctcaaagtccctccccaaaattatctgaaaaattctatcttaatgcagtgttcatcttttctagccactggctcctccccttaaaaataagcctgggatctaaataagatgattaggagaggctgaactgtgagaggttcaaacaaggagcctggaagtcagacagcctgggtctgccacctggctttgccttgctagctgtgtgaccttgaggcagtcacttaacctctccatgccttagcattctcatctggaaatcagaatgacagcataggacctggcagagcagttgtgaatactgaatgagagtgatgtcaggcacatggatagcctggctcctgcacccgtactcttaaccattcacatgtggtacagactcattttgggggccatctgacatatagttcagatgtctgtcccctccaaaactcatattgaaatgtgatccctggtgttggaggtggggtctggtgggaagtgtttgggtcatggggcggatccctcatgaatggtttggtgccctccctgcagtaatgagtgagttcttgctctattagttcatgtgggagctggttgtttaaaagaggctggcatctcgcttactccccctcttgcgacgtgatgcccactccccttcctcttcccaccatgagtaaaagctccctgaggcctcaccagaagtccagcagatgcaggcaccacgctcgtatagcctgcagaaccatgagccaaataaacctcttttcttcataaattacccagtctcaggtatccctatatagcaatgcaaaatgatctcatacaccatccttttccaacctctgtgaggttaagagcctggctttcctttatccttggctgttgggcagggtctctctggtcaccccaatgttccccctgctccattccattaaagacatagagaccagaccaatcatcttggagctgaggctgcaccctttcaagctcagaaaacttccaagatcccccagctacctccctactacagtcccatcttttgacctggtaccctaagccctcagacctaatcagcccttcaattctgcttctgatgtgcccacctctcaccttccactctggtcaaagcccaacagcctccaaggtccaacacacactgaacttccacatcacaggatttttttcattctgccctttattatactatctatcccaattgttttcatccttcagggcccatctcaagtgccttcctctgtctgagcagttacaccgggacattctttctctttcctctgaactactttttttttccttttttcttgaaacagagtgttgctctgttgcccaggccagactgcagtggtgtgatcatagctcactgcagcctcaacctccctgggcttaagcagtcctcccacatcagccttccaagcagctaagactatgggtacacatcaccatgcccggctcattttgtttattttttgtacagacaaggcctcactctgttgtccaggctagtctcaaacttctgggctcaagtaatcctcctacctcagcctcccaaagtgctaggattacaggcataagccaccatgccgtagcttattttctgtagtgtttatggcatctaatagattacgtgaatatgagtgagttgtggtgatggaaaggttctatatattaactgtatcaatgtcaatatcctggttgtaatacagtaccatagatttgcaagacattaccactgggggacactggacaaagggtagaggcaccttcctgcattatttcttacaattgcatgtgactctacacacatctcacaataggaagtttaattttaaaaatatagattaagaattataattaattgatcaatcattaaggttattcagcacccaattctgcagcacaccacacaagatattttacttatgtaaatcttaatgcgtccccaaagtccagactcagttttgtaatggcctattcagaatctccacctggacagctaataagtattggactcaacacgttcaatactgagctcctggactttctttctcccctctcagttaatctcacctctattcttctagttgattgagccaactatcttgctagtcctccctcacttctttcttcctcttgcactctacacctaccccgcaccccaatcagcaaatcttggtaagtccacctttgaaatagatccagaatctgtccaggcacagtgactcacatctatattcctagcacttagggagaccaaggcaggcagatcacttgagctcaggagcttgaggccaacctgggcaacatggtgagacctcttctctactaaaaatacaataaaaaattagccatgtgtggtggtgcttgcctgtggtcccagctactactcaggaggctgaggtgggaggactgcttgagcccagggtgggtggaggttgcagtgggctgtgatcacaccactgcactccagcctgaatgacagagcaagaccctgtctcaaaaaaaaaaaaagaaagacagaggaaggaagggagggagggacggagatccagaatcccactgctccttccaacctccagggccaccacccttgtcctagccaccaccgtatctcgtctggattattacaaagcctccatgctactcctactcctgttcctgcttattttattttctgtaatttttataatataatatactatgcctgctgccacaagagcagaagctctgtgggaattctactttgcttactgctgcatcctggaccttaaaactgtgcttcaaacattgtaggcactcaatcaacatttgtgaatgaatgagcaaatcaatgaatattatgccttcggtatttaaaaaacttcacaaagttacttattattgtctcatttttacaagtggggaaactgagggtcagagaaggtcaaggctctggaagggatgagagctgaagttctcctattctgagactgacattccatccaccctgttctacctggacttagtctcttggctgggtcctcagaggctggacctctgtctgattgatcattttggttttcagcatctgggaatactgcttagatattgcagaaatgcaataaaaacttgaagaactaatgcaaatttttgatcattttatgaaaatgtaccaaattcagttatgagtttatttctcatttatttattacctctatggaactgatgccttcatccttacaactttcttctgtgagtcaaggtgtgattctgagataacaattcccatttgtgttagtttgttttaaggactgctataaagacatacctgagactgggtaatttataaaggaaagcagtttacttgactcacagttctgcatggctaagggggcctcagaaaacttacaatcatggctgaagttgaaagggaaacaagcacatcttaccatggcgaagcaagagaaacagagaacgtgcaggagaaactgtcatttataaaaccatcagatctcatgaaaactcactgtcataagaacagcacgggggaactacccccatgatccaatcatctcccaccaggtctctccctggacatgtggggattacaattcaagaagagatttgggtggggacacaaagccaaaccatatccccattctttttttatagacaaagtctcactctgttgcccaggctggagtgcagtagcgtgatcccagctcactgcaacctccgcctcccaggttcaagcaattctcctgcctccgcctccagaggagctgggactacaggggtctgccaccacacctggttaatttttatatttttaatagagatggggtttcaccatgttggctaggctggcctcaaactcctggcctcaagtgatctgcccacctcagcctaccaaagtgctgagattacaggcatgagcaactgtgcccagcctcatatccccattttaccagaaggcaaactgaggctccatttctgctcttcttggtggctctgactattgggtagcactgcctgtcagcaaactagaccaactactgcacagaatacacaggaacctttctcggtgctgcgctgtctctcttgtgtagtgcactatagaatcttgtgatgaagtctttcctgttggatttccttaggctggcaatgaacaattttatagctgccttctctacagatgccctggttttgttgcacataatttgctcaggactgcatcaaatttggggagaatgcagagaacatgattgtttgagtgtacttgatttgtctctgcctggtaatttgttaaggccatgaaagaacaacgtgatgcatgagtcccctgcctggatccatcgtctgctgtccccactcatcagcctcccaagtgacttgtagctatctcgagcacacacacagagccactgtctctatgaagacaaatgtgttttactgtgagagggcaatgctttagggcaaaaaacacattataatcaaaaacagtgatcagaggctcagagggcacttcctcactccgttgtttttttatttttatttttttttgctgaggggacagaatctgttatgagctcttagtcataacatgcagcacaagtcaacctgaagccattagcacttaccttcacatcttagctcacttacataaatattctttttctttcccccccgctgagacagagtcttgcttgccctgttgcccagactggagtgcagtggtgccatctcggctcactgcaacctctgcctcccaggttcaagcaattctcctgcctcagcctcccaagaagctgggattacaggcttgcaccaccacgcccagctaattatgttttatttatttattatttattgtttgtatttttagtagagatggggtttctccatgttggtcaggctggtctttaactcttgacctcatgatccacccaccttggcctctcaaagtgctggaattacaggcatgagccaccatgcccggcctttcttttcttttgagacggaatctctctctgtcacccagcctggagtgcagtggcacgatctcagttcactgcaacctctgcctcctgggctcaagcgattctcatgcttcagcttccccagtagcagggattacaggtgcccgccaccacacccggctaattctgtttgtttatatttttagtagagacagggtttcaccacgttagccaagctggtctcaaactcctgatctcatgatccaccctcagcctcccaaagtgctgggattataggggtgagccaccacacccagccttttttcttttcttttctttttttattattattgttattttttttgagatggaatctcgctttgtcacccaggctggagtgcagtggcatgatctcggctcactgcaacctctgcttcctgggttcaagtgattctcatgcttcagcttcccgagtagctaggactacaggtgcccctaccaagcttggctagtatttttatatttttagtagaaacagggttttgccacataggccaggctggtcttgaactcctgacctcaagtgacccactggcctcagcctcccaaagtgctgggattacagctgtgagccaccacacccagcatagctcacttaaataatttttttttttttttttgagacaaagtctcaccctgtcgcccaggctggagtgcagtggcgcaatctcggctcactgcaacctccgtctcccgggttcaagccactctcctgcctcagcctcctgagtagctgcgattacagatgcgcaccagcacgctggctaatttttgtatttttagtagaaatgaggtttcaccatgttggtcaggctggtctcaaactcctgacctcgtgatccacccgcctcggcctcccaaggtgctgggattacaggcgtgagccaccgcgccctgcctaaataaatattctttaaggagagatatacggaagcgatgggcacttttcaagatttcacaacttgtggggacattattagtgtcctattagatgggggcttttttgcccctacacttcaagaaattccatctcgaagaattcttgcctggcctgacacagtggctcacacctatgatcccagctgtttaggaggcctacgtgggagggtcgctggaggtcagaagtctgagacaagcctgagcaatagagttagacctcatcgctacaaaaagttttaaaaattagccgggtgttgtgacatgggcctgtggtcccagctacttgggaggctgaggtaggaagatcacttgagcccaggagttcaaggctgctgtgaactatgatcatgccactgcactccagcctgggtgaagagcaagaccccatctctaaaaaagaaaaaagaagcacatgcacacacacatacacatacttctaaaaaagatgaccaaaattctggattcacagataagacttggtttttccctttcacattaaaatatccttcacactttccagttttgttcaatcaattatttttttttctttcaaatttgagaccaggttttggtctgtcacccacgctggaacacaatggcaccatcatagctcactgcagcctcaaactcctgggctcaagcaatcctcctgcctcagccttccaaagtgctgggattacaggcatgcatgaccatgcctgacctagttaactcatttttaattggacagactgggaaaagataaaagaaattcattattgccctattcccttactccttccctctgacatgccaagcaatagtactaaatactcagctattgccaagtaccctgccatgtgccaggcaccttgccacatcctcctcccaggaggtgggtgattatattccccactgtattagttcattttcacactgctataaagacactacccaagacttggtaatttataaagaaaataggtttaattgactcacacttccatatggctggggaggcctcaagaaacttacaatcatggcagaaagagaagcaaggcacatcttacatggcggcaagagagagagcgtgcacaggggaaactgccacttacaaaaccatcaaatctcgtgagaactcactaccatgagaacagcatgggggaatccgcccccattatccaatcaccttccaccaggtccctcactagacacgtgcatattgcaatttggattacaattgttgatgaggtttgggtggggatacagccaaaccatatcaccccatttgacagatgaggacactgagatgtgtgactgtttaaaacttgcccaagggaaatgaaaattaaaaccacaatgagatgccaccttactcttgtaagaatggccacaattttaaaaataaaaaaaaatagatgttggcatggttgtggtgaaaagggaacacttccaacgctgctggtgagaatgtaaactagtacaaccactatggaaaacagtgtggagattccttaaagaactaaaagtagatctaccacttgatccagcaatcccactacggggttcctacccaaagggaaagaagtcattctatgaaaaagacacaagcacacacgtttatagcagcacagttcgcaactgcaaaaatgtggaaccgacctcaatgcccatcaaccaacgagtggataaagaaaatgtagtatatgttatgtgcaccacggaatactactcagccataaaaaggaatgaaacaatggcctttgcagcaacttagatggagttggaggccattattctaagtgaagtaactcaggaagggaaagcaaatactgtgttttctcacttctaagtgggagctaagctacgaggatgcaaatgcttaagaatgatataatgaactctggggactcgagggggaagagtgggaggggagtgagggataaaagactacatattgagtatggtgcactctgcttgggtgatgggtgcaacaaaatctcagatatcaccactgaagaacttacccatgtaaccaaaacccacctgtacctcaaaaactactgaaatgaattttttaaaaaaaaacttgcctaagagcacagagatataaaacatccaggatttgacccaagttcagtgtgatttcacaatccctggaatttgctccttcaccggcaagaagtcaagctccttatccatggggcagccctaattataggcaggcaatctttgatttcctgcagtctctttatggttccatttagcagaggaaactacagcatatttctgataccctgaaaaagagatttgtgtggccaggagccagagtgaacttcctttaaaatcggagacagctactgggtttagaccggtttctgattcaaacaagcagtttgaaagagaagaactccatcaatcaataacccaagggcactgtcaatcaataaaccagattaattgagcacaaataggtgactttttgaactcaacatgttcatctttctgatacgggattttggctttcagaatactatgggaaactaggggactaagcatggcatgttaaacacagccaaaagatatgaagaagccaggggtggtggctcacgcctgtaatctcagcactctgaggctgaggtgggcagatcacccaaggtcaggagttcaagaccagcctggccaacatggtgaaaccctgtctctactaaaaatacaaaaattagctgggtgtggtggtgggtgcctgtaatcccagcactttgggaggctgagacgggcagatcacccaaggtcaggagttcgagagcagcctggccaacatggtgaaaccctgtctctactaaaaagtaaaaaaaaaaaaagaaagaaagaaagaaagaaaattagccaggcatggtggcacacacctataattccagttactaggaaggctgaggcaggagaattgcttgaacctgggaggcggaggttgcagtgagccaagatcacatcactgcactccagcctgggcgacagagcgagactccatttcaatttaaaatatattatttatatatatatatatgtatgcatcaaaaaaagatatgaagaaacttagctggagaagcagtgactcccagttctccagccaccattgaccaccttgtgatcaagcatgattaagactactgggccttggggatgggtctttggctgtcttctcattatcatcacttaagtataatgaagactccaaaatctgtatatctgggataaacactttgagtcccagaaatcaatatgcaagaacccactggacatctccagtaagatgaccttcagttctcatcaccattccaccctatccagactccctgtccctggtctcagcggttgtcaccacctgtacctcattacctagttaagcggccacacacctcactcctcacccccacatccatatctcatcaagatgaattacagtagagacaatttaacatggtagttaattaagagtatgggctttggagtctgattaagctaagcgggaatcccactcccaccaattatgagttgtgtgacttggccaagtgacttttaatccctttcacattaatttccctcatctgtataatggggacaccaatgcctcccagttattgcaaacatcaaatagaataacataaacacagcaagggtctgtatttttaaattcccatgccaacttctccccaactcattgctccttcctcagtctaagccctttcctttcttttcctttctcccctaactatgcaaaagggcttctggttgttgccccagcctcaaggcccacttctctcaaatccattctgcaaaccacaaccaatgcaaccttttaaaatgcaaaaaggatctcatcagcaagcatcaatataccttgtccagtcttcccaccaaaagcaaaacactccagtgctttgggaggccaaagtgggaggacagcttgaagccttggatttgagaccaacctggacaacatagtgagataccatctctacaaaaaatgtaaaaattagctgagtgtgatggcacacacctgtagttctagaggccaggagtgtgaggctgcaatgagctatgattgcaccactgcacttcagcctgggagacagagcaagactctgtttctggaaaaaataaaatataaaataaagcaaaagccctgtgcagtgataagaataagagaagtccagttcatgaagcatggattagcaactgatgttaccctttttgttgaactcctttgacaaactccgtttgttgaactccatatgacaaaacttacagatctgtcttctctccagaaaaaacatcactactcataaacacacacaatattgttaagctccacgggtgcacagaccccaggttaaaaacttcagagttgggctgctaggctgatcaaccacagtcgtggagattcaaaatctaaaacatttttcttaacttgcatactgaggatcttcaaaatctggcaagaggcttcggcagcagctcagggcacttttcccagaaagagtggcacctctgaagggatcttaaagggagtagcacaaaaccatgatcaatcatgcacctgaaaccctcaagttttacacccccagtgggtgctggctaagccattgcacttggctatctgaggagccccccacacagatgtaagaaacactaagttctcagatttgtctccatgacaccccttttcccacttccccccaccacagcaccagatggcagagaagcaagctctccaaagtgccctacaaattgcacaggggtaccagaccaaattttatgatctatcatccctacggtgcttctaggttcagagatgttaaattcccacccagatggttgaggtctgcaacataccctgaggctcatttcactggatacgagcagagtaacagcagcaaagcacacaccaactggcaccagcttaaaaactatcagtaggctgggcacggtggctctcgcctgtaatcccagcactttgagaggccgaggagggtagatcacctgaggtcaggagttcgagaccagctgggccaacatagtgaaacccatctctacaaaaaattacaaaaattcgccaggtgtggtggcacgcacctgtgatctcagctactcgggaggctgaggcaggagaattgcttgaacctgggaggcagaggttgcagtaagcggagatcacgccactgcattccagcctgggtgacagagcgagactctgtctcaaaaaaacaaaaacaagaacaaaaacacaaaaaatctatccgtacacatgagcatgtaaatggtggcacactcctgaggccagcatcacctgcagtcctgaaaccatttatttcagaagctttttttttttcttagagtatcactctgttgccaaggctggagtgcagtggctggagtgcgatcatagctcactgcagcctcaaagtcctgggcttaagcaatcctcctgcctcagcatcacaaatagctgggactacaggtgtgcacatcacgcttggataactttttcaacgattttctgtagagatgggatcttcctatgttgcccaggcaagtctcaaattcctgggctcaagtaatcctcctgcctcggcctccagaagtgctgggattataggcatgaatcaccacacccagcttattttagcagctttacaggaaaaaaacaccaccaccacatacttttttcaccatcaccataaaactttagtggaacaaacaaactcttaatattgaagttgatgagtagagtttggaagcaccactgaaacaaaaatggccttgaatgttaaccagatgacgttagggaaaccgcaagaggagtgagaataatcagggaaaaggaacactcctgaaaataggcatgctaacatccaccaccagcaacacggatggttgggctcttcccattttcagaaagcttcgctcttcaaacaccacctcccgctttagagaggaaggcagagaaatatttccagtgtgctcaactcaaagagaggccagtgtcaccctccataggggagtgagttctggtcaaccggccttgctttcagcctccccatgtcccatcaccaccgcagctcctacccaaggaataagtattataggacacatctactaactttaaaaggagatctatggacacgttccctcctgatccttgagagcatcacacggaggacttggaaggcctgcatatgcagccatctgcagatgtttcccacatcgaaacccaggtcttagaggatcctggatcttttttgtttcttttttctttttagattcgggggtaacctgtacaggttagttacatggatatattgcatgatgctgaggtttgggctttgatggaaccatcacccaaacagttaacacagtactactcaaataggtagttcttcaacgtgcccttttcctctctcctctgttttgaagtcctcagtgtctattgtttccattattatgttcccgtgtacccaatgtttatgtctcacttataagtgaaaagatggagtatttggttttctgtttctgcattaattcacttaggataatggcctccagctgcatccatgctgctgcaaaggacatgatttcactttttatggctgcacagtattccatgttgtatatgtactacgttttctttaagaggatcctggttctatccctcaggacaattcaaggtttggaaactattattggttcctcttccctctcctctctctggcaatttaagtctgttacctccaaaccaatgaggacagccactgcgatacaaagtgctgaggttgaagtgggggagtaggaaaggtatccttatgcgcttagagctaagacacaaagactcacaatgggttgtccagattcttccatttactgacaggcctctccagttagaggcatttacattgtgaagtgggcctgtcctggcagaacaattgcattggaccctgtccagtgttttgcttctcctctaaagagctactatttgccccagtgttggggtggtggtcctttgtctgggtttgttccatcataataagcatcatcatcataacaataacaataattactattcctgctattgttcccatactgtgtgtatttggcatgcagtaagtgcccaacagataggaacaataataggaatagtaattcctcactttgcatgtattatctcttattatccctataaagtatatattattatccacatggtacaggtgagaaaatcaaaacttgtggggtggtgaagtaggtcaaatgccatgcatcttcaaccatgcatttttattttattttattttttattttattttttttaaccagggactcactctgtcatccaagctggagttcaatgacatgatcgtggctctctggagcctcaaattcctgggctcacacaatccttctccctcagcttgctgggcaacttggactataggtacccaccaccatgcctggctaactttttaattttttgtacaggctggttgcccagcctgtgccatgttgcccactatgttgcccaggctggtcttgaacccctggcctcaagcaatcctccctcctccgcctcccacagtgttgggattacaggcacgagccaccatgcccagcctaatgagctcattttttgacaaagttctcttatcagaggaactagtgttcatttattcaacaagtatttttgagcagtcactatgtgcctatcatttcactgtgtttgttcccagggataagcatgatatatttaggcactgcctcaaggatgaaacaaattccccccaaattaatgtcctcctgcaggcttcaagggtctaggccatccagccttccctgttgactcccctccttttaccttgctgaactgctttgcataaatattaagtgaaattgatgagggccactggtttggactgagctcctgcacgcggcccaataaaccaaaccaaaatggagtccctcatgctaaaagttccacacgaccgagccaaaactaattggtttatatgaccttctgagaagtcaggagacggagagctggcagccaaaccctaagcaagcccattttagccagcatgtgaaggaagtccctctgctctaacctttacaaggaaaagtcgctctgaaacaatcaatctgctttttttgttttctgtttctgctttcctcagcccttttctgtctataaaaccaaacttctctgctcagctcataagaacactcactttatagaatgaggtgttgcccaactccagaactgcatataaaagccagttaagatctttgaacaaaatatatcttcaaaaaaggacaaatctccaacactttaaaattatagatctgtctgtagatcctaatctgctacaacacttcctgctcaaaaataataagcaggatttttttttttttttgagacagggtctcgctctgttgccctggctggagtgcagtggtgcgatcatagctcattgcatcctggaacctggaactcttaggctcaagcaattctccagcctcagcctcctgagtatccaagaccacaggtgtgcaagcaccacacccagctgattttttgtggttgttgttaacaacttttaagtttaggggtacacgtgcagatttgttccataggtaaacttgtgtcataggggtttgctgtacagggttatttcgtcacccaggtattaatcctagtacccattagttattttttcctgatcctctccctcctcctacctgcctccaccatctgataggccccagtgtgtattgttcccctctatgtgaccatgtgttctcatcatttagctccagattacaagtgggaacatgcagtatttggtttcctgttcttgcgttagtttgctaaggataatggccttcagctccatccatgtacctgctaatttttgtagtatttgtagagacagggttttgtctcgaacttctggcctccagttatcctcctgcctcacctcccaaagtgctgggatgacaggcatgagccaccacgcccaagctaaaccaggaagtttttgagtcatttgttacacagtaatatggcaatacaggtctggatgtaaattcaacactcttccttcttgagaagtaaatattaatgaccatgttgatagagcaaatttgtattttaaatgggtgtgtcctaactcatcacctgcgatgagtggagcaacgtttagatgccctggatgccactgtgaagagagaagaccagtgagtcattgctgctagaacatgttgctaatatcaaattcttgagtagtcccagggaacagttgaacctgctgctggccaattactgcaaggagaaacaatagtgtcagtgaagccaacatcggaatgatgggttttggcaaactcccttcagcatccagatggataatgttcaacaactctactcaacaggttaactcatttagttatctgggggagcacgatggggcttaattagcttactagatctgttacaatgcatttctgttgaaaatgaaaggttccccaggaacaagatacaggtgattttatgactgagataaacacgtggttactcctgttcctcaaatagctcaagtcaaagtcatgctttaagatgcagcaggttcttttgcataacaagataccaccctctgcttgctatctcatgcagggttcttagaaataagaacctaggacacatttttctaaagccagtatttagatcacctgttgggaaggctttctaaactacaaaggctgggcgcagtggctcatacctgtaatcccagcattttgggaggccaaggagggaggatcatttgagcctaggagttccagaccagcctgggaaacacagtgaggccctatctctccaaaaataaaaaacaaaacaaaattagccaggtgtaatggcacgcacctgtgccattgggaggctgaggtgggagggtcgcttgaacctgagaggttaaagctacagtgagcagtgaaggcaccaccacattccagcctggacaacagaccaagatcctatctcaggaagaaaaaaaaaaactaaactacaatgtacccccatctccttgcatctagaaagtctagtatgagcacctctttcctcattgaaaatcaccatcatgatagcttactattactagaagaagtatgttttgaaaaagtccacagaaatttgatagtgaggtaaggttgaaagccaccaatgtgtctgaaataatacaaaatacttgtatattagataatttgaatatggggcaaagagttcctgcttaaaatatagttgagaaaaccattcttccaatagacactttaaggccatcactggaatcaggtaactggtgtttaactttttgcctcaaccaattggaaatttgcagctaatgtcatgcacattccgagccaatgtgttcctttaaggggctgtcatatttttttccttcctccctgtgtgtggatttctattttctatttctattctgacagcctttgcagttgtgttttttcttttatcttatgatgccttgatcgcttttggaaacaggcagaatataaattacaaattaatagcatgaagctggcagggaaggtaggtactcgggtttctttcttggccacagctatcaaaatgcattttcagaacaacatgcgggaaactactagaagacttagcaagtgcctctttaaggaatgggcccttggaagcagctaccatcagagaaatccctgctctgccctgctaacaaagcctcacaactctccacaaaagatatctttctcaaggctcaaagggcaggtcaagcctccaggaggaaggtacccaggcagataaaagacgtatgttgtaaagctaattcccagctcagggcagagctgtatatctgacactccccctcttattgggatgatgatgtggctcattcattgcgtaggttttaggcttcctctggaggagagaactttgagccatcagataagagttgtgagcttgtcttcttgtaacaggaatgtttctgcctccttcaaacctcctcttagaaagcctgtagagagaagtgtctccaaaaaaggcaagttgagtttgcctctgggatcctgaaatcaaccggcaaaaacgggataaaacagtaggggacgggggaccttcattacaagaaaacgtaggatggaccacatgggtggcaggtggagagggccctccagagcttactgcacagaaaccagcccccctcctggcataaagtcatgctcatggccagcctttcctgggctgcagggcacctctcctctcagtaaggagcactctgggctcacacagagctttaaaaatatctctccacccactgaaatttgattaatcagccaagtgctcacccatgtgtcacagtggtggcagagatatatgtgatggtgacatgacgggtacaagggaagcacacaggatctcatctcacagggagcaggattcagtacatgaaagtgaatggcatgggctgtgcagccaggtggcagcttgaatcccaggtccagcagatgctggttatgtaaccttggacaaggttatttaacttctggatttttcacgtttgcaaaaatgtagttagtaacagtacctgggccgggtgtgttgactcacatctgtaatcccagcactttggcaggctgaggaaggaggattgcttgaggccaggagtttgagatcagcctgggcaacacagcaagacctcgtctttgctaaaaatttaaaaattagctaggtgtggtgttgtgcacttgtagcctcagctactcgggaggctgagatggcaggattgcttgagcccagaagtgtgaggctgcagtgagctatgatcgtgccactgcactccagccggggcaacagaatgacagtctgtctttaaaattttttaaataaataaataaaaattaatagtatatgcataataggatgattgaaaaggttaaatgagttaatccacataaaacactttgaacagtgcctagcacatagtaagcactcaataagctttagctgtgatgatgattatgatgatgacaacagtgacaatattgaaactaaaaagttgaatgaataggtagggatttcccaggcagacaaagaatatgtctggcccaagaagcttaaacaaaagcggagaaggaggaaggagctcaaggcagcaggggatcgtgtggagggtaagcagggagttgaagcagacaaaaaaaaagaagggattcagccacacaggacttcatacactttgtcaccaagtctagataccagtaacatggctgtaggctgtagagagctatttaagaatgataagcagaagcaaaatgttaaaagtgctataatggttgacaattttaactaattcagggaaacaaaataaaattaaattaattgtaacaggatgagcatggtggctcatgcctataatcccaacactttgggaggatgaggcaggcagatcccttgagcccaggcgttcaagaccagcatgggcaacatggcaaaccctgtctctacaaaaaattatccaggcatggtgacatgcacctgtagtcctagctactcgggaggccgaggcaggagaatcacttcagcccagaaggtggaggataaagtaagctgagatcacaccactgcactccagcctgggcaacagagcaagaccctgccacacacacacacacacacacacacacacacacagaactaattgtaacatacttctgggtatgacaaagaaacttatgcaagaataaccctcccaccatgtgccataagccaggcacaataaaactgaaccaaatatatgaggcaactgttttcaggcaaatgacaacaggcagcacaagattacaattgcaaggagaagggaaattcacatgacaagccccatgctcgccctggctctctgcctggggacaatttcccaaccacaattcacgtagtagctgcacgaactagaatctgcagggtaggacaggagagagaagaacactatgcagagagggaacatcagaagcccatgtgtgggttccccatgaacatctggttgaagcctatgttatccagatgcaaggtgagattttattttattttattatactttaagttttagggtacatgtgcacaatgcgcaggtttgttacatatgtatacatgtgccatgttggtgtgctgcacccattaactcgtcatttaacattaggtatatctcctaatgctatccctcccccctgcccccactccacaacaggccccagtgtgtgatgttcctcttcctgtatccatgtgttctcattgttcaattcccacctatgagtgagaacatgcaaggtgagattttaaataagacttaaccaggaagcagctgctatgaggttgagaacagaaaacaaatactataactgaagcagcagatagtggaaaaacctcattagtactccaggcatccagctaagacactagaaagaccacctcttaagagatggtcagtttccactgatttgccccccaacagagcgtaaaaacgaacctacacaaatttaaggtggtcagccagtaattgaattacctactagaacaaaaatcagcactcttcagagaaagataacacataatcactctaacataggattcacaatgttcagtctatagtcaaatattcacaggcatgcaaagaaaaaagaaaatctgaccacagtctttttaaaaagtccataaaaaccaatcccaggatggcctagagccttgatgttggatttagcacatacaactttaaagagctattataaacatagaaaagtatattcagagaattaaagaaaactattgtcttaatgattaatcagagaattaaagaaaactattgtcttaatgattaaacagatagggtatctcaccaaagaaatgggaactataaaaaagaaccaaatgaaaattctagatctgaaaaaaatttgggtgtttccgtgtgtgtgtgtgtgtatgtatgtgtgtgtgtgtgttgagagagagaaaaaaaccctaaatgctgaaaaatgttaaaaagtaagccaggcacaatggatcatgcctataatcccaactacttaggaggctgaggcagggggatcacttgagcccaggagatcaagactacagtgaattctgatggcaccactgcactcaccagggtgacaatgcaagaccctgcctcaaaaaactaaataaataaattctaaataaatgaaggatatacagatattcacttttactttccaaaaacctctgtggatttgaattttttaagactaaagaaatattttttaaaatgtatttttatttgtatatacacaaaaaaagaagataaaagttttaataagccaaggctgggtgtggtggctcatgcctgtaatcccagtactttgggagactgaggtgggaggattacatgagccctggagttcaagacaagcctgggcaacatagtgacaccccatctctaaaaaaaatttttttttaatttagcaggtgtggtgacacacacctgtagtcccagctccttgggaggctgaggcaggagcatcgcttgagatcaggaggtcaatgctacagtgagccatgtttgtgccactgcactccagcctgggcaacagagcaagacactgtcttaaaaataaacaaaaaaagaagttataagccaaggaataacctaactaagtgtgcatttgagtagcatccctccaatggtatcgaactgaactgacatgtgggtggatcatagatgaaacccaataagatcagctccagtgaatgctgttgtctaggaagtggaaacttgacccaaggcaataccaatgtggtcagagaggaaggaagacttacagaatacgaagagaggtcaagatatatgggactaaagattgtatgtaaggaccaagagataacaaggatgattcccagatgactgctgtggctgactggcaatataatttcctgggaaaaatcccagaggagaggcagttttcaagaataaagaaaatccattttggctttagatatttggagtttaagggacttgtgagacacctgcacaggactacaggtactaggtctaaaatccaagagggaggcaggactggagatacgtatcttgaggtcatcagcacgtagatgctcgggcagaaggcaacaaaaaccaaccccaggagacaaagagtgtgcctcatacttctttaatcttttttaaaaatttcacatctatagaggtttaggaatgcatggtgaatatctatcttccattctttcttataatatttctttttgttttcttttttctgagggagtgccatggcacaatcatagctcactgcagccttgacttcccgggctcaagcaatcctccctcctcggcctcatgagtagttaggattataagcatgaaccactgtgcctgccttttaaaaaaaaaaaatatatatatatatatatagttttcagcaggcaggagatgaggggtacacaatgaatgcagagatgacaaatatgtagaaaagaggaaggaggagatctaggtaacgacatgggtaccaaggcagtgatggactgcaaaaactaaggtgtgaacaacagtgccagatgctgcagaaagtcctgaataaacattaaaagtcatctaggccagtcatggtggttcatgcctataatcccagcactttggaggctgaggcaggcagatcacctgaggtcaggaattcaagactagcctggccaacatggtgaaaccccatttctactaaaaatacaaaatgtaggcgggcgtgatggtgggcacctgtaatcccagctactcaggaggctgaggcagaagaatcgcttgaacccaggaggcagaggttgcagtgagctgagatcgtgccaccgcactccaccctgggtgacacagcaagattctgtcaaaaaaaaaaaaaaaaagtcatctagaggaggcaaataggggctcctagagaaaactgagctgcaggagagcagtgactctggaatagtcaaagtgacactggtcaactactaaaatggaaccccaggttcaaaggatggcagtctggtattctattcccatactcaaaataccccctatgatatacagaagagtatatcagtataaatattaattttgaggccaggtgtgttcgctcatgcctataatttcagcactttgggaggtcgaggcaggtggaccacctgaggtcagaagttcgagaccaacctggccaacatggcaaaaacccatctctaccaaaaatacaaaaattagctgggtgtggtggtgcacgcctgtagtcccagctacttgggaggctaaagccggagaatcacttgaacccaggaggtggaggctgcagtgagccgaaatcgcaccactgcactccagcctaggcgacagagccagactctgtctccacgaaaaaaaagaaagaaagaaaaagaaatattaattttgagacatgcacacatgtgagaggctgggaatttttgctaattgccccgccaatgaaattggagagacacaatttccacccacacttggaactacagtggcacataaggaagactgactcaccacaatacattgacagtaaatcatgcagtcactccctacttcacagccactgttttccatgggaatctattcctcaacccaaacccacttcagcagcacccttttttaagctcatttggggaacacaacttaaccgcagccatgggttggtatgtcccatcctgggttatctatacagcacaggtgaaagccaaaatgttcctaggatgaccaaacgtacaagagtagcttgggaatgggaaggagagaaggagagaggaagaacaaacaacatagatggagaattctgtggcatagggcgcaaagacagcaggaacaaccaccgagacccccacctctgcccagagccatgggctacatgaatgtcttctggaaactggagacggcatgcatatcaatctctcaccagtctaaggataaaaaggcttaggccaggcacggtggctcacacttgtaatcccaacactttgggaggccaaggtgggcagatcacaaggtcaggagttcgagaccagcctcgactaccctgtctctactaaaattacaaaaattcgccaggcgtggtggtgcatgcccataatcccagctactcaggaggctgaggcaggagaatcacttgaacccaggaggcagacgttgcagtgagccaagattgcaccactgcactccagcctgggcaacagagcaagactccatctcaaaaaaaaaaaaaaagcggcgggcgggggcggtggggaatattatctcaggtttgggataaagtgaagaaggcaagattctttttttttttttttttttcttccccctagagacagggtctttctttctcaccaaggctcaagtgcaagtgcagtagtacaatcatagcttacagtagcctcaaactcctgggctcaggcgatcctcccacctcagcctcacaagtggtggggactacaggcatgcaccaacacatccagctaattttttgtagagacagggtctccctatgttgcccaggctggtctccaactcctaggctcaagtgatcttcctgcctcagcctcccaaagtgctgggattacataggcatgagccactgtgcctggccaaagttagactccttacaaaccttgtttactgacaaatactgagcctacaaaaaaacttcataatgttgagttacaaagcataatagaaaaaagcaatataaattatacaaaaaaaaagtttcatgcaaaagaaagttaccatcatctggaagacgtagagaaaaagacttttattatgaatatatatacaaataatttatgaccagaaacagaagagattttcacaaactggaaaatagctaatagctatttcctaatagctccaaactgaaaacaacccaaatatccactgagaataaaataggaaaataaattaagatatatttatatacagtggaacattatatattaaagaaaagaggtaaacttcagatggaggtgaatttagtttaagattaagatagcattacaaggccaagcacagggtctcacgactgtaattccagcactttgggaggccaaggtgggtagatcacttaaggtcaggagttcaataccagcctggccaacatggtgaaaccctgtctctactgaaaacacaaaaattagtcaggcgtggtggcacatgcctgtaatcctagctacttgggaggctgaggcaggagaatagcttgaacctgggaggtggaggttgcagtgagcaaagatcgcgccactgcactccagcctcggtgagagtgagactgtctcaaaaaaaaaaaaaaaaagatagtatcacgagattattcaataaatagcattaagaaaactattcttcaacaatcatactgcatatatctaatagaattccatataatgcactctaaaagtataagatattgctaataaatctggtatatgcataaacttcctggatagacgtaagctccttggaaagaggcaatgaatattatgcttatttgattttcctctactacctagaaggcatttcctcctccacctagtaaatatccgtttaatgaatgaataaaaatggatgaatgaatgaatgactgtctccatcaatccaccttcactgagtttggctgggtgattcccaactttaatctgatcattttgaagcagctttgcatgtttccctcctgagctttgtgtaaagagaagaaatagggacttcccagaagggaattgcagctgaaaatgacctgcgtggcaagtggtccttttcatgcctgttttcagaggataaccattcacgaagtgcacacctttggcccttacactggaggaaagggattttccatcattggtgataaacacgaacaggtggggaaacctgtagccattcacaagcagaaggctgcagtggctgcagggtggggagcttgacagcagataaggatagcacccaactaatgcctatgctcaaggcagccagaccacaaaggatgctgcgatgtccatcagtgtccaacacatcaactcccagtgcagcaccacctgtcctctgagggtaaatgagtgcccccaaccagcagaactttagggtcaccttgccatgcagcagcccaagagaacagcaagcaaactatgccctggaaactggcttccccaacaccaatccatagtcatctgaattgattcaagccagttggtttccagaccctgcgtgcctgctctaaaatcagaacacatccgcactgtcctgcccagagccccgagatgcttgtaataaaccaggaacagtcataactcagtgttcgccttggcaaaaactaaataaataagtagaacgaatcttctgtcagaaaataaatggcccttccccaggctgagagcctggattaccctcctgaaggacaaacacagcatcttcaccagccaatctcgggactttataaagcccccacttcactcaataaactaccccaaggctgccaatgctcaggctgccagcctgggcttggagggctcttagaattactctcgctaatctacatactgaaaaagtgcatttcagtgcttctcaagctgcctttgcctgattaaaatagcaagtttatatgcttttctgtttgtccaggaaagtggagggcatttcaccagggcacccaagtagggagaggagggttgaaatccagccagcagccctcttgaaaagccatgcacccccacagtagccctgaacagttgccttagcagagcttgaatttaacagtgaaaaaagccattgcactgaaaagtcacagagaaatcatctcttgatcattcatggcaaagttgggaaggaggaaggggggagaatatggaaagccacagatgattccaaactccatttggttagtgatttttaacctcttaaataattgcccaaaacatatagatagtgttgcccagttctcagccagggccactcagtgggtcctgcacgcatgggggactcccagtccctcctgctgatgactgagcctggaggatctactcaaataaacacaagcaaacatccaccccacattaatgtaccacctgccctaatgtctattcacagtgaagactcccataggtaggaaaagcctgggcctcacttcacctcccaaacacacctgctatgagctgaatgtttgggtccccccaaaatgcctatgtggaaacctaaccaccaacgtgatgtcattaagaagtgaggtctttcaggaggtgattaggagggagcagccctcatgaatgggattagtgcctgctatggtttgaatgtcccttccaaacctcacattgacatttgattagcattatgacagtgctaagaggtgggatggttaagacgtgatttgactatgaaagatctgccctcatgaatggattaatgtcattatctcggggggagttcattatccagagcgtggactattataaaagtgagtttagccctctcttgctcttaccctctctcgcctttccaccttctgtcatgggatgaaacagcatgaaggccctcaccagataccagtgctatgcacttggacttcccagtcttcagaaccatcagccaaatatagttcttttctatatcaattacccagaaggtactatgttgttatagcaacacaaagcagactaagacagtgcccttacatactcaaggcacaaaagaacttattcactctctccaccatatgaggacacagcaagaaaagtgacatctatgaatcagaaagtggccctccccagacatcaaatctgctggcaccttgatcttagacttccaagcctcctgaactgtgcgaaataaatttctgttctttatgagccacctagtctatggtgttttgttatagcagcctgaacagaccaagacgccacccaagtgacatctatgaatcagaaagtggccctccccagacatcaaatctgctggcatctttatcttagacttccaagcctcccaaactgtgagaaataaatttctgttttttatgagccacctagtctatggtgttttgttacagcagcctgaacagaccaagacaccacccaagggcagccttagcctgaatttgtggtcgcctgtatgggctcactttggaggaggtcagagctcaatttcctgcttctgtgtcctgcaccagcacaccttttgctcaactgaagaccagaagatgtaagggttcctgctctcctctcaggccaccagtctttgtccagaccacagtgagcagccgctatccctaggaatcttgattctgccccaatcactccacttcttcaaacatcccccagactctctttggacccagcccaccggggccacatcctctgctgcctccctgctcattcatgtaaataagcaagcatttaaataagcacacaagcaaaatggatgagagaaggagaagctattcaatggcctctcctcttcacctccctcacttcctgcctgttgtgaagcaagtttggcttcactgtctcagagccaaatgtcctccatcttccttctgggagaaatgaggctccctaatgtgcacatacaaagcacactgatttgaaccattacacttaaaagcaaatatgtgggccaactggggtaattttgacttctctacttgagaaagtaaatttaaactttgtgccttaaaatgatattattacaaacaacaaagtattcaaaaacacgagggaaaactgattctggtttgacctcagccgatgtagtacctaggtaaaaacatcaggccaaatcaacctaatcctctattccgggggggggggacttgtttttcctatttttaattagaggattggtttatccaagatacaatgagacacagtcctaggatgaatttagtcatcacgttcccaggtttatgtccatccctaacccctgccttgagcacccagggctgtactgtgttacaaagaaacagaggcaattaaaataattgctatccactgtcacctagacaaagcttccagatgattctgatctgaacaggattcaaagcaccatggccagaagtcaagagacagccattaacagggcttaaacctcccctgcagatggactccattgtcagtgacaacacagaaacaagacaattccattggtgataaagactccggaaaatggaaaacacattttaagagaggtgaaggctatccccccagtcactatccaaggaaaccgaaatatccaccatagattgctcaggctatcaggtctgtacacacacacacacacacacacacacacacacacacacacacgtcacttgggcaaaactttgtctctgaactctttcccattatgccatggctacacttggccacaactgccaaggagtggccaaagtccagggctttcaattgagcttcacaatagccagaaacacctccctgggaggggggccatccccccaaacagggtaggctccttaccatcgagctcctccacggagatattagccagctgttcgctgtcactgccagcagagagcgatcggttgaggtaattccccttgtacaacaagccggcggtcacatggtggaacggcatcttttccctgcccaagagagaacaggggaggggaaaagaaagacatcatcattcattcttcctttcctttcttaaaggaccatctgattttcagatggccagtgtcattttaaaaatagcagtaatatttctagtgggaaagtcaagatatttccagggtcccaatgacctgagcaatttccaaaggaattcaggtttttcccattccttcactgtacatcttacttcattttccccatttaattatgaatttgaacgatgttgtccttgttaatcatggcacaccacatcaccatcgaactatctctttgcaaacggcaatatccttgactcctttccttggcccgataaattctcacttgatgcttgtaaggaaggactgagaatcccagaagtgtagggatgcccagggactagatgtcttgtctgtgatcaagcagagatccaaatgtctcatttctcccagataatataggcattgcactcacacagcactcaaaacaggtaggaaatgcccaagctctaagtaagtacatgcaatgctctgcatctcaagcagcagctgccaaacctggttgagatgcagatgctgcttacatgagtggtgtgtgagcacacacattctgaaatgctaatcacacctgccctgctggaaacaggagtgacgccttcaggtgtcccacaacgaagctacttccagcactctcacacaaagttaaagcatccttctacgccaatagaaaaaagctcctgaacccagatggtcatcaatggggcttagaagtttccactaatgcaaggctgactggaggctccaggctacggaaaaaagagatgtgagataaaaggacagcaaagacaatggaagagaatggaagaatgagcaacgacaagaaagaggaaaggcagatgggaagattatcttctccaaagcagaaagagcatagctcctggcccaacttgtctaatgatgctctccgtgactttgaacaagacgccgaatgcttcacattctggttccccatctagcaaaggggactaagaggatggataaacctctgagcagaattagggccaacaggcaggaagcacaggagtcaatcacaaggagtgggtagagaacatctttgtatcggagcttctggaaagtgaactgggcagcactcaacctgtgaaacccctgaaaattaaaaggtttaaccaggagcacaaagccagttagtgacagaagttgttctagaactccagcatcctacatgctatttccattaagcagacccagctaagtgccagacatttccacccggatgtcaaaccctcatttcaaactcaaaatgtctaaaaatgaattaattatcttcctacaaagtaggctacactttctggtttctctatttctatcaaaggtgcttttcgctcatcacaacaactgggacaactctcccaaatgctcggggccccaaaaagtaaaacagacacatggctgaggcaagagccaactgtcagcttgcaacccatcccctcgcccttaactctttccatagctaacagcatgtacatccacagaacaattgcaaatggcaggatgctgattacaaagggtatatgcatttgccaattataagaggtacatcttcagctagttacaagtgagatgtttccaaatctatccttatatttaaacagaatacaagaatctttctctagaagaacacttcaatgaccacctccttttttctccaagttaattttcagaccaaaaagctttaaaaggaagaatcgcatgtgtgaattaggactactctatcttttccttaaggccaatcctgatttcttgggactgtgtgtcatggtcatttgagtacggactgatacccactgccataatgtgaatgtctccccaaaattttgtgtgtcagaaacttaatccccaatgcaacagtgttgagaggtgggacctttaagaggtgattaggtcatgaggacagaattaatgctgttattgcaggcataggttacctatcacaagagtgagttccttataaaaggatgagttcagttgggtgcggtggctcacacctgtaatcccagcactttgggagacctaggcaggtggatcacctgaggtcaggagttcgagaccagcctggccaacatggtgaaaccccatttctactaaaaatacaaaaaattagctggacatggtagtgcacacctgtaatctcagctactcgggatactgaggcagaagaattgcttgaacccaggaggcagaggttgcagtgagctgaaaccatgccattgctctccagcctgggcaacaagagcgtctaaaaaaaaaaaaagatgaattcagcccctttcccttctctgcctctttcattctctctctaacactcatgctctcttcctcttctgctacaggacgacacagcaagaaggcccctgaaagatgtaggacccttgcccttggacttcccagcctgcagagatataagaaacaaatcttggctctttgtaaacaacccagtctcaggtattctgttacagcagcacaaaacagactgagacatccatggtccagaaaatgagatgtcaaccctggctaacacttcttatgtgatttcaacttcaccctcagtaccagtcccacacacagtgagcctcaccagctgttatcttaacatgtttaagtcttcataaacatgggaagacacctgctctgatattatctaatttgttagctaagcctcactagatgagcctcaccagctgctaccttaaccaacgtttaagtcttcacaagcatggaaagacacctgctctgttcttatctaattcacttcctggaacaagacccactaaggtcggtacaaaaagcattccttccattccaccatgcatcactctagtttctcagcattttataaatatcttcctattgtcaccttttacctggttgtctgcagctttggattcactacacaaatttttacagtcataataaggatgttatactcaagcaagcatctccaacccacgccccagttcagccacagaataaatgttgagtactttgcagagaaaactggtcacaactgaatcccacttgatataccaacataatttgcttctgaaaaaaaaaggcagcttacaaaattaggtacacattcagttcatttagtctctgcattcaaaaagctcaaagtctagtggggaagaaaccatgagcaatggaacgatccatatagatatataaagtcatgttcaagaaagggaagaacattatcctaagtaagctaaaaacagctgctgcaattaaggactaaatttcactccaagctgcctagggaaacccaagctttaagattctctccttggctaagggaagagaaatacacaagttcaagcaaagataaaccttgtcctgaaactaaaacttgaagatggatccttctatagagagcaacaaacaaaaataaataaatattttcaacagcagtttcactcactgtgaaatatttaagcgactgtcatgaaaacaatctttctgtgttttatgtaaaccagtgatatggtctgaatgaatgtgtcccccagtaattcatacactggaatctaagactctaatgtggtagtattaagagatggagcctttagaagctgattaggtccatgagggctcctccctcactgatgggattaatacccttataaaagggttggaaggaactagcaaggctcttttgtctttctgccttccaccatgtgaaaatgcagcaacaaggcagcatcctggaagcagagagcagctctcaccagacacaaaatctataggtgtctcgatcttggacttcccaacccatagaactgtaggcaatgaatgtctgttgtttataaattagctagtctaaggtatttgttacagcagtagaaactaaagcagagtggtttcatggttaagaattggctgggtgtggtggctcatgcctgtaaacccagaactttgagaggttaaggcaggcagatcacccaaggtcaggagttggacaccagcctggacaacatggtgaaaccccgtctctactaaaaatacaaatattagccaggcatggtggtgggtgcctgtaatcccagctctacttgggaggctgaggcacaaggatcacttgaacccgggagtggacgttgcaatgagccgagatcgtgccactgcactccagcctgggtgatcgagggagactccatctcaaaaaaaaaaaaaaaaagaatcagcactttctagtcaaaaacagtgttagatttgaatcctacctctgcccttattagccaggtaaataagtagtttgacctctgtaagcctgtctcctcttctgtaaaatgggttttaatatatactgaagagaatagtactgttgtaaatattaaataagataaacggccaggcatggtggctcacatctataatcccagcactttgggaggccaaggagggaggatcacttgatgtcaggatttccagaccagcctgggcaacagagcaagaccctgtctcttcacacagaccaaaaaataaaaaaatttagctgggcatggtggcacacacatgtagtcatagctactccggaggctgaagtgagaggatcatgtgagcacagtaatttgagacttcagagagctatgatcccaccactgtactccagcctgagtgacagagcaagactcttgactctaaaaagataagatatggaaagcactgtacttagcaccaggcatctgctcagtgagtaacaccagtaattatttgctaaggatcatatgaagcaggatgcaggggcaacaagaagtcatggatgaattagattgatgcctggattacatgctggattacaaaggagggtcagtgagacctgacaaagggcaagcttcagggagaggctggcatgtaaaccactgtgctgagggatcaggtgtgagcagcaaagcaccagcgggttccagtgctgaatggtgtcagtatgcagaaggggctacttgaatggaaagtgccagagccaaagaagagtccacttcctgggtgccagggaggctggctgaattgtcatatcaaagaaaagatcttgtgaggttaaaaccaaaagggatggttcctgttaatggggtcaaggaactggtacatttcttgacagagtaatatactgaagaggccatgtatggtgcctaacacctgtaatctcagcattttgggaggctgatgctggaagattacttgaggctaggagttcaagaccagtctgggcaacatggtgagactgtgtctctacagaaaaattttaaaaattttagtcaggcatggtggtgcatgactgtagtccctgctactcaggaggctgaggtaggaagatcacttgagcccaggagtttgaggctgcagtgaactgtgatcttgccactgccctccagcctgggcaacagagggagaccttgtctctaaaaagttaattaaataaataaactaaagagcctcattcacattaacttgaaatgatgcccttttgtgatggtcagttttatgtgtcaacttgactgggccatgggttgcccagatatttggttgaacattattctctgtgatgtgtctgtgagggtgttgctggattaggttaacttttgaattggtagtctgagtaaagcagattctcctccccagtgtgggtgggtctcatccaacagtgaatagaatgataggcctacatggaatgaacacactaagaaagaatttgctcttcaaactgtcttcaagctggtacatcagtcttaattctgccactgaactcagacttggactggagcttttcactatctgattctcaggtcttcaaaccagactggaactataccattatttctcttgggtcttcagcttgctgacagcagactgtggaattttcagagtctgtaactgcatgagctaattccttatgataaatctctttaaagttatacagatagattaaggatagatagatagatagatagagatatatgatagatgatggatggataggtaggtaggtagatagatagatagattctgtttctttggagaacccacattaatgcaccttccttttttttcctctacagtaccaaggacccaggcacattgcagtagggtattattattattctgagcaaagccctgtgtgttctgcagggcttctaaagcagtgctactcaaagtgtggtctatagaccactgcaaattgcatagcatttgttgctggtctgcagtgagataagtaaaagaactgagagaaagcattgaaatagcaatttagagcattgccccaacttctaagcacttgaccagtggacttgatttttgtatatttttgcttcttttatttttcctggtaattctttcttactggtttttgttttgttttgtttgtttttgagatggagtcttgctctgttgcccaggctggagtgcagtggcacgatctcagccactgcaagctccgcctcccgggttcatgccattctcctgcctcagcctcccaagtagctgggattacaggcgcctgccaccacgtctgcctaattttttgtatttttagtagagatggggtttcaccgtgttggccaggatagtctcgatctcctgaccttgtgatctgcccgcctcggcctcccaaagtgctgggattacaggcgtgaaccacagcgcccagctcttactgtacttttttaaagtatcagtctacaaatgaccgaaactaaaaaaaattaaaactggtccttcctcacaaatagtttgagaagcacagctctaaagtatttaatttatgttgtatagatttctggtaatgaaccacagagaaagcaagaaaaacatttggagaaatgcatcttaacttgtccctgaaactttttcaaagagcttaagatttcttaaaagtcttagatggacttctgaaagaagctgaaagacttcaattgattcctgagctctctatagagtgctagagaagtacaaggcatctcttgcagacttgacagcaatccgtgtcctccaattaccagacatacaaggggcaatattgatcttgcatgctaaaggttaaagagcctaaccagtcctgacacagcctttgccaaattcctgtaaaaacaaccacgaaagcacaccaaaataatgatattctcaacaccaccaatgccagagtatggaagaagctttcataaaatcagtgcagttaggattagaatgatgaataatcagtggtgcagccttgaagtcagagacggaataacagagtcagatagtacagggataagaagagattgttatctacccaaattctcttctgtttcagggacttagggatgaccaaccataacagcaggcaatcacccttctgactggaattgctttattaaagcagccaaggtcaaatcccaccaccatctcttccaccactgtgaagcaacaactttttttcctctagctactcatggatcataactcccagtatgcaaggtggctaggaatggaaggtctgagacgtggaccctgcacatgaagatgagaaattagctgcaaggcacaggtgttggtgagaaggatcccaggagtaatgacctatggggattatgatttttcatgcattgcttctgattaagaaaaaactgcagaaggcctcaaataacccagaaatatatatgtcttcctctctgttcaacagctacatggtgggcacaagaagatctcatcttactccagcaaagatgctctcaacaaaggccagctagaccctggacatttggctaagcacttatgaaacagttttgttcccctgttaaaatcctgcaggggcatgccagttggcaaacacttggtttggacagatctcaaatcagacaagaatgagtaagcaaaaacactaacgtagtggtctgtgtaaaagttctgcatcattagagaaggaagaactttcaagaagaagtacagcaaaagcctattgccaataatgatataatacaagaaaggacaattttacaaactttaacaaggtgtctatgacacaggaatgcaaattcataaagaaatatcagagtgagaagaagagatatcaagacaaaaagaaaaggcaataagctgagaggtaagccggtttggaaaaggtgcatgcatttgcaaacaaaggagaaatgcaaaaacagtagcagaatgaaaatctgcattaaaggcaatgaagagtatttcaaagaaacagaaattttaccacataatgcacccatgtacccaccacccagatttaatgatattttgccttctttgcttattttttaaagaaataacatattacactgaaacccttaccacctactctattctttcacttccctccctccacagtgacaactctattatccttcctgtccatgcttttaaatttgtccagattttgatgtaactacatagaatatattgtatcattgctgtgccgatctttaaatttacataaatgatattacaccatccatatgcttttgcaacctgcatggttcactctatattggatttctgagatctatctaaatccatacacatacaccaaattaattttttttttttttttttttttttttttgagacagagtctcggctctgtcacccaggctggagtgcagtggcgcaatcttggctcactgcaagctccgcctcctgggttcatgccattctcctgcctcagcctcccgagtagctgggactactggcgcccgccacgacgcacggctaattttttgtatttttagtagagatggggtttcaccgtgttagccaggatggtcttgatctcctgacctcgtgatccacctgcctcagcctcccaaagtgctgggattacaggcgtgagccactacgcccagcctagttaatttttaactgctcaacagttttccattgtatataaattacacaatcgatggaaaagtgtgctgcaatgaatacccccatgtgtgtctcttcatatatatttgcaggaatttctctgaactgcatatctagataaaatactacctggttattgagtatgcgaatctttacctttattggatttagtgaaattgcactccaaagtgattgggttatttattggtatataatagttatttattggtatataataaattacccctgaactttgtggcttaaaataaatatttattatctcaggttctgtgggtcagaatcaggagctgcttaagctgggtggttctggctcaaggagtctcctctgattgcggtcaagacactgactggggccaccatcatcagaaggcctgaccggggctggaggatccatttccaagatggtgcactcacatagctttgttcacgtgagttgggagcactcacatggctcccaacatgatgccattaaacatggatttggaaagagatgttcataaaaggtctcactttcttgtgggtctctccatagggcttctgaagtgtccttatgacatgggagctggatcaccccaagcaagtgatcaaagacatgggggtaggggctcttatgacttggtcttggaaatcacacatcatcacttctgccacattgttttcattagaactgtgtcactgaatacagccaacacttagggggaaaggaattagactccaccttttgaaaaatggagtatcagataatttttagatgtattttaaaaacaccttaatgattgtgacaatttacagatccaccattagtctaggagtgtgtcaatttccccgatagccttgccaaaacttggtattagcagactgtttcatttttaattggatttccttcactgctagcttaagcatctttttatatggcttttactcattcaatttcttctgctacaagtatgcttttcatctttatgtattggattgtttatgatttttgcactgctttgtccttctatgttattgtccagtgtccaatttcaatcttatttttaaccccttttccccaaaaattagtcagaattattgtttcttacaatcgatacttatgtaaacttttccacaagtttgccaattttctgctcatcattggttcttgcaggctactcctttgttccagattcaatttctttttcaatgaagtgtaaatgtaaataaggggctataaatggcaagctttctaagtctttgtcttaaaaagtctttatttcaacttcatttgaattatgaaggttaacctagtagagaattataaattaatgatttccttagcacttaaaaaatgttttgttgctgatgagaaatctataggtatacttgctgttcacctattcatactcattctggacaattctaagtcattatgttttcagatataggtgctctccaaatctctttattctctttttggtaagctcttattagatgtacgttggacctctttgttcaagctggattctcttgactggttcacccaaaagctattcacagttcatctgactgaggaagctgggaggccaataactattttccagactttcttgctactaaggttctggatgaaagttagttctaatattcaaaagctcttacacaaaatttgcaatatagacatgaggtgaaggcagtgatatactggtaaatgtttagcacttggtctcaaaaagaaacactcttgatgtgtagcattttccattttcatggtgaaaatattcccaacaaggaccaattccaagctcccaacatggtaccactaaacatggatttggaaagagatgtgcagcagtataccagcataccaccatgaagtatctccaccacacacacacaataggctaaattaaccacaaaatcacaaataatagtaaaatgtagcaaaatgattaggaagtgatgaattttaaatatttattaccttgatttttcacttatttcattgtaagttcatattccatttttaagaatgaatgcataggctgagtgtggtggctcacacctgtaatcccagcactttgggatgccaaggtgggagcccggagttcaagaccagctgggcaacatagcaagacctcatttctacaaaaaataaaacaattagccgggcatagtggtatgtgcctgtagtcttagctactcaggaggctgaggttggagaatcgcttaagcccagaagttcaaggctgcagtgagctatgattaaacccctgtactccagcctgggtaacagagaacgagaccctgtcttaaaaaaaaaaaaaaaaaaaaaaaaaaaaaaaaaaaaaaaaaaaaaaaggatgcatttaatagtcacctcacaaaatcccttaaaatttaaaagtgggctctcacaagccagtatgagcttatgagctagctccagcatgtcactggctgtttccttgccatgttttgactttctacagaaaagaagacatgaaaacatgacattttcctgcagcaacattccattgttcactctccagtttcctggctgtgacaaagcagctatggtggtggcagcaacagcttctgaatccccagatcacagctctaggggaccattctctaaatgctgggaagtcaagagaatgttgcagggacaatatacagcagtggcagcctcagtggtagcaactctcctggagagttgactttgagttattctggaattcattctggacaaccacctaaaatccactccttcaacccttgaacagttatgcaagcatcaaatcccttatactaaatcccctcctgcttaaaatacccagagtggttactggttcttgaactaagtcttcactgatacatcatagtgttgtccatattctttaaactctttttaattgttcacatttttacctctctgtgtatcttagaagtaatctcctcaaattatttgcaaatttgtactttctcttttcagtttttactgaatggtggttgaacctgtctactgaatttttcatttacatgactgtattttccatttccagaagtttactttggttcttttataaacacacctcttatttttcactgagtatcaatctttcattatgattcctatactttctttcaccttttaaccattttttttttttttgagacagagatctcactctgtcatccaggctggagtgtagtggtgcaatttgggctcactgcaacctctgcctcccgggttcaagcaattctcctgcctcagcattccaagtagctgggattacagttatgcaccaccatgcctggctaatttttgtattttcagtagagacaggatttcaccatgttggccaggctggtttcgaactcctgcctcaagtgatctgcccaccttagcatcccaaagtgctgggattacagatgtgagccactgcgcctagcccttttaaccatttctgacttatttcatatttttcttcagaatgtcattttataatttccatttctgaaggcactaatcctctttttgtactactctgactttcccagtgacaaactgtttcccagtattgcctgtcatttgttgaggggaggaaccccagcagcctttgcaacaggtgacgcttttcccactggagttccaagttcacagagatccccgtccatcacacagggcatctcaccagttcagaaccagtcattacattaattccttaacttagaagcctgcaccacacaggcagtgtacatttggactgcacatcccctggaacactggcttagagttttgatttgtcactgtagcctttctcttttgtagccattgatctgggaagaaaataagcatcactgctactttgctgggccagtgtggagactgagtctagctcccacctgtaagtgaaaactgtaacctccacctcccgggttcaagtgattctcctgcctcagcctcccaagtagctgggatgacaggcatgtaccacaatgcccggctaatttttgtatttttggtagagacaggattcttcatgttggccaggctggtctcgaactcccaacctcaagtgatgcacctgccttggcctcccaaagtactgggattacagacatgagccaccgagcctgaccatatgttgaaattcttattgccaatgtgatggtattagcagataggggccaccgcacttcagcctgggtgacagaacaatactccatctcaaaaaaaaaaaaaagaatttcaacatatgacttttggggaaacacaaacatttagtccatgaatagtaagttgctactaggttgtacaagaataattgcagttattgccattactcttgcaccaaccattactttcaatggcaaaaatcgcaattactcttgcaccaacccaatataacagaatatgtggcttaaacaacaaacatttatttctcatggttctcaagcctggaaggccaaaatcagggtgccagcttgatcaaattcttgatgaagaccctcttcctggtctacagggggccctcttctcattgtgtccccatgaggtggacagcagagagcgctctggtctctttgtccccttataagaggacattcgtgaggattccacctcattagtgaatgaggcctccacctcccactcattagcagatagggcctttgagaggtgattgggtcactatatcatgacccaatcacctctcaaaggccatatctgctaataccatcacattggcaataagaatttcaacatatagtcaggtgcagtggcttatgcctgtaatcccagcactttgggaggccaaggcaggtggatcacttgaggtcaggaattcgagaccagcctggccaacatggtgaaatcctgtctctactaaaaatataaaaattagccaggcatggtggcgcatgcttgtaatcccagctactcgggaggctgaggcaggagaatcacttgaacctgggaggtgaaggttacagtgagccgagatcgcgccactgcactccagcttgggcaacagaacaatactctgtctcaaaaaaaaaaaaaagaatttcaacatatgacttttggagaaacacatttagtccatgaattacagggggctgggaaaccggagtctcatttcctatttcctgcctgtgccagtccaagaccacatcttttgtctctgcatgaacattaaaaccccatcaccagagctttctggggggcagggaggttcctgttgttcagtagcgcccactcctatgcttatctccctgggctctgagtttccccttccttcctttctttctaactgattttattcgtcagagcttagccaggaaaacagagcctgtatcaggcagttcaacaagaggatttaaaacagctatctactaagttgttggaagggtggaaaagccaaacagagatacttagcagagattagagatggcagcaacgtattcccacccctagtctggaaggacgtagggagagggtggtactatcagaacctcaaagttgagtttcccaaaaggatctagcaccgtggtaggggctgcccaataggaactaaaaggagagatggaaaggctttgctctgccaagattcaaagcaagaaccactaaaaagagacagccactgctggagacaattatcaaaagcagatcgagatggggaaaaataccccagcctctctctttttcccgccttttcatttcctgctggtgtctccttttggccaaatcagtcagcagcctattgccagggaatctggaaatgtagtttgcaaacatcaagccctaccatgcagggtagcaggagaaaaaggcagataaatccgtaagaaagcaggcagatgaccagcaaagtgacacgtttggtattttttttctattttattctgcatttctatgttgatagcagaaaaagcacccatgttagcttaggacactgacagaggtagatctccaggtaacatttttgaacttcaaggataagaaaaaatgctctgagcattcaggtagaaaatacagtttaccggccaggcacggtggctcacacctgtaatcccagcactttgggaggccaaggcaggcagatcacttgagatcaggagtttgagaccagcctggccaacatggtgaaaccccgcctctccttaaaaatacaaaaattagccaggcatcatggtgcacacctgtaatcccagctactcgggaggctgaggcaggaggatcacttgaacctgggaggtggaggctgtggtgagccgagaccacaccactgcactccagcctgggcgacagagcatatccacaaaaaaacaaaatgagattcagtttccttcagaataataatggcttctgaagattcctccagaagcaaccacaaaaacaacactatctccacctcccgccgccttgaatgggtcacttaaattaaaataagtagagaagtttatgaagtaaatcatgaggaaatattgtaagtcaaatgtaatagaaaataaagttctcacttcaaacaattcaaactaaaaaacattgaagtacagtgaagtccaagtgaaagatgatgaaggtcattctatgtttgagggtaaaattcaaaatgatagcatattagtcataaacttctatgtaccatatcatagcactgtaaagtaaaaataatttaaatataaagaaaaactgcctgggcacagtggctcatactcacaatccccacactttgggaggttgagacaggaggataacttgaggccaggagtttgagaccagcctgggcaacacagcgaaacctcatctctatgaaaaatttagaaatagcctagcgtggtggtgcgcacctgtagtctcagctacttcggagactgaggtgggaggatcgtttgagcccaagaagtcaaggctgcagtgagcataatgttgccactgcactccagctgggacgacaaagactgtctctaaaaaagtaataaataaataaataaataaataaataaatacagatttttaaaaatggttgaagtctttaaagacaccctataagcctctgataaattacctggacaaaaaataaaaacaaaaaggatatgaagaaaagtgggtattaggctatgaaggctaatttaatgtgtgcatttctgagtgtgtgtgtcccccagagatccgtcaaattatcaaatataagaccacagagcaaacttcagcatacgtatttaaaaagttggtctaccacagttgaatttaagtagagacaataatgaaagtcaatactttcagtgtatactgggcagatgatgggtgcacccaaatctcacaaatcactactaaagaatttatgtaaccaaacaccacctctttcctaaaaacctatggaaataaaatttttttaaaataaaatagaagccaaaattgaaaattttattatattcccctaaatatttcctaggtcaatgtttaaattaaagttataattacgggctatctttaaagtaatgaaaatggaaacaatacttatttttaaaaataacaaaaacaatacttattttttttaaatcacagagtgtagcaaaggagcattcatatgaactttaaagtagttttttccaattctgtgaagaaaggcattggtagcttgatggggatggcattgaatctgtaaattgccttgggcagtatggccattttcacgatattgattcttcctacccatgagcatggagtgttcttccatttgtttgtatcctcttttatttccttgagcagtggtttgtagttctccttgaagaggtccttcacatcccttgtaagttggattcccaggtattttattctctttgaagcaattgtgaatgggagttcactcatgatttggctctctgtttgtctgttgttggtgtataagaatgcttgtgatttttgtacattgattttgtatcctgagactttgctgcagttgcttatcagcttaaggagattttgggctgagacaatggggttttctagatatacaatcatgtcgtctgcaaagagggacaatttgacttcctcttttcctaattgaataccctttatttccttctcctgcctaactgccctggccagaacttccaacactatgttgaataggagtggtgagagagggcatccctgtcttgtgccagttttcaaacggaatgcttccagtttttgcccattcagtatgatattggctgtgggtttgtcatagatagctgttattattttgaaatacatcccatcaatacctaatttactgagagtttttagcatgaaggttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgtagaattcggccgtgaatccatctggtcctggactccttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttattagtcttgctagcggtctatcaattttgttgatcctttcaaaaaaccagctcctggattcattgattttttgaagggttttttgtgtctctatttccttcagttctactctgattttagttatttcttgccttctgctagcttttgaatgtgtttgctcttgcttttctagttcttttaattgtgatgttagggtgtcaattttggatcttttgaatgtgtttgctcttgcttttctagttcttttaattgtgatgttagggtgtcaattttggatctttcctgctttctcttgtgggcatttagtgctataaatttccctctacacactgctttgaatgcgtcccagagactctggtatgttgtgtctttgttcccgttggtttcaaagaacatctttatttctgccttcatttcattatgtacccaaggagcattcagaaaaaaagttttgttatttaaatgttctcttttatcttaaagaggaaaaaacactaagtcctcaatgctaacttcttagttaaaaaataacaacaaaataaattaagaaaataggaaaaaaaggaaataatgaaagtgaattagaaaacagataatttgaaaaagctagttctccagaacaaaaccaataaacaacaaatctctgacaggtttattaaaacaaatatagaaagcataaatagataacatcctgaaatatgggaattctacatgcaactccagactaataaattttaaaacactggttaaatgaataactttgcactcaagataaagaaagtggatttttttagcgaaaacaagatgatttaatattattcacacttattgaaaaccttgacataacactttgttatacagtaatttgaagatttggttttgggttgagtttatttccagactttattttcatgtctgccataaccaaaaatacacctccgtaagagacacagatccaaatggaagaaaaatgtcattggcagtatttacgaagtcataatattcattcttcaattccatctgacaagcatgccaaggtttttgctgacatttggctggtgaagtttcatcttccctaacgtcaacagatgattttgcaaactgaaagcagttgcattttcatatttttaacaaatgagtctgaaactcccttgatctcttcatttggaagtttctcacacagttgacaaagttctgtttccagatttttgaactttacagagtagagtttgtagatagtgcactcaccatcttattattttttttagctacaaaatcacataatagttgagacatttccaaaaacatctattttcaaaaatgttctttccacagcataaggttcctttgagaagcggtgatttcctcaatctttgttaaaatgtcatctttacctgtgtatggccaacaacatcccaccatctcagaaaagaccagaaagtgtagatcatttgactgtttatgacagaaagcgtgcgactcttatttgtgtttgacaattcacttaagaactttgccctgaaataagacgcacactttgttgtggcacaaaagccacctgcagccatcttccatctcatctcaaagatgtaggccagtgagagtcaatagagatctacattttaaattgtcttttggaagtctgttaatcgttttggccaacttctgtccaatctgatgaactcctcagtgctctaactcatagagtaactaatgaagggctccttttgggagcaaaggaaatgtcagcttggtcactgtcttggggtctacttgggcctgttagatcagcatgatcaaaagctgaggtttcttggtagacgttctgtaaagcctcttgcccattatctattagtctagttgaagcaaattaatataatctgtaaatccctgatatggtttggcttcatcccaagccaaatctcatcttgaattcccaaatgttgtgggaggggcctggtgggaggtgactgaattatgggggcgggtctttcctgcactgttcttgtgatagtgactgagtctcaagagatctgatggttttaaaaaaaaaaaaaaagaggggaggggtgcggagtttccctgcacaaactctgcttttgcctgccgccatccacgtcaagtcgtgacttgctcctccttgctttcctccgtgattgtgaggcctccccagccatgtagaactgtaagcccaattaaacctctttcttttgtaaattgtccagtctctggtatgtctttatcagcagcttgaaaatgaactaatacaatccccctaaccaggcacttgtgtcacaagtcactggaaggtaccacagtacctcccagtgtgagatgctctccttttcctaaacacttcacaccagaccagacagcatatgggcaactgaaggcggcagtgtcattctctactgtagataatcagtaaagtataatttcctccttttattcttatactccaaaaaaacccttacatgccctcccctttgaaaatcaggcagagaaattaccatgaaacaaggaaaaagacaagaagcccattatgtccactattaaataacactatcctagaaattctacttaatgcagtaaagcatgaacacaataagagactatttaagaggagaaaaactaaaaaataaaaatgaaaagcctagagtgaaatacatgtaaatatttaactcatctttcatagttaagaggcagaaattacaaaggaaaagatgaatagccttgccagtataaaaatacaaacttctaaacattataaacgatataaataaaggtaataggcaaacagggaatgcaaagactgtatgatcagacaattcacaaaactggaaagacaaagaattaataaagtatgcaaaaacaacagttgatctcacaagtaaccaaagaaatacaattttttaaaagatgctcttatctttttttttttttttttttttaaaaagagagactgaggtcctgctgtgttgcccagactggtttcaaactcctgggttcaagggatcctcctgcctcgacctcccaaagtgctagcattacaggcctgagccagcatgcctgaccatgttatctgctttttcaatgggggagagtttttgtttcaatttttgttttgttttgtttttttgtttgttgtttttttctgagacggagtcttgctctgtcacccaggctggagagcagtggcacgatctctgcctccccggtttaagcattctcctgcctcagcctctgaagtagctgggattacaggcgcatgccaccatgcccagctaattttttgtatttttaacagagatagggtttcaccatgttggccaggctggtctcgaactcctgacctcatgatccgcccacctcgtcctcccaaagtgctgggattacaggcatgagccaccatgcccagccctttttcaagttgtttttaacatactggtgagaatgtaatgggactgatacttcatagcaattgaaacaacagttcagagaaagtaatttggccattctgcatcacaagtctgaaaaaaatagttctggccctttgaccctgtaactctattttttttttcagtctgtcctgagatgtagccaaagatttgtgtatcaagaaaaggcactgcgttgtatttttaatgaacaacaacaacaaaaaagataaaaacaagaaaaaaaaacagttaaaaatacagaaatcaataagcaaagtgcattcatatcagagtatgttgtggatcaaagacgctcactaaaattttaatgacatccaaacatctttataatgtaccactaactctaatacgtgtttcaactgagaaaaacgaacacacttctctcctaaaattctattacaatcatgatatagggaacaaaatagaataagtgcataaacacagatgtatgtatttaagtataaactgtatttgtctaattatatttatagccagtcacggtggctaatgcctgtaatcccagcactttgggaggccaagagggggcagatcacttgaggtcaggagttcgagaccagcctggccaacatggcgaaaccccgtctctaccaaaaatacaaaaattagctgggcatggtggcacgtgcctgtaatcccagctactctggaggctgaggcaggagaatcgtttgaacccccgaggttggaggttgcagtgagctgagatcatgccaccacactccagcctgggtgacagagtgagactctgtctcaaataaataaataaaaatgtaaataagcacagaatatcagggaaagaccatcattggcccaaaaactttggcagatccctggagggcaggatgaattcatccatctttacagacgtaattgggcagacagaagccaggctgaaagcatgcaaactggaaagaaagtggaggagggagaagcgctgagagcacacagagtatagtcccagtcagcagttgctaagatctggactggagacagggtggacagggggtgactgatttaagtccttcacttagatcagcttgctgggtttcccacccctagaaaaagatcctcttaaaagcaagcaggccgggctgggtggctcacacctgtaatcccaccactttgggaggccgaggcaggtgtatcacttgaggtcaggagttcgagaccagcctagccaacatggtgaaaccctgtctctactaaaaatacaaaaattagcctggcttggtggcgcatgcctgtagtcccagctactcgggaggctgagagaggagaatcgctgtaacccaggaggcagaggttgcagtgtgctgagatcacgccactgtactccagcctgggcgacagagcaaagactttgtctctcaaaaaaaaaaaaaaaaaaagcaagcagtgatctgcctgaggagtagatctgacgttgatctcccagagtaaggccttcatctcctggcatttacatggggcatcctgttcaccccttcccagtcttgaaccctacaatgaagcctactggtcaacatgccccactgctataaaagagtttgcagccattggtctcattcagagagaaaggctgctactaaaacctgcctcttatcacagcccatcacattcagaaacgccaggaatggcaatgaccaaacaaggattgccagacacttcaagaaaaccagtgtcaccgacaagcaggacagaaaaggtgaccccagacacagcaaggatgatcctggaaaaaagaagagaccttggaagaattttaatgtaatgcttcagggagagctgagaggctgctaaaaaaaaaacagtctgagatgaggaattgaagaaagtttaaagaactgatgaaataggagagaaaattcaaattgtatacacagtgaattactgcagatgcgtttcagaacaagagaacagagaccacggagaggaaataatacaagagaaattcccagagcggatgagatgaagcttgagactgaaaatgcctgtcagctgctatatgggataaatgaaaagacccacaaagagccaaacctcataaaatttcagaacatcagaattaaagaaagcacctaaagccctagaggaaggaacggacaacgttttaatgaatggcgatcatgctgacattaaactgcacatcagcatcatcagacacgagataacagtggagcaagtggtctggacatcacaggaaaaactaatttacacccagtcaaaatccaatcaagacagaggcttagaaagtttacaatttggctgggcgtggtggctcaggcccatcatcccagtactttcggaggtgcaggcattccagattagccagcataccaagcccccatctctacaaaaaatacgaaaacaggatgagcgcagtggctcacacctgtaatcccagcactttgggaggccaaggcacgtggatcacttgaggtcaggagttcatgaccagcctggccaacatggtgaaaccccgtctctactaaaaatacaaaaaattagtcaggtgtgatggtgggcacctgtagtcccagctactagggagactgaggcacgagaattgcttgagcccaggaggcggcggatgttgcagtgagccgagatcgcgccactgcactccaggcttggagagagagtgagggtctcaaaaaaaaaaaaaaaaaaaaaaaacgaaaagaatccgggcctggtggcatccatctgtagtcccagttaccacagagactgaggcagaaggatcccttgagcccaggagttcaggagttcaaggatacagtgagctatgatggtgccattgcactctaacctggtgacagagacagaccctgtctcaaaaaaaaaagaaaaggaattttacaattcatagacatcatctaaaaagaaatcactcagtgaattatttcagcaacatgcaaaaggagtccaagaaatgagagaaaatgagatctaattcatgagatggattctaacaatgaggtgagagcccagaagaccacagtgggggcaggtgttgtaaatcagtgccaaggaggacaggaagaagtgaacttccagcatcagtgcattaaagaaactgcataccaggtggccagatcatctgaggtcgggagttcaagaccagcctgaccaacatggagaaaccctgtctctactaaaaatacaagccaggcgtggtggggcatgcctgtaatcccagctacttgggaggctgagacaggacaatcccttaaacctgggaggcagaggctgcggtgagccaagatcgcgccattgcactccagcctgggcaacaagagcgaaactccatctcaaaaaaaagaaaaagaaaaaaaaaaaagaaactgcatatgcttagtgagaaggagaatccagcatcaatattaaatatcaaataaatacaatgagagtgggctcgccctccctccttcactctcttttccaatttatttatcctttcctcctataaatgttacagcactaggtggggtgtgctggctcacatctgtaaacccaacactttgggaggccgaggcaggaggatcccttgagcccaggagatcaaggcttagtgagctctgatcatgccactgtactctcatctgggtgacagagcaagactctgtctcgagaaaataaaaagtaaatgttatgggattgcttgtatcatatttgtttctgcagtgagtaattatttacataatcatagtaatcatattcacaaaatctttggttttgaatttgaaataggagaatcatggaaatttcagatagagaacaaatgtaaatgcctgccactctaagagtcagtaatacagaagacaagctgcaaaaaagaagaaagaaatgaagaggtgctaagccctcccccgaaaccaccgtctttcagactgggaggtccaaaggtatggtttcaagttaataaagaaagacttaagtttataagctaaagcaataaagctattcaattcagattggaaaaataaaaatgtgactggcagagactgggatgggaaaggggaaagactccacgttcttcctgtctttcaaaggagaggatggagagatcccatttcaagtggatgctcaaaaccacataaggttgggcacagtggctcatgcctgtaatcccagcactttgggaggccaaggtgttcgggggccaggaaggggggattgcctgagcccaggagttccaggccagcctgggcaacaacaggaaggccccatctctacaaaattaaaatgaattttaaaaaaaatcaagtaagcactttacttggagtgatttcatccaccagaatcactgagatgaaaaatggcttacaatgcttgcctctgacatggggggggtatagctgccagcgtctcttttacgtctatctacttatattttgtttttttattatcctattcttatattactttcattaggtcaggccataaaatcctatgtagggcataatcacaactatataaatataattacctggcctacctagccacatacatatatatttatagagatatataaagttcttcaaaggatataaaccaaaatgtaaatactagttattgctgagtgatgaacttactgttgttgtatatttagttgtttaacctctccacacttagtgacatgggtctatttcatttttacagctagagagaaattaaaatgattttacaaatgaaagagcctggctggaatttcctccacgtgggagtaaggccccaggaagccctcagacaggaccaaggctgcctgatggccacggctacagtgacctgcagcctcgcatgtgacctgctgtctgcagcccaggcctccaaagagagcctgggttggaaccctttaagggcccgtgttaacagctggctgtgtcagccaggacagacatgtgcctcccatcccaattttgattttgattgggactggcccccagagaactgcggaggattgcaaaccttcaggtaattagatgaacgctcctgctggaagaaatcctgcaccagcttcacaaggatgccggcgctggcctgccgacaggaatgcttttggcaggtgattttgagttgttctttctgaaagtaattacacaaaaagttccactgcttgttaaggctccttcttaaggctgttttgatctcttttaattaataagttgaatatggaaggatttaattgtgatgaatttctatgtaacttccttcaagatccccacgtaaagtggtcctgctaagtccaccatacacttctagctgctcagacacctgtatcaaaccgagagccttagatagctttctgcaaagtttgagagaatcctgctggctgaggcctctcccaagacagtgagaggtcagggattatttgatctacgggaaataactgcacactgtacccaacattgattgttgagagttctctagaacagcacttttaagactttagtagcttagtttgctcaggttaccgtaacaaaagactacagaccgggtggcttaaacaacagaaattaattttcttatagcctgaaggctggatgtctaagatcaagaggtcaacatggtcaggttctgatgaggactctcttcctggcttacaaatggccaccttcttgctctgtcctcacatggtcggggagagacagaaagagggagagagggcaagctctctggtatctctacttataagggcactaaattccattatgagggacccaccctcaagacatcatctaaacttaattacctcctgaagactaaagttaccttgcccaaattcctatctaaggggtctagggagtcatgccctacaaaccataaacactcatcagatgggttttatctaaccttgtatatcatgacttactttccaaactgacactggtataacatgacaagacaaggaagaaaatcaaaaaattttaccccaaaacatgtttctttgccatattttgaaatggtcctgcaaagctgtcctttgtgggggaaaatgtacatctgtaaagaatctctattcacatagctagatctttttcttccaggccctcccaatcctgaagagattaagtaagagtctagcaattttttaaaggtctgaatagaaaacatttgtcatctatctatctgtctctaacggcagccactataagccttcagaagaaggtctccacagtcttttatcttaacctaaacatttcctttctatggaacccaggtctttagacaaactcaaccaattgtcaatcagaagatgtttaaatttatggtgtacttggtttctccagtcgcccacctggccttccaatctgtactttccttcttttcttttcctactgttctaaagcttttaaataaactctcattcctgctctaaaaaaaaaaagaagaaaaaaaaagaaaagaaaaataaaaaagaaaatgtttaaatttacctatagcctagaagcccccattttgagttatcccctctttctggaccaaactattatgtttcttaaatgtatttgattgatgtctcatccctccctaatatgtataaaactaagctgtgccctgaccaccgtgggcacctggttctcaggacctcttgagggctttgtctcgggccatggtcactcctatttggctcagaataaatcttttcaggtattttacagagtctgactcttcgttgacactcccaaaaccccatctccagatagcatcacacggaagagaggaagagcctcaacatgtgaatttggggttgggggacacagttcagtccacagcactaactaggtcgacagcaaatatgattgaagacagacaaagtcaggcaggggccctagccagacttctgtttttggtttttgctttttgtaattttttttaaactcaaattagccctatctcagcagaagaggcttttaagagattcaagcagaaaggtacaggacctctggagattggcttcattttggccaattaacataaaatgaatagtatgtaaattagattcattcaatccatcattcagatggaaagccatttgaaacttacatgttatttttgagttgacagcatgagaatgtttggaaataagactacagcacagaggacaaagattgcattattttttcctgaggtttcttctcattctgccataaaactgagggcacaccctacgaaggctgaagcccgtctggccgcaagagaggtcagttcattcactcggtcgctcgtgcagtgcagtgggcatttaacgcatctaatgggctgtgatcctcggatggtatcagagcagaagtcacagcctgtggcctcgcaaagcttgcagaatagctatgatatgatattatctgggcaatgcgactgcctgagagctacgcatattcaaagacagcagagtagggactagaagcaacctcctggctgagcctctggtgcagatgccgtggggaggtgacgctggtcacagacttcccaatgcagacacagacactagtgccctgcagagagcagccggcaacagggatgtcaccagcaggacacaagatcatcccaacagccgggcagaggacaatgactgaaagacggctgttgcctcaggacatctgctggcaagaggagggtcccagacgacaagagaagcaaaaggcagagacaaaaaaaaaaaaatgaacacaacctaacccaagagggtgagttcaccagaaggacatttcgtgagtcctctcactcactaaccttcacaaagacacggtgatggacagaaatctgctacaagaaatcagaacttttctttgctcaagatgtgtaataaacaaaacgacagaaatccacaaactagggctgggtgcagtggctcacacctgtaatcccaggactttggggggccgaggcaggtggattgcttgaggtcaggggtttgaggccatccccgccaacatggcaaaacctcacctctactaaaaatacaaaaattagccaggcatggtggtatacacctgtaatttcagctacttgggaggccaaggcacaaagatcatttgaaccagggagaaggaggttgcagtgagctgagattgcaccactgcactccagcctgggccacagagtgagatgctgtctgtgggggggggagagagagagagagagagagagagagagagaggaaagaaaggaaagaaagaagaaatccacaaagtaccaccaaagcttgagctgcttggatgcaatgccctcccagtgtcaagcccaatgtcagatatacaaggaatatttgaaaatgtttgctgaatgcacgaatgaatgaatgaatgaacgatatgagggatcctgtccccctgggaactgcaatgaaaacattgcagatgacataaaatgatgagtcccccagagctaccatcctcccatgtccttctgatgaactcacactcttgggttaggttgtgttcattttttttggtctctgcctttttgcttctcctgtcagctgggaccctcctcttagttccttcccggaacaaaacacaacctcaaggtcggtgggggcagaacaataaaaacttgggtgaagaactttcatggagtgataatgattctagaagcttccctggggatcattcccatctggcatgtatgcaagtaccaaaggaaaattttgcatgaaattccatgcaactaactcatgcaggaaaatagtaaacatttttagagggctcactatgtgctaggcaattctaggcaatgttaagtaatgtctcagttataccttatccccattttatagatggggaaatggagcacaggccaattaaataactggttcaaaactgcagagttagtaagtggtagaccaggcagtttagctccagaggcaacagcttgcacaagctctatagcctgcctttttcattttctcacctaagccaggaacctggagggaggctctacgggagggagactattcagaactcatcctgagccagatggagaagacacaactaaaggcattcatttatcctagaaatccatgccggtcctgttcatctttctgaagtcacattctgagccagggcctccactctttgaaacatacacatcagtctgtgtgcaaataaatccactggcacccaagaagggactcaaaagggtcccaaggaactcaggaatggacccctctcttctgatggagcacatgtcccgtgcaaggtcctgtggcctggaaacacagccctggcaggtgtcaaaggtgctacagaaaagaataggggaggggggctcacaagggttacacgggactcaaggaacggcaacatgcgtgaccaagggagggaagccaccttcaagagcccttggcggagggcatgggagggaagctgatgaatcagaagtggcaagcagggaagggcagggagaggcaaaacaagcacaagtgcaaggtcccccgctgtgcactgtcgtctcctgtcccacagccggccaagaaagacagcgctggaccacttcccacattctgctccaagccaaagaggtccaaaagccaacctcatttagtcatctctctactctctcctgaaacgaccttccttcatcaccaggtccagggagatttgctgactttgaatcagaaacttaacctgcgcttcccgcttcaaggctatccagggccaggggcaagcctggacaaactccgatgccctccaaggggccctgccagcattctcttccctgagcactgcaccctgttcacatcggtccgccagcatcccccagggatgcccccacactgccctccatgtcttcattctctgactactcatggctactagctgactgttataacgtcctgatcaaggacttgctcaggaaggaggagttctgcaacccttaagtctctagatatacaaagagaggcagcctagtagattggtctggttttcaagccaaaaagccccctgacctagtcctggctctgaaaaaccctagacagcacaatgctactccatcttagttttgccatggatcaaatgggagttgtaaggtatctacctcattgagccattgtgagggttaattgatatgatccagaagatacttatcacagaggctgatatgtggtcagaagataatgcatccagctcttggcattcgagatactacctaataacaatggcaatggcctagatgcagcagtgctaatatcagtagacaaggaacagagggcagaacaaaaggaatcttggcttctgtggttataatattgacatcaccctagtgccatttagataataccttgggtagtgccagctctcagccatgtgctggcatggtgtggcggtggacacttgatgcatctggtgacatctacatcaaaacgtaagagcaggccaggcatggtggctcatgcctataatcccagcactttgggaggccaagatgagtggatcacctgaggccgggagttcgagaccagcctggtcaacatgatgaaaccctatctctacaaaaaatacaaaattagccgggcatggtggtgggcacctgtaatcccagcaactcaggaggctgaggcaggagaatcacttgaacccgggaggtggaggttgcagtgagccgagatcacgccactgcactctgtcgccagcctggcgacagagcaagactccgtcttaaaaaaaaaaaaaaaaaaaaacaaaaataaagaagaagaaaatatatatatacggtggatccttaaacaatatgacattgaaaggcacgggtgtacttatgcatggaatttttccagttatgccaagtgtgcctttctctcctgcatcccttcccacctcctccacctcttccgactctgccaccccttggggaacaagaccagcccctcctcctcctcttcagtctactcaacgcaaagatgatgaggatgaagacctctatgatgacctacttccatttaacgaatagtaataaatagattttctcttctatatggtttccttaataacattttcttttactaataacattttattttactttactgtaagaacacaatatataatatatcaaatacacaaaatatgtgttaattacctgtttacattattggtaaggcttccagtcaacaataggctattagtagttaagttttggggggagtcaaaagttatgtgaattttttactgtgcagagggtcaacaccccaaccttgcattgtggaaggatcaactgtatttcttttttcttttttgtgtgtgtgtgtgtaagacaaggtctcactctgttgcccaggctagagtccagtggcttgatctcggctcactgcagcctcaacctccccggctcgagcaatcctcccacctcagcctcccaagtagctgggactacaggcacatgccaccacaacgcctggctgagattttttttttttttttttttttttttgtagagatggggttttgccatgttgcccaggctggtctcgaactcctgagctcaagcgatccacctgcctcagcctcccaaactgctgagattacaggcgtgagccaccaccgcgcctggccatcacctgtatttcaagcaaagtaaggtgatctgtgaagggtttgaatgccacaacaaggctcagactttgaagaaaaataggaatgatccaaagaaacatgaaagatccaagaaatgagcataggagagtgatgggaaagaaggaagaggaaaacaacagtggcttccaagacccagtggcagaagcaacctgccacaggcgccacttccagctgagtaagatccatgtccccaaaggatactgttgacatttctggacattgctaaaagccacctgccctagactacaagaagcattctggtttcaacaagtcactcccaggctgggcgcagtggctcacacctgtaatcccagcactttgagaggctgaggccagagtatcacttgatgtcaggagttcgagaccagcctagccaacatggtgaaaccctgtctctactaaaaatacaagaattagcagggtgtggtggtgcatatctgtaatcccagctactcgggaggctgaggcaggagaatcacttgaacccagcaggcagaggttgcagtgagccattgcaatccagcctagacaacagagtgagacttcatctcagaaaaaaaaaaaaaaaaaaaaagtaagtcacttccctataatattttggattttgttgttcaccccatgttatacctataagccatgtgccccaggacagacagcgctgggccactttgcagttgagggggcagaaaattgggttgcaggtgagccatgtatacctagagatcctcgtgctaggagatattttttcttttgcaaattcaaaatgtaactttggaaaagatgcctcaggttcagaaaattcagaaaggacaagtaagtcaaagaaagaaggacaatggcatcattgaaaaggaaaacaaacagttatgacaagttgaaagatttgggacaactagaaaaatagtgaccacaaagatcatgcttattttcctattgaaaaaaatatggataattttaaaatagaagagagaataagggaacatttgccctatcataattttttttttttgagatacacagtctcattctgtcgcccagactggagtacagtggtgcaatctcggctcactgcaacctccacctcccgggttcaaatgattctcctgcctcagcctcccaagtagctgggactacaggcatatgccaccatacccggctaatttttgtgtttttagtagagacagggtttcaccatgttggccaggctggtctcgaactcctgacctcaggtgatccgcccacctcggcctcccaaagtgctgggattacaggtatgagccactgcaccttgccaatcataaagttactaaaattaaaccagggtggcactggaaaaagaatggatgggagaatggagaagaaacaaaagatttagaggtcaacccagatgagtatggtaattcggtacataacaaaaacgacatttctaaatcagtgaatggattatttagtaagcattattgggaaaatcgaaaaaacatttggaaaaaaataacaataaagttacatccctatatcctaccatagccaaattaatactagttgtattaagaaaaaaaaaattctttgagacagagtatcactgtgtcacccaggctgaagtggagtgatacaatctcagctcaccgcaacctatggctccagggctcaagcgacagctcccaactcagcctccagagtagctgggactatcggtgcgtaccaccatgcctggctcattgttttgtactttttgtagagatggggtctcactgtgttgcccaggctggtggtctcaaactcctggctcaagcaatcctcccaccttggcctcctaaagtgctgggattacaggcatgaggcaccgtgcccagcctggattaaaaaatttaatgatgggactatatatgagacttctggctaataattggcaaactgaactcattttcccctctctttacctaaacactgctaaaataagaacaaagaacagagaggcaagggagatactcccctgtaaactacaaggaaacagaggaagggaagggagagatttcaaaggagatgtggaaggcacaaagaagagggaatggtaaccacagggtggacaaattctgtgcctattgtgggtctacaccacaaatgagccagacaacagggcagacagacagagccccgtccctcacccatggagtcagcacattgcccctatgcctgtgttcctggaagcctgcaggccagccttggcagcaatgaataagaggacacaccaggcccagcacagggctggagtgaggtgtcggtcgactgagggcaaggagggggagccagtctatgcacagaatcaaggggccctctgccaccatccccctccctgacggcagaattccagcagctgagcctacgcctgattcctgctttccagcactttcccagggcagcaagggacagccactttgtgtaaaaagccatttaatactatttgatttctaagctatgtgcaatacactatgttaacatatatatatacatatatatacatatacatatatacacatatatacacatatatatacacatatatacacatatatatacacacatacatagattttttttttttgagagagtctcattctgtcacccaggctgtagtgcagtggcacaattttggctcactgcaatctctgcctcccgagttcaagtgatactcctacctcagcctcccgagtagctggaatacaagtgcccaccaccacacctggctaatttttgtattagtagagacagggtttcaccatattggccaggctcaaactcctgacctccggtgatctgcccgccttgtctgcccaaagtgctgggattacaggcgtgagccaccgtgcccggccatattttttaatttttaaaagaacgcagaggtaagtatttgtgtaatctcagggatggggaggaattttctaaacatgattccaaaacttaaatatttaaaaagaaataataaaacattttgttaaaaaaaaaaaaacaaaaaaaactataggctgggcacagtggctcacacctgtaaacccagcactttgggaggccaaggctagaggatcacttgaggccagagttcaagaccagcctcagcacacagtgagacccatctctacaaaaaaaaaaaaaaaattaattagctggacatgacggcacacacctgtggtcccagctacttggcaggctgaggcaggaggatcacttaagctaggggttcaaggtggcagtgagctatgatcgcaccactgcaccccagcctaggtgacagagtgagaccctgtaactataaaaataatttttaataataaacacaaagttaaaaagtaatactaaagaaataaagggataaagagcaaacatagaaaattttgcaacatgtaataaaggctactattctttccactacaattctttaaaaaacattttttaaaaaaccgtgaccaatgaacagacataaaacatcaatgtgcaattcacaaaaggaaaaatcaagcagccaataagtatatgaaaacaaaacgtatgtgctcacttataatctcagaaatccaagctaaaacaccaacacaaaaccactttagctgtcaaattttgaaaaacagaggccgaggcgggaagatcacttgaacccgggagttcgggaccagcctggaaaacacagcaagatcctgtctctacaaaaataaaaaaattagatggtgtggtggtggatgcctgtagtcccagctactcgggaggctgagaagggaggattgcttcagcccaggagttcgaggctgcagtgagccatgaccataccactgtattccagcctgtgtgacacagtgagaccctgtctctaaaaaaaaaaaaaatttcaaaaaacaacgccaatagcagacattggtaaggatggatagaaataaagcctcttttcattgctgctggaaattaaaataggaaaaagcttgaagaaagtctgcaaattgtggacctgataattcctcttctaagaatttctccggccgggcgcgaatcatgcctgtaatcccagcactttgggaggctgaggcaggaggatcacttgaggtcaagagctcaagaccagcctggccaacatggtgaaaccccgtctctactaaaaaaaaatacaaaaactagccaggcatggtggcaggcacctgtaattccagctcctcaggaagctgaggcaggagaatcgcttgaacccaggaggtggagtttgcagtgagctgagattgcaccactgcactccagcccagatgacagattatgtctttaaaaaaaaagaaagaaagaaaaaaaagaatttgtccttaaaaaaatacttacagatgtgcaatatttttcattagtgaaatcgaaaacaacacgtggcacacccatttgtggactatgatgaattcgttgaaaatgttgaagtgggagaatatgtaatattagggtggtgcaaaagtaattacggtttttgccattgaaagtaacggcaaaaaccgcaattacttttgcaccaacttaacacagaaacattcacaggatattaagtgaaaaaacagttcatttaggaatggatgctgcaaccccttcagataataaagaggggaatacagagtaaagacacacaacatccacacaaatgcagactctgggacattttagcctgaaactgtcatcaatgattacctctggggtcagtgggattacgagtgaatttaattttcttctatttgcttatctttaaaagtttaaccacaaaccttttacttatgcacttaaaagaatattttaggccgggggcagtgtctcatgcctgaaaccccagcattttgggaggccgaggtgggaggatgagaggattgcttgagtccaggagttcaagaccaacctgtaacagcatagtgagaccctgtttctacaaaaaacttagaaatcagctgtgcatggtgtcacatgcgtgtagtcccagctattctggaggctgaggcaggaggatcacttgagctcaggagttcaaggctacagtcaactatgatggcaccactgcactccagcctgggcgacagagcaagactgcctctcaaaagaaaaataaacaaataaacgaaaggaaaggaaaggaaaaaaaaaggaaaggaaaggaaaggaagaaggaaggaaaggagaggaggagggaagagagagagagaaagagagagagagaaagagagacacagaaagagagagagagagggagggaggaagggagggagggagaaaaagaaagaaagggaaggagaaggcagggaagaagggagcaggggagggagggagggaaggaggcaggaggggagggaaggagggagggaggaagagagaaagaaagagaagagaaggaaggaaggagagagaagggggggacggagggagggaggaagggaagggaaggaaggaagaaaaggagggaaggtgtttccaaatgagaaagcaaaaatgagacagcagcagttttctcctggggaaatccctgttaggttggtgagtcttacaagccatcatcccacagaggatttattcctaaacatttctacaatgaaggctgagaggatctaatgttgcagtttggtaccacaactgttcccacaactctgtttgctctgcctggctggccccaccagagaactgatgacagccagcatctggtaggatgggacagctgggctgcaaacgctggagacagaactgtgaccacagggcgaactgggctgctgccactcagagaagaacctgtgtggcacctggacagacctggcctaggaagtcccccccagactcagaaaggagtgctaggctgagaggaaagaaagggctgaggttagggatttgaggagaacattacttccagtctttctaagaaaaagaactcaatgtctccctccaagagacaccagcatgacaccggccccagaattggaggctccagccctggtaaacaccgggaatccaaagaatgtcctcgcaacagatgaaaaagtaaggacatgaatgaactggaaatacagaaaaaaagaatgtcaaaccaccccaccctttaggaaaaatatttcactctgtgcaatagatcaaattctacttcccagtgatttgcaaaacagtatgggacctgagtgttatttctgattgagcgtctatggctgctcacagggaccctttttctctggtctcacctccctctgtcaataacctgatctggaaatttcactcaaattcataaggggcatccctatttcaaaggactctacaacgtgaattatttggtttcaatgcaaatgatactcaagtcttaaacatctgttcagatattcttaaagggtcccattaagaaacaccttgattttacgttattttctcttctgctaattctctgaagaattcaagggactgaaagaagtcgctcatttgacgcactttcattcttctcctactaccaacctctccaatagtgtctcaactattatctccctcttactctggagcaaaaaaatcacagagcaagggacagaagatcaggattccttgcagaagaaccaccttgcaaacagacacaagcttattctttccacattggtgtccaggagttatgatgacagaggatcaaatgtacagctagctctccacagtatagttagtcctccaattaaacttcatttttcttttgagatggtgtcttgctctattacccaggctggagtgcagtggtgtgatcatagctcactgcagcctcgaactcctgggttcaagcaatcctcctgcctcagtctcctgagtagctagaaccacaggcatgcaccaccatgtgtagcttttttttttttttttttttttttttttgtagagacagggtctcgctatgttgcccagactagtctcaaactcttggactcaagcagtcctcccacctcagcctctggagtagctgggatttcaggcatgtgtcaggaatggctattattaaaaagtcaaaagaaaaaaaaaaagatgctggcaaggatgtggagaaaaagaatgtttatacactattagtctgttagtgtgaatacaaatgagcacaacctctatggaaaacaatatgaagatttctcaaagaactgaaaagagaactacatttgatccaacaatcccactactgggtatctacccaaaggaaaagaaatcatcttatcaaaaagagatctgcacccatatgtttatccaagcactatttgcaacagcaaagataaagaatcaacttaagtgtccatcaatcgaggactggataaagaaaatgtggtatagacatatatattctgtattatttcgttttcatgctgctgataaacacatacccgagactggacaatttacaaaagaaagaggttccacagactcacggttccacatggctggggaggcctcacaatcatggctgagggcaaggaggagcaagtcacatcttacatgaatggtggcaggcaaagacagagagcttgtgcagggaaactccctcttttaaaaccaagagacctcatgagacttattcgctatcacgagaacagcatggaaaagattcaattaccccatgattcaactacctcccactgggtccctcccacaacatgtgggaattcaaaatgagatttgggtggggacacagccaaaccatatcatatacacatacacacaatggaatactacttagccatgaaaaagaatgcagtagcaccatagatggaacaggaggccattatctgtaagtgaaataagtcagaatactatttggtttccaagctatgcacaatatactatgttaacaaatacatatattttttaatttttaaaagaacagaggtaaatctgtggtgaggctggggtgagatgtccactgaaggcaaggggggtgggccttgggagctaaataatgtgtacacacggacatagagagtggaaacatagacaatggagactcagaaaggtaggagggtgggaggggatgagagataagaaattacttaatggatacaatgtacactattcgggcgatggttacactaacagcccagacttcatcactaggcacagcttggccaacatggtgaaacccagactctactaaaaatacaaaaacaaattagccagggcgtgagacaggagaatcacttgaacccaggaggcagaggctgcagtgagctgagatcgtgccgttacactccagcctggacgacagatcgagatgacacagcgagactccatctcataaaaaaacaaagagcagactgtggtcctctaaaaatcaggctgtaataccaggcaagcaggcagagagggagggccaagatcaagccaagctgctgaccagggctaggacggcgggctaggaccccagcctacgaccttgcaaaacggtagagcaatccagtaccattcaggcaagggtaagtcccaggaaatccagtccagtgagtcgagcctgaagtgcgggaggattcagggagctctatctgttccccaggtgcacatgctcccggagtggctcttattggggaagcaagaatgaggtaacaagtttcgggatggaagcagaaaagagccacggtcctgggacctaggatgacataagcaaagaagtactctgcagacacttgtacaagttgagcaattagaattacagaggcagctggaagtgatggctcacgcctgtaatcccaacactttgggaggccgcggtggtcggatcaattgaggtcaggagttcaagaccagcccggccaacatggcaaaaccccatctctactaaaaatacaaaaattacccaggcatggtggcatgcacctgtaattccagctactcgggagcctgagacaggagaattgcttgagccagggaggcggaggttgcagtgagccgagaccacaccactgcactctagcctgggcgacagagcgagactccatctcaaaaaaaaaaaaaaaaaaaaaaagaatcacagaggcagcctaacctagcaggttaagagcatggcttttgaagtcatgagtccaaactcactagtccacagctgtgtgactttcagccaggtatttaacttctctggggttaggtgccctcatccataaaaacgttattgaaaagattaaatgaattaacctatgccaagtacttagaaagcagcacttacataaccataagctgtaagtatgctgcctcaatctttatgctcactttcagctgccccctaagacttcacctattcaatttaaacacttgatcttctaggacataatgcacacaccctgaaaaagcactgtctatttgagtccttgagtttcgcatttattgtcttcatctcaaggcagctcacaaagagccgggcaggaaaccgtccctgtcgacactgacatgctgagacaggtgacttgggttgagaaagcaagaaaaaaggatccaacgaaatacaacttattagtcatcacgcgttgagcacatcacggctgggtgataaatgccaagagcatcaattatgaactattcttacaacaagctgaacatattcaccacaacaccaagaaatctataggttacaagtgttctctatgggtttcaacgacaggagacaatattttgggcgaaaatcgtaaacgtaattgttttgcgtgaagtggggcagcctacatcagcgtcccacctggaaacaagctgttgaacatctgtcaaggtgtcaactccaactgcagaagcaaagaatttcattaagcttctgtgtagttaactaaagttggtgaggtgcctggagggaggggacggaaaatcacaggtataattaactgtgacatcgctggagtcacaggtgcctttaacgtgactatacccgcagtctttctggatagctctgtctcctgattctcccttaccaagaacagcacaaagtgtcatctctcttggcatcttcctgccacgtctgtcctcctgagcagacctcctgttctagtggtctgtgactctaaacaaatcaccctgggtcccagcttcctccaccacaaaacacagtggtttagaccagctgtccccaacatttttggcaccaaggaccagtttcgtggaagacagtttttcccatggaccgggggcaggagaggatggtttggggatgattcaagcacattccatttatcgtgcactttatttctattattattagattgtaatatacaatgaaataattctacaactcaccatcatgtagaatcagtgggagccctgagcttatttttctgcaactggatggtcccatccgggggtgctgggagatagtgacagatcatcaggcattagactctcataaggaggttgcaacctagatcccttgcatgcacagttcacaataggcttcctatgagaatctaacactgccgctgatctgacaggaggcggagctcaggtttacggtaatgtaagcaatggggagtggctgtaaatacagaagcagcaccgctcccttccccaccgctcacctccttctgggtagcctggttcctaacaggccatggaccagtcagtacccatccatggccaaggggttggggacttgtttagactagataattcctaagttcctttccatttctccaagcttccaattctgacactataaattctgaccaggagtgaaataaaccaggcacagaaagacaaactttgcatgttcccacctatttgtgggaactaaaaattaaaacaattgaactcatagagatagagagtagaaggatggtttccagaggctgggaagggtagtgggggaatgtgggggatgtggggatggttaatgggtacaaaaaaataggaagaatgaataataccctagtacttgctaggacaacagggtaactatagtcaaaaataatttaattttaaatttaaaaatttaaaatcccttgttcataacacaagggataaacgtttgaggggatggatataccccacttaccctgacatcattattacacactgcatgcctgtatcaaaatatctcatgtaccctataaatatgtacccacaaaaatcaaaaaaatttttaaataaataaatatcctgggtggagtgggaacagaaaaaggacaggggaggggaggggaggggaaggcacgcaaaaaaaccaatttgtaattcaaaccacacagaaaaaaaaaaaaaaaattcctgaccagggacaggagaatatgctaaatcttgaaggataaataagtttcatcctgacaactggttctgagagggaccctgtagagaggactcagagtgtgctgtgagcctttgcagtgagtctgtcttgttctgaggggtgggaaaggcaggaacccagtcctttgttctctaaccctgccctggatgaacccacgctaccaggcatctcatgaaaaggcagtgattctggaagcccttcgtgtgaagctacggatgtcaggaaaatgcttctcttaactagcatcttggtagtcccactgtggtccaccctatagcagtggtggctgcagcttgttggaaatgcctgctccacgggcgattgcctgaggtcaggagtttgagaccagcctggccaacatagtgaaatcccgcctctactaaaaatattttaaaaatcagctgggcatgctggcatgcacctgtaatcccagctactcaggaggccaaggcaggggaatagcttgaacctgggaggcagaggttgcagtgagctgagatcacgccacagcactccagcctggggacagagcgagactccatctcaaaaaaaaaaaaataaaaaataaagagaacaaaaagagaaagaaaaaaagggaaaaaagagttgccttccccaaactcaacgatcataatttgcagtttaggctgagcacggtggctcatgcctgtaatcccggcactttgggaggctgaggtgggtggattgcttgagtccaagattttgagactggcctgggaaacatagcgaaaccccatctgtacaaaaaacacaaaaattagccgggtgctgtggcacacgtctatagtcccagctactcgggaggctgaggcaggaggatcacttaagcccaggaggttgaggctgtgccactgcactccagcctgggtgacagagtgagactctgggttttttgttttgttttgtttttttaaatgcagttcaacaagatcccctggttggcacatcccttggagaaatggtgtccgagtgccctggttcgcaaagttggctgtacagtggaatcaccactgcctcccaggccccaggagactcctgggatgtgattagagcattggaatttttaagcctccccagagaattttaatgtgcagcaaagtttgagaaccactgaattaaaatctctgcttcagattctagcactcaaatccaagttctggagggatttcacctcctccagaaaggtctgtttcctgaaaaagcatcactgataaccatccttttccaagaccacagcagggtcatcccatctctggagttatcatttatgacggggtcactgtcccaatcatacctgcctcttgcatttaccttccctcctaatattattccccaataacctccaaaatctttccctaggagtggaaagctcattttcagctctggctctctctctctttttccctccttttaaatgatgtaatttatttatttatttatttatttatttatttatttatttagagacagagtctccctctgttggccaggctggagctcaatggggtaacttggctcactgcaacctccgcctcccgggttcaagtgattctcctgcctcagcctcccgagtagctgggactacagatgtgtaccaccacacccggctaatttttgtatttttttggtagagacagggtttcaccctgttggccaggctggtcttgaactcgtgacctcaagtgatccacccgcttcagcctcccaaagagctgggattacaggcatgagccactgctctcagtctcaaatttttccctgttgcctactaccctttgagggttccagggagttctgtgctgggtttttggaagctcgacagatgcatttatctctttgggtgtcgagaattagagaatttcagcgtttacttaaagattgctgggtgcactggctcctacctctaatcccagcacttttgagaggccaaggcaggagaattgcttaagggcaggagttcaagaccagcctgggcaacatggtgaaaccccgtctctacaaaaaaattttaaaagtagctgagcttggtggcaaactttggtcccagctactcaggaagctgaggtgggaaaatcatttgagcccaggaagttgaggctgcagtgagccatgattgtgactctgcactctagtctgggtgatagagattctgtctctgaataaataaatgaaaataatgctgtccgggtgcagtggctcatgcctgtaattccagcactttgggaggccaaggtgggtggatcacctgaggtcaagagttcgagaccagcctggccaacatagggaaaccctgtctctactaaaaatgcaaaactgagccgggcgtggtggtgagcaccagtaatcccagctacttgggaggctgaggcacaagaatcgcttgaacccaggaggcagaggttacagtgagccaagatcacaccattgcactccagcctggacaacgagattgaaactctgtctcgaaaataaataaataaaacaagagtgaaactctgtctcaaaaataaataaaataaaaataatgcaggaaccaagtcagttagttgcctaggtaaataacttgaggcttgggtcttggcaggaaaagaaaaccacccatctctgctgagggcagatgatctattggtgacctgctcccaccaagtgactcatgaagggaacggattgatggcaacccacaaaacaggcttgaaaatgcaataacctcgcagagacctctctgccgcttgacatctgggcaaaaaatgtgatttaactgttttttggtgggcttttttagaagacagggtcttgttctgtcacccaggctggaatgcagtggcacaatctcagctcactgcaacctccacctcccgggttcaagcgattctcctgcctcaagccttctgagtggccaggattaccggtgcccgccaccacgcctggctaaattttgtatttttagtagagacgcagtttcaccatgttggccaggctggtctcgaactcctggcctcccgaggtccgcctgcctgggcctcccaaagtgctgggattacaggcgtgagccatcatgcctggccttaatttaactattgaaagtggttttacaaactcagatcctgatcgtccttgcacaaaggttgcttgtcttggataggcacagaaaggatgaaggctttagctagtgggttacatacctctgggtttccaagtactaagccgtgaccctgtgcaacatctctgtgacctggctacatctctgtttcttcatctgtaaaatgggagaaataaagcagatgacacctactaagcactaagctagtttgcctgctgagatggaatatgtgtttatgtgtatgcatataaaatgaatcatcagccacagatcagattaaaaagcagagcaactggttttccgaaccagcagtaggaatgctggaggctgagacgccacatcagtgttcagtacagatgtttgaggttttcttaccaggctataaaaatgtttacacagtaattaggcctgttatcagtacacaaacagattacaatttgcagaatgaatgaacagctcaaaaaccctctcggttttcatgaggttcggagcattttcctaattcttgggtttacaaaaataaattcggtttccaataacaaggagccacagctgagtgtaggggaaagggctctggggtgtgaaatgaactctgtttgacagtgcacatgtcactcagtctctctgactgagtctccccatctgtcaaatgagctaaccaaggttcctcttctcctttaaattccatggttctattactttgcagtcaatgtcttctaaacacatattcattcttttcaccacaaaaggatatgtttagttaatgatttttaaggtagtaattctgctgaatcacatgagactccaatccaacactattcagtcatattgagactgagtttgtggcagttaattcctgacaatgaagcccccaagcccagtctgtaggatgagaccacaaggtcaacttgggctttatgtgaacatccagctcttccagaacacatcaatggttctgagtaacacttgattgaggctgggtgcagtggctcacgcctgtaatcccagcactttgggaggctgaggcgggagaatcacttgaggtcaggagtttgacaccagcctggccagtatggtgaaacccgtctctactaaaaatacgaaaattaggtgtggtgacacgtgcctttagtcccagctactcaggaggctgacgcaggggaatcccttgaatccagcaggcggaggttgcagtgagctgagatcacggcactgcactccagcctgggcaacagagcaagactctgtctcaaaaataaataaataaacgaacacttcattgaacgtttttcttttcctgttttcaaagaataatacttagttgtaacaaatatgacaccaaaataattagccaagctgtcgaatttgcacttctacattttcctattgcctaacttttgataatgaaaaagtgcacgcgatttgtaatcgtgatacaaacttttgggatccaatgatgtttgggaaagcaataatgtttaaatgttcagaaataagcttttaatgaatatttaattgctctattcttcataagtataaattatgctttcagtaacactctgaatactaaaaaggcaaggttcagttcttcctagttatgtgttcaaatttcctaataatttgtttaaaagggggaaaaaaaggtcatcttggtttcaacctctatgagaagaaacttggagagtaatttagaagcaaagtaacttcttacagcaatacctcaaattcaacaaaatttagatgtatgtatttgaaatgcatagaaaaaaatctaacaatatatgtacttgaaatgttaatggtattgagaatgagagtgaagaaaggtgccttccaagttctatgtaacatttctgtatagcttttaatttctttttttaaaaaaaaaatgtttactttcatcgctaaaaaatgtcttaagcacaaaacagagccacttattgggcaccttgtcaaaacatgtaatacagtttggctgtgtccccacccaaatctcaccttgaattgcaataatactcacgtatcaagggtggggccaggtggagataattgaatcatgggggtggtttcccccatactgttctcatggtagtgaataagtctgatgagatttcatggttttacaaatgggagctcccctacacaagctctttcctgccatcatggaagacatcctcttgctcttccttcatcttccgccatgattgtgaggcctcccaggcatgtggtactactgtgagtgcatcaagcctctttcctttataaattacccagtctcaggtatgtctttattagcagtgtgagaacagactaatacgatgagcatcctgtgttttgtcccaaccaggaccatgggtttttgagattaaaactcccaaaataagatggtaggggaaagtgttttgtagatatagtctcccaacattctattcaaggcattggtgatcatcggtgtctacatttatttacttttgttgagacagagtctcgctctgttgcccaggctggagtgcagtggcacaatctcagctcactgcaacctccgcctcctgggttcaagcaattctcctgcctcagcctcccaaggagctgggattacaggcacccaccaccatgcccagctagttttttatatttttagtagagacggggtttcgccaggttggccaggctggtcttgaactcctgacctcagctgatccaaccatctcggcctcccaaagtgctgggattacaggcgtaagccaacgtgcccagcccggtgtctacattttaaaacaaacatttttccgattgtaaatgtgtgttcatttgcaaaaccataaaatcattcataacgccaacagctttggacaagcattgttaacatttttggtccatttatttccattgttcttctgtaccacgtttttaaacaaaactgaaatcatactataattgcagttttgtttgtatccacacttaactggtacgttagaaatcaccaaattaaggtcaccaaagcattttctctccatctgttactgttaaacactacattttattttacactctgatggataaagactcactttattgtaccacagtagtgcaggcagaatggacagctggagacaggatgatctttggaaaatatagactaagtcatatcattcacctgtttaaaacccctcagtggcttctactgaactcagtatcaaacccaaactccacagggtgaccctatatgagctagcccccatctctctgaactcatctcctgccacaccagtctccttccttctcctctaatgaacccagttcattcctgctttgagacttttgcactggctgttcccacaccctggaagttcttccgcagatatttccccactttatcccttcatgtcattctggtatcagcctaaatagagctcatcagtgagacctttcttggttgggcgcggtggctcatgcctgtaatcccagcactttgggaggctgaggcaggtggatcacctgaggtcaggagttcgagaccagcgcggccaacatggtgagaccccgtcactactaaaaatccacaaattagctgggcgtggtgccacgcacctgtaattccagctattcaggagactgaggcaggagaatcgtttgaatcctggaggcagagcttgcagtgagccgagatcgcgccactgcattccagcctgggcaacagagcaagactccgtctcaaaaaataaataaatataaatacataaataaataaaaataaaaatacaaaaattaggtcgggcgcagtggcttatacctgtaatcccagcactttgggaggctgaggcaggcggatcacctgaggtgtcaggagttcaagaccagcctggccaacatggtgaaaccccgtctctactaaaaatacaaaatttatctgggcgtggtggcgggcgcctgtaatcccagctactccggatgctgaggcaggagaatttcttgaacctcagaggtggagggtgcagggagttgagatcatgccactgcactccagcctgggtgacacagtgagactccatctcaaaaaataagaataatgacacaaaaattagctgggtgtggtggtgtacgtctgtaatcccagcttcccggaaggctgaggcagaagaatcacttgaatccagtaagcagaggctgcagggagccaagatcgtgccactgcactccagcctgggcaacagagcaagactgtctccaaaaaaaaaaaaaaaaaaaagagagagagacctttgttggccatccaatctgaagcagtgcttgcatctgtctcaattatatcctccaattttatttccatattttttattgtgtcttacaccactagactataagggtaccatctctgtctgacgaattcatcattttccccagtacctgaaccagagatgctcaatacattctggttggatgaatgaaagcattttcaaagaatccagatttgtggtgcatgagataaagtaacctacttaaataggtcttattcacagcagcacagtcccttaatgaggctttttaaaatagattgtcaccctctccaatagcctggtcatggagagctgcccacagccctgccagtgggaaggcaaaccagttatttagtcttgctcggacttcgattttacttctccaccctgttacctaaaccagaaacccaacagtgacaccttccctttctcccacttccccaccaattaataatcctgccaattttccctcctatggaagacaagctcaacatcactgtcactgtcttttagcagaatccttccagtttcctttcagaaaacaatctctcctggccgggcacggtggctcatacctgtaatcccagcactttgggaggccaaggcaggtagattacctgaagtcaggagttcgagaccagcctggccaatatggtgaaaccccgtctctactaaaaatacaaaaattagccgggcatggtggcgggagcccataatcccagctactcaagaggcgggggcagaagaatcgcttgaacccaggaggcagaagttgcagtgagccgagatcacgccactgcactccagcctgggcaacagagcgagactccatcaaaaaaaagaaagaaaaaaaagaaaaagaaaaaggaggaggaaaacagtctctcccaatcccagtgacttttcagaaacctacccctagatacagggacccaaaactatgccaatcagatatgtcctctgagcatcttgaatgcagcagaatgatacagtaacaataacggaggacaggtgagcccaaaattggggcttagcctgggagggttcttggctttgcccaggaaagaattcaagggcaagccaggggtgtgagacagcaacttttttttctaatagtcacagaatatctatttatttacttattcattttattttttttccaactgttaccttgttttttttccaagttttatcttaagttcagaggtacatgtgcaggatgtgcaggtttgttacacaggtaaatgtgtaccatggtggttttctgcacagaccatcccatcacccaggtattaagcccagaatccattaggtattcttcctgatgctcttcctcctcccaccctccaccctctaacaggccccagtgtgtttgtgcatccccatgggtccatatgttctcatcacttagcttccacttataagtgagaacatgcagtatttgattttcagttcctgcgtttgccaaggataatggcctccagctccatccatgtccctgcaaaggacatgaactcatcattttttatggctgcatagtattccatggtgtatatgtaccacgttttctttatccagtctatcactgatgggcatgtaagatgattccatgtctttgctattgtcaatgggagacagcaactttcattgaagcagcagtgtacagcagcagcagagatactccttgtagagcagggctattccctaggcaatgtgtgcaaggtagcaccccagaagcagtgctgcagtcatatttacacccacttttagttacaggcaaattaaggacagtttatgcagaaatttctagaaatagggtggtaacttctgggtggttgggtcagtgccatggaaaggggtgataacgtctcggtgttgccatggcaacagtaaactgacatggcacatgtgtgggtgtgtcttatggagagctgcttccaccccagccctgttttagctggtcctcaatttggtccagctacttggaccaaattgagccccacctccaaagttgagtcccacctcctacctcaataataatagaaaaggttggtgatcatttacttccatagcatcccctgggagagaccacaagtcaattcctgccactgagatcccctggactgcctaatgcctgagtattccatgcctggttcttcagggatgttcttaatcctgtgagtttccatcagtattcttaatgcgatctttattgacgttgttagccagacttagtttctgttgcttgcaacccaaggatcctaactgacaactctcctgtttgccaaattcatcccatcttctccatcctccccaccatggcctcatcagccttgtccggctttcagagccagcttcctccctggtatccatgtttctggtcttctcagtgccaaatccattcaccacgaagtctccagccacaactgaccatgccatcctaacggagaaatgctgagtccctgggtcctgactaaaggcccccaccatctatcattctggtcacttcttttgtacctccctgtctcaacctttaagcaccaagaactccaaactaccagctgcttcctcatattctccacgtgttctaatttctcagactttcccaccctttcctctgcaccagaatacccatgaaaagctaaccacgtcctaatcatcctttaaactcagctcagacatcacctccacccttgcctagctaccatccatctctgttcacaaatgttcaaccctaacacatggtctggcctccccactaatctgtgaattttttgatgacaggcactgtgtcaacttcatctatctatccataccacataataggcactgaataaatgtttgttgaatgttaaatgattaaaaacttaattcacattgaaaaaccccaggttggatgcaacaatggtgttttccttttcctccttccgaaccacatttggaattatcctcaaattgagcgttctgagaaatctgccaatgttctgctaatcttgaaggatggtttcatagcttaagagtcagaactcacactgttttaacgagcatcagaggctgttgctggttgcactgcttaatggttctcaatcgtgaaaggacatttcagacactctgactacaccagctgaagtcccaagtgaacctataccaacatgggtacagaaagggaatatgcagaaaaaaaaaaaaaaaaagcttaccatcaatcatcaaaccagtctgggctcaaaccagtacaggcacacgtgacaaagaaagggttttgctgtgggattctccttccaccccagaccaactgcacagacacagctcctcctgtgcctcagtttcctcaccaggaatgaggaatgagctgctgacctagattcactcaacgaatatagggcacccactctgtgtctgactctaaacaagttactgcaggtcaaaggttcccaaaatacttttcctaaggaagcaatgtggaaagtgccccgcacataggatcgaaacccagcctgttagcctcaaaccgtaactctgcttctgacctgcaagcttcacagccccaggaaaagtgatttcacttccctttgcatcagtttccaaacacgaagaatgaggatgacatgagctcaaaggtgtgaaagggtctggcacacaagtagggtctcagaaatctgaattaagagggtctccgaaggctttaaacgtccaaagtctatcaattggaatttctctcgtaatgagaaccagtgcccccttctgacaaccagcaaacactgcataggtggtcaatacaagaatgtggtaaaagacaccactgcacacaccacaacagaaggaaggaccagccacagatatcccaccctggctggtgaccctcaagagaccagtttctatgaaaaagaaatttctaaatgcgaccccagccctgcccaatatttatgaacggatcagaagctacccactggagagataaatgtaaaactcaacaatgaacagttgtcatccacccctcaacctgtaccccccctccccttacagaggaaagggcatcatgtgtgtcaatcaagtcttgcccatcgtttctcaacagaagcagctgaattaaattattttcgttctaaaaagcccttatcctgcaccctagccgaaggcctgattactggcaatagttgctttcagagttcagggaaaggtgacatcttggtgaacaattctaagaggatttagctctcctccaataaaatatcgtgaggattggatttccaaagagttttgttttcattactccacttggatacacccagtaaccaacttcaccattgtagaacagcttctcagtaaacagcttcatgcagctattgccatgaaaaacccacacgtctgcagtgaactcaacaaacagagccattccactggtcttccaccagggcaggctactctggaaacacagctcagggcatccttggggctttggtagaagaccccaccaactgccgggggaactagcaaagttatgcagttcctggagccctggaatgaatcctaaactgggcgtggtgacagaaccacaaggccgagaggtctgaggtgacacctggacatgagtacaggtagcagataaaaatcaaaactccacattcttcttccaacacctcctcccaccccacaaaaaatgaaataaaaccacgaacaagccaagaaggagagctggaatggggcttctatgaaaaacacgtcctgttctagcctcaagacaatttcacaccaaatggctttaaattcctttccaaagctctgatgcccgaattgaaaaataatttccctttttgagcaaaagtcatcagttaaagaagcagaacctgaaaatgctaggagctcatgagttctatgtgcacgaatgttgcgtgtgtctcaacacacacagcgcagaaatctacccattctttctgagaaggtcatcccaactctgtcgcagaggctactgtgggtcactctagaatgtagttattatcaccactaaacagacttcccagccacacacagccggcgctaagctgctattccctgagcccaaaaaagtctccttttttgcagaaaaccggctcagggcctggggatggctggcgccccagtcttggcactcagggaactgcaggcaccgcttcacccaggagctacgggcttcgacccaaatggaagaaaggcgccttcctcacacaagcctcgtccaagaaaaaagagcagtgggaaacgatggtgggctggtggcccgggcgcacgtggcccaaggctaagacgcaagccgatcccctcggtgcacgctctgtacccccagcccgtctggatggggcgtcccccgctcgccctcgccccaagggtggcccagaactacctgctgctgcctaggcgccctcggaccaagtctcgggaagttcactccgcgctgcgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggactcggggtgggtggcggcgaggagcgtgcgcccagaaaggcaagcagtcagcgctaggggccggaggtggagagaaccctgcctcccgcctcccccgatcgccatgactccggcttcgcgaagagacctggttgccgccgggcgctcccacctgggctgcggtgcggctccgagtcccctgccctccctccccatcgcccgggcgcctgcgggcgggggcgcgcagcctggtggccactggcgcctgggggctagaagagcggctcccagcctccagcccgcacggtgccgggacagccgagtccgccgcggcccttccctagccccacgtccccaggcaggcggccaggagccagctccacggaaggcaaggtggccggcgcggcccccagcccgcggggtgggtgccccagtgtcggagccaacaggtacgggaggcgctgtctgccaaccatctgcccactctgagcaccagggcccgcgacagcccgggggtttggacaccctagagagaagcgaggaccgagggaagaagaaaagagagcgcgcgcgcgggtaagctagggagccggcggcggcactcacctcttgctgggccggggctccgcagcccggcagccgaggcgcctccgcacagcgcggggggcttcctccgaggcccgcagggagggggcggtgcggaatggatgcgccgagcgggcagcgctcagcctctcgctcacacccccagcaggcagccgcgtccccgtgccggcatcctcgctgccgccggctccctcggcgcccccgggccgctccccacgcgcgcgccgggacctgcacgagccccctcgtcgactcggagcgcgatctgggcgcgtgcctccctgtccttgtcctctgctctcgtctggggacgtgtgccccgcaccccctgcaccgcgcgctcctctacccctcccgctcccgctggccgcgcgggttcagcccatgtgcgcggctgcctcgctgcgccccggagcccagtggccgaggccccgctggagttgcgcgccctagaaactccatgcagctccggcctcctccccagctcctccccagcggatcccccagggccttgccgccg

SEQ ID NO: 1173 - DNA, 632885 bp, Homo sapiens
tcaaaagaaaaaaaaacttttattttttctattgcataaataatggtaaattagactctttttatacagattatatatttacagacaagttcggttaaagaaaacatctggtaaatatggcagttttcctttatacactaagataacatattaataatatatacttcatttgatcggtaagttgcatgctaagttaatttatattaatatgtacattttatataaagattcttttttgactagtctgctgactttctcatcacttaatagcagaaatcatcaactaatactgaatgagagaaaatgggatgctaatgaggtaaatgggaagatggtgattgatgagttccgtcttagtggcttattctggatatgagagctgccaagctccaatcgtcctggccatgatcaatccccagctgtgcttctatttacacccaacatattgggggcaatatacaaaatacagtcatttactactgtgctttgagagacaactcacgtcccaagtctaatgaccgctacgatcacagcgacccctcctccccatccaacagttgacagttcaccaacccaatgcctggacagactttctgagtctaatttttctccaaagtcattgtttttggttggtccttggagaaaaagcttcttcctggattcagaactggggaagaaaatcagaccccaataaggacccctgaaagctgattttgagctaagaaagagaaaatatgctttaattttccttggagagagttgagagccactggcttgtgcaactctccaccaggagctgacaggatcctttcttggccaatctaggtctttcccagggagaacaacagggcttgttagaaaaacaattactgggacgtcagtctactttaggaagagggaaaaagaacaagaatctagggttttatgttgcctggggcagaagggttagagacttgtggatcctgcagctgctctcttcctgccctctctccctggtcatgggtgggccacatcaaaagcaggcaccgctcagcactcagcatccctcattagccatttaaagggctgtcgcaggtagccggtcccccgcgactgttaatctaattcctcacaatcaccaaagatcacgactctcttctttctggggtattaggaataattacaagctactatcaacatatactggaagtgctgttatagtggccagaaaaaaaaaaaagcaaagaaagaaataactggaaattgtgctctttattcagtagctttcagtaaggctttctcaaatggagaaacaagcatctcttcttggaatctgccattgtttcctccaactttctcctgaattctgattcacatgacctttggggaggtgactgactccctttattttcacacttgccaagacagacagaaagctcatctttgatgctccctcgagtcagcaagtccttagagaataaacaaaacctcttgcctgcaagctgtgacacatttaacatacaccaatttgcattgtttcatttacagacagcggacaccaaaagagagactttatcacaactgcctcttgggacttgtgttcaaaaaggagctcccagttcctagtgcaattcatgggtgaaatccagaccctctcagtagggagcattcactccatcttgtttcagacaaaatagatgggagggcttgtctggtttacttttcctctggctttagagaaacctgaagccagggaggaatgtcactcaacataacctagatagtgggtggaagagtcctggctcctgggctttctccagctggtagtaccgtccacactttgagttctttcttctgctctcctggcctcagtttaacaggtctgagagccctgagagaggcattctgggcttgacagatgtcagcatcctcccaggaatggcgagctaccagcctgctcttgaaatgcacagagcctttcgtgtggatcagactgatgggcagccccatggcactcaatggcctgcatgtttccaaagtaggccagcgatccagagaagaccttcagaggacagcatctgcagccctttaagaactttctttgtctccctcaggtccagggatggagcaatatcgcagttgcaccttgcattccctggaatattccttcctaattagcctgctcttctatcccactggaaaattccagcctctgcatcctttccacttggacaataacttctaacagtgcgagaaacactagtttgaaagccaacccatcacacctgaggaaaagagatgggtgagtctatgcccggcatgggggttgtgctcaactgatgaactaccccaaggtcagggtaggggcaggtggccgggcaagcttttccactttcagaggactgtcttgtgggtgggactggaaaaacctcattctttgtgatatatttccagtcaacggaataaaattaattttgccttggagacgttttgaacagtattgtcatgtctctcgagaccctatgaagagtcccaaatgaatatgaaggagaaaccacagctgtcaaaatgaccatatgcattagcaatgaccataggatactaagagaaatgcttggcttgttggtgtaattgatctcattgctccaaaccaatcatagaggctggatatttgttccccccaaatttcatgttgatctccagtgctggaggtggggcctgctgggagatatttgggtcatagggacagattcctcatgaatgactcggtgccctccctgtagtaatgagtgaattcttactttattagttcatgcaattgcgggttgttaagaaaaggagactggcacctcttctcctctctcttgctcctgttcttgctgtgtgacgtgcctgctcccccttcaccttccaccatgggtcaaagctttctgaggtctcaccagaagccaagcagatgttgataccttgctcaaacagcctgcagaactgcgagccaaataaacctcttttctttataaattacccagtgttaaggtattcctttatagcaatgcaaaacggactaacatacacctatttatggcagggccaaaaaattgaggacaatcccgagtgacttagtcaaagcaagtatgaagtgaagctgaacagttgtgacactcaaattatcatggagactgggtcggtaagaggcagcccaaattctcctctatgttgctgtcactttaaataatttaaattgaaaagtcttagctggtgaataatgtttcttttttaaaattattttttgagatgaagttttgctctgttgcccaggctggagtgcagtggcgcgatctcagctcactgcagcctccgcctccagggttcaagtgattctccctcctcagcctccagagtagctaggattacaggtgcccgacaccatgcttggctaatttttgtattttttttttttagtagagatggggtttcaccacgttggccaggctggtcttgaactcctgatcttaagtgatccacctgccttggcctcccaaagtgctgggattataggtgtgagccaccgcacctggtccttaatgcttcttttctatttcagatagattctccccttctggggcagttgagcaatcaggtgtggagggaagatggctatggtaaggcctttaggttacggactcttagctccatggggatcactgaagaggccaatgagaatgttctgatttgaggtcttttaagacagatgttcttcaggggttgcagctctgcagacctcctggttatacaaccaggatgtgtgacgtgctgaagtctaaaagtttcatctcagttcatctgtaccatcacggtgatataggaaaaggggcccttcctagcaggggaattccagaccccccctgttatcttggtgaaatggtaaaaaatgtaatgactatgggcctttggagaaatagtgtggcaaaatgacccaatagggtttgagacctgcagttaggaggagcagagcttagcagcttctgcaaggaaggagagcaaggacacagtaaacacagatcccaggacatgtgaccacacgtggccaggccagcccaaaccagggagctgtcctgggtggttgcatccttcattttctgtccatgccctcatagggcctcagggaaactgctagatttaggtgaagagcaacgtgcaaaactgtctttgatttatgacctgagtctggacttaaaccgagtacgaggcatttggaataaaaggtaaacttttctctctcagttctgaaacatatcgctttatgattctatgaatgggaagttgggaggggcattattgtcaaaagcagctgtccatttttcataggctcttttggataactgcaagatcgtagaccatttgtcaagtgagatttgagacagggcaggtattgagaaagaagactcataagacacatcttgttctctgcaaataaaacacccagacatttctgaaaccactgggtttgcctaagaccacacctaaacctcagttcaccaaagttcacgtgtttggcttgcaggagtgtgctcaacaggcaaaccgatacttttaaagattggaggcttaatatcttgtttgccttccaagatgatatttctgtcaatttacctagattaaggggtcctggctctggaccctgggagaaggggctgggagtagggatggggagataccagggcttacaggtagctcctgctctcctgagtaaatagaaggacaagttcaaatgccagacaaaaaggcagagataccacccagattctttaagggtaattgcctctcccagcaggatacagatgcagagagtcaggttgcactcaggctgaattggagtgttctttaagaaaatgttccctatttttgtgtgccttggcaaactcagggtggaatgcaagggttgccatggtaatatccctcttttttttttgtcagatcagtcacgtgggacccaagcacattctggaagccattgctaatagtcccgatgctagattctgtctgggggctttgtgggtatctggaaaggtggggcgcagcttctttggggatcaagggggtcagggtccatttccccttctctcccaaggaaaatgccttcttgctcatcacttgtgctttccaggggggcggcggggggtacctgctcttgcagcaagaatgagccaacctgtgtttgtcaatcactcagcctccacacagttgggcagccaaggtcactggttcctaagtccggaggacagaatgaggggtgagctattccctctcaattcctgcggaagtcacttccagctggggctacatggcatcccttgggcatgggagaccaggaccttctggaatcttcagccgtgagcttcatagccaccatgatggggacactgactggcatggggccctagcataaaatttgtgtgaacagggctgggagttggctgcctgacaaggaaggcttccctatacccaagacaaactgtccaagcaaagcagccagggtgcaagtcaccgggacaaactctgagctcctgaagtctaaggaatgccgctagctcagggccgtctccacgcactgtgtccttcagtccctgggtgccacatggggggttaccacagtgggaagataactcctaggctgtcagaaagaattctgtgtcttccttcttgccatctctctctagcagtctgcagaggaatgcattctcctagattttcccctggggagggtgggcttgcttccaggtcactgggagcaagaagaaggtcaccgttaggaaaggaatcctgcagcctttccagaaaacaggatggcggcgcctctccagaactccttttcctccctactcctgcacagtggctaatctctctgccaatgaaatctaaccctcacctcttgaagggtctctgttctccagcaggaggcagaagaactcgcagaaaagccaccttcaaagaagtactcattttctgccctgaagaccagcctcagctgcagcatttcagtcccctctcatggaggagggggctttgaagaatcatccctggggtttctacccagtctacttagggtcctgcacccctatggatgtggttgggtggttcgggggtcagggaaaaacaggaaagtatatcccttcaagatctgctatgccctcccatctaagtccagatgggagagggcaaactgcccagggcagagattaaggatgaagttgttcgatgtattaatattctgcatttggaccggttctagttgagaattccaatcctaaggggacagtggtgagtcagccaacaggagcagcagaaggggcaggcatgcagtgtgcaggcagcagggcaggtaagggggaaaggcaggttgctgcctccttggtctggccttgctgggctgaactccaggaagttttgcagagggacctgtgatcccccaggctcttgggagcttacatctgctccctcctccatattatggctgaagccttagttttacttgtgctcatcaggaatattcatagtctcccacagagggaaagtttctacagctgccctcaggctgttgccagtagcacttgcagaggtgaatgagaaaactttcattggagaccttgggtgctccaagtctgaaaaggcagtagggagaaagctgagcaggaagacagggagggagatcaggaacacacaacgcaccaaaaaatcctacccactgcatagagacaagaaagcttctggtggctcgctactggaaggggggaagcatgtagttttaggatgtaatcaaaagaagtaggagcaaggtaattccattacaaaataaagacctgagcttggaaaagtacaaagggaactattacatctagagattactggctaatctgactacacaagcttgaattcatagtagtggctgacatctaggaaaagtcaggaaattacagacttggaatggtgttgaaaacagatccttggattcagttctcttccccaacgaaaagtattctgcaggcaggagtaaattacctgttctgttggctaaactcataaacatcttttcccccaacctcctgaaaatgagtcagttgcagaatctgaaggccagaagatcttatgtgaaaatacagtcgtttgatctctccatctttccattttggattgcatttctctttttagctggggaagactaacaaagcaaactccaaggtaagggaaaggtaagatgcacaaggaccttaacttacaaaggtcatccggcatagagacgtggtgggtctccatgactccagatggctgggtgtgggtatcaaaacctcaccgccagtcccagtcccctcccccctcaacctgcctcacccctgccccaaagaagcagggatgagtgtgggagggaggacaagcttatattaggtgtaagcgattagggaagaatgacatcacacacgaagaagccaaatatatatatctgtctatgttatagagatgcccacgattatgcttctttttttctctaatggcagcacaggcggcaaagctgggagaaaggctctctgcaggttccaaaatgctggtgcgggatgggctctaggaacagaaagccaagtgccgacggaaactgagagcaccccagctctaccaatggcagtcctctagaaaaggcagtaagaacggaagcggtgaggggtgcagctgaagaccgccagggctgcaccccacttaatggctttcccctcatgccttgggggggtctccactgggtggaggaaggaagccagggtgggatggaaagccccctcttctgtggcaaccctgaagtcagcctcttggaactgagggttgacctcagcagagagtctcctgttgacccttgggttgaaagaatggggagtggaggtgactgtgtgttcatgcctctctcttgctctctcaccattatacctggatggctgctggaattccgagatgaagatgaagtttttctctagagttatgactgatggttgaagcaataatttggaaatcctggcgatttattgcattagaaaacaaaaccattaaagcactgaagacagccctttagtgtccctgccaaggagatgaagctgaagtgcaaccccagttgcactcaaccttgggttctttactgaacggttccatcgtccgcatccatccatagtccataggtccgtgtctgctgtgtggaggaagagtctgcccgcacggcatgcacatgcgcggtgagctgcaacacagtgtggctggcgggaggctgctactccatgccgctccggagtatctggttggctgcaatcagcatgacactgatgatgaaggccatagcaaaggcgcatatgaggctcttccggacgcaggtctgtctgttctgcttctgggaatgcactggtggtgggagaagcaggtgtgggaagaaggaagaggggttgggagaagagagaagagagaaataacacagtgagataggttgcaactcttcctcaacaggccagcagtgagtcctataggatgagactggtcaaatcaagttgacaggcatttatgggaccactgccatggagactgcataatacaaaatgccttctggtgaaaggtatgaaatgagaaaacttctataacaagaatcatgatggatgtgatgatcagagtaaggcctaaattttctgatagaatagagccagagtgactttcagagcccggaaatatgggacattccagggtgagtttcataaaagacatcatccagtgactgctgtatccatttctgcagctgatacaaacagagtggaagttcagatgcttccctacacctctgtgatcagctgggtgcaacttacctttcctggacgttttcttgggttttgctaatcaccataagtgacttcttgcattatttcagacatacacatagtggttctacagtggggtcgttggacaagcagcatccccattactaagaggtttttttttgttgtttttttttttttttttagagaaagtgtcttgctctgtctcccaggctggagtgcagtggtactactgtagctcactgcagccttcttaacctcctgggctcaagctgtcctcccacttcagcctcctgagtagctggaactacaagtgtgtgccaccgtgcctaattattattattttttttgatactggagtctctctctgtcacccaggctggagtgcagtggcatgatcttggctcactacaagctccacctcccaggttcatgccattctcctgtctcagcctcctgagtagctgggactataggcgcccgccaccatgcccggctaattttttgtattttttagtagagatggggtttcaccacgttagccaggatgatctcgatctcctgaccttgtgatctacccgccttggcctcccaaagtgctgggattacaggcgtgagccactgcgcctggccgactaatttttttaattttcatttttgtagagatggggtcttgctatgttgcccagtataatctcaaactcctgagctcaagccaccctcctgcctctgcctcccaaagtgttgggattacaggcatgagccaccatgcttggccactgggaggtttttgaaaatgcagattcttggccaggtttggtggctctcatgcctgtaatcccagcattttgggaggctggggtgggcagatcacctgaggtcaggagtttgagaccagcctggccgacatggtgaaaccccatctctactaaaaatacaaaaattagctgggtatggtggcacatgcctgtaatctcagctacttgggaggctgaggtaggagaatcgcttgaacccgggaggcagaggttgcagtgagctgagatcaggctactgtgcttcagcctgggagacagagcgagactctgtctcaaaaaaacatgcagattcttgtccagcccccaccccagatttgctgcatcagaggctctgggagtgggggtccccatctgtgtttaacaagccctccgtgagatcttggatgctgctgaagttggggaagtggggattgcttgctctgggcagcaccaatgtgaagataggggggcaccaaactctcttagacatgccagaggcagggtgtcctgcctccagataccacggccccacagggtttactttgggtctaggggtttcgttctcttaatctttctgttgtgccaggtcttgcactttcatttttataacgcccatgagaaaccatgtataggtctcaatcaaaaggcatgaattagcggatattaatatgggccagaaacagataaatggaaataacaagaaaaagcattagcctgtaattgcagcactttgggaggtcaaggcaggaggattgcttgaagccaggagtttgagaccagcctgggtaacatagaaagaccctgtccctacaaaaaataataaaaaaaaaatttagctgggtgtcgttggtgcatgcctatagtcccagctagttgggaggctgaggcagaaggatcgcttgagcccaagagctcagggctgtggtgagctgtggtcacaccactgtattccagcctgagccacagaggagtgagaccctgcaggagagagagagagagagaagaaagaagaaagaagaaagaaagaagaaagagaaagaaaaagaaaaagaaagaatcaaagaaagagaaagagagaaacaaagaaagaaagaaaggcaggcgaaagaaagaatgaaagaaaggaaggaagaagaaagaaagcaagaaagcaagcaagaaagaaacgaaggaaggaaggagaaagaaagaagaaagaaagaaagaaggaaagaaagaaagaaagaaaagaaagaaagaaagaaagaaaagaaagaaagaaagaaagaaagaaagaaagaaagaaagaaagaaagaaagaaagaagcaagcaagcaagtgggctttgatgaagtgcatcaaggatcccaggcattgcattacctaaggggaaactgagtggatgtcagaatgtcttttccatctcctcctccttttcctctacactttctcccttgctgtctgtcctgcagttgtgcacggttccccagatagcttagaggagacatctgtgcccttgaggtcggcaggaagccacctactccagagcaactggctgaaacagcagcaccagcgccagctgagagtttgatacaaatgagattctcagccctattgcagaattactgaatcagacctctggggtggaggttgggaatttgtgttttaataagctctccaggcaattaagcaattgctagacatccactcgggagtttctgattcagtaggcccggagtaggatggagctgccggggacaggaggggtgtgtgtgtgtgttgttggggacatgaaatcaggggtgttgaagaagatggctctttacattcagctgttaaagaagactgcgtagcaaaagaaaaaggtcaaggttgtgttcacatgcctttagagaatataaaaatcactcaagctcaactacctctctcccttgatgtgaagtggctcatccaaactcctggtattaataccaggtaagaagtaggaagctggccatatttccaaaggcaaacagaattttctccaagagaaagggtcccaagggcttgtcaaaggatctctaaaaatggcattgatcttttttatggctgtgtagtattccatggtgtttatgtaccacatttcctttatccaatctaccattgatggccatttaggttgattccatgcatgtgtctttatggtaaagcaatttatgttcctttagatatatacccaataatgggattgctggatcgaatggtagttctgtttctagctcttcgaggaatcgccacactgctttctacatcctttacaggaacattaatggtgctggaggccatgatccttggcaaactaacacaggaagagaaaatcaaataccgcatgttctcacttacaagtgggagctgaatgatcagaacacatggatgcaaagaagggaaccacagacactggggcccacttgaggatggagggtaggaggagggagacgagcagaaaaaaatcactattgggttctaggcttagtgcctgggtggtgaaataatctgtacaacaaacgcctgtgacacgagtttacctacagaacaaacctgcacatgtatccctgaacctaaactaaaagttaaaaaaatggcattgaggccgggcacggtggctcacgcctgtaatctcagcactttgggaggccgaggcgggcggatcacaaggtcaggagatcgagaccatcctggctaacacggtgaaaccctgtctctactaaaacatagaaaaaaattagccgggcgtgttggcgggcgcctgcagtcccagctactggggaggctgaggcaggagaatggtgtgaacccgggaggcagagcttgcagtgagccgagatcgcgccactgcactccagtctgggaggcagcgagactccgtctcaaaaaaagaaaaaaaaaatggcattgagcaggaaggtttctccagaaagccaggcttcaagaaaatgcacttcaaatgctgggtgtggtggacagagctgcgacctggcactaattcatgcgtttcctgataattattgaagattatcatgcatttgcattgtactatatttttgtatatttatttactcttgcctcttgctgtctattatttagaagtctgtaatagaagactataggtcagcctgggataaactgtaagtctaagatctgacttacagtgaccccagtgagccagccgcaacccccagccccctcaccagtatgatacttgtgaattatttcgccatggtctcttaggtctcatctcattatctttattccttctgaatccactgatttctgcttccctggggcgatttaaagtatatgtggctcagctttcttcttgccgattgaagcttccaccttttggctactacaaataatgctgtttaggtgtgggtctcagaatcttacaagttcttacctggaggaagacaatatccttggggtagagatgggctttatcccatcagtaggcaaatgtacaaagataccaagtcccaggaaggaaaaaggaggtggcatttaagaaggaaagggccaaagaagaaaataagacgagaatgtggaagtagcatatcctaacactttctggctaatttattctgagtagcttcttctcctggaaatgtttccgaaggcagcccttttccattccatcttgagggcctgcgaaagcattaggaagagaaacattgcatgactgggctgagggagaaagtttttgctgaagctcttcttcgtgaaggtcaaccaggaaacaaggttaccagcaacagggattatcccccaggagagcggggctgcaagtttgatctaaaaatccatccaagcagtaggaagggagagataaggactgagcaatcgcctggagaattcacaccaatgtcctataagcagagaggagcagagccgggtgcggtggctcacgcctgtaatcccagcactttgggaggctgaggtgggtggatcacctgaggtcaggagttcgagaccagcttggccaacatagtgaaactccgtctctactaaaaacacaaaaaatttgctgggcatggtggcgggcgcctgtaataccagctactagggaggctgaggcaggagaattgcttgaacccaagaggcagaggttgtagtgagccgaaactgcgccattgcactgcagcctgggcaacaagagcgaaactccatctcaaaacaaaacaaaaaaaaagcacagaggagcttctagatcattagtggattgtagcagctctgaaatagaccttagtctgagtcagtaccctgtgctttgaagagaatcattttacaccacattctgacatcatcacgaatagtgtggctaagcaaagaggaatgactttggagccagaccaaaatgtggatcatgattctctgtgtgactttgagcaagcaaatttccctaggcctcaattttctcatctataaaatgggataataagatctatctttgttgggctgggtgtggtggctcacacccgtaatcccagcactttgggaggttgaggtgggtggatcgcctgaggttaggagtttgagaccagcctggccaacatggcaaaaccccatctctactaaaaatacacagaaaaattaactgagcacggtgttgtgtgcctgtaatccccgctactcgggaggctgatgcaggaggatcacttgaacccaggaggcagaggttgatcatgccactgcactcaagcctgggtgacagagcaagactgtctaaaaaaaccaaaaaaaacaaaaagaaacacatacaaaaaagatctatcttcttgtggagattatgcatataggaaggaactggaaaattgtttgtgcccaatgaatgcgagctcccttgtataaaccttttaaatgctcctatttctttattgaacaccagcctcagcgggttgggtactgcgttaagtgctttttttttatgtgcagaggttgcatagtggcagataccatgtgtgatgggtgtgttgtcttcatttattgcgtgaggagcctgaattccaataagtgaagttcaaggtcatttgggaaatggcagaggtgggatttgagctgagggcttactgttacgcccaggttcaaaacttgtgtacaaattctttttggtctcctgcatagcaataaacaggtccaaagaaaatgcacttcaaacaccgagtgtggtggacagaactgcgacctggcactaatttatgcatttcttggtaattattgaaggttatcatacatttgcattgtactatatttttgcatatttatttactcttgctgtctattatttagaagtctataatagaagactataggtcagtctgggaaaaactgtgagtccaagatctgacttcttctcctaattgccacttagaagccccggacaaatgaaggaacttctgcgagcgtcagtttctctctctgtaaaaggagctaataattgctctgctcatctcaagaattatttcaaagatcaatgagctaatcaaagtgaaagctacatccaactgtaaattgccagagaaatacaaaatttcattcttgcatcccctgaggacaggaggaaacccctgctggtttttcatcctattccctgcagcctacagcacgaggctgagactaactcagatgctcccaaatctttgttttcatctcttccttcatcaagtcattcagaactgcagctagactcacctttcccttcctgcaaaggcccccgctgatgggagaagcctgttccagcccctaagctcagcacataagaccatagctcactcttccccgcttcctggctctgttccagccttggccacttctgttccagccaagcaggtctcctcattttcttcagtgtagatcagtggtgccttctgatcttgcctattttttttcttttctttttttcttttttgagatggagtctcactctgttgccaggctggagtgcagtggcacgatattggctcgctgcaacctccaactccctagcaattctcctgcctcagcctcccgagtagcggagaggggattacaggcatacaccatcacactcaggtaatttttgtatttttagtagagacggggtttcatcatgttggccaagacggtctcgatctctcgaccttgtgatccatccgcctcggcctcccaaagtgctgggattatagacatgagccactgtgcgtgcccggccatcttccctctttttctctggggcccagcccaaacttttctttcctctgaggtttcttctgaacaccctgctctataaaagggcctgctccttgtgtttatttgttgtaatgatctagctttcaatatttatttatttttaattaagatatagttcacataccataaaattggcccttgttctaaaattatgtccaattcagcagcgtttaacacattcgcgagattgcgcaaccatcaccactacctaattccagagccattttttcaccctaaaaagaaatcccaggcacattaacagtcgctgctcattccgctcgctctgcagccccaggcaaacactaatctaccgtctgtctctaaggatttgcctgctctgaatctttcaaataaatacgatcatacagtaggtgacctttcgtgtctggcttcttttagcataatttttcaaggttcctccagctgtatgtagcatttaccagtacttcattcttttttttttttttttttttttgagacagagtcttgctctgtcacccaggctggagtgcagcggcaccatctcggctcactgcaagctccgcctcccgggttcacgtcattctcctgcctcagcctcccgagtagctgggactacaggcacccgccaccacacccggctaattttttgcattttttttttttagcagagatgagatttcactgtgttagccagggtggtctcaatctcctgacctcgtgatccacccgccttggcctcccaaagtgctgggattacaggcatgagccactgtgcccggccatttcattcctttttatgaccggataatattttattgtatgaatatgtcatactttgtttatccattcgtaagctataaacgtttgggttccttccaccttttgggtactatatgagtcatgccgctatgaacatccatgcacatgtttacatgtcaatatatgtcttaaattctcttgggtgcaaacctagaagttgaattactgggttatatagtaactctatgtttctttctttttttttttttttttttgagacggagtctcacactgtcgcccgggctggtgtgcagtggcatgttcttggctcactgcaacctccgcctcccaaattcaagtgattctcctgcctcagcctcccgagtagctaagattacaggctcccgccaccacgcccggctaattttttgtatttttagtagagatgggttccactacgttggccaggctgatctcgaactactgacctcatgatccacctgcctcggcctcccaaagtgctgagattacaggcgtgagccaccgcgtccagcttatgtttcgttttttcaaggaactgaccttttggggtcttactgaatatgtcatgctgctggtgatcttttctatcttcccactaaaccttgggctctttttcagcacagtccttggcacagtggaagctcagaaagtatttgggaatgaaacgtgagttgaggaggctgccgcgggaggacacagaggcagagtttcctgttttcctgcaagcttgttcacaggctccatgcatgacagactggtggctgcctcagtgagacctgggtgtgcaagctctagcgacagactgtttgactgtttctttccctctcttattttaacagccattcacactgctccactcagcaaatgacaggcagtggttcttggcttttctcctggagagagtcatctgcagagactctgccactcattagcccatggccctggagacaacaggttcataatccctctgccttcaatctccacatttgggagctgggctgcatgttttcagagacaccggcttccaaatgaggcaaatcagagccacgaaaattctgattccttgctccgcgacagaccaaaagaagtcatattatttctggcagggagctgggggtgcagggatgttaaaaaataaaacagtagcagtctcaactcaggtgattcttaggataaccagagccaccaggtctgggagctatttttgctctttgatccttccagttctgatattttatgattctatgaaattggctatttatgcaccctaaaatggaactaattaagagcttttcaaagagaattttgtatacaccaatgatatcagaaatgcccaggtacccaaaactcaaaggaagagctggaggatgtggcttctatggaataagagtgagactggtatgtttcatgatgcttttgttaagaggaagataagtcatgctgacttgtggggctgggagctggtcccttctcctctacaaaatctcatgccctgcatctcaggtttgctagaccccagacagctgtgttttgctttgagggtcctacaatgaactctggtgcagtagccaggcattgtttttgtctctctggaagccctaccccttgttctaataacaaaattcatcttttgtggttgggaccttcaccaccactccatctggtggaacttagtccctgacttcaccttttccaccatcgcaaaccaggttgaccaggtgtcatacccaaagattgttctgcagtaggcacctgagttaatcaggtttgattggagctcctttttggatgaagacagatactgagagagaaaatcttgataccttgtgaagagagagtctgcccaggaatggagctaacagggagttaaaaaggacagagagagggagaggcagagagcaggcaagagagagagacagagagagagagagagacagagagagacagagagagagacagagagagacagagacagagacagagagagagagagagagagagagagagagagagagagagagagagagagagatgttgcttgagctctttgagtccaggccacccaaagttcatgcacttgacttcccccattatttgagccagtgcttttttggtttaaaagaatcttggttggctttcttttatttgcaacccaaactatattttatttatttatttatttatttatagaaactgggtttcactctgtcttctgggggcagagcagtggtatgatcatagctcactacagcctcaatctcttaggctcgagcaatccccctgtctcagtctcctgtgtagctgggactgcaccatgcttggctaattttttaaaaaactttttgtaaaataggtctcactatgctgcccaggctggtctcgaactcctgggctcaagtgatcctcccacctttgcctcccaaagtgtttggattacaggtgtgagccaccacgcctggctggtaagagtctttttttttttttttttttcttctcagatggagttttgctctgtcacccaggcttgagtgcagtggtgtgatctcggctcactgcaacctctgcctccggggttcaagcaattctcctgcctcagccccccaagtagctgggattacaggcatgcaccaccatgaccgactagcttttttttgtatttttagtagagatggggtttcaccatgttggccaggctggtctccaactcctgacctcgtgatccacctgccttggcctcccaaagtgttgggattacaggcatgagccaccacgcccagctgagagtcttgatgaatatccttgatacccccaatgtgggcagtgatttgactccgggtatgaatgtgtcaacagcaaggctcccaccccctgcatttggttcctgctccatgaagacatggagctccagcagcagcacatgttcagcaatgtctccaggtaaaaaaaataactagaagaagataactggggctagggactggttagccttgcctttcattcattcacttccagtgcttactaatatgttgagttttgtactgaatattgtcatggatgatgttgtttaatcctcaaaacaactgcatgaggaagattgtatcatgattcccctttcacagatggagaaaaggagactctcaatatttacccaagtgcctcactcaagtgagggcatgctggggaaggattttaagccaggctcgtcctgggtgcagagctggagctcttaaccagctctgtttcagtgttatttacacaaaacagctctctgggtctttttatttatttatttatttatttatttatttagttagttagttagttagttagttagtttttgagacagagtctcactctgttgcccaggctggagtgcaatggtgcgatctcagttcactgcaacctccacctcctggattcaagcgattctcctgcctcagcctccctagtagctgcgattacaggtgcccgccaccatacccagctaatttttatttctttttgtatttttagtagagatggggtttcaccatgttggtcaggctggtctcgaactcctgacctcaagtgatccaccggcctcaacctcccaaagtgctgggactacaggcatgagccgccgcgcccagctgggtctctattttctgtttcagaatctcattgcttcctacaggtgtgctgtgaagggtccccaaacagaagaaaaattcctttttgtctgaagtcccaaatctctttgaaaactgtcctctgtctcaccactggctactgacctcagctccttaacctcctatgtctacccaaggagaaaggttttatttcaggaaagtcacagcacaggagaactgcgaacagatggtgttgatgacatattgtgccctttttatttagatgggcatgagagaaccattgtgcatggccaggtgatggggcaggtctctccatccaggtgtgaacctgacagcccgacaggaacgctgtgacttcagcggggaggactgagctgggaaccttggatttggctgcagaattccttctgaccttccagtgagcccagaagtttctgtatttaaatatgaccatcatcatccagccttttcatgggatggatgaggaaaataaggctcagagaagttaaccaacattcccagggtcacacagctagttggcacagaatccacacctcttccccagggggcttcctggggctgcctggcctgtgtcaccatccttggcacttgtttcttttgtccctcatatggaagcgctgagtgattcagagcagctctgtcttgtctttcacagaaactatttattccccagttggtgatttcgctttacttgcctctcccgtgccggttgtcagaatgtctagaaaaatctgacagctggtattccatttagggacaacacttgggggatgtgtcttaagagggcgcacacacagatcttgctgtgcttctactcgacttccaaatataatatgctttcgtcggcaatgaaatggaaaatgagcacgggtgatgaagcaccgtttcgtatgaagactttgaaatgccaaagcccaggtaaatgacccagggtgaccaatgaagaggccagggctgggcattgacaggtagacccaggttaaaattattttcttttgttttgactcagcaattaaaaaaaaaattattttaagttccatgatacatgtgcagaatgtgcaggtttgttaaataggtaaacgtgcgccatggtggtttgctgcacctatcaacccattaggtaggtattcagccccgcatgcattagctatttatcctgatgctctccctcccattgccccctgacaggccccggtgtgtgatgttcccctccctgtgtccatgtgttctcattattcaactcccacttatgagtgagaacatgcggtgtttggtttcctgttcctgtgttagtttgctgaggataatggcttccagcttcatccatgcccctgcaaaagacatgatctcattcctttttatggctgcatagtattccatggtgtatatgtaccacattttcttcatccagttaaaattctttttataaaaacattgagacagggtttcgttctgtcacccaggctggagtgaagtggtgcgactgtggcttactgcagcctcaacctcccaggctcaagtgatcctcccacctgagcctcctgagtagctgggactacaggtgcctgccaccatgcctggttatgtatgtatgtatgtatgtatgtatgtatgtatgtatgtatgtatgtatgtatctatctatctatctatctatctatctatctatctatctatcgagacagggttttgccatgttgcccaggttgcaggttaaaattcttagccactatttgacttgggaaaaatgacttcactttgtggagcctcagtttcctcatctacatgaaaatggtaacagaacttgtctctcagggccatgcagaggggtcaatgcaatgtgttcatattaggttggtgcaaaagtaattgcagtttttgctgttaaaacacttgccattgctgggcacagtggctcatgcctgtaatcccagcactttgggaggctgaggtgggtggatcacctgaggtcaggagttcgagaccagcctggccaacatggtgaaaccccgtctctactaaaaatacaaaaaattagctgggcgtggtggtgcatgcctgtaatcccagctactcaggagactgaggcatgagaattgcttgaacccaggaggtggaggttgcagggagttgagatcatatcacttcactccagcccgggcaacagagcaagactgtgtccaaaaaaaaaaagaaaaaattgccattccctttaatggcaaaacccgcaattacttgtgcaccaacctaataaatgaccagcacttggcaggcatgcgtgacagttctcttccaccctcttccttctggactgcatccatatggattaaacagtaaacatcctggaagcaagcaccatcaaccttaatagatagtataatgtgtcatgggagcacttaataagaatctggtgaccggcaaatagatgattcaaccacaaagaccactgaattccatagatgccagcaactggaaccaaataataagatatacattcgtctcagtgtcattgagcttatgatctctaaaaccaagaatgtctggtgcctaaaatgggtggaactgaggcaaaacatccttaaaaactcccttattcagtatgaatggtgaatgggtactttcagtagacacatacttaaatgtccaacctgttatggggatatgggcttggtaagttttttattcagagttggggtcttgctctgttgcccaggctgaagtgcactggtgcaatcatagctcactgcagcctcgaacccctgggctcaagtgatccctccacctcagcctcccgaatagctgagactacaggcatgcgccaccatgcctggctaattaaaaaatttttctttttgtaaggaagaggtcttgctatgttgccaggctatggtaatttttccaaaaaattaggacgcaaagattgacaagtaacacaaaagtatatcaagctgggtacgggggctcacgcctgtaatcccagcactttgggaggccgaggatggggaatcacttgaggtcaggagttggagaccagcctggccaacatggtgaaaccttgtctgtactaaaaatacaaaaattagccgggcatggtggcgcatgcctgttaattccatttgctcaggaggctgaggcaggagaattgcttgaaccaaggaggtggaggttgcagtgagctgagatcgcgccactgcactctagcctggatgacagaacaagaccctgtctcaaaaaagaaaaagaaaaagaaaaaaaagtatagcaagcatattttatcataattacgggattcagagatatctgagagactgggagtgcctgaaagtcatgcttttaaccaaatattctcatgatactggggacatataaagttctaatactatgtaatgccagagagttcctgaattcagaggggtgaaatgaattcatatgcacaaagcacccagaaccgcgggtggaatgtggtcagcacctgactcagtttgagtgattttccatcgggaagccaggtgtgattgatggaaaggtcgactgcagacccctgagctagggtcttctagcctcctccctgccttcaaaagggtttctgtagggaattccttttggtgctgtaggaaaatgaattctatatgcaatgtgagcccctgatacagggtttcctggagcagtcaggaagacttgccttcttttttctttttttggcagagtcttgctctgttgcccaggctggagtgcagtggcacaatctcggctcaccgcaacctctgcctcccgggttcaagtgattctcctgcctcagcctcctgagtagctgggattacaggctcctgccaccacacccagctaatttttgtatttttagtagagacagggtttcgccatgttggccaggctggtctcgaactcctgacctcaggtgatcctcccacctcggcctcccaaagtgctgggttcctgcctgggtgcaggcaggaaccactgcacccagccaggcttgcccactatccagcttggagtttcatcccatttattcttgtcccttccttgggagaaaatgtaaagggtgatgcttccatatgactgcagggtgctcctaccacaaagataaggcagactggctaactggaggggctgtgtatttgtgtatgtgtgtgcgtgtgtgtgtgtgtgtgtgtgtgcgtgcatgtgtctgttgtttgtgttgacctaaaaattaaacaagataacaaaatcaaaccaaaaacaaacctttcccatcaaaagtgccacaatctttggggtcttattttttttctttattctttattcttccattcatgtagaaggaatagtcaatattgctcacttaatgaagaccatctgaacacctcttagtaaaattatcagacccaaaattcagacaaatgaaaaatagaatcattgctataacatgggcccgccacagtggctcacacctgtaatctcagtcctttgggaggctgaggtgtgaggatcacttgaagctatgagttcaagaacaggctgggtgacacagcaagaccctgtttctacaaaagtaaaaaagttagcctggcatggtggcacatgcctctagtcccagctactcaggaggctgaagcaggaggattgtgtgagcctgggaattccaggctttagtgagctgtggttgtgccactgcattccagcctgggtgacacagcaggactctctttattttattaaaataaataaataaataaactcactgggtgccgtggctcatgcctgtatttccagcactttgggaggccagggtgggaggatcacttgatgtcaggagttcgagatcagcctggacaacatggcaaaaccccgtctctactaaaaatacaaaaatgagccgggtgcggtggcacatgcctgtaatcccagcactttgggaggctgaggtgggcagatgggcagatcacttgaggtcaggagttcgagaccagcctggccaacatggcaaaaccctgtctctactaaaaatacaaaaattatcaggacgtggtggcgcatgcttgtaatcccagctactcagaaggccgaggcaggagaattgctttaacccaggtggcagaggttgcagtgagccaagaccatgccattgcactgggcaacaagagcaaaactccatataaaaaaaatataaataaaataaaaaataaaaggatgctgatggcattttcaagtcctcccattaatttctaatagagtccttgtcccttgtgctgcccacagcagcattttgaaatcttttccatgctccagatctcagtcccacctccagctctcctgagctcccagccctctgatgtgggattctttaagttccatctctgccacaaaatgtctgtttctttgcccatctcttagtttctggtgaagaggcagatgggctcttccaccttctgatggcaaagaccttcctaattggtgtgattacctgtttgctctaatgagagcagcaggaaagaaattcctagggatgaggggtgggttagcaagagtagagaagacctgagtgggggctctggggctgagggaagaggcccagcccgttcctttccctctcattggtcatgtggggttgcgaggaggattcagtttaatgagaaaagaatttcatcacttggaagaaataaaggaaaccatcttggcccttcacagttaggtgctagattcatcaagacttgggatggagggagcagacagtgagtcagggatctgagattgaactgttctgccccgatacaccttagaaaattaatcaaggaagaagggcaggagagaaacaaaaataaaccaaatttgacacacactcagtgttgatcgtgaggtcagctcgttttccaacttgcttcctcataggcgtttgctgcctattgccccagaatcacatagaccctattataagattatagttctttataatataatgatttatattcctttgggaatatacctagcaatgtgatttctaggtcaaatggtattgctggtcctagatctttgaggaattgccacaccattttctgatagactggataaagaaagtgtgtacatatacacaatggcatactatgcagccataaaaaggaatgagattatgtccttgcagggacatagatggagctcgaagccatcatcctcagcaaactaacacaggagcagaaaaccaaacactgcatgttctcactcataagcgggagctgaacaatgagaacacatgttgcggggtgggggatggagaggagagcatcaggaaaaatagctaatgcatgctggcttaatgcgtaggtaatgggttgataggtgctgcaaaccaccatggcacacatttaaatgtaacaaacctgcacgtcctgcacatgtaccccaaaacttaaaaagtaaaattaatgaagaagccaggtgtgcacatgtgcacgcatgcacacacacacacacacacaaacacacacacacacatgattatagtttccccctccttttttttttttttttgagatggagttttaactcttgttgcccaggctggagtgcaatggcgcgatcttggttcactgcaacctccacctcctgggctcaagcaattctcctgtctcagcctcccgagtagctgggattccacgcacatgccaccacacctgactaatttttgtatttttagtagagacggggtttcatcatattggtcaggctggtctcgaactcctgacctcagtttatccacccgccttgccctcccaaagggatgggattacaggcgtgagccattatagttccccttaattgccctattgataacaatttgaacagtataaaacattaagttttccctttgagatattctttaggttctgcatatcaatgagactactgatgtcagctggtctgaaggacccccccccagggagctgacttaccaaagaatgcagtttccacatcctgatggtttcatcaaatcaacaacctcaatttttcagtctcttgccctccacaatccccttaaaaaccctagctcaacactcctcagggaatggatttgagggttcctcctgtctccttgctcagctaccctactgtcattaaactgtttctctgctgcaaaccctgctgtctcagtgtattggtctattactgaacagtgggcataagaacctggtggtcctgtaacaggacgtcagcaagggcatggttgacgtggctggacaaggcacgcagcttaggccaagggcaaaagaggatagggaggagttgacagtttgggagagatggggaggccccaaagcgctcaaggctgggaggaggagagggagatttaggaggtggaagcaatgcagctgtgcaatcaggtcttgatagaagaagggaaaggttcaaaatgccaacgggcccccgtttgtggatatgggagcaatatggaagcaaagggtctaaggtgagccacaggatctcagacaaactcctctagtcctaggatgctaagcaggtagactcaggaactcagtattctcttcctagacacctctgcccaaaatgcaaccagggaggctctttcttgcatgtggaaaggcctgtgagcattaaatatattcacccatcactttgatcatgcttgaaaaattcttaaacctaaacacaaatcaacgagcttgtgtctgggggacaaacaaccctgacataatgtttttgcaaagtttctctgagataaaaatatgcaaaagggattatgtaatgaccgtcccagaggtcatacaagaatgcaacgtgcaaattacaaaataacagcttttttaaatgaaataagataatgaattttaaaccacttagtgcagtgcctggactaacaggctcacacctgtaatcccagcactttgggatgctgaggagggggaatcacttgaggtcaggagttcaagaccagcctggctaacatggtaaaaccccatctctactaaaaatacaaaaattaggccgagtgtgatggctcacgcctgtaatcccagcattttgggaggccgaggtgggcggattacgaggtcaggagattgagaccatcctcactaacacagtgaaaccccgtctctactaaaaatatgaaaattagccgggcatgggggtgggcacctgtagtcccagctattcgggaggctgaggcaggaagattgcttgaacccgggaagcagaggttgcagtgagcagagattgcgccactgcactccagcctgggtgacacagtgagactttgtctcaaaaacaaacaaaacaaaacaaaacaaaaatactactatagttattggttaggtaatggttaggtacctaaccatggttagataataccataattattaccataattattaattatgatatttattaaatgttatggtgataattattaccataatggttaattaatgttaagccacttagtgcagtgcctgggctaatagttattaatggcaattaataatggtaacaattattagtccaggcactgcactgacttaaaattattaattaaccattatggtaataattattaataaacattaataattattttataacaataaggattaataatttttaataaacataatacttgcagtatggttattaataaatataattgctattaacgatcattatatattaatcatattacattaattataaataagctattgacaaatcattaaagcaaacccagcaaggcttctgtttggtagcccctttgtcaggcatttattttattaatgtataaggttttgagaaataaaaaggccttacttcgaatttagattatttcccagtatagcctgacctttcccaaattactaagatctatgacatttccctgaacaaaacactgatccaccaacaaaggctgttgtggaaaatgagatgatacccaaaaatacccttctccacccatctcaagagtgctgactagcagtagagcgcttgagccccatgtgctttcattgtgtggggctcacatcatctgtcagccccgagcgagatggattgggaaggccaggtctgctgttttctcaagtttcagttctcaatcccttcgctcctcacccctcctcaccctcgcatgtcctgctggaaatggccttggctgtgaccaccccatcctgcccttataagatcagtgtgactcccactccaaatacagtcattgatgctatcaccccattgtcacagcaaggagaccaaggcaacttcaggaccacagctgggttttgtttgatgcgcatggcagttttgcagtgtttaaatttgagtgacttcagaagagatcattgctttctgttttgcaacagactccactactccctctctcccactgtttgcaacctcagagtacaggccatctcctgttccctcctgtcgtggcctttaatgctgggtccatgatgcagcagttcagccaagacagggctgatgggagcctgggtttgcatggacagttctggtgcctgggaccagctcagctccaagcacactagcctccccccatagcactcactggctctaagggagacagctacaagaccaggcaaccaaatatatccttctagtgtctatgtgacagcttcccaactatgtatactgacttatttaaatgttcaaaaaaaaaaaaaagaaaagaaaagaaaaaaaatttgacctccttaagaaatgtcagcattgaacagaaaagttgctgatagcctgctatatgatgttttaatgtaattaaaaattttttttctatacaacagggctattaaaaccactctgattttcaaagttggaaagaaggattaaatcctttagcttctcaggaattctctactgattaggagattcagtaggctctcttttttctttaaatttgctttcatgaataaaaaaaaataacctttcatgggtctcttttttggcctccagagaaccttatttcttctgtaactacttggttaagttcatcagaggactctgtcccttttttttttcttttttttggccagtgcatttgggaacatagaggtcatccattcctaagaattctgcgaagtaggtgtaatcatcctgatgtttatagatgaggaaacacagagaaggtccatcctttgcccaaggtcacacaacggactcgacccaagtttgccggacagccaaaataggctctttgcaccgccccatgcagccacaaccaagagaaggcaaacagcacaaaaccacacatccaatcacacgcagacctcagagagccttgagagaaaagacagggtcagtggagattctgcaaaaaatgcagaatttggaggagaaagatggagaaaatgaaacccaccgcatcttagcaaaaaagatctttaacctcagtcctggatttttggcttcagtacaagggaacatcagcccaagagcctgtgtgtgaacgcatttttcatatagagagtgtggtgcattggcctgtcccggaccggggaggggatggcagcaggggcacctacctccttcaaactctgtttggcagttccccgaggtctcattcaggctctcttcctcattgataatgatgttctcaatgtccttcatcgttaggtggtctcggaaggcatgatagagaatgtgcttcaactcttccagagttatcctttgcatgtcaaactgtggagataaagagtagtgagatggtcagaagcatgtggagatgggaagttggctcgggccatgacaggccagacccacagctgctctgcagaaacttgtctcagcgtttcaggatatcaggtgaacagttttccatcctgttcagctccaagtatactcatgaacttgcagggacttattggaatgatagagagtggaacatattcccttcgctttagcttcttggagaaaaaaaatgccacccgccagtctggtttcctattcatccagccatctgctgtcaaccctgcatactttgtgtactttagaatggtgaaaccctttatataatgcatacgtctctaaaatttttataatttaccaacactctggcaattcccatattggtttaagcatgtatctttttttttttttttttgagatagaatcttgctctttcgcccaggctggagtgcagcggcgagatctcggctcactgcaacctcgcctcccgagttcaagcgattctcctgcctcagcctccgtagtagctggaattacaggtgcccgccaccacgcccggctaatttttttgtatgcttagtagagacggggtttcaccgtgttggccatgctggttttgaactcctgacctcaagtgatccgcccgcctcggcctcccaaagtgctaggattacaggcctgagccaccacgcccggcctaattatgtatcgtttaaaaaaaaatttagagacagggtcttgccctatcatccaggctggagtccagtggtgtgatcatagctccctgcagccttgaactcctgggctgaagccatcctcctgcctcagcctcccaagtagctgggattacagacatgagccactgcgcctgtctaacatttacaattttttgtagggacaaggtcttgctatgtttcccaggctggtctcaaactcctggcctcaagtactcctgccttggcctcctgaaagtgctgggattacaggtgtaagccactgtgcctggccatgaatcttgttctaacaagataaaaacacaagttcaaagtcatgttcatgaagaaaagctgctgaaggagaggtgcagagttcctgattacatcctgcccctccccgagagaggactgtacttttccactccatttatattaggtttgatagtgtcgctttcttttttctttttttttttttttttccgaaatggagtcttgcttccatctcgcaggctggagtgcagtggcgcgatctcggctgactgcaaactccacctcccgggttcaagcaattctccttcctcagcctcccgagtagctgggattacaggtgtgcaccaccacgcccagctaatttttgtatttttagtagagacggggtttcgccatgttggtcaagctggtctcgaactcctgacctcaggtgatccacccgcctcggcctcccaaagtgctgggattacaggtgtgagccactgcgcctggccagtagtgtcactttcttggccaataaaatgtgagtagaagtcacatctaccacatctaattcacagctttatgaatcattgtgtggttctaacatttgttctttccctctgctatgagaattacatgccccagatagaggctgttccttcgggctgggtctcagaatgaggataaagtggggaacacctacagctgaatcacaatggacagctcacgtcaggaataccctgtgttgttatgaaccattgagatttggggcttgtttgctacggcagcataacttagaccattgttggtctatgtcaaaaatagagaaattggtacataaaactaagaggctaccataaccaaaattctaaaagacaatgtactggttccggagccaggcagtgaaaaatgagaaaactgtgactggaggctggaaagacacagatccctgtaatacgatagcaaaacatttggtaaaactgttgcctgtgataccttggaggacaggcagatattgaatccgagtccagtggttttaggtaaaaagtctgtgaaacagaatgccgtgattcacaattgaaattagctgcatctaacagagcactacaagaaagagatgagctcaggaaagaactggttgatttgcaagccaaaaataaaaaccactcagaaattcctggcgttgcagcattgaaagaagcaattgtttcttttttttctcgtaatgatcttgttatcttcctatccacacatttctcaaagcccccatttctatttctagttctatttttttagagacaaggtcttgctcggtggtccaggctgatatgctgtggtgtgatcacagctcactgcaacttcaaacatctgggctcaagtgatcctcctgcctcatcctcctaagtagttaggatgacagacatgcaccaccatgtccagctattttatttatcatcatcatcattattattattattattattattattattattatttgagatggagtcttgctctgtcacccaggctggagtacagtggcgcaatcttggctcactgcaacctccacctcccgagttcaagtgatccttctgtctcaccctcccaagaagctgggattacaggcacacaccaccacacctagctaatttttgtatttttagtagagacagggtctggctatgttgcctgcctcagactcccaagaagctgggattataggcatgtgcaccacacctggctaatttttgtatttttagtggagacagggtttcaccatgttggccaggctggtttcgaactcctggcctcaagcaatactctggcttcagcctcccaaagtgctgagattacaggcactgcaccaagagcaattgtttctcatctccaactagtaagagataaaataaagaaatgctttaagtaataatacagccctattgaaacaaatcaatgcctctttaaaaaaatctctgaatgtgttaagtgactctcctaggaagcctgttattaagtttagagagaggtatgtctcaaaaataattgtggatgtgtttactagcataactgattggagccagataaaaacataactaagtccttgagagctatactggccaagagccaacaatcttggattaaaagacactataactgttccaaactttaaaagatctttggggccgggcgcggtggctcacgcctgtcatcctagcactttgggaggccgaggctggcggatcacaaggtcaggagattgagaccatcctggctaacatggtgaaaccccgtctctactaaaaaatacaaaaaaattagccgggcatggtggcgggcgcctgtagtcccagctactcaggaggctgaggcaggagaatggtgtgaacacgggaggcggagcttgcagtgagccgacattgtgtcactgcactccagcctgggtgacagagcgagactctgttgcaaaaaaaaaaaaaaaaaaagatctttggacttcccaacctacgggcccaagcaattaagaggataagctacacgggtcccaggaagggtgtattacacaatgccctcatagagtaagtacaagaatagtggaaaaggacagctttcctgggaatcttggagaacaatgtcatccagggtcacttctaggaagcagaagcagctaattgagggaaaattcctcaccccaaggtttttgtccaacagggtttcagaactgctctgagcctctgaccgctatgggtatcccatgttttgctttccagaggggaatgtttttggtggttggcctgaccctggtccaccaccatatgtcaagtgtgtgtttgtgtcgggcaagggtgaggggtaatttgactttttagtttttatgtttccataccaagaagagccacatccagatttgatgagcatcatgagattctagagcttgagtctggtgttataactggatgggactgttgggaagtctcccctggggaggggaggagtatattttgcagctgaagagagggaaatgaatattgatgagcaagagtgtggactgtaacagggtctattatttccagctataattgagccttgaaaaacatgggtttgaactgtgtgggtccacttatatgtggatttccttctccctctgccattcctgagacagcaagaccaacacctcctcttcctcctcctccacctactcaaggtgaacaccatgaggatgaagacctttatgatgatccatttccagttaatgaacttacttcctcctctttatgattttcataatagcattttcttctccctagattactttattgtaagaatgcagtgtacaatacatataacatacaacatatgagttaatcaactttttttttttttttttgagacaaagtctcgctctgtcccccaccctggagtgcagtgacgcaatcttggctcactgtaatctccgcctcctgggttcacgccattctcctgcctcagcctcctgagtggctgggactacaggtgcccgccaccacgcccagctgattttttgtatttttagtagagacggagtttcaccgtgttagccaggatggtctggatctcctgaccctgtgatctgcccggctcggcctcccaaagtgctgggattacaggcgtgagtcaacacaaccagccttgagttaatcaactttttatattattggtaaggcttccagtcaacagtaggctattagcagttaagtttttggggattcaaaaattatacttggatttttgactgcacgtgggtcagtgcccctcatctttgctttgcctaagggtctactatatttgtttccccttgtaggagaggatgatatctccttgcctgttgatgtcacaagctttggccaatcaactgagagccaaagtgatagaagtatgaaagtccaaggagaagcttcaaagccattgtgttttctgccatttccctttctcttctttcacataacatttacacaaaagaggggctgctgcttcattctaggttctggaatgacctaggaattcaacctgagtagatcctcaaccatcccacaaaggacgcgggatctgagtgagaaataaatgcttgctgctaactgctaagactctgtggtttctgcagtgtaacttagtcaagggtgaacacaaaactcagtgttttcagttactctgcactatgaggaaggaagttttagactcttttttccctctctctctccctgcctcccttccatccttcctttcttccttccttccttccattcccttcctccttctttccttccctctccccctccccctttcctcccttcccaccctcccgccctcccttcttttcttcctccctccctccctccctccttccttccttctttccttcctcccttccttccctccttcctctctcttttactttcttgtttcttgctttgtcacccaggctagagtgcagtagtgcgatcatagcttaccgcagcctcaaactcctgggctcaagcaatcttctaggtggaactacaggtgcatgacaccagacctggctaattttttttttaattttttttttctttacagagagagtcttgctatgttgcccaagctggtctcaaactcctggcctcaagccatcctcctgccttgcttgcttgttaaacaatttgtaccttgctttaactgtgcacctctgttctaaaaaattaaattgggatattgaatcttgctgtaaaatctaaatgattcaagttcaaagccatttatacacttcagagcaactgaaggggaggtgtaaaacaaacttgttttctgcattagagtttaacgatcctagacaggaattttgacatacactcagagaaaactcatgggaccctgtctctttatattgggtaagggagcaaggtattgttcatttggctttggggaaaaacctggcagaatgcatgaagaggatgatttacagatgagaacaccaagaccccctgccatgatcagagatgaagagtggcaagatcaaggtcaacaagactcagaaaatgagtaaccatttcctaacacttgaagagtgtggtgcctggaaaacctctaacctgttgagaggttgctgtcattcagaaatcaggccaaaagattggtcaggagcaacgagaagagaaggaaagatacagactccaaaatctatagttttgggccaggtgtggtggcttatgcctgtaatcccagcactttgggaggctgaggtgggcagatcacgaggtcaggagttcgatcacgaggtcaggagttcgagactagcctgaccaacatggtgaaaccctgtctctactaaaaatacaaaaattagcccggcgtggtgacgcattcctgtaatcccagctactcaggaggctgaggcaggagaatcacttgaacctgggaggtggaggttgcagtgagccgagattgcaccactgcactccagcctgggcaacagagcgagactctgtctccaaaaaacaaaaatctatagttttggagatctgggtcatgttttagtattagggtatatatttagtattaggacatctaaacaaaataagttgcgtagcattccatatatcacctatattgtcaatatctgtctttcaaaagtttgaaaaaaatcactgtaaaacaatgtgtaccccatgccaacaagcctttcttctgtgattgtcagtccattttacttttcagtttttcttcagtcaattttggaatgttgtagttttttggaaaaccagagagaacattttcattatcattagtatgcaactatggaccctagtcctgcaattttaaattcctcccaatcattattacatcccagttctcctttgtacttttattggtttctctcttctagttgattttcgtcacctttttctgttgttaatggatcatagggaagagaatgtggcccatacatctgcaatttttggaaacctaaggaattttccactatagtagaatctctgtaaggtcagttatacaaatatatttacatttatttgtttattcatttatttatttttttgagacggagtctcgctctgtcgcccaggctggagtgcagtggtgtgatctcagctcactacaatctctgcctcccaggttcaagtggttcttctgcctcagcctcccgagtagctgggattacaggcgcccaccaccatgcccagctaatttttgcatttttagtagagatggggtttcaccatgttggccaggatggtctcgatctcctgaccttgtaatccacctgccttggcctcccaaagagctgggattacaggtgtgagccactgcacccggccatatttatatttattaattacattacgtaaccttataattataatctttttctataaacttacttttttttttttggactactggagtcaaggaccatgagtagcatattgaagtctgtgaagaaaacttgttctccataaattattcttatagttcaaatatttgttaaatgaggctattctgtagtgcaaaaagatttatatactaatccaacaaatggttattgggaatgactctgccagatactgtgatgggaatacaaaagcgaacaatacataaatcctgttcttgaaaccaagcaaatgagtcatttgaattcaatgtggtacatgctgtgggagggaagccaggatgtcttggcaccacctggttgggggtgaagggtgggtcagagggggctttctggagaacatgcctactatcaaagacctaaaggaaaaagaggctgactttgccaggtgagtgaggggagggtgggaaaaggataaggagggaagaggagacggtcaggtagggtagggggcagccgtaccaaggcacagagttgcaaaagcttgacatgttcattaactgacaatatgttgagttcttctgaggcttcgagtagccaggagaaggtgggaaggaatgaggtgagggatatgggtggggcactagtcagtaaaggccttgtatgacacggtgaaaagcttaattgtattttgtttgtttttattttttaattcttattcattttgtagagatggggtctcactatgttgcccaggctggacttgaattcctgtgctcaagtgatcctactgcctcaacttcccaaaatgctgagattacaggcacttgccaccatgaccagcttattttatttatttatttatttatttatttatttatttatttatttatttatttttttgagctggagtctcactctgtcacccaggctggagtgcagtggtgcggtctcagctcactgcaacctccacctcctgggttcaagcgattctcctgcctcagcctcccgagtagctggtattacaggtgtgcaccaccatgtctggctaatttttgtattttcagtagagatggggtttcaccatattggccaggctggtctcgaactcctgacctcgtgatctgcccgcctcagcctcccaaagtgctgggattacaggcgtgagccacagcacccacccgaccagcttatttttaaaaaatagttttgtaaagacagggtcttgctatgtcgcccaggctggtcgcaaactcccaggctcaagcagtcctaccacttcagcctcctgagtagctgggactacagacatgcaccaccacttgtttttatttatttatttttattgtggtaaaatataataactaaaaatttactattttattctttttttttttttttgagacagggtttcactcttgctccccaggctggagtgcagtggtgcgatcttggctcactgcaacctccaccttccggtttcaagcaattctcctgcctcagcctcctgagtagctgagattacaggcatctgccaccacacccggctaattcttgtattcaccatgttggtttcaccatgttggccaggctggtctcgaactcccgacctcaagtgatctgcccgccttggcctcccaaagtgttgggattgcaggcatgagccaccgtgcctggcctattttattcaagtgtacagttctgtggcattaagtactttcacagtgtcatacaaacaccacaattacttctctccagaagtccttcatcttcccagactgaaactttgtacactattattaattatcattaaacactatctccccattcctccctcactgcaaacccaacaaccaccactctattttttgtttctctgtgtctttgacttttttaggtaccttatgttaagtggaatcatatgatatttgtctttttgtgactggtttatttcacttagataatgccctcaaggttcatccatgttgtgtcatgtgtcagaattcccttcctttttaaggctggaccattttctgtaaacccaaaatagaattctaagctccacaaccatcggaatggaccccacttctcagccaagggcattccaaagttaacctgaaaaatgacttcaggctatgatgggaaggaagaattgaacatgactcattataccctcctcccttttggaattcaggcccaaatattaaagttaattaatgtttcaattaactaacattaaaacagagtaagactgataggacaaggaacacttacaatctattctctctgcagcctgcaacctggaggcttcatctgcataataaaaccttggtctctacaatccttatcataagccagacattccttttgattgattccaagtctttagataatacctcaaccaactgccaatcagaacccaccaatgaccaatccacctatgacctggaagctccccacccaccaacctccagttgtccagcctttttagactgaaccaatgtcatcttatgtgtattgacattttacatctccctagaatgtacaaaactcaggtgtaggctgaccaccttgggcacatgttctcaggacctcctgagggctgtgtcataggccattggtcatttgtatttggctcagaataaatatcttcacgtattgtttagagcctgagtcttttcattagccattccgttgtatggacataccacattcacaatagacataaagtagaagcagcccaagtgtctgctatggatgtaggtgtacaaatatctgttccagtcactgcttttaactctttggggtatatacctagaagcagaattgctgaatcatacggtaattctatgtttaaatttttcaggaacagagcttggttttatctgttgagtatctttgagttgtatttttatccactaaaacattttcatcagagaaattacttgatcaggtttgagcttgagaaaaactaccctttgctgatacaaaggtcccaacaaccagagaggaggctattgaagttacagattctgagactgaagtaggctatggagatagggagaatttatgagctgtgtaaacgagaggttgataagacttgatggatcactgtgtgtggtgtgtgaaggcgaatgggccatccagggagacacctgggttttacgttcagctgaatgtatgggcttagaaagaaaggctacacgttaaattttggatgcattctttgaaggttcctgagggacagcccagtagaatagcctaggatgcagtagaatgtatagatacaggttaatgacacagatttagcattcatttgcatacagatgatgataaagtcatcagaaaggatgacaccacccaagaagagagtgtgggctatgaaagccccgagggatgcattcagaggacatcaagatgaacaagtgggtggccctcgttactgaatgcacagagtgtgacttttatcttcatattaatccgttttcatattcttctaatgaagacatacccgagactgggtaatttatgaagaagaagaagtttaaaggactcaccgttccacatggctggggagggctcacaatcatggtggaaggtgaaagtcatgtcttacatggcagcgggcaaaaaagaatgagaaccaagcaaaagagggaaaccccttataaaaccattagatctcatgagacttactcactaccaccagaacggtatgggggaaaactgcctccaggattctattatctcccactaggtccctcctacaacatgtgggaactatgggagccacaattcaagatgagatttgtgtggggacacagctaaaccataccaatcattatacacggtctttaaaaaatatttcagtgctttgttaatgtcttttggaaaaaaatctatttttgtatcagtacagctatgcttaattcctttggtgtgaattctgctaaatgtttctttctttttttttttttttttgagtcagggtctcgctgtgtcacccacgctggagtacagtggtgtgatcatggcttactgcagccttgacctcctgggctcaagcaattctcccacctcagcctcctgagtagctgggactacggctaatttttgcattttttgtagagatgcagtctggccatgttggcccaggctggtcttgaactcctgagctcaagtaatctgtccgcctcagcctcccaaagttctgtgaccacaggtgtgagctaccacacctggcctttcttttggtttttaaactttttaatgttatattttagagatatgtctcttacaaggaggctagaattggattctaaagaaatctaatttgagattctttgctttccaatggtagagtctaattccatttttatatattgttataaacatatttggctgtactgttgttattttatttcctgcttctggttcttctgagatggcgtttcgctcttgttgcccaggctggagtgcaatggtgtgatcttggctcactgcaacctccgcctcccgggttcaagtgattctccagcctcagcctcccgagtagctgggattacaggcgtgtgccatcatgcccggctaattttgtatttttagtagagacgggatttctccatgttggtcaggctggtctcgaactcccgacctcaggtcatctgcccgtcttggcctcccaaagtgctgggattgcaggcgtgagtcaccgtgcctggcccgcttctggttcttatggtttgttttctcttttacataagaaacctgtggacattttagttttggttatgctgctggatgtttttccatttgtgtaatgcatgacttaagccaccatttcttaaattatcaaattcaagaaactaaatggcatcctgtcattttttcttgtatgtaataagattaatagaccttttattttcctaccttttgcctcatgcttttcagtctttgtaagtttaatttgagatttatgatgacacattttctactatttgcatctttttctagaatagtatttggagtctgcatttaattttgtaacaaaatttacaacagctcctgctacttcattatatttaagtgattccaatgcttacttccattttttaataactgtccctaaactaagtgcctgattgtcatccaaatatctgctagagaacatttaaaactatttgacaatgaaacacttgtgaatattacattttctgcattcttagaattctgataatacctttctccccttctctcatgacagacaatttattctgacataaaattctagaatcatacaaatctccccctcaaagttgttgaagcttctccagtttcttctctctctctccgtctctctctcttttttttttttaagagacagggtctcactctgtggcccaggctggagtgcagtagtaagatcagagctcactgtagccttgacctcctgggctaaagtgatcctcctgtgtagctgggattacaggtgcatgttaacaggcctggataaatttttatattttttgtagagacgggatgtgtgagtctgttctcacgctgcaaataaagacatacccgaccctgggtaatttataaagaaacagaggcttgggccgggagcggtggctcacgcctgtaatcccagcactttgggtggccaaggcaggcggatcacaaggtcaggagttcgagaccagcctggccaatatggtgaaaccccgtctctactaaaaatataaaaattagccgggcatggtggcaggcgcctgtagtcccacctacttgggagactgaggcagaagaattgcttgaacctgggaggtggaagttgcagtgagccgagattgcaccactgcactccagcctgggcaacagagcgagactccatctcaaaaaagaaaaataaaaaaaattaataaaaagaaaagaaaaagagaaagaaaagaaaaggaaaaagaggcttaatggactcacagttccacatggctagggaggcctcacaatcgtggcagaagacgaaggaagaacaaagggacttcttatatggtggcaggtaagagagagaacttgtgcaaagggactcatctttataaatccatcagatcgcgtgagacttactcactagcatgagaacagtatgggaaagatccgccttcatgatccaattacctcccatcagctccctcccatgacacgtgggaattgtgggagctacaattcaagatgagatttgggtggggacacagccacaccatatcatgggtgtctcactatgttacccaggctgatctcgaactcctggactcaagcaatcctcctgcccaggtgccaggcctctctgttgtttagtgtggggaaagagccaagaggttggataatgtatgcagaatacatgttttctgaatgactaaacctgaatcttctatttgctccacagcccagtctttcctgcctgtttccccttcctcaatcattgtccccccaaaatccaggagaaggccaggaggagcactctctacaggtggacttcccatgttcagcttctctaccgtgttgcatggaaaaagcagactaactgaacttgttttcctgctgtgaaaggaacctcaggggtgcctgagtccccagtgaagtctgaattcccgataagatgaaatgccaggctgccaaaagcccagagctcgctgctggctgccggctgccttgtgaggcctttgctccatttttcgtccctgactcatactgggacctgcacagctgggggccaacatctttcctgcccagatttgtgagcgagtccaatctcatgtcaactttcactgaatgtctggaatgaatttgatgacacagttctttctcctctggagaaaaagacaggcggaataaactccaaaatatttcacacctctattcctttctctgcccatctgcaaaaggcattttcctgccgagagagagctgcctggacgatcaatgggtcagaacttcttaaccagggagcagaattggttgcagtgcaccacaatagtaactcctgttatctggggtctcctgatggggtcttgaacagctggagtcctacctacacagttgagtgatctcacccatttatcttggtacacagtataaaaatacagtcatgttttaagtctgccttgagcgccagcgtgaccaggccaagcgaggtcagtagatctgcataacttccttccagggccttctccttcctccttggtccccacagcgcaaacaatgcagcctcttctatcaaataagcagacccccttcctaaagggtgggtccaaccatcaacctcccacgggggtccagatgtgaagggcaggagacaccaatgtaaccagagagacgtctagagtctgactggtatggtttggctgtgtccccacccaaatctcatcttgaattgtagttcccataattcctgtgtgttgtaggagggacccagtaggagataactgaatcatgggggcagtttcccccatactgttctcgtggtagtgaataagtctcatgagatctggtaagttttataagggtttcccccttttgcttgtctctcattcttttttgcctgaatgcacagagtgtggcttttatcatcgtattagtccgttttcatgttcttctaatgaagacatacctgagactaggtaatttataaagaagaggtttaatggactcacacttccacatggctggggaggcctctgagatttttccctatatgaggaattaaacagcgggaccgaaatgaaaggtatcctgagacagactcctccctgccaagaacagagagacagacgtaccttggacaagactgcttgggaagatgagtagtttgggcaaagaaatggaagactggtaaaggtattgagaaaatgcaacgttcaaagcagaaagcagggctgggcatggtggctcatgtctgtaatcccatcactctgagaggccgaggcaggctgttcactcgaggtcaggagttcaagaccagcctgaccaacacggtgaaaccctgtttctactaaaaatacaaaaattagccgggcgtggtggcaggcgcctgtgatcccagctacttgggaggctgaggcaggagaattgcttgaacctgggtggtggaggttgcagtgagccaagactgtaccactgcactccagcctgggggacagagcgagactctgtctcaaaaaaaaaaaaaaaaaaaaaaaaaaaggcagaaaacaacaaaaaacccaaaacagtaggtgccagactatggataaatccatttggactcctgcacatcttgcctcattggtatggagagacaggaggacagagagaaaagtgactccctgccttctttggcccacaaggaatcagctcaagggagcaaggggatggggccagggcatgtgactaagcctctgcagtcgacccccagaatgcactggtggcttagaaaaagatgaaaatgcccagtaacacccaaacgaagattgagcacctattgactcccacagtctagaagaaattttccactaacagcaagatctatggagcagacatgtgactcagacatcgtggttgactttgaaaagctttgctctctgaaaaagagcacaagatcattctgagtgaagccaggaaggtgctttgacctgcccttgaatacctagggctagggtgtccccagtctctgctcctgaagcagctctgaccccaaccctagcctcttgtaccagcattcctccctccactcctcttcaaaggcaatcaaccacagaccatgttggaggggacaggggaccttgacgtggccttgctgcttgcctgcccggcatcagatgaagtgaggtgtgaatctgttgttcccacctctgatctcatttcctacaggtctcgcccaatgtggggtctcatcattgcaacctctgcctcccaggctccagcaatccccagtctcagcctcctgagtagctgggactacaggtgcatgccaccatgtccacataatttttgtattttttatagagatgggtggtcttgctatgttgcccaggctggtctccaactaggttgctatggtgcctggagatgtctatttcttataaagcacagccctgaacacatgtcaacatcaacaagggctcagatgaagaaattgatctcttgcagcctggaggaaatgccagccggatgcacgtagggatagggtgcagccggagtccaggtcacgtcgcagagcctgggcttgtcacagagcctgggctctgtggaagatggtattcccctacatcatgggtgagaggaggctgcatttcaacttggcgtgtcacttaaatgaagacctgtgaatacagacagcttgtctgggagctaagcccattggtgggtcctccggcggcaaatctgagaagggatggccacaggactgggctgtcggcatgccaagtgtctggtccccacctaggctgtctgatggcaggtcagagaggctagatgcagggagagcttcctctgagccaggagcacagcagatgtggcctcatttaagtctcatggaggaagcaaaggctacatgatgcctattttacagataaacacagtggagttcaaagaggttaaataacgtaggcaaagataagaaacaaaagagtgaggacgggcatggtggctcacgcctgtaatcccagcatttggggaggccgaggtgggcagatcactggaggtcgggagttcgagacaagcctggccaacacagtgaaaccccatctctactaaaaatacaaaaaattagctgggcatggtggtgggtgcctgtagtcccagctactcaggaggctgaggcaggagaattgcttgaacctgggaggcagaggttgcagtgagccgagattgcaccactgcactccagcctgggtgacagagtgagactccatcttaaaaaaataaataaataaataaataaataaataaataaataaggactccagggaaagtcacattgagaaggtgatatttgaggaggaacatagaggaggcaagggtgggtccatgtggatatttgggggacggacattccaggtacagggaccagcaagagcaaagaccatgaggctagaacgtgctctgtgtgctggggctggaagggagatgagggcatgtgtttccacaatgaatatgtatcactggagaaccagataaacgtttctccttttaaaatggagataatcaccatgctgaagtgcatttcctcgggtaaaattataggtatggttttggaggacaggtcaaaggagaagcccattagtagctctctgctcccaatttccaccactatcctgatgggagccttgaccccaaataataattcattggtgtctcagcccttcacaccagcttgatctgacccgctggagtgcagaatgtgtgagaactccagagaatatagttcactctgccctcaaagaaatgggttttgtgataagccaattggtggccccaaagatatccacatcctaatcctgagaacctataaatgggttaccttacatggtaaaagggcctttacaggtgcaaagattcgcctggattatgcggatagaccctgtgaaaggaaaataccttgggaccccaaaattactgagctaaagggaaaattcaagcttggaactggtcagggcaaatctgcctcccattgtattttggaaagacttatcagaaaaaagaatgcaaccatctgtctctcatcttccagtgacctagaagctccctccctgttttgagttgtccctgcctttctgaacagaaccaatgaacttcttacatatatatatatatgtaagatatatacataagatatatacatatatacatatatatatgtatatgtgtgtgtgtgtgtgtgtgtgtaatttggggttttgtgtgtttttttgagacggaatctcgctctgttgcccaggctgctgtgcagtggcatgatcttgactcatggcaacctccgccttccaggttcaagtgattctcctgcctcagcctcccaagtagctgggattacaggcacacaccaccacacccagctaatttttgtatttttagtagagacggggtttccctgtgttggccaggctggtctcgaacccctgacctcaggtgatccatctcggcctcccaaagtgctgggattacaggtgtgatccaccgcgcccggccacatatattgattgatatctcacctccctaaagtgtataaaaccaagctgtgccccaaccaccttgtgcacatgtcaggactccctgaggctgtgtcacaggtacgcgtccttaaccttggcaaaataaactttctaaattaactgagacctgtctcaaattggggttcacaaccctaaatgtaatcatgtaagactgggggagagagagatttcactaaagaggaaaaggccctgtggggaaggaagatggggcaagcggccacccaccttgtcaccaaaagccaccaaagggcatggaaatggattcttcccttggagcctccaggaagacaccttggtgtcagcccaagggaattgattacagacttctgacctccagaaatgtagaatacatttgtgttgctttaagccacaaagtgtatgataatttgttataagagcaacagggaatgaatagagatttattttggttgttgtctgtaaagtaaagggcttttatgccaagagctcactctgtctggaagtaactcatcatcagaaatctggacacagggtaggctgtggtttgctagtggcggccacacagctattggattgcctgggtcgggccctgagggtaagctgtgaatagcctctagagtaaagtgggatgcaggtggagttctcaacagggagcccactctattcaatacctgggagctgtttgcagtctgcactgtctggggatgatgaaatgggaaacaaacagggcaaaggaaaaacattcataacctcacagcactcctgagaataaacaacagagaaaattccccattgcacatcgaagaggatgtgccagtgttctcaagtggttcattttatgtgaaacagacaagcatgtattacagatctgagtgaagatgaggacttactgaagaagccattgtctgtctgtctgtctctctctccatctttttctatgtgtgtatgtgtgcatgagtaagttcctttttttttttttttgttcttttttggagatgggagttttgctcttgttgcccaggctggggtgcaatggcatgatcttggctcactgcaacctctgcctcccaggttcaagtgattctcctgcttcagcctcccgaatagctgggattacagccatgcgccaccacggctggctaattttgcatttttagtagagatgggttttcttcatgttggtcaggctggtctccaactcctgacctcaggtgatccacccgcctcggcctcccaaaatgctgggattacaggcatgagccaccgtgtccggccatcagttctttttttctttttttgagacagagactggctctgttgcccaggctggagtgcggtggtgcgatctcggctcactgcaacctctgccgcccaggttcaagcaattttcctgcctcagcctcctgaatggctggaagtacaggtgcccaccaccatgcctggctaatttttgtacttttagtagagatggggtttcactatgttgtccaggccggtcttgaactcctgacctcaagtgatccacctgcctcggcctcccaaagtgttgggattacaagtgtgagccaccatgcccagccaatgaataagttcttagtagtaataaactgagaaaaagtcctcgaacttggttcttactcagataccatcacataggggctgtgtgactcattgaaagttactaaacttctctgttccttagcttccctgtgaaaaatagagatgatattgtttacaacatgtggttgttatgtggatagaactctttttattcccaaatcacacatcttcattttgctgtggcccacacataaaaagttaaggagaaacaaagtcattcagtttgttatcgcagaggtaagaactcattgacaccctgattccccatccaaagctcctttgtgtcacttttattggcagctgcagctgttccggaaaataaaatgaatcacctaagttctctgcctcctcatgcacataaatgcagaccccgagttcaggagctaatggactcataatctaggatggattctgccactaactagttgcgtaccctgaagcaggtcatttaatgacttggaatctgtttcctcatacatttaatagataatcctaatgataaaaagaatagggccaggcgcggtggctcagacctgtaatcccagcattttggaaggccgaggcaggtggatcatgagatcaggagttcaagatcagcctggccaagatggtgaaaccccgtctctactaaaaatacaaaaaattagccgggtgcagtggcgtatgcctgtaatcacagctactcaggaggctgaggtaggagaatcgcttgaacccaggaggcagatgttgcagtaagccaagatcgtgccactgcactccagcctgggcaacagagcaagaccctgtctcaaaataattaattaattaaaagaataatatgaatagcaataatatgataagaataaccataataatgaaaatcccttccttatccaccttatagaggtttttgtgagaattaaataaagtaagaggctgggcgttgtggttcgcatctataagcccagcactttgggaggaggaggtgggcggatcacttgagctcaggagttcgagaccagtctaggcaacatggcaaaaccccatctctacaaaaaaatacaaaaacaagccgggtgcagtgtggcagcacgcacctgtagtcgcagctactcgggaagctgagtcagaagaatcgcatgagcccggaaggtggagcacattgcactccagtgtgggtgaagggagtgaaaccctgcctcaaaaaaaaaaaaaaaaaaaaaaaaaacaaaccaaaaacaagaaaactaaataataagaaatgttaattttcttccacaaaaatatgcaaagtaatacaaatataagacatactgttgataggcccgttaatgatgtgatgccaatttcatctctgtatttaggctcagaatgtccatctctgctccaggtgggaggctgatgttgtccaattcataattctccctgagaatggtgaaatttaagttcctcgtggctaaaacacccctgcttttttttgttctcatttaaagaatgtcatgtaggcttttaggcttccctcaacagcttccatctggcattcagcaaagcaagaggatgagatgtcactgctatgacttgtctcgttctggacagttccttttaccacaccaatgaccctaggcaagtaattcttattgaatatcttcagatagagaagaaagccatttctgatggggttttgaaggggacggaaaagagtcaaacagcaacaaagtgcaatctaaataaggagatgcctttttgcttgtgcttagcaaatgaatgaagtgtggatttaccttgattctgtatgcagggactgtgacttttgtagatatgggcacttattcagaaacaagttcccagatgccaaggtgactgctgaaaacccttcaatgactcttagttccttcatcattgagtccaagttctgaaacacagctcctaagtgtttccttttttgttttttgagacagtcttgctctgtcgccaaggctggagtgcagtggcacaatcttggctcactgcaacctctgcctcccaggcttaagtgatcctcccacctcagcctcctgagtagctgagattacaggcctgcactatcacgccaggctaattttttttttttttttttggtaaagaaggggtttcgccatcttggccgggctggtctcgaactcctgagttctggtgatccacccgcattggcctcccaaagtgctgggattacaggcgtgagccgccatgctcgcccacttccaagtgtttctataatatcatccagccttgtcattgtgtcctgcccgcgatgtcttgatcctctgtatgccagccattctacttagtggctgctctatgcaacaggctttctttcatccatgggtttttgcctagtctttctgtctggaacaccattctctgacgtgtccttctccaaagtgattcctcctttaggcctcaacttctctgacattctctggcaagcctcctagagttctaggggttggatgtgttttctcttacatgtgatccatgttattctatacaaccttaatagagcacttgcaacggtgtgtgagaatcgcctgctgacatttttgttctgtccatgagactgtgaattcctacgggatagcaaccatgccctgttggtggttttatctccatactacttagcacacgtgagccctagatcaatatttgttgaatacaaggatgagtgcacattgtcctaagaaacgggtaaaacaaccaatgcatggaggaaaatcctcacttatgaagaaaaatatgtggcaaatggagacgttcaacaaaataagccatgattctatagaagcattaaagcaaggagaggggtggaataaaatctagtgacagccatgagacttaaggaatggaaaatacaggatataacatggtaaagaaaaaaaaaaaaaagaccaaatagaggatgaagaatcagaagaccaggcgaggcacagtgatgaatgcctggaatcccagcactttgggaagccaaagcaggactgcttgaggccaggcatttgggaccagactgggtaccatagcaagaccctgtttctacacccctgtgcccctctaaaaagaattagctgggtttagtggtacaggcctgtcataacagctacttgggaagctgaggtgggaggatcacttgagcccaggagttcaaggctgagctatgattgtgctactgtaccctagcctgggcagcaaagtgagatcctgtctcttaaaaaacaaaaaaaaatcttaaaagttaaattggcccggcgcagtggctcacgcctgtaatcccaacactttgggaggccgtggcgggtggatcacaaggtcaggagatcgagaccatcctggtcaacatggtgaaaccccatctctactaaaaatacaaaaattagctgggcatggtagtgcgtgcctatagtcccagctactcgggaggccgaggcaggagaatctcttgaatccaggaggcaaaggttgcagtgagccatcatgccactgcactccagcctggtgacagagcgagactccatctcaaaaaaaaaaaaaaaaaaaaaaccaacaaaaaaaaactagttaaattaaattacataaatgacacagagtaaaaaggaagtggccacctgctatctcagtctcccttttaaaggtaattacgatccaccctaaaaaaaaaaaaaaaaaaaaaaaaaatcagaagacttaagtcaattgagcccaggctgagtgaagagtagaaaagaaatacgtatatagaagtggttgagaggaacagcaaggtaaggaatgtgtccctttcatgctgtacaaatattagcatcaattgttaaaaacattgggaaaactaagctattgtgttctgagatgtaaaagtgttctgagatggaaaagtgaaactaagggggttattatgatttttttcttagaagcccaaaatactcagaatatccttgcaccagttttagttcccaggggaagccctatgcaatttggagacctccttcttcttccaggaaacaatcagacaggattccaaggttaggcccggggccctctgttcattaaacagatgacaaatgcagactgcgtttaagccatagtcactggggcacatatatggtgtatgggaatgtggtacaggactctgttttagctttttcatttctttgagacagcgtcttactctgtcacccaggctgcagtacagtggcttgttcacagctcactgtagcctcaaactcctgggctcaggcaatcctcccacctcagcctttcgagtagttgggactatgggtgcacatcaccatgcccaggtaattttaaaaaaaattttcatagggacgaggtctcactatgttgtctaggctggtctcaaactcctggcttcaaggaagggatcctcctgccttgctctcccaatgtgctgggattacaggaatgagccactgtgccctgccaagacttttgttttcataaccagctcacaaacacggcacttgcctaagcccctggccttttgttttggtaactgatcacaaaggtaacatggctgagcttataatcctccagtaaccagatcactaatatggcacttggataagtcacacttccttctgtttgtcttaccaaatcatacataaggcatgcagttaggaattacaaccctctgttttagtaaccacagggaaacatggcggcacggggtaagtggtagaaatatctattatatttaggaaccatatcacgaacttagcctgtgtttaaaccgtagcctctcccttttaataaacagatcacaaatatggcaagtggcattgcctctcagatcacaaatcgagcacacggctaagctgtgcaatgtgacatttgttagattcaattatacatcctggcctcatctttttaaatttatttgttgcttatgaaattttaattagctaaagaaaaacaaacactttatagaaacaaggtaacagaggccataaagcacataaaccaccagccccatagaagcacttaaaaagataggtagagatcacatctaggaagttacagagtcaaggcagagaaaactgtagaagaaacacaccgaccccactagagttggcactgtgagggcatccgagcagccatggggtagaccaaggacctttccttgtgaagctcttttgtcctcgtgaatcattatatgtggggacagctgggagttataatttggaatattgcaaagcaaatatgtacttctctcactttggggtatattcctgcctgttggtgttagactcggctaggtgacttgctttgggcaatgaggtgttagcagctgtggaatgagcagaggcaatcggtcatgacctcttgcaccaaagacatctcaatgagaaaaacttgccttgagtttctgctgcctggacctagaatgaatacatgagacagacctgacccaatttcctctagaagcagagcctcccagctgagcccagcctggatcaaccgggtctccgcctacctgcggatcctggaacatcagggtcaatgcttcttgtgatatgtcactgaatttgggggtggctgcaacctcattgtgcaacattaactatcacccttgcaatttccaagggcaagagtaacgacacgatgggggcagggagcagctccagggaaaaggctgcacaggtggacctggatctggagtggaggtcaggtccaatgaataaaagggaggaaaagaccttgcatctctgcagtggtgcaatcgcatctctgcagtggtgctgactccaggttcagtgactttcaccttcatagagaaacagcgatgaaccgcctttaagggacttatctgtattccatgctctctgcacattcaggaactgtttctggctcactgagactcattctattttatggcaaattctgtcccattatttctctctgtctctttttttttttttttttctgagacagagttctgtcgcccaggctggagtgcagtggcggatcctggctcactgcaacctccgccttccaggttcaagcaattcttgtgcctcagcctcctgattagctgggcttacaggcacccaacaccacgtccagctaatttttgtatttttagtagagatggggtttcactatgttggccaggtcggtctcaaactcccaacctcaagtcatctgcccacctcggcctcccaaagtgctgggattacaggcgtgagccaccagtgcccagccagaaaattgttatttctaaacaagagccactggccaggcaaggtggctcctgcctgtaatcccagcactttgggaggccgaggcagacaaatcacttaacgtcaggagttcgagttccgcctggccaacatggtgaaaccctgtctctactaaaattacaaaagttagtcgggcatggtagcacgggcctgtaatcccagctattcaggaggctgaggcacgagaatcacttgaatccagaaggcagaggttgcagtgagctgagatcacgccactgcactccagcccgggtgacagggcgaaactccatctcaaaaaaaaagacaaaaaaaaaaaaaaaaaaaaaagccacaaagttagctctccagatctgttgggcttattgttaaccaggtaacataatttaatagatgtctagccttagacataccttgatggctgatgtgtttgaaatgcaagaataaagaaaacattgtgcaaatatcttggcataaaacgtgaattaactataagggaagaaaacccttctgggacaatccttggatacaacagagagattccaggacacaatggagagatatcactgagtttttagggcaaagggcttttacttaagaatttgacacctgggaaggttatgatccatctacaaggcaacagaatataaatcagttatgcgagagctcaaaagcataaaatctatcacccttcctaaagaaatactgaaagtgcacataggccctgagacatgaatcaaaacaaggggttcaagaatgggggtaaaacagggtcttaaggttctgtttctgagaactgaaaccatccacatctaaaatttaatttaaaacaaaggccttaaacacagctatagaacaaaatggaaatgacgtggtgatgggttgaaagggaagacataatatgaaaaaccaataattttaccataacaaattggatctaaatcccatattacataagcaaagatcaaaacgccagaacaggagggatgaaaaggaggggggtgggagaagtactaattttattatttaaatgggggcagagttcttatttaattacactgattagtagattaacgttaagtggtaattgtggtaacaggcatatttatcatgttacagattttaatggacatggctttagaggctgcataaaattgccgtgtatttttccagattttgttctgcggaaaagagttccaggaagtaaagtgctcttcaaaaaaaggaaaaactctgccatggttaatatgaatggaaatatagcatatgatttccccaactggaaatgaaaaaatgaaaaatgcctgttagtataaatctttttaagcaggcttgtagttaagagatcattttttaagtctagtgtttgccagtaattaaagcaggaaaatcttttctcatggactattgtggtaaacatttggcattgtcctctaacatccattctgtcccagatgagcatgtgacccaattttgaccacagagatactctttgatgcccgctttatagagacagggtcttggtctatcccccaggctggagtgggtggcacaatcatagcttgagcccagtcttgaactcctgggctcaagtgatccttttgtctcagcctcctgagtagctggggctacaggcatgtaccaccacacctgtggtatggtttggctgtgtccccacccaattctcatcttgaattgtagttcccataatccctgtgttgtgggaggagcccagtgggaggtaattgaatcatgggggaggttacccccattctgcagttctggtgatagtgagtgagttctcaggacatctgatggttttataaggggcttttccctcttttgcttgccacttctctttgctgtagccatgtgaagaaggacgtgttttcttctccttctgccatgattgtaagtttcctgaggcctccccagccatactgaactgtgagtcaattaaacctctttcccttataaattacccactcttgggtatgtctttattagcagcatgagaactgactaatacaacctgcctgatttttaaaattttctttagagagagggtctcaccatgttgctcaggctggtctcaaactcctggcatcaagcaatcttcccaccttgaccttctaaagtgctgggattacagacatgagccactgaacctggcccattttatcattcttgagagagagagagagaaagggagacccataaaagagatactccccctttaaactctaggtattgtcatgtctagatgtgatgtctggaactgctgtaaccatcttgtaaccgtcatgaaaatgacacttttgggccaggtgctcatgcctgtaattccagcactttgggagttgaggcaggcacatcacttgatgtcaggagttagagaccagcctggccaacatgatgaaatcccatctctactataaatacaaaaagtagctcggcatggtggcacacacctgtaatcccagctagtcaggaggctgaggcaggagattcgcctgaacccaggaggtggcagttatagtgagccgagattgcaccactgcactccagcctgggtgacagagtgaagctaagaaaatgacacttttctggttatcactgctgtataacagcttaatcattttatggattctgtgggtcaggaaagaatcaaatgctggattggattatctgctgaagccttgttcacggtgccagagccagaaggagtctgagaccaggagtgccaactcagcccctctccatggcctctccaaatggctcagcttctacctagcatggaagcctcaggctggctggacttcttatggcggcatctcaaggcactaattacaaatgatccaggaaacaagacagatactgcattcccttccctgacctagcatcactcttgctgcattctctgggttacaaaaaagtcacatgcccacccagattcaaagggtgggaaggtggacccctctctctatggagggctgcccaggtcacatgcagtgccacggctgtctttggagaatgcagtctgaatggaagtcagcactaaggcagggagagggggctcaaagaatctgggttactgttgggccacagattcaaccaaccctgaagttttccctgactctgtttttgttttctgagatattttcctatcctttaagccatttagaattggtgtgttttgtttatgtttttgacttgttgcaaaagtgttctaacagaagcaaacaggcaaggggcagtggctcacacctgtaatcccaacactttgggaggctgaagcaggagcattgcttgagcccaggagttcaatgctgcaatgagctatggctgcatcatagcctgtgtgacaccacaagacccgtctccacaaaaaatttaaaaattagccgagcacagtggtgtgcacccatagtcccagctacttgggaagctgagttgggaggatcatttgagcccaggagtttacagctgcaatgagctacgattgcaccatggcactccagcctgggtgacacagtaagatgctctctttaaaaaaaaaaaaaaaaaaaaaaaaaagagaaaaagaaaaagaaacaaaccccttcttaacatcctgcagggccaagtgtgtggaagaaattgtccagacagtgcttctctttagatattaaattcggagagacctgtgactgtatggctgggctctcttaggcattgattgaaccgctcagagcaaaacctcagtttccttatatataaaatggggataataatactaatgaataggacagttgtgaggctgaaatgaagcagcacttatgaaatttttttgttggcacagaggaaacagtcaataaatggtagccttcgttagcactgtttgaccatgactatttcatggtaatatatgatagcattttggagggaaaaccacattttggatacatcctttctatattttactaagatatgtgggtgtgtgttttaagaatgtattgaagtcattttccctttttctttggaaaaaaaaaaaacctttttaaaggtaaagagtcagggaagcatctgtcacagaatgatagcctagagctcttcattatcttagtggagacgttttgcaaacaaccagaaatccttccaaactgagttaggtaacaaacagaggctatgttggaaggacaaaaggaagtgccatagaatcctaggagaggagatgaaggatgcaacaacggttctccaagtgtaacaagggtagctgtgttccacaggatcattgaaagtagaatgcacgaccctccccagactctcactccgggaaggcaggctgctgcctctctgccctccctctctctgggactgtaagaccctcagctctttcttcttctctgttcatgtggcaggaaggagcctgcatgactgatggttccatccgttcatgcctgcaaagactggatggaatcatcatgggccaattccaacaagatcaacaaatctcaaagcagtatggagatttcccagagaattcaaaacagaattaccactcagcccagcaatctgatttttactggatatctacacaaaggaaaataaatcattctacctaagacactcacacttgtatgttcattgcagcactattcacaacagcaaagacatggaatcaacctaggtgccctagatggtggactggataaagaaaatgtggtagatatacactgtggaatactatgcagccatagaaagagtgcagtcatggcctctgcagccacatggatgcagctggaggtcattattttaagtgaattaacacagaaacagaaaaccaaacactgcatgttctcaattgagtgggagctgaacattgggtccatatggacataaaaatgccagcaataaacactagggactactagattagggacagagggagggggacaagggcttaaagactacctattgagtattatgttcaccatttgaatgatgggttcaatagatacccaaaccccagcattgtacaatatatccatgtaacaaacctgtacatgtacctcctgaatctaaaaaagaaaaaaaaaaaagacaaaaaacaaatctcccagcccttcttggtcaagggtccgtgccagtttgttactgattaggagagagagacatatggctcatatctcacatagggaggctggagatagctagatactaggcagcaactcacgtgtctgcctctgtcctaaaaacaaagtctagtcccgagtaaactctttgacaagcaggattcacccaatgtgacaatggagaattgcagcttgagtgtgagtcctcaaatgactgaagcaagcaatactatcctgccctgcgggagcataaaagtgaggaccctgctttgtcctgaaagcttactccaattcactggatgctcctcccaaatttctccctgatgttgatcgctgccgttttgtctgggttcttagagacagaatccattctcacctaagatcaagggatgagtctgagctgttgggattttgcccctgtggcttagctgatttcttcctgggattctggcagcagggttggtggcacaagagcaagacatccacgtttacagtgaattctgaattaagaaaacctcagcacagcctggaatccagccagagaaatacaccggtacattagcttctctgcttccatttgcaacgttcaccgatgcctgcaagctgtgcttgttagagcactttgataacatgctaatacacttagtgaggcaaaaataaataataaggcctcttcaagcttgcctggctttgaaccccataactattagtacttccataagtaattattcccaaaagcttacaggtccgttcctgtaccctcagcactgcctatcttcggggttatacctcctgtaactatatttagactgtaacataactacattagactgtcatattgcattttatcctaacaatactctaaatactttacatgactgtaaatctgatttacaaggattcttggaaaatcagtgaaggaaaatcctagacctccagcattccagggtagtgagaggttgttatttcatttttttctctgctaggcattaactaataaaggaagagatgtgaggatgggtattggacggcctccaaataagaaatgtaggtgaaacatataattgatagaagctgaatccaccataatttctacatcttcttattctccctaagaagacacttctcctttcccctctttaaatttctttcctatgcttcctgaagacctcttagaagctgggttggcccataaatgcaatggagcaccatcttgaattcacaaataaagaacgaaccagccaactacatcaatgcactcattgcaactaagagtaaaaaattttaggccaggcatgggagctcatgcctgtaatcctagcgccttgggaggctgagggggatgaattgcttgagctcaggacttcaagactagcctaggcaacatagtgagaccctatctctaaaaaaaactatttagaaaaatagccaggcatggtagtgtgcacctggagtcacagctacttgaaaggctgcagcaggaggattgcttgagcccaggaaatcgaggctgctgtgagctatgattgtaccactgcaccccagactgggtgacagagcaagacactgtctctaaaaaacaaacaaacaaacaaaaccagagagctaagctaagctcctcatggcaaagataaccctcagtttcctcatttgtaaaatgggactagaatggatctaattaatacattatacttacaccatacttattatgctcatgggcacgcatgaggtatgctaaatgccagcagccacaagccctctataaatgttaatttcctcccctgtgtcctctttcttctctgacagtgactgaaatctgcacacagatggcgttagagattctacatagtgtgcttgattttctggattggtatttaagggagaggaagtggggtaacagcatcagagaagcagctaaatgcacgttactcaggaattgatctcggtgactttttggttgatttgctgcactgggcattctggcatttatagagatggaccctggagttgggacagtcatgtcacttttgcacaaggagcacactgcgatatgattttcctttctccatagagcaggctacaaaagacaggagagctgattgtcatagggtggcaaagctatctttctgaagcctcattcttgggaattccttttatgatggtgatctatgtcattccatcagatgcccctgccatcaccccagataatatttgctcctcccagaaatagcttggagcaaggcccaattttttctgatttaatcttacctgccttctttataatgactcaaaaatgtgttgctacaggacaaaaccaaagttctaagtttatgtgacactcaccctggaaaaacaacagctttatgcatagccagtttcttgagcataaatttggtaccaagcattacaatatccttaagcagataaataacaaatggggaaataatttagtcatttcaattggaacaaattcccaaaatatcttcttgttatcactttgatgaatcagactccagagttcttagggaacatatcacaataactaattaaagcttttaagatgatggaaaggaattaatattaaatgggttggaccaaaagagggaactgtaacacttagtggaaagggcagaagagaaaaggaagaaatcctggctaaactaagaaatgattgtgaaatggactcacccctgagacaaatgtcaaaagcagggaagaaatcacatcttctaccaaattctgccttaaactaaggatctgtaatttattggaaacatcacatgttttaaattggaaacaacatactcctccatctgagttctttaatgtcttatttttttcaattttttacattttttgagacagaatcttgctctgttgcccaggctggagtaccgtggcatgatcttggctcactgcaacctctgccacccgggttcaagcagtacctcagcctcccaactagctgggattacaggcatgtgccaccacaccaggctaatttttctatttttagtacagacagggtttcaccatattggccaggctggtctcgaactcctgacctcaagcgatcctcctgcctcggcctcccaaagtgctggaattacaggtgtgagccactgcacctggcagaatgtgtcttacttgttcaatttcacctggttcctgtatcttgataaaacaagctaagtctgaaaaacaatgtcaggtaagaatttcatatggaacatctatactgacgaattccattcatctttccaatttggcaaacactctgccagaaagcaagaactgaggaggaggcctaggcagggtttccttcatgcctgtgtttcgtttaggtgtggtctgtgtgtttcaataactcacccacctccacttctagaggctggctctaaggccaacagctcctggcagcttggctttgttcacggcccaagccctggtctctcctcttctactttgccctctgctgtttggccttattgcaagggtcctgacttcctgctttatgattttctgcctctagccctttccccctagccctgaaccctaatgcagaggttcatcagcatggctggggaacttgttagaaatagatacactcaggccccgtccagagactctggggtggcatccagcacccagaattcagctgattctggtcatcacttctagggctgacctgggatttcccgctgggttaagattaacactctcatccgggcacagtggctcatgcctgtatcccagcactttgggaggctgaggcaggtggatcacttgaggtcaggagtttgagaccagcttggccaacatggtgaaaccccgtctttactaaaaatacaaaaattagctgggcatggggtgcacacctgtaatcccagctagtagggaggctgaagcaggagaatcacttgaacctgggaggcggaggttgccgtgagctgagattccactactgcactctagcctgggggacagagccaaactcggtctccaaaaaaataaaagattaacactctcctcctggatgtcatcgtcttctgcccactttgcataacaaaacaacagcaaaggagggttgaacattcagcacctgactgactgcagcatttaggatacaccaacaaagaatcgccctatgaagcgaaacacacttctcattgaatatatattgatgccaaagtttgggaaagctgaaaccccttaagtgatgtaattgttgccgttctgattctcttattttacagagatcagcagagacttgggagatgccaggcagaggttatggccaggctgaggcgctgtccatggtcatgaaataatgacacagattcttcaggaggaagaaaggagcccgcagttttctgctgagcaggaaaggcaccaaacactgctccttgggaagctgtactagtcgggttccccagagaaacagaactaataggataaaaatatgtgtgtgtatgtgtgcgcgtgcgtgtgtgtgtatagatagatatagatatgcatatatatcaagctttttgttttcccccatttacagtgctattctttacttctacagggtaaccctccttctattgtgcagaaattttctgtgcaatattctgtggggttttatttatctacctgtctacttggaggctatatatatatatagcctactagggatagtagtaaacaaaatccatacatatatgtatatacacgtatataaatatatatacgtgtatatacatatatatgagcaatatatacataaatatgtgtatatacatgtgtatatattatatatgtatatatgtatgtatatataatatatacacacatatatgtatatataatatatacatacatatatgtatattatatatacatatatgtatatatacatatataatatatacacacatatatacacatatacacacacatatatatatattgcttatgtcatggaggctaataagccccaagatctgcagggtaaggtggcaagctagagacccaagagagctgatggtgtagttccagcccaaagggtggcaggctcaagaccaggaagagcccatgtttcagtctcttctcttggtgaattccctttaaagggagaggaagcctgaaggcaggtgatatggtttagctgtgtcccccactcaaatctcatcttgaattgtagctcccataattcccatgtgttgtgggagggacctggtgggagataattgaatcatgggggtggtttccccacaattcttgtggtagtgaataagtctcatgagacctgatggttatataaagggtttcctggctgggtgcagtggctcacgcttgtaatcctagcagtttgggaggccaaggtgggtggatcacctgaggtcaggagttcaagaccagcctggccaacatggtgaaaccccatctctactaaaacaaaaccaaaaccaaaaccaaaaccaaaaacaaaaaaaaaattatccagatgtggtggtgcatgcctgtaatcccagctactcaggaggctgaggcagaagaatctcttgaacccagggggcagaggttgcagtgagccaagattgcaccactgcacgccagcctgggcaacagagtgagactctgtcaaaaaaaaaaaggaggaagaagaaagaagaaagaagaaagaagaagaaagaagaaagaagaaagaagaagaaagaagaaagaagaagaagaagaaagaagaagaagaagaagaagaaaagaagaaaagaaggagaaggagaaggagaaggagaaggagaaggagaaggagaagaagaagaggaaagttttccctttttgctcggctctctcattctgtcttgccaccaccatgtaagaagtgccttttttcttctgccatgattgtgaggcctccccagccatgtggaactgtgagtccattaaatctccttttctttataaattacccagtctcatccaaaaacacctgaacagaaatacccgcaatagtgttagaccaaatatctgggcaccctgttgtctagtcaaggtaacacataaaattcaccattgcagaagtgaaactggttataagaaagcaccctgggagaatggtactttgggaatgccaattttaaagaattgtaaagaactgttcagactgtgtcagattagccagatgtgagcaacaatcccacagtcagaagatgggatgataaagtatccccctcagaactgcatcacatctgtgcttgctaatcaaatttgatgctcacacccgtatttatactgaatggccccttctgttcaagagccaagtttggaattctattgatatccagaagaccaaagaggaagaccaagaagcaccagccattctgtgtcctggtatttgtaaactaggggagacctttcttctttgaaggataaacaggaaaataaaaccccgtagaatattgcaaagaaaatgtctgcactgtaaaaggagggatactttgtaaacatacagaataacactaaaggggttattacagaaaaaaagcttaaaagccatctgttttgtgttctcaatgaaacacacacacacatacacacacataatattacctatgaaacaagagctatgataattgaagactgggatagaattattttaagttgagaaaaaagggaattcaagaaaagaaaaaatttaataatattaaaacataatagaaaaaaattacattggtagttgtaaagtccaatatcgatgatgctgaaactctaactcaggttacagaaaacaaacttggaaagctcatcagtcaactattcagtttacccttgggttgttcacctttactttttaaatttttactccttttatatattttgcatgctaatcttttgtttattgtgaatgctgcaaacattttctcctggtctgtagtttcttttttaatttgttatggtggctttccccatgtgagggtttttaaatttgcatttagtcaaagctgtttgttttttccttctggatacgggtgtcttaaggtgtttaactcaatgggataaatataatccactctatttacatctaaccattttagaattcttatgtgtgtttaatctatgtgtggcttatttttataagtgctgctgggtgagcatgtagcttttttacatctccaatagataggcagttgccccaattgtattgaatatcccatccttagcccaagtgatttagcacaagtttcacgctaaattcccacgtagacctgggcatatatatggactcccagtccattccattgatctagactctattctatttatggctagtactgcataggtatatgtgtgtcttgatatttgataactctttgttctttttcaatcttggatcttcctatttttttttttttttgccacatgtattttaggatcaatttagcgattccatgagaatcttgttaggatttgtttattagtaatcagggaaatgcaacttaaaactataggatgctattttaaatctatctaattggcaaaatattcacatttgatggtattgagggttggagagaatttagtaagaaaaggtcttctatattattagagtaactttttcttttaaaaggcaggatgttattcagttgcccaggctggagtacagtggtgcaatcatagcttactgcatcctcgaactcctaggctcaatggatcctcccacttcagcctcctaagtggctggggctataggcgcatgccaccacacctctgtcattgttttgtagagatagggtctatgatgcccaggttagtctcagactcccagcctcaagcaatcctcccgcccaggccttccaaagcactgggattagagaattgagccatcgcactcaacccgtactagcaacttttaaaggtgatatgacaatgtctattaaagctgaaaatgtgcatggcctacaacttggcaattctgcttcctagaatctctcctagaaaaagcctcacacctgcgtgcatggaggcaagaacacatatgttgcctgaaggattcttgtgaaaggaaaaagtactggaatcaaatgtccatcattagaaaaactaaggaaaatatccttacatggaatctatgccatatatcaagagatctgagtgcgtaatatactgacatactgtttttgttgttgttttttcttggagatggagtcttggtctgtcacccaggctggagtgcagtggcacattctcggctcactgcaacctccgcctcccgggttcaagcgattctcctgcctcatcctcaagagtagctgggattacaggcgcataccaccacacccagctaatttttgtatttttttagtagagatggggttttgccatgtagtccatgcttgtctcgaactcctgacctcagatgattcacctgccttggcttcccaaagcgctgggattacaggcgtgggccactgtgccagcctgacattctcttgagtgaaatgaaaagcaagaatactaaatgactacgatattatttgtggaaaaagaaaaaatcactcaagaaaacagtatattttttgtaggggggaggttatagattctggagggatctatactaaagtaataacagtggctagttagctctgcggagttcaatatttggcaggcaggtagtggtaatgaggtgaaagcacacagaacaatacaattagctcttaaaagcatagattagtgaataaaataaagaacagaataaaatctatgttatgaattttgtttactactatccctaggcagaaagtagtggttgacacatagtgagtactcaatacatatttgaaatgaatgaaaaaacagaataccatttatgtacattaaatatgcatgcaatattggcctggtgcagtggctcatgcctctaatcccagagcattgggagactaaggtgggaggattgcttgaagccaggaggtcaagaccagcctgggcaacatagccagacctcctttctataaaaattaaaaaatggattagctaggcacggtggtgcacacctgtagtcctagctacttgggaggctaaggtgtgagggttgcgtgaacccaagttacagtgacctgtgactgcatcactgcactctagcctgggcgacagagagagaccttgtctcaaacacacacacacacacacacacacacacacacacacacacacacatcacacatatacagctgggtgcagtaggaggccgagatgaccacttgaggtcaggagttccagatcaacctggtcaacttgccaaaaccccatctctactaaaaaaaatacaaaaattagccaggcatggtggtgggtgcttgtgatcccagctattcgggaggctgaggcaccagaattgcttgaatctaggaggcggaggttgcagtgagctttgatcatgtcactgcactccagcctaggtaacaggtgaggccgtgtctcaaaaaagaaaaaaacagtatatatatacatatatatatgaatatatacacacacatatatatattcactaaaagcaaaaatgcaaattttgcaccaacagccacacattaaaatcctttggataattgcccataggaatagaggtggaataggagggaaacagagagaaaaggaaataaacaaatgagcaaacaaacaagtaagagagaggctttgcatggatctaagatggtgtcctaccctaaatggagaaatataatagatgcaactctccgccccgatgcagaaaagtgcacaaacaaacaaatgtgtctgtgaactgacaagaaaggaagaaaactccagagggcagacattaagaacaagcagttaattaagggagagctcagagctggcttttttcctgagaggatctgcccaagcctggtgcctggaagctgtggtttaatgaccctgcagaacccgagggacaggaggcagagtctatggaccacacaagaggaggatctaaaggaggttctgcaagaaggcagaatcctcagagccaggtggaatggtttcgatattcatccatgtcattagaacatgattagttcattccattttgtcatcgaacagcatttcattgcacacgttcaccacaattttgtttatctgttctctggttgattgacatttggttgtgtctagtttgttgctattacgatcaagactccatgaacaatcttgtacacatcattttacggacatatgttttcacttctcttgggaaaatacctaggagaagaatgtttgggttaaagaacaagtatgtatttagctttataagaaactgccgactgggcacagtgactcacacctataatcctagcacttccaggagctaagtggggaagacagattgagctcaagagtttgagaccagcctgggcattatagtgagaccctgtctctaaaaaaaaaaaaaaaaaaaaatcttagctgaagtgggaggatcccttgagctcaggagtttgaggctgcagtgaaccatgatcgcaccactgcacttcagcctgggtgacagaacaagagactctgcctcaaaagaaaaaaaaagaaaacagaaactgccaaacagttttccaaagtgatcgtaacattttacactcctctcagtcatgtctgagaatctcatttactccacatccttgccaacattcggtattttcagtcttttcagcttaactttttttctgggcaagaagtgggtaactcacggctgttttaatttgtaatttatctagacaaatgatgttgtacgtctttatattgattgtgcttattagccatttgtatattttctcttgtgaaataactagatgttgagcacaacctttacaggattgtttgtcttttacagtattgagttgtgagactttaaaaatatatttaatatattctgcttacgactcttttctcagatagatacgttgaaaatatttttttcctaatctgtgccttgccttttcctattcttagtggttcctgttagagagctgaagtttaaacacttattattatttgcttttttttttgagacggcatctcactctgtcacccaggctggagtgcagtggtgcagtcatagctcacagcagcttctaatttctgggctcaagcaatcctcctggctgagcctcccaaagtgctgggattacaggcatgagccactgcactcagtctaaaaagttatttttaaaattggattttaaaataaatttgaaaatattttctaaaattttatttatataattggcaattaaaaattgtatatattattatttatggcatctaatttgatgttttgatatatgtatacattatgcaatggctaaatcaatctatttaacatatacattatctcatatgcttatcagtttttgtgatgagaacatttaaaatctctccgcaattttaaagtatacaatatatctttattgagagtcttcacaatgtatgatagatcttttgaaattatttttcctgtttaactgaaatcttctgtcattctgaaattttaatttttttttttttatttgagacagggtcttgctctgtcagccaggctggagtgcagtggcatgatctcagctcactgcaacctctgcctcccaggctcaagcaattctcctgcctcagcctcccgagtagctgggattacaggtgtgtgccaccacacctggctaatttttgtatttttagtagagacggggtttcaccatgttggccagggtggtctcgaactcctgatctcaggtaatccgcccacctcggcgttccaaagtgctgggattacaggagtgagcaactgcgcccagcctgaagttttaaattttgattaagtccatgagtccattttttaatggttcgtgattttcatgttctgttcaggaaacctttgtctacctccagttgtgaagatactctgttttcttccacaatccacatatttctatgcttttgggactatgatcagcctaaattaatttgtgtgtgtgtgtgtgtagggtttgaggtagaggccaaatagatggtagaattttaacttaaatttggatccttgatatttgctttaaaaagtctttacacaacatgggctagaagaaaacaccccaaaccattgacagtgtgtgttcctgaaaatgaatggagagaaagaaacaggccgggcaggaggctgaggcaggagaatctcttgaacctgggaggcagaggttgcagtgagctaagaccatgccactgcattccagcctcggtgacagagcaagactccctctaaaaaaataacaataaaaaacagacagacagacagacagagaaagaaagaaagaaagaaggaaagaaaaaaagaaactgaaatggcatacaaaagagatatcaatgaaatcaggaatgtgctatttattttaagaggaaagaaaaggtcagaagcaattatagcaagttggtgatgtttgttcattctgcattgtggttacatgcatgtttgttgtaaggacctggttctttttcctactgcaaataattttccaagtaaaaccaagaaaaagtgtacactacaaagtagcaataaaaagttactttgaagattggcagtttcatgctagacagtgcaattagatgcagttgaagttgccaaactctctcgaaagatcacagaaattttcagatttggagaagccacatagctgattcattcactgtgagtgtctgtcagtcagtgggtgataactgtcagaagcttcgggctcatttcccaagaaaaactatataatgtgaagccaagcttaattcaattaaacaaagaaaataaatcacggcttcccttaaacattaagaagcagaaaatctcacagttctttgatacatctcaaaactatgctgcaattcaaaacgatgctaaccctgtctggacaagggctatgaactgtgaaaagctctgtgctgttctgaggttctgtgtaaagaactgccgatggctgaaagtgatttagaacatgcttcatactaactgtgaacacagcttaaactcaaacttcgagctaataaagaagaaagggatatggaattgtatgcatcaatgcatgctaaggggaattgaaaaataaatatgcattctagcgtcgttctccaagtgtggtctatgggctggcagcattacccgagtgctgattacagatgcaaacttgcatgtctcaagtctgacttactaaatcagggggagtagctcaggagtccgtgtttcatgaagctttccaggggatgctctggctgacgctggacaatgactgctttagtggaaatgtgacattcagttttaggtgcacacggcacccaaatttcctttctacattgggcggtgcttcatcttaggagccttggtaagtatcccccacctcaacttggaagccccaaaggccataaatgtcaccatcccccatgcaactgagatttgggcatgtgacccaggcttggcaattcaaatgcagcaccccagcctttcaatctggagctagggctgcaaagaagctgttttggaggttccgtctgaccctaggcagcacccagggtgttgtggtccctcgtgggcactctcagtcccctagtggcagtgagggtcttgctgtagctttggtgatggcatttggactctggtgctggctaccctataccttacttatttcctatgccttctccaagcctgacccaccagccttcctgtcaactctgtgagctacccagtgctttagaatacatttcttttcagcttaaattggtcagagttgatttctgtagtgggcattaagagtcctgactacatgtgcattgaatgcagtgctttttcatttattttattttggttttgctccaaaggcactttttcaactgatattatgtctgtgtgcgtgcacattatatacacacacatacatatacatattgagacagggtctctatgtatgtatgtattttgtatatgtagatatgtatatatttgagagtttcaaatatatatgaatatattaaagatatgcatgtatatatttgagagttttcatatatatatttggaactctcaaatatatacatgcatacatacatatatacagcccttgcctggggtgatacatatgtaaatatacatatatatttataaatatacatatacatatatttaaactcctgagctgttcattctgcaatccttcattaattttaatgtaaatattttgtatgtatatattttgagacagggtcttactctgtggcccaggttggagtgcagtggtacaattacagctcactggagtcttgacctccagggctcaagcaatccttctgccacagcctctccagtagctgcaactacaggtgtgcaccaccacacctggtcaatatctttgatgttatattttagagtcaaagatgtttttagaatttaaaaacattacttattatatgtatatatatgaacatatacatctagatgtggaggtaaaacatctggaaaaaatagatcatactgtttaactgcttcattttccactgttctgtatttttatatttgttttcccaagactatacatgtatgtccaaataaaaaataataactggccgggtgtggtggctcatgcctataatcccagcattttgggaagctgaggtgggcagatcacttgaggtcaggagttcaagaccaggctggccaatgtggtgaaaccccatctctactagaaatacaaaaattagctgggtttggtggtgcatgcctataatcccagctactcaggaggctcaggtggaagggtcgcttcaacctgggaggcggaggttgcagtgagctgagatcgtgccattgcactccagcctgggtgacagagtgagattttgtctcaaaaataaaataaaatgaaataataataataactgtagacaacctcatggtgtgtatatgtatgtgtgtgtgtgtgtgtgtgtgtgtgtgtgtgtgtgtgtgtgttgcaaactaaatttgtccaggcctaagtgtagaaactatgtgttattcaaatggaccatgcttcttttaaaaaagaatcagaaattcaaacaaagatgtaggtcaaaaatatctatcacaattatttgtaattaatacaaaggacatgagttaaataatctcacaaatgggctaagtgaattttggtgcctccatattctgcaatcttacatggctattaaatattagatttttgaagaaagcttcattctgcatcttcccgcctctggcactgtcatattgctcagagttaagaattcaatatagggaatgtgtcagacccttgtgaagtgggaattcaccctgtgagtcaaaggagtttaaatggaggggctggaagtgctgtcagggctctcacccattctggctgagaactgctgccttgggcgtttcaaaggattgctcctttagaaaatcatcaggggagatttacccacatccatccttcatcctgtctccagacaactggctgtctcaccgactcctcttccctctcctccccctgttctcttggtggagttgcccccgcccacttaatcaggcgagcgctgaggctgcagaggtggcactggccaatcaccccaggcaagggctctgcgatccttcattaattttagtgtaaattaaattgttcaatttattccttccatgggagagggcccaaggaccaaggtatcttaaaccaagatgtctgatgaaaatataaaacaataattagaaaaggaaaaaaggcataatgagaaatagctgagtccttcatggttcagagactccaaaggccacatcacgttcctgggaatgctgcatattctatatttctattatcaaggaagtgggccaaagaactgcagaatcctggcacttaagaaatcaggtgatgataaaaatgtcacaaaagatgtgcaaaaggcaaataaatctcaggacccctgatatggtttggctgtgtcctcacccaaatctcatcttgaattgtagttcccataatccccacgtgtcatgggagggaccctgtgggaagtaattaaatcatgggggtggttacctccatgctgtcctcatgatagtgagttctcattagatgggatggttttgtaaatggctttcccctgacttcactcattcttctccttcctgctgtcacgtgaagaaggacgtgtttgcttcatctcctgccgtgattgtaagtttcctgaggcctccccagccatgctgaactgtgagtcaagtaaacctctttcctttataaatcacccaatctcgggtatgtctttattagcagtgtgagaacagactaatgcaactcccaaatcactaagtcaaagggaagagttgagctgggaactatgtcaggaaaacctgcctcccattctgttcctatacaagatagctacaaagagtaaagaaaaaaaaaaaagctacagacctccctcacaatttgcccaccttgcccacaaggaaattccttatggacagaggacagacagaactcaaagtcatccttctgcttatgtgagacaaatatatatctgattgcttcccccgccctaatatttcactaagccctcctctcacatgtaaattgtgtgttcagtgaaaggccaatcagagattcaaaagagtgaatctacctatgacctggaagccccctccccacctcaagttgtcttgcctttcccgacctaaccaatgtacattttacacatactgattgatgtctcgtgtctccctaaaatgtataaaaccaagctgtgccccgaccactttgggcacatgtcatcatcaggacctgctgaggctgtgtcacgggcacgtccttaaccttggcaaaataaactttctaaattgactgagacctgtctcggatattttgagttcacagatgtaaactgaacaagttcagagtagaaggggtcctctgctgggtaatcatttttctttttgtcttttttctttttttgtatgtttgtttgtttgtttttggagacagagttttgctctatccccaagctggagtgcagcggcatgatctcggctcactgcaacctctgcctcctgggttcaagcaattctcaggcctcagcctcccaagtagctgggattacaggcatgtaccaccacatctggctaacttttgtattttcagtagagacagggtttcatcatgttggccaggctggactccaactcctgacctcaagcaatctgcccgcctcagcctcccaaagtgctgggattacagccactgtgggcatcattttttatttgtctgttgacctccggacaccaagtcagtctaagccactcttcatgttgatgtgtttctatcactttatgctgtctttgaaaggaatgtgtatgggttgttcccgtcagaggcctctaggaacttctgtttctccttcaacctccagttgacatcatgacccttggctatatgagtttgagactgtaagtgtggactcctgtatccaggtacactccaaattcatttgatctcctgtctcctctgctcattccaaacttgaaagaatctatagcaatgaaggatatcaaaccagagactaaattagaagttgcccttcctggcaatgtggccctgctgcatggtgtatatgaataagctgtaggatggaaaatccatcactgttagttctttttaactgagcccatgcggacacggtgtcagaggcgtgggtaccagagtgactccatcttgaataggggctgggtaaaataaggctgagacccacttggctgcattcccaggacattaggtattcttagcctccagaggtgtatgattaagggaacagattgataacatttactaaacagacccagactcaggaatgtcctaatatcccgatatcttgagaacaggaacattcctagtcttgctttaaagagaataatatcaattcttgcaaatatagtaattaagaaaattaaccctttatcacaaacccttgtagtagagcatatctcccaggatatttttgctaccctgtataaacaagcattgtacctagggtgggtgcattcctcctttcgggaaagccctgctctgcctttattgagcattctttattttcattttttttttttttttgagaagcagtctcgctctgtcacccaggttggagtgcagtggggtgatctcagctctctgcaacctccacctcctgggctcaagcgattctcctgcctcagcctcctgagtagctgggactgcaggcacatgccaccatgcccagctaatttttgtacttttagtagaaacggggtttcaccatgctggccaagctggtcttgaactcctgacctcgtgatcctcccgccttggcctcccaaagtgctgggattacaggcatgagccaccgcacccagccttgagcattcttttattcctttactttcttaataaactttctttcactttactctatggacttgccctgaattctttcttgggtgagatccaggaaccctctcttgggggctgaatcaggacccctttttggtaacaacaacactaatagttatgacatgccccataaaaaatgacatgacattgttacacagcaaagaaacaccaggtcaatgtcacattgcaagcctttaaggccacgtaccactgccaggagaggttgaaagtgaaagacagaaaacaggcagcgaggaagagtcttcagagtaaacttccagggagcactctgccagggatgattaatgcctgaatcctccctgggtggtgctactctcaccaaagctacagagagcatttgctgaggggacatttataggcagaggatgatcccacggagaactctctgtgatcaggagaccaacgatgacaaagagaaccatctagttcaaagtaacccacattattaacttaacatgtgtgggtcttcaaagaggaccatttaggtcagatacagagaggcagaacaaggaaagaagagaagacactccttcctcatgtctccaagagatgcatggagacatgcatgcttaacactgaaccctgaatgccattttgcatgcataaagcaaactggtgtgttgtggtgtggggtgtgtgtgtgtgcgtgtgtgtgtgttacgcttatgcaagtataagctgaccgataaacattaattgagcatctacttgttttgggcaccaaactgagtgtgcaaaaaagagagacaccttccctgacttcaagaaatgtattactctatccctcattttgaattggtctcttcacttaactttcttgtccttacaaaatctcttttttaatcccttctggtgttatttaatagcatcaggggaaactcagatttggaccccaccctcagaaagatctcataggttatcaaatctgtgttcaagagtaatgtccaggcaagatgtggtggctcacacctgtaatcccaacacgttgggtggccgaggcaaggggatcccttgagaccaggaattcaagaccaacatggtaacatagtgagaccctgtgactacgaaaaaaaaaattacaaaaattagccaggcattgtggtgtgcacctagtcccagctactcgggaggctgaggtgggaggattgctggaccctgagaggctgaagctgcagtcagcccaggtcacaccactgcactccagcatgggtgaaagagtgcaactctatccaaaaaaaaaaaaaaaaaaaaaaagagagagagagtaatgtccaaaacatgttgattgggtttcctgctttaaggactttactttagcctggtgtagacctttccaggtccttttcagtttccttagagaattccagggctgcctgtctacttagatgaaaatccttgaccatccaagacaggcagaagcagggaatgggaagcttcaccttaaggtgctagcttgtgagctgtgcttgcttcctcaaaggttagcaactaactaactttctctaagacgtggccatctcatctttccttgacccttttgcgctggacagagaatcccgagcctaattctcaggaacaactagcctctcataaatctgcaaaggtacctgctgtaagcagctgggattcaaggcttacgcccctttgaaaaatctagggtgtggctgaaattaagatcagcacatgctggagacactagcgtatgctgttaaggcccaagaatgctgatacgatttggctgtgtccctacccaaatctcatcttgaattgtagctcccataattcccacgtgtcataggagggacccagtggaaggtaactgaatcatggaggcaggtctttcccgtgctgttctcatgatagtgaataagtctcacgagatctgatggttttataaaaggggctcctgcacacaccctcttgcctgttgccatgtaagacgtgaatttgcttctcctttgccttctgccataatcatgaggcctccccagccatgtggaactgtgagtctattacacctctttcttttatgaattacccagtctcgggtatgtctttattagcagcatgagaacagtttaatacacatgctgagttagaatggaaagacaaaaccactcttgtaattgctaggaagattcatgcaatcttgataagctcacatctttagatacattatcctgaccaggatttaaattcccagattttgttcagcgtttcttctaagtaaggcaatatggttacttactattccagtggatcagctcaagataacaatctactagtgggcagaaattcaggagacagggcgccctccagttccagcaagtggacagagaagaggaaatcccatgtaatgacaagataatccaagttagttgaatgtggcttgaatgaacttcaataggggaactattatgaaacaacaacggctgggcgtggtggctcacgcctataatcccagcactttgggaagccgaaatgagtggatctacttgaggctaggagtttgagaccagcctgggcaacatagggagacccctatatctacaaaaattaaaaagttagccaggcatagtggtaaacacctgtgtcccagctacttaggaggctgaggtggggagattgcttgggcctgggagatggaggctgcagtgagccatgatcgcaccactgcattccagcctgagcaactgagtgagaccctctctctctctctcagaaaaaaaggccaggcacagtggctcacatctgtaatcccagcactttgggaggccaaggcaggcggatcacccgaggtgaggagtttgagaccagcctggccaacatggtgaaacctcgactctactaaaaatacaaaaattagcagggcgtggtcacacatgcctgtagtcccagctactccggaggctgaggcaggagaattgcttgaacctgggaggcagggattacggtgagctgagttcatgccactgcactccagcctgggcaacagaactaaactccatctcaaaaaaaaaaaaaaaaaaaaaaaaaagaagaaagaaagaaataacaacaaaacacccatacaagcaactagcttgatgccatagaaaacacactgcaaaacaacggaattactattgggaaggctccacgcaggagtctgtctacacaactgactgtaagattaagaagtataaggtcagcaatcatggcacctgcagcaatcctctagcctgtctacatctcttccctgtgttctcatgaagtctgggaagttgacattccatcctgactgatgatgcctcaatctatgtttccagctctctctcttttttgagctccacgcatgcatagctaactgtgaattctccactggatgtctgtatcgaataggaatctaaaagttagcatggcccaagctgagctctttaattccacttctactaattactaaagtcaaagtcctattcccctattctctgcaaagcatccagttagctttgttctttacagattctctattgaggttagtgatttttaatgtttaaataagatcctcccccccgattacaattcttcaaatagcttcttattgcaaatagaaaaaaaatataattttccttcccgctgtggtagacagaattttaagataatcttcaattacccacagtcttttataacctccttcacttgaggatgggatatcactcccatgattagcttaaaaatcagttgcatttgagttgatggaaatggatagtacactgggtgggcctgcccaaatcaggtgaagtctgtgaaccaggctctggttggcctggaagacagcaaatgtgcatgctgtgaaatgcctgtgtgagccacacagcaaggattcatgggcagcctgtaagagctaagagtagttcctggcccaaagctagtacaaaacagggacttccatcctggagccacgaggaactgaattctgaccgtgaattagaacgaacctggactagaatcctgagctccaaataggcatcccaatgtagctaacaccttgactgcagccttcaaatagcttcccaggcagaggacccacctaagcctcctgacccacggagactgagagatgatatatttgagttgttttaaatcactaagtttgtggcaatctattatacaacaatagaaaataaatgcactggccaggtgtggtagctcacgcctgtaatcccagaaatttgggaggccaaggcaggaggatcacttgaggtcaggagtttgagaccagcctggccaacatggtgaaactctgtctctacaaaaaacttataaattagccaggcatggtggaacacacctggtagtactagttgcttgggaagttgaggtgggagaatctcttgagcctgggaggtggatgttgcagtgagccaagatcacgccactgcactccagcctggatgacagagtgagaccctgtctccaaaaaaggaaaaaagaaagaaagaaagaaagaaaagcaagcaagcaagacagaaagcaagaaataaagcaagcaagcaagaaaataaatgcaccaataaaatctgatttttgataatggtttggctctgtgtacctgcccaattctcacggtgaactgtaatccccagtgtcggaggtggggtctggaggagatacttggatcgtgggggtggtttctcatggtttaacattacccccttggtgctgccctgtcaagagtgagttattgcaagatctgattgtttaacaatgtgtgacacctcccctctctatctcttcctccagctctggccacgtaagaagtgcctgcttctccaggaggtggaggcatggccttccgccatgactgtacgtttcctggggcctccccagaaggtgatgccgccatgcttcctgtacagcctacagaaccatgaaccaatgaaacctcttttctttataaattacccagtctcagatatttccttatagcaatgtgagaacagactaatacagttctcaaagccttatctggttcttccctgcctcgttggctttatttgctattaatcttctccttcactcatcatggaacattaaaacgtagttttgtcacaatggctaaccttggagggggttgttaattgggaggacacatggtggcttctggggtattggtaatatttcacatctcatctaggtgctgtttagtcaagggtattgagtttatttatagttaaaattcatttaactatacatttggatttgtgcattttatgtattatacattagagtcaataaagagtttaaagttagttttgcagaataatatttaatgatgtgacaaatgctcctaagttaatatttatgtgaaacaagtcaaataaaaattaccaattttagaaagagtagtaaataaaacacaaaagtatacgaatagcagctttctgagaaatgcaaaaattgttaaatacaaggcacattttttttcttttttttttgagacagagtctcgctctgtcgcccaggttggagtgcagtggcatgatcttggctcactgcaagctctgcctcccgggttcatgccattctcctgcctcagcctcccgagtagctgggactgcaggcacgtgccaccacacccggctaattttttttgtatttttagtagagatggggtttcaccatgttagccaggatggtctagatctcctgacctcgtgatccacccgcctcagcctcccgaagtgctgggattacaggcatgaggcaccgcgcccagccaataccaggccagttttatatgtttattatatattacacatgcaatattatatatttattatctgttccatatgctatattatgtatattatgcaatatacatattatatatgtaatagatcttatagacatttccccatttttgctatttgttttacatggaactgtaaagtaagtagcatatgatccatatgttattggtaaaaaacatatagatcattgatagatattggaaagagattttataaaatgcaatatttggttttgaattgtaagccttttagcaagctaataatggaatgaactgagtactccacatgcttgagaacatttaactgaaactaccagtcaacatcctaccgaacccccaaatctagagatggtccaggtaaactcaggggatgatacaggatgcttttcaacttcaaaataatttagcatgattctagaatttcaaaccaatatagtagagttatgaaatagggggagaaaggtctgttatttgaaaaaggagaaaatttggcagataatttgtctactagaaaatctaagggcaggccgagtgtggtggctcacgcctgtaatcccagcactttgggaggccgaaatgagtggatcacttgaggtcaggagttcgagaccagtctggccaacatagtgaaaccccgtctctactaaaaatacaaaaattagccaggggtggtggtgcatgcctgtaatcccagctactcaggcagcggaggcaggggaatcgcttgaatccgggaggcagaggttgcagtgagccaaggtcacaccattgcactccagcctgggtgacagagcgagactctgtctcaaaaaaaaaaactaaggacatttacagtagcattactcaaattgatagagtatgatctggaatggaaataaacataaaaatcaacagctatattatacaccagaaggcgtctgtcaggaaatatgagggaaaaaagaggccagtcacaataacatgtaaactataaaatacatcaaaatgtccttaggggaatgacaggaacatcaacccaccagaatttgaccacatgtaggtttgaatgcatttggtggtgtgttgtggggagagatggggactgcctttttacttatttatttatttatttattttgagatagagtctagctctgtctccaggctggagtgcagcggtgcaatctcggctcattgcaacctccacctcccggattcaagtgattctcctgtctcagcctcccaagtagctgggattacagggatgtgccaccatgcccagctaattttgttatttttagtagagacgaggtttcaccatgatggccaggatggtctcgatctttcgacctcgtgatctgcccactttggcctcccaaagtgctgggatcacaggagtgagctaccgtgcccggctggggactgccttttagaatactccttttgttcatttgtttggttttctttttaaccatcaaagacccacagtatttgttgacagctatgtcagggctgtgagagtgaacagagccacgccaaaggcaggcttgctggttacaggtagctgaaggcttctctgactcagttcttacttatttatgaggactatttacatattagaaacagtccacttatgtttttaaacatctatgatagacatatctcctttttcattatttattttaatgtacggtcttttcacgtataaaagtattctttttttgttttcaaatctattaccatttattttttgctttatttctgctttgaaatatttatgcttacaaaatctatccccatcctagaatcagtataattcggaagaagggcaatgtattagcctgttctcgcatggctataaagaaatacctgagactgggtaatttataaagaaaagaagtttcattggctcacagttccatgggctatataggaagcatggaggcttctgctcctggagaggctgcagaaagcttccaatcatggcagaaggcaaagggcaagcgagacgtctcacatggcaggaacagcgagaggggaggaagtgctacacactttttttttttttttttttgagacggagttttgctctgtcacccaggctggagtgcggtggcactatctcggcccactgcaacctccgcctcctgggttcaagcaattctcctacctctgcctcctaagtagctaggattacagatgtccgccaccacgcccggctaatttttgtagttttagtagagacagggtttcgccacgttagctgggttggtctcgaactcctgacctcaggttatccatctgcctcagcctcccagagtgctgggataagaactcattcactcattatctcaagactagcaccaaggagatggggctaaagcattcatgaagggccacccccatgatccagtcacctccccccaggtcctacctccaacattggggatgataattcaacgtgagatttgctcgaggacacagattgaaaccatatctgggaaggatctgtttgccctattaatagtaaaagagaatataaagtgataataagagttcaatcactgtgtttgtagcctaagaatagaggttcctgttgaaatatacgctgactccaggaaggagaccaggagaggctggctcagctgaccaaactgtcatctgactcatttcctcttagcttccatggtctcctttttaagaacaagttgggtgaggtagctatgttcacttcaacaacctcagtgagtcactaccacaatgggggcagggacagagtgcttctcctctcctaaaatgggagatgagaaactctcccataagggtctatatatacagctgctagagatctgtatagcagagaatacattcaactttttcaagacctggaaaaaacacttttttttttttttgagatggagtttcactcttgttgcccaagctggagtgcaatggcacgatattggctcactgcaacctctgcctcccaggttcaagggattctcctgcctcagcctcctgagtagctgggattacaagcatgcaccaccatgcctggctaattttttgtgtttttagtagaaacggtgtttcaccatattagccaggctggtctcgaactcctgacctcaggtgatctgcctgcctcggcctcccaaagtgttgggattacaggcttgagccaccgtgcctggccaaacactcctttaaatactggcttatggtcaactttcagccttggtttctaatactgttatatttgccctttggtatttcttcatgtaaaacctaacaggtaatcaatatttttaaatgtgaatttgaagtctagagtgggcaaacagtactactctgccatcctgttaacctgggattaatttcattcttggaacataatgtatatatctgaatattcatgaagtagtacattttacactctactctctggggtgatcgggttgtttgaaggagacaatggaatcgtgtaatacaattggaagatgccccagaaaggtgagtgaaactgcgagttgccgcaggatcgtgttttgggagtagagcagagaggtcaccacctccttggggtgggcctcagctttgcagaccagattcctcaggtttcctggaattaccaaaaccaagacaccaacccaggtgggcactgattagcacatcgcaggaaatccccaacggccgtagttacctctggggagaaaaggaacgatgaggagtggggatgggctttacctgcacctataatattttatttgttaagaaacaaagagtggctggcgcagtggctcacgcctgtaatcccagcactttgggagtccgaggtgggccgatcacctgaggtcaggagttcgagaccaacctggccaacacggtgaaaccccgtctctactaagaatacaaaaattagctaggcatggtggcatgtgcctgtaatctcagctactagggaggctgaggcaggagaattccttgaacctgggaggtggaggttgcagtgagccaagatggcaccattgcactccagctgggcaacaacagagaaactccatctaaaaaaaaaaaaaatgagtgctctaaagcaaatatagcaacatgttgacacctgttcatttgggttgtttgtaaattattttttatacctgtctgtatgtttgaaatgactcataattgaatattaatttttaagagaaaaggctaaaaagaaagataatatattacaattagtggctgtctttgaatagtagaattgtttttttccctccttccaaattttcaatattttccaaaattttgatattgagtctctgttacttttataattaggagaacaacaagctccatttgaattaggcatatcaccaatcagccgagatcaatagaaacgtactgaggaggaaaatggatcaaggatgatgctgataaaatggcaaatgacgaagcataaaatgtggttaagtctcattactttgtattttacttattctgaattagttagtgggcagttgggttggccttgcatggttggtggagagaaaagactgctgagcactaggtgggattgtacttttaatgcttattctattctggagtcccaccatacacttcctataggcaagggacgtgttttctacatattcagtttctccttctgttttggggatttctgggccctcaactgtctgacaacacgcacctgttgaaggaatgattaagcaaaaaaaagaaaaaagaaaaaaaggtaagcaaaattgcagggaggcagagagattctcaatctacttaagagaacaaactcttttaacagctgttagctcattaagtgttgaaatgtaaatattgtagctaattaaatacagctttatttattcattttggcaagacccagctgaacataaattatacaggatacatttttaatgaataaaagagctttaaaaaaaacctatgtttttgctaacactggctgacctttttccaattagcgtgaattgtcatcaagcctcatttccccggtatctgtagcctgtagggctttctcaaacaaaaactggacacaaccagccctccacctactccagacctgcacccacacagctgaatgtgactgggaaaaagcatcaagttgccacctccaggccgggcaccacagctcactcctgtaatcccagtgctttgggaggctgagtcaggaggatcactcgaggccaggaaagtttgtgaccagcttgtacaaccgagtaagaccccatctctacaaaaaataaaaactccttgctgttcctggactgcctcctgcctgcccccactcccaccaccagatggctcctcctcaggacatcgcaccttctgttcccactcctggaatactcttccatcatttactcttctctagtttcccatgaatcactctcctctggtttcccatcactcactctccactcttatgttttttttcaaatatcaccttttcagagagattctcagatttatataaatgtcagctcccctgttctccacatggcctgttgtccttcccagatctgctttttaccataatatatttcatcttccaccatggtctcgatcaggaccatccacagaactttctgccatgatggaaatgatcattccgtactgtccaacacggtagccactggctacatgtgtctactaggcacttgaaaatgcctaacgcaataagataacttttaatgttatttagttttaatgaatttaagttcagtttaaataaccatatgtagctcagggctactgtgttggacatagtaggtctatcattgatttatccccttgctagtttattcagaggttgactgtttgcacatttgatcttcctgaaaataatacccctgattgacttatccccatcactagcatgcaccctccataagggcagatgtttttcctgcacctgacacatagtaggtgttcagtaagtgagtcaatgccctttaactcaagtttatcattttaagagccagagtgttttcattctaaacattttcagaaattattctaagctctgcagaatctgtccttattttaacttagtaccagaatgtattgtttccttgcaatttcaatgtcgcttttctgtacataacttgttatgttgtaataaattgtgtcctcagagacggttaatgtcattccttcaacaactgcacagattgctgggtttttattgtctactaaatgactgtttatcattaactttttcttatgtctgtctctattatatgctttatttacttttctttctttttttctttttttttttgagatacagtctcattctgttgcccaggctggagtgcagtggtgtgatctcaggtcactgcaacctctgcctcccgggttcaagcgattctcctacctcagcctcctgaggagctgtgactacgggcatgtgccaccatgcccagctaattttagtatttttagtagagacagggtttcaccatgttggccaggctgacctcgaactcttgagctcaagccatcctcccgccttagccttccaaagtgctgagattacaagcatgagccacggcgcccggccgtgctttatttttccatggaaatgactgggtaaggtttgaaggtacttccattctcccacatagttaaacacacaaagtttgtgacaattttttttttttttttttttgagatggagtctcaccctgtcacccagtctggagtgcagtggcgcgatcttggctcattgcagcctttgcctcccggattcaagcgattctcctgcctcagcgtcttgagtagctaggattacaggcacccaccaccacgcctggctaatttttttatttttagtagagacagggtttcaccacgttggccagccaggcaggtctcgaactactgacctcaggtaatctgtctgtctcaggctcccaaagtgctgggattacaggtgtgagccaccacgcccagccgaaaatttttttttgtggacacattcatggtctgttcagagagactggttgcctatacatacagtcatcatgaaaataatatcagaaataataaagaaggcagttattgctatttccctttataaattggaccacgaaaataaaaggtttgaaacctaaagccattgagctagaattaaaacccagtgttttcctctgagtccaatgttctcatctaacccagttcttctcaaaagcgtagtgcataaatcatttactaaaaatcatctgctttcgactcaaagttgctcaagaaaaaaataaaagtaaaaacaaaaaaaatcacctgcagtgcttgtttaaaacaaacatccctgggctacccaccagacctacgtgggcagaatcttggggccaggccccaaaaatctgtagttttaacgcactgcagagtttgagacccactgtgctaagtttactttctgaagacttgacactaccttgagcttttattctacaggggaaaaatgacactattttcattggctcccaaatcataaacttataacaactattctgttgcaaaccaaatgaggattttaagccttgatatatacattcaactaacctgaccataagtagagatatgatcagtaaaaaatgtatttcagtaatagattataggtcaaaaaatacttctagattcggccaggtgcagtggctcacgcctgtaatcccagcactttgggaggctgaggcgggtggatcacttgagatcgggagtttgagaacagcccagccaacatggtgacatcccatctctactaaaaatacaaaaattagctgggcgtggtggtgggcacctgtagtaccagctatttggaaggctgagatatgagaatcgctagaacttgggaggtagaggttgcagtgagctgagatctcaccactgcactccagcctgggtgacagcgagactctgtctcaaacattaaaaaaaaaaaaaaaaaaaaaaaatctagattccctcaccgtgtcttaggaacagaaagattcatccatcaagtattaagacctaagaggataccattgctacaatgtagggctaatctcagaaaatctaaaaggtgattattctatgcaataaagaaggtcatttgcagcaaaagcaaatgcacgtgtccttttgctaggttcacattcttcattctctagtttgggttccagagcacggaatgactttgtgatttaaagccacacttgcagcgtggactgggactggctttgaatattagtgttgtgtatactcaccagccactacagtaattgggtctagaatacaagaaaacaactttatttttctgtgattccccggggctagttctggcaagaagaaattctggcagagcttttgcttctgcagtgattccagggacttcgagtgagacaagactggtctagggcaaataagggtacaaaggggaggccaacgagagaaacggccagagtgggaactcaggagccgagtccagcagggccgagcacatagttggaagggctttatgtgtcttggggtgggtaaaggatcagtaaaatggctgggtactgtgatccatgcctgtaatcccagcactttgggaggccgaggtgggcggatcacttgaggtcacgagttcaagacgagcctggccaacatggcaaaaccccgtctctactaaaaatacaaaaattagctgagtgtgggggtgcatgcttataatcccagatcctcagggggctgaagcaccagaatcacttgagcctgggaggcagtggttgcagtgagttgagatcataccattgtactccagcctgggtaaaggagactctgtctcaaaaaaaaaaaaaaaaaaaaaaaaaaagaatcagtaagatgagctctctagtgaatggtgtcaccagctgtgtcagcagatgggcaaatgcaaggagccatgcaggagaccagagacctgacagaactgggacaaaccaccctgaagtatgggtcacacccaagtttgccaccagataccagggatcagtttacagggaaacctggatttctaggcaggaactgcagtccaggaaagccgtggggtgaagagcagtaaatcattttgcagattgggaaaacatggtagaatgccaacttttgatggcactgtgtgtgcttaactctgatataatgaagccagtaattgagggtctgggtcatggggcatagtcatcaattatgagtctgtggcaggaggtcatggcaggaagccagaccctaggaccctgatactggggactgtggtagaataacatgccccagatcctctgctcagccatcatctaccatcaggagctatgtatctggagaataggtgaataagaagccacctgtcactgtctttctaaagtgaaaaagaggtggggtaagggggcccagctaggttcttatactacacactagacagactcaaattccaggaactccatattggtctgtgttattgggagactccatggggagaactttaaaagtggtctgttggcacttttgttatttcctgctcagtccaccatggtgagaaaaaggtagtgctcacagaccatggtcagtagcaaagtgtccctgaccatgagcacaagttcaaggccagcagtcaagaggagacctcaccccaacctccacagaaacctatttatcagatgagaggtttggggcatttggccaagaaaccacacaagtgactccctctgcttcatggtaggttatgttttgacagttaacagggaaagaaaaaaaaatagccttgctatggtgtgaaaatggtttgtctccaccaaaagtcatgttagaatttgattcctaaagtaatggtgttgagaggtagtagaacctttaagagatgtttgggtcatgatggcgccatcatgaagggcatatgccactcttgtgacactgggttagttctcgtgggagtgagtgagttcttgctcttgcaggattggattagttgcctttagagtgggttgttataaagcaaggtcactcctcgtgtgttggccctttcacatgcactcacttgcatttttccatcgtgttacaaaactttgtgccagaagctgccaccaagcttttggacttcccagcctccagaaccatgagccaaataaacttttcttgataaattatccagtctcagctattctgttatagcaacagaaaacagactaggacaagtctttttataaaaaattccataaatgagggtatagagctaacttttattgattctttgtaatacatgatctcttacttggtaagggggggagaatgtgatttagagaggaatgaccccgggtgtcctcccctccactccaactaacctaaatgaatctacataatgtgtttagaaaacacagtaaaagttcaataaatgctagccatttttcttacccaaagttgcccaggttgcaagtggcagaacaaatattgggacccagacttctctgagacagaaactaatgctccgacccaccacattattactgttatcaatgattaccttttatctgtcgtttggtttagttgggatggtaaaagatgaaagagctccaataattaggtgtgcaggcatttgtgttttagcttatcagacttacgttgtgttcagataacttacctaagcaatcaattagaacccttgtttctttgtttttgttttttaaagaaaactgatgaaaccagaaattgattgtgataggaatttgtgtttcttcttgctacagcataagagcaacacattaaagaaaaaaaaccatataaatatcaatagacgctggaaagacatatggtaaaaatcaacagccattcctaataaaaatcttaattataacagggctagaaggaaaccacttaaatgtattaaagaccaccaagcccaatagtaaatgttattctaaatgttgaaaaagtaaagctgttttgaattgagtcaggaactagaccggtgcatttgcttttgctattatttttccacattgtttacaggttctagtgaatgcagcaaaacaaaagagagtataaacatagaaagaagaaaattatcttctcattaaaaatgtcactgcaaaaaattacaaaccacttgaataaataagataatttaataaagtggctacatataagataaatatttagtttatataatagcttttttctctaattgggtaacaaaaatctagaaatggaatagaaaaagtacttaactcaatataatgacctcaaactataaattatttatgaatacatttggcgagaaagtcagaagacctttataaaaaaaaaacgatggagaaataaaaagacattttgtattctcagatataaacacttaatgtcacaaaaatgccagttatcctaatgttaatatataatttattgcaatgccccattggaaccacagactgttttaatggaatggaatttatgttcatttgaaagaacaaatacatgcccatgaataggcgagaaagtccgaaataaaacactgatgaggggcattgattttatgacagtcaatatacaagcatctagtagaaagccattttgccatagtggtagtcaaatgtcagcatgcatcaggatttgctggaggacttgttaaaacacggaagaccaggcctcacccagaatttctgtttcagtaagtctggagtggagcccaagattttgcatttctaacaagttcccaggtgacgctgatggtggctgctgggctaaggaatactctcaaatcaatatagtgttgaccaaaaagaagacaaaccagtagactagactagaaaagccaggaattagcctagtataagttaagtatttaagaaatgacaaaggatgtccatgaggtaccactgggtaagaaaagtaagatgtataaaagtttgtataatgtgggccaggcacagcggtgcatgcctgtaatcccagctacttgggaggtggaggcaggagaattgcctgaacccaggaggcagaggttgcagtgagctgagatcatgccattgcactccagcctgggcaacagagtgagaccctgtctcaaaaaaaaaaaaaagtataatgtggtttcataggaaatgcaaaattagtttctcatggaccagctgggccctatgagacagctggtacagggctgtctgaaggaccacttaagagggaacatcagaccagaccccagtgcaaaggagctacaggtatgacagaatccctaaaagccggaggagaaggaagtgaacagctgaaatggaagtggattttacctgacatgaacaccacaggtgagtgatattgaccaatgtagagtgtgggaggtccttgaaaacacaaaaatgcccatgaaatgtgagaaagaggtggctttaaccatctgccacgtccagagagctgggacactacatcatcacaatagtaatgattacaactgtgccagtcaaaaggaatgacccctgctgtccttccctccacgccaagcctgaattcctggtgacccagagaccacagccgtggagctccaagaggagcagaagaatcaggtgagaagagagaaccaaatcaaccaagtcccttcccacaacctgggtcagggatggggtgctgggacagtgacttccaatggaacttgcagttttgacgatggcagtgaactgaggacttatgggacctcaagtgaccatagcacagaacatttttattgtctaagagtgagtagaaaaatctgcctgtgtttttacctgatggcagagaaagaataaaattaagggacatggacagacaaaaacagagttgctttattccaagagtgtatttcttcaatttaagagttacataagaccataaaatatttaaataaattgccattgaaaaacaactgagatatgtttttttctccccatgagaagatgattatctctgtcctctgagtagggaactccagattttgggggctactaacagctgcagagtttcaacaccctagatagaatggtctggcacctagaagataagcctacttacatctccctccaaaagattttgtgcaagaggcgaagacttgtttaaaggaggggagataaactcttgctgagagtggaaaggcagaaatggtctcctgtgaggtggaggcttcccttccagaggctgagaaagagcagagattgtggggtttctgaaagttgtagagacctgtcccctcctgttgttacttccccagctgggctgagtgcaggatagctgtctggcagaccagttttttctcaggcttagagactaaatggaaaagatactctgaagagctccagggtccaaggatggcagagaggaaaactatcagcatctttctaaagcaaagggcaagagggtaaccatggcaacctgcaaagaaggaccaaaaggaccctcctgggctccaggtaccactctgatgcttacgtgcctcacagagatggaaagaggctcctcaaacatgactgagaaggagtttctcaccactgtggtgagggagattgtgagctagattaactctgaattaataagccactctggaacacaaaatatttggagtatatccatctatgctctggacagacatctaggtactgtaagccaaatccttgaaaaaacagaggttaggctgggcatggtggctcatgtctgtaatcccagcaacttttggaggctgaggcaggaagatcattaaagcccgggagtttgaggctatagtgagctacgattgtgccactaccctccagcctgggtgatggagcaggatactgtctcaaaaaacaaaaacaaaaatggaggttagagattttcacattctcaaacaattgctcaaggttgattagtttgatccttcaattgagctcatcaacctaaagtgaaagagggaaagaaattaacttgacacagtgctaattctccatgtgatagcattctcccagggttgaagctatgtcctcttccagcttgcattttgcttcaggaagactataattacaacatcactacctcttgcatgaactttcccttgctctctgtggctgtgtgtctcaggctgcccttgaaatccaagaattgcccaaggcttagcccatctctactggcttccttcccttcccctctcttgccttttctttcccccttctcttttcttctatgtttaggggatcctatctggttctatgctgatgacctttgcatttatttctttaatccaatctctcccccgaattctagacttttatatacaactgcttacgaaacatctccatttgggcatctaaggaccatttcaaacttaagttcaaaatgtagttcttaagccctctccctctctaaaaatagaaaaataaataagttaaataactaacaataaaatccccagactcttccctccctttgtatttcagtaatgggaattccacagttgctccagttacttgctatttgtcaggagttatcttccctaccacttttcctcgcattccttccatctagttgtgatggtgaatattgagtgccaacttgtttggattgacgcatgcaaagtattattcctggctgtgtctgtgaggatgttgccaaaggagattaacatttgggtcagtggactgggagaggcagatccaccctcaatctgggtgggcaccatctaatcagctacctgcacagccagaataaagcaggcagaaggacatggaaggacttgacttgctgagtcttccggaattcatctttctcccgtgctggatgcttcctgcccttgaacatcagactccaaattcttcagcttttggactcttggacttacaccagtggtttgccaggggctctcaggccttttggccacagactgaaggctgcactgttgacttctctacttttgaggttttgggactgggactggcttccttgctcctcagcttacagatggcctattgtgggacttcaccttgtgattgtctgggtcaattctccttaataagctccccttcatatatacatctatcctattagttctgtccgtctagaaaaccccaacacatacactagcttatcagcaagttctatggtcttcacctttgaaatagcccagtcctggcaccttctcattgtcccatcatcacttctctctaactggtctccattccccaacttctccctctttgggttatcttctaccaagaagccacaatgttgatataaacatgcaaattggatcacagttgtcctttgctcaaaatgtttccaaggcattgattcacgctccgattagagctcaacagccttacctagggtaaggctctgcaaggctatcccgggctctccatgatttgacctttgtatcagggtcccagtgctgctattccaaattaccatacacttagtggcttacaacacaaatttattcttttatagctttggaggccatagctgagcacagtggctcatgcctgtaatcccagcactttgggagacgtaggtgggaggattgcttgaggccaggagtttgaggtcagcctaagcaatgtagcaataccctatatttacaaaaaaaaaaaaaattagccacatgtggtggtatatgcctgtagtcccagctacttgggaggctgggataggaggatcacttgagcccaggagttagaggctacagtgagctgattgtgctactggactccagcctgacagagtcagaccctgtctcttaaaaaaaaaattggaggttagaagtataaaatcaaggcatcagcaggatcacgttccttctggaagctctaaggcagaatccatttcctcgcttctttcagcatcttgaggctgcctgcatcccttggctcatgggcccatccctctatcttcaaagccagcagtgttgcatctcctgttctctctgacctctgcttttgttctcacgtcttctctctatctacctggccctcctgccttcctcttatgaagacccttgtgattacactggggccactttggtaatccagaagaatctctccttctcaaggcctttaatcacatcggcaaatttcctctactgtgtaagacagcatagtctcaggtccaggggttacgacatggacatcttggaagggccatgattcagcccaccacacctgcttaaattagctctaaccttgtctctgaatacctgcgttagcactgtggctttagccacactagccatcttgcaaatcctggatacatgaagtttgttctagataactgctatcctctcagagaggccttcccctttgcatccaatttagaatagtcttcccccaatactttattcccttgtcctacttaaaaaaaaaaacaactttttaagagatggggtcttgctatgttgcccaggctggagtacaatggcacaatcatagctcacttcagcctccaactcctgggctcaagtgatcctcctgcctcagcctctggagtagctgggactatgggcatgccaccatgcccatctaatttgtgtgtgtgtgtgtgtgtgtgtgtgtgtgtgtgtgtgtgtgtttgtaaagacagtgtctcattatgttgcccaggctggtctcaaactactggcttcaagcaatccctccacctccacctccaaagtttccaggattacaggcatgagccgccacacccagcctcatcttactttacctttgatagcacttattattgacctactatatatttatttgtgcattttccctctatcacatgaaatactatgaggatagtgatatatatatctatagctctatatctatataaatctatccatctatacacatatacacacatgcacacacacacattttgtttgttcactgttgtgtcatcagtatccagaagagtttgtggcacaaaataagtactcagaagtatttggtgctgtatgaataactgaatgaacaattattcattattctaggtttggaaggcctagatgggaggatcgcttgaagccaggggtttgagaccagcataaacaacataatgagatcccatctttacaaaaaccaaaaatggtgggggatgtcttcagagcctcagaactcagtagcattttaagctcctaagctgtaagtcactccgtttctcttcttcccacttcttgttaggaacataatgagcaggaagtaataatgagcaggaataaggagttaggaacataatgagcaggaagtgtggaggagaagggcaactccaccttgcatgctaatccaccatactgactcacggttaaccctgttcctggaatgcctctaagacttccagtgtatctactgctccttgtgtaagagcaggtgcttactgtaaatcccgcccttaggtcaaacaaccttgatgtgatcgtatttcaattaccttacccatcccttctgaactgtcctttccctgtggtatataatcgctgggtcttgagggtattggcatgagatttaccatcttgtttcaccgctgcccaagacacatacatggcttctatttatatgtctccattaaatgtttcctcctgagaaactggatatatcagcctctttccttccttcctttctttctttgacagagtctctctgttgccaggttggagtgaagtggcgcgatcttggctcactgcaatctccgcctcccaggttcaagcgattttcctgcctcagcctcccgagtagctgggactacaggtgtgcgccaccacgcccagctaattttttgtatttttaataaagacgaggtttcaccatgttggccaggatggtcttgatctcctgacctcatgatctgtccccctcggcctcccaaagtgctgggattacaggtgtgagccactgtgcccggccatatcagcctctttggttagcctctcagcttcctgggacttttggggatgggtttgcatagacccgcccaccttgaaacatacgccttaagcaacttccacatgcagtcctggaggaggtccagaatcttggggggtgtaagctgcctgtttcccttccttccatcaaaacactggacagggcggacacatcatcctatctgaatactgtgaaaatcaatggaatacgaaacccaacagaagccacagaccctgaggctgggggcgatgatcactgaaccatgaggtcaccatattccagcttgggccagatcgatctctcggtggtggtgatggtttacactgggaacagtcaccttttaaaaataatactgaggactaaactctgattcttttaaatcttgcgcaaattcccagttaaggggtctggggattcatgccctacaaatcataaattctaatcagatgggttttatttaaacttatatatcatgatttactttccaacccgactctggcataatattacacaacaaggaatcaaaatattttaccccgaaacctgtttctttgccatattttgaaatggtcctgcaaagttgttctttgtgggggaaaatctgcatctataataatctctattaacgtagctagatctttttcttccagacctacccaatcctaaaaagattaactaaaatttgaataggaaaacttgtcatctattgtctctaagggaagccactgtaagacttcaaaagaactttggtctctgcaatctttatcttaacctgaacattccctttctatcaattccaggtctttagacaaactcaacaaattgtcaaccagaaaatgtcaaaacttcacctatagcctggaagctccctgcccgctccgctttgagttgtcctgcctttctggaccaaaccaatgttatttcttttttcttttttttgagacggagtcttgctctgtcgcccaggctgctctgcagtggtgtgatctcggctcactgcaacctctgcctcccaggttcacaccattctcttgcctcagcctcccgagtagctgggactacaggcgcctgccaccacacctggctaatttttttgtatttttagtagagatggggtttcaccatgttagccaggatggtcttgatctcctgatatcgtgatccgcccacctcggcctcccgaagtgctgggattacaggcgtgagccaccgcccccagccgccaatgttatttcttaaatgtatttgattgatgtctcctgcccctttaagatgtataaaacaaagctgcacccggaccaccgtgggcacatgttctcaggacctcctgaaagctgtgttcactcatatttgactcagaataaatctcttctaatattttacagagtttgactcttttcatccacaatattgtctttcttttgggagtgagttctgttgggacagaatgagcaaacagaattgctgaggttagcacataaactacaaaccaaacaaataaacaagagtgagacgcgctgaccacgagcagacagatttgccaaatgtttctgactattatacatccccagctctctcttcctgtggttctattttcatcctttcccctctttggggagaaattcacaggagtcttgcaaaccttgctgtacagcctgcaaatcaggaaggaaccacaaaagtaacaaattcatttccgtagtaacaggctcaggaccatcctggctgccagtacaatgagccgatttaattccttcccaacaaacatatccaccattttaacatgtgaatggcagaagaaagttaatctgaggggtctagagaagatagctggctgaaaaattcagggtgggttccaagtcccagcgaagaatccagcacactgttaacacaaatccaaaagacagttgtaagttttctctgctttgaaaggagtgattcatcatttcacagtgacatacaaagcccttgccccaccgccgcaaggcgaacatctcctttgaaagcttcattgttaaatccagcagggtccttaggacagctcaaagtcacagcagcccaagttggaataggctggcctgaagtgccctggaagggattttcggcagatcctgcctttcccttcagtgtccaatgcttcagccactgccacgcccccttagcatgtcactcacgtctttctgttgaaaggaatcaggataaagcttcatgtgctctttcattcatgcaagagtctgcggtcaattattgcaagccttccggctgggcatggtggctcatgcctgtaatcccagcactttgggaggcgaagacaggcagatcatctgaggtcaggagttcgagaccagcctggttaacatgatgaaatcctttctctactagaaatacaaaaattagccaggcttggtggtgggcgcctgtaatcccagctacttgggaggctgaggcataagaatcacttgaatctgggaggcggaggttgcagtgagcagagatcgcaccactgcactccagcctggacaacaaaagtgagactccatctcaaaaaaaaaaaaaaaaaaatattgcatgccttctatgttatggggtagcattctgcaatgaggatccaagctgagaaatggtgttcgctgctgaagaattcacattctactggggcacagagacatgccctgaaaccataaaaatgggggcatagcaaaataggattaggtacaaagtgctgtgagaacttaggggagagagtgcctaccttagttgaaggaaccatgagctgcatcgtagagggtgagtgagattttgctaagggaaaattctgaacggaggaaagtctaaataatgttgcaaatgtgtgaaggtgtaaggaggatggcacggttggggagcgccgagggattttgtgcggtaggggtgggggtgtcaggaggagatctgtgaggttggcaagacggatacagttctgctcatcaggatcttgaaactcatactcaagtgtttgggcttgatctgtaaagtcaagtgcaccaggcacacaccacggatggttttagctggcaagtccataattatgcttttgttttttgagatggagtttcgctcttgttgcccaggctggcatgcaatggtacaatctcggcttaccgcaacctccacttcctgggttcaagcaattctcctgcctcagcctcccaagtatctggaattacaggcatgcgtcaccacgcctggctaattttgtatttttagtagagacggggtttctccatgttggtggtcaggctagtcttgaacccccccacttcaggtgatccacccgcctcggcctcccaaagtgctgggattacaggcatgagccactgcacctagcccatgattatgtttatagttttggaaaagagctctggtagcaaacatagggggagggagattagagcgggggtctctgcaaaagtcaaagcaagaggtcatcaaggtgtgaattgaggcagccacagtgcaggagagaggaggcaatgcaagtaaaacatgctcagggatgtagagttagcagagtctggcaaaggctggagatggagggtgagaaggaggagagcaggtggacaaggcttactttgaattacacagtgaatgctgctaccgagaatgtgtgtgcaaaatgtgttgcaataaatgatggcggcttgggtgttgcgggcttggagggcatgattcgttcaacctgggacccgcggagtttgacatgtctgtagggcaactggtgcatatgtgcattaaacttgcaaccatggcactaaagttttgaaatgagtctgggcgtagaaagagagctgcgaggatcatagggaagtctgggataaaagcataggatggaataagacctcccagagtttgggggcaatgtaatataagaagagggctaaggagtagggtctggggaacaaaaatgcttaagatgctggaagaagaagagaaggctgagaaagaacagtcaaacaattttggctaactgggaacaaaaagcatctgaaaaaccaacgggctgctaatgggcgtgggtttattttggggggagatgaaaatgttctaaaatcgactgtagggatgactgcagaactctatgaatatactgaaaaccgctgacttgtgcactaaaagtgggcgattgtatggtttgtggattgtatctccatgaagccattatcgagagagagagagaaagacattttttcttaaaaaaaaaaaaaaaagcaaaaaaacaaaaaaacaaaacaaaacaaaaaagcaatgaatacctatgtccaatacagccaaaggtcaataaagaaacggctaaaaagtagtctttgatgttgctaattaggacagtagcgttgatctcagggaaggaggcatcaataaagtgaagggaacagaaagcatatggcaataggttgggtgagaagggagttagtcgtttctagggtaggtcggtggttaacaatcacaggcagagttcggagctggtagtgaggaagtggaaaggaggtggtggcaagaggggtgacgtgatggggcccattcctagaggagaaaggggaggagggcaggggacccagagcttggggtggggtgctttgggcagaaggagacaccatgatgccactgagtttggcaaatgaggcaaaagaatgaacaatgttcaccttcgatgttcccttttgttcacaatgtaggaatccaggccaccgctgaggagggaagccgcagtgtggtgaggagatcaggaaaggtaggaacaacttggggtaccagctacacagaacagaaaatgtacaggctggggacaggtgcaggaactgcaccccagtgcccaggacccaggtgcgatgtgagatcaggtgtcttagttccttctggctgctacaacaaaatatcataaactgggtagattctaaacaactgacatttacttctcacagctctggagactgggaagtccaagatcaaggcatcagcagatttggtgtctgatgacctggttcctagatggcaccttcttcctgcgtcctcatgtggtggaaggcaagctcccttggggctcttttatttatttattttaagaaacataacattttaatagatgaaataaatactccagtacatgcaaggtaaaaacttgacgttggggcaaaaaaaaatcactctatagtgtaaattaaaaaataaaacacatgctcacagtagcttccccccatttgcaaatcactggggctcttttataaaaacaccagtctcattcatgaggactccaccttcatgacctaaccacatcccgaaaggccccgcctccaaatcatgaccttgaaggaggttagggtctcaacctatgaataaggggggacacggatattccaaccccacaccatggatttgtgattgtgttgaaaagaatttgagccacttggctgggcacggtggctcaagcctgtaatcccagcactttgggaggctgaggtgggcagatcacctgaggtcaggagttcaagaccagcctggccaacatggcgaaaccctgtctctactaaaaatacaaaacttagccatatgtggtggcacacgcctgtaatcctagctctgtaatcctactctggaggctgaggcaggagaatcatttgaacctgggaggcagagggtgcagtgtgccgagattgcactactgcacaccagcctgggtgacagatctagactctgtctcggaaaaaaaaaaaaaaaagaattggtcactttagagtgtaaattctcagagaaacacaacagtggctgattttgaggttatttgagttgaatccccttccattccctgaatgagagcaatgagaatgagaacagagcttttatttatttatttttttggagacaaggtctcactatgtcactcaggctgaagtgcagtggcacaatcatagctctctgcagcctcaaactcctgggctcaggcgatcctcccgcctcagcctcccaaatagctgggactacaggtatgctactgcacccagctgagaacagaatttttaggaacagaacccaagacgggcacatcagccatgacaaatggtgccttggaagttgctatgctctggagccattacttgtttataaggtgtgggactagtccatgttctccaaccagactgtgacataaaacactcatcttcccttccctcctttccaaacagttcctgggcttctgattccctctttctctctccatactgtgttcctcctttattctagcaatactttgttaaagtctttaaagacctttcattacagtagcaacacatgctcatataaaatagaaaaaattattaagaagaaaaaaaattatccataatattttatctagacataactactgatagtatttggtatatctctttccaatatctttccatgcacctatacctatatacctatacctacatgcacctatgttttaacattgttaaggtcaaatgtgcaattttgttttctagctttttttttttttttttgagatggtgtcttactctgttgcccagactggagtgcagtggtgcagttatggctcactgcagccggaaactccccaggttcagatgatcctcccacttcagcctcctgagtagctgagactacaggcatgcaccaccacgcccagctcatttttgtatgtttggtagagacagggctttgctattttgttcagcctagttgcgaactcctgggctcaagcaatccacccacctcagcctcccaaagtgctgggattacagatgtgagccaccatgcctggccttgtttcctaactttcaacctaaatgtctaccctttaaaaaccttctcctagttattaaatctaattgtaaacacaattttcatggctgtataatattcgacatacagatataccataacataggaacattcttgtgttcttagtttgtttcgatttttattgtattaaaaatgcgacaaaagcaaaggaactctaatttttgtccacagctcttgcttcctagaaatcgaactattagttcaagtcaccatgaatattttaaagattctggatacctgcttcccaattgcttttcagaaggctcattattcttctggacttactcgacacaagtcatgttcaagggagccttgttccaacttccatggtgctttctccagaagctgcctatcaaactggttaagagcagggactctggagcagaattatttatcctagactcccacctctgccacggctgttgtctttcgggaagctacttagctttttggtgcctccattttcccatcaataaaatgggaggataatgacagtgcctattacatagggttcttgagagaactaaaagtatcagaatttgtaaagtgctttcctagcatataacaagtgctatatgccgggcatgatggctcacgcctgtaatcccagcacttcgggaagccaaagtgggcagatcacttgaagtcaggagttcgagaccagtctggctaacatggtgaagccccgtctctactaaaaatacaaaaattagctgggcatggtggctcacgcctgtaatcccagctactctggagtctgaggcagaagaatcgcttgaacctgggaggcagaggttgcagtgaaccaagattgccccactgcactccagcctgggcaacagagtgagactccgtctcaaaaataaataaataaaaaaaaaaataacaagtgctatgtatgtgtttgttaaattaaattgattatatagactagaagcttgagggcagagactatatcatgcctgtctcggtattcagagctcccagcttggtgactggcacacaggtactcaataaataaatgtttattgaagtgcacagaaccttggccacattgaatattttcatcactatttaatatttgctgatttgatagtctgacattgtatcttgtgctaatttatatttcttttaccatgaatgaagtttgatagatttttaaaaaatgattattggccatctatttttctgctttcattcatctgttcctgctttttgcttacctaactattgagattctagtatttttctcataaaataaagatccagggccaggcgcagtggctcacgcctgtaatcccagcactttgggaggccgaggtgggcggattacttgaggccaggagttcgagaccagccttgggcaacaaggcgaaagcccgtctctactaaaaatgcaaaaattagccaggaatggtggtgcccacctgtaatccccgctactcaggagaatcgcttgagcctgggaggcagaggtttcagtgagccgagatcatgctattgcaatcctggatgacagagtgaaactccatttccccccaaaaaaaatccaaattattttcaataattattatagatatttttcctggtttcttgtgtgactttcaatttcatgtatgctgggctttgagagcagagtaaacagaggggcttacaaagccctcctcattcacaggcttgagaaatatctacttctgtctcctttcacattttgtatgttctgagttttgtatgtttctaatagttaaataattaacaaaacagctaactctctacctaataaatgacgtgagaaccacgtcattttttttttggagacaaacttatttttgtctgcatgtcctagcttttaggaagcttaaaatgatcattgaggtgtgatgtgtccaagtaaattacaacttgcaaggctttgaaattgactctgaaaagccaataaaaaggttctgtttaataactcctttctttcattttcttttccttgttcattacgttagataccactgttaacagcccacattttcttgataagctatcttatcctggtggttcaccactgggaaggatcctgcaccctcaggggacatttagcaatgtctagagatatttttggttgtttaccacttggctgggcaaggaacgggggagatcctactggcgtttagtgggtagaggctatggatgctgctaaacaccctgtgatgcacaagaaggcctcccactacaaagaattgtctggcccaaaatgtcaatgatgctgaggtggagaaaccctattttaaactgaagtgtacaatctagttgaaataaggtgcttttggccaggcgtggtggctcatgcctgtaatcccagcactttggggggccgaggcaaggtgagcggatcacttgagcccaggaattgagaccagcctggccaacatggcgaaaccctgtctctactaaaaatacaaaaattagctgggtgtggtggcgtgcacatgtaatcgcagctacttgggaggctgaggatggagattcacttgaacctgagaggtagagattgcagtgagccgagatcacatcactgcactctagcctgggcgacagagcaagactctgtcttgaatacaaagaaaaaaaaaaaagaataaggtgcttctgcaaactctgaggctattctcgggatgtcaagaagaaaatgccgtgagatgaaccattaaggtttcctctgagcctctttagttctgcccattgcaagatttgggcctctctgggaatagaggagctgacatgaaggctaaggaaataatattggtccaaagatcatctcttagagatctgtgtatgttttctctgtgaatcaggcttgtactccttcccatgatgctgcccacctagacatcacacaacttgataaaatctcccaggatttaaaaagcttggcaagactcgttttttatattctgtcacgttcttcaggactcaaactcctatagctactgaaactgggttctgatgccttgtgcctgatgtcctagcacagccagagccctacttgtggagtaacccttagtgatttttagtgcttcctttgtcccatctgatgtctttatttataaacgggtttaattctggacctattatactgttgatttcactgatttaaatactataactttatactgtgttttaatatcccattggccaagtctcacttattccttctatccccactcaaccagaaagacaggatcttgctctgttgcctaggctggagtgcagtggcatgatcacgccaaccaggctgtcacctcagccttctgaattgctgggactacaggcacacgctactatgcctggctaatttttaaattttttttgtagagacggagtctcgttatgttgcccaggttgttctcaaactcctggcctcactcaggtgatcctcccacctcgacctcccagagtggtgggattacaggcatgagccaccatacccagctcaatcaattattttcttcaaggtcttaagtttttattctgtattccagatgagattagaatatatctgccatttcaataaaagttccattggaattttgattcagagcacaatgatctatgcattaatctgaaggaaataaaagaaaaacccgtagtgttatttattttgctttctgagagcatgatatgttttttcacttaaatcaactcttagtttagttttcagtagtttaatttgtatcaattctgtatatttcttattaaggttattcctgtgtgctttatatttttgttgttactagaaatgaagtttccatatttctgactggttattgataagaaaaacagactgcaatgtttgtgttgcattcagctaccttgaatttcattttctttttttggagacagggtcttgctctgttgcccagtctggagtgcagtgatgcagtcttggctcacagcaacctctgcctcctgggctcaagcgagcctctcatctcagcctccccagtagctgagaccacaagggtacatcaccacgtccagctaatatttgtattttttgtacagacgaggttttcctatgttgcccaggctggtctcaaactcctgggcccaagcaatccaccttccttgacctcccaaaatgttgggattacatacatgaaccattgtgcccggccttgaatttcattttcaatttgtgtgtaattttaagtgattctcttgacaattttctctcttttctttttttttgagacagagtctcgctctgttgctcaggctggagtgcagtggcgtgataactttatctcattttaattgttcctcttgttttgatttcatagaattgtctacaactttcagaaaatgttaaataagatgatcgtagttctcattcattcgacaagagtgacatgactcattttgtttctgcttttggtagaagcacctctcatgtatcacctttggctgggctgactttccccactccctggtgaaatttccaattctcttttatggggtctaaattctgatataaatattacattcatgccaggtgcccaacaaaattctctgtaagagttatgacagaatgacaaggtaatatacagaagaacaaaaatgaccgtttaaggaagaaatctgagaagaaaaatgactcctgctagagatgtacctactaaggcatggattccttccagtcattcattagagttcgtgcttgactctagctgagaatgaaagtaatgtggaactatcacttttaatggcaaaaacagcagtgacttttacaccaatctaatggttccatcccatcattaccttagattctaaactaataggagggaggctccaaatgtcaattgttaataaacttggaaccacactggccacagaagtatcttaatgtgcttatttcctgagaataatgatctcagtaggctccctaaaataggagtgggctgccctgtatagtgcctgctgtgcccagaagccaactgaattctacaaagggcaccaattattctgaaaatgacactcacaatacctttccattttaataatatacgctttaatgttttttaaccgtccattcatttgcagttgttgcccagatgaggagggacgtgatttgattggtaatgtcacatttctttgcagggcaccaagcctcatacataatacaaatatctgactatctgtgactacataaactcgacaattgagggctgatttgtcaccaaatatcatctctctttactaattcagtgtgtctctagagaacttctttctttcttacaagctcagcacttcctcatgtttaataaaagattaggtttcccaaaaaatagctgagcaggttaaaatggaatcatgcttacaaggcctgatgcaacagttcccagtttctcactaaaatacttgcgaaagaacaaaaaacaataaacaccgaaattagatgagaatcttatgggaattcacaatgaaaggcctgtgatgctggattcacagacaggataggagggccttgtgtaggtccatcaagcttcctgctcttgagtatgaaaggaaggaggaccaggctttgagaaactctcagtgtgtgtccatctcacataggccctgagagcctcagactgaaccaacagcaaagctgggcacacgtctttgttctgaggcagccagagagctcttagctcctctccacctccactctcattttaacttccttctctgtccatacagagctgcagttccctgatagcattctgctcccaaacagaggagaatggcgagattcctgggaggagggttctcttctgcagagcattgcatgtttgccaaggaggaaaaagaaacgcgctgtggcagaggttttccctatattctacatttttgtgtttcaatgagccaggaaataaggctatgagaagacccccatctcagtctagcagaaacttattggagggtcatttgctaaaaacaaagcaaaacaaaaatccctggaaacttgcaggcagccctggaaatgtgttcatccaccaacacaagagaaagctttatggacctacaaaaggcctcctgtaatatctgtgagtccagcatcacaggcctttcgttgtgaattcctgtaagattcgcatttaattttggtgtttattgttttttgttatttcagaagtattttagtgagaatttgggaactgttgcaccgggacttgtaagcataatttcattttaacctgctcagctatttcttggaaatgtaatcttttattaaacataatattaagtgctgagcttgtaagagagaaagaagggggattctacaaaagggccggttggaagaaccaagcacttgctattctgttggtaaacaccagctcagcacacatttcttcctgtccaaggataaaagaacagaaaacaaaaatttcaccttgagcctctggaaacacaaggtaaagggaagataattgtgactgctcagattaaatatgccatctttgaaatttattttctaatgaaaaggaaggaaattgagcatttccttcttcttcttaacaggatgcagaaagatcctgcaatgggaaatgaggagaggggctggggggaagataatatcaacccaggcctcaaaatatttctgttagtgttcaaatctagtatcccacaaataataaaaaatagtgtggcctatgaagagacaacacattatgaacccaaaccagcaaaaacagcagagaacagaaacagacttggagggaattccaatattgaggctatcagacacagactgtaaagcaatgtggtttacaatgttcatggaagaaaaaaccaagcttgagaatgttgtcaatctagccaaggagtagtgttggaaaaaaacaaaaaacaaaaaaaaaaaaaaaaaaaagagagagagagggagggagggggggggagagagagagagagagagagaatgttggcaatcaattggaaactatcagaaagaacacagacattgcaaataaagaaaaatagttggatcacctgaggtcaggagttcgagaccagcctggccaacatggtgaaaccccgtctctactaaaaatacaaaaattagctgggcatggtggcacttgcctgtagtcccagctactcaggagcctgagacagtagaatcgcttgaacccaggaggcagaggttgcagtgagccgagattgcactactgcactccagcttgggcaacagagtgagactccatctaaaaaaagaaagaaagaaaagaaaatatcccaaaatttaaaactcaatagttgggtgtaacagcagattggacatggctgataaaaggatttaggaactgaaatgtaggtcaaaatgaatactcctgaatgataccggtagaggacagagaatacaagagacataaagcatactgtgagaagatctgacataaggtttattccagagtttcacaaggagaggagatagagaatgaggcagaagcaatatgtgggggcttaaaggctaaaatatacaagccatggtttgaagaagcccaacaaagcccaaggaagacacataaaatgaaatccacaactggacacgtcatagtaaaacttgaaaaatgcaaagacatagcaaaaacctccaaagaggccacagaaaaaataagaagttactcttaaagaagcaatagagagactgatggctgacagattgccctcaagaaatagcatccagatagagaagactcatctcaacaacaatggatacaagaagacactggaataatataatctcatttgaatgagaaagtgactgcttgcttagaaatttattccagaaataaggggcataacttagaaattagaagacaaaattacagttattgaactgtatagaatcatatatccatagaagctaagagactaaggttcaatagggtgaataaaattcagcaaaacccaatgacttctgtaagccaaaatactaaaatataaagaaaaattccattcaccacaaatacacaacttctctctctctctcactctccctcccaggcccctgcagagacatctttttttttttttttttgagacggagtttcactcgtcgcccaggctggagtgtaatggcgcgatctcggctcactgcaacctccacctcctgggttcaagcgattctcctgccgcagcctccccagcagctgggattacaggcatgtgccaccgtgcctggcgaattttgtatttttagtagagatggagtttctccatgttggtcaggctggtctcgaactgccgacctcaggtgatatgcccaccttggcctcccaaagtgctgggattacagacgtgagccaccacgcccggctgagacaccttctataaaatgccaagaaatgctaacaagaaatttatgggatgcttatgaaaaacagtaagcatcaccactgaaatttataaaggaaaaataaatatttagacagggatttcatgttcctgaatggcaaaagcctatatcttaaaggtccttaaagtaatttaataaacatcttgatgatatttattttggaattagaaaaaaaatcactctaaagttcatatgaacaaataaacaggaaagaataatgtgagagggccaggtctccaggtattaaagcatataacatacttcagaataactgataccatgtcgtaacaacaaaatgtcaccatatggatgcatggcatagaatatgtccgtacgtatattaggcacattaagacgtttgattctctggaaaaaaaatgaggtgaaattctcatcacataaataaatgtaagctctagaaggactgaagaatttaatgttactaaatcaaactataagccataaaatttaggcaactatttaactcatcactataagggcaaaaccttttaaatcataaaacccacggagtaaataaaataaaaacttgctagacttgtctactttaaattttttaaactttatcatgtcaaaaataggagaacgaagatgaaaatacaaaggaaaacttgcaaaatagcttccataattgtgacagacaaatttttaacatcctgaatattacggcttttatagatcaataagaaaagcagttaaggtcatagaaaaagaaaatgcaaataactatggttatttttttaaatggctaatttaagacaaagatgtccattttcaccactcctattcaagagggtactggaagtcttagccagagctatctatcaagagaaagaaagacactcaaattggaaaagacaaagtcaaattatctctgtttgctgatgatatgatcttatacctagaaaaccctaaagactctgccaaaagactcctagatttgataaatgaattcagtaaggtttcaggatacaaagtcaatgtagaagaattagtagcagttctatacaccactaacaatcaagctgagaaccaaatcaagaagttattccattaaggcaggcagttagtgaaggaatggggcacaattacttgcaggtggctaagagcaacacaaatggggccaaacaggttagcacaaggaccccagtcagtaacagatgttccagaagggggctagggcagatgtctgtggtcacctgtggttggcaacttccttgctgaaggaggaatgactgttggagggaaagtcccaaaggctgagcaggcatactggcaaaggactgtgtcgttatgctgaactttgctcattttaatagtaaaaaacacaccactgggtggagatttaaaatgctaatgagacatccgacatatgtagtagcatgtacagtaactgtgcacgtgggcccaagagaccatccacaacatgctgagcaacaatgcccattccagccctttcatgaataatcatgtaagactcacataaaaggagtttccccaatgccagtcagcactgtctcattcttgagcagcccaccggacccagctatccgagtgtacttttgctttgcgataaacttctttgcctactcttactttggacttgctctcaaattattttgggtggtgaagtcaagaccctgaaccagtcctctgaaaacactataattaccaaaataataacaataaaatacctagaaatgcatttaacaaaggacatggaagatccttacaagaaaaacactaataaaagaaattttagataacatgaacaaatagaaaaatattccatgctcatggatcaaaagaatctgtatcattggaatgctgcccaaagcaatccacagattcaatacaatccctatcaaagtactaatatcatttttcacagaattaataaaaaacaatcctataattcatatggaaccaaaaaaaaaaaaaaaatagagccagaatagccaaagcaattctaagtaaaaggaacaaagctggaggcatcaacattacctaacttcaaattatactacaaggctgcagtaaccaaaacagaatggtactagtataaaaatagatacacagaccaatggaacagaatagagaacctggaaataaagtaacatacctaaagccaactgatttttgacaaagtcaacaaaaacatatactggggaagggacaccctattcaataaatggttctggaaaaactggagagccatatgcagaaaaatgaaatgaccctctctctcaccatatacaaaagttaactcaagatcgattaaagacttaaatataagacccaaaactatttaaatactagaagaaaaccttcaaaaacctcatctggatgttgactttggcaaagaattcatgactaagacctcaaatgcaacaaaaacaaaaaccaacaaacgggacaatgggacttaattattactaaagagcttttacacagcaaaagaaataattaacagagtgaacaggcagcctgaagaatgggagaaaatatctacaaactctgcatccaacaaaggcctgatatccagaatctacagggaactcaaacaattcaacaagaagataacaagtaaccccattaaaaagtgagcaaaggacatgaacaggctgaggctggagaatggtgtgaacctgggaggcggagcttgcagtgagctgagatggagccactgcactccagcctgggtgacaatgcgagactccgtctcaaaaccaaccaaccaaccaaccaaccaaccaaccaaccaaccaatcaaaaaaaaaaaacatataaatggccaaaactcttatggaaaaaatgttcaacatcactaatcatcagagaaatgcaaattataactacaatgagatactatcttacaccagtcagagtaactattattagtaataaataacagtaaaaaataacaggtattggagaggatgtgaagaaaagcaaatagatggatagaccaatggaacagaatagagaacccaaaaataaagcaacatacctaaagtcaactgagctttgactgttggtgggaatctaaattcatacaacttttatggaaaacagtatggagatttatcaaataactaaaaatagaactaccattcaatccagcaatcctactactgggtatctacccgaaggaaaataaatcattataccaaactatatgtataagttatattcttgtatgtttattgcagcactattcacaatagcaaagatgtgcaattcataaagaagtattgcataaggaaaatgtgctgtatatatattacggaatactactcagccatataaaagaatgaaataatgtctttgacagccatatgggtggaactggaggccattatcctaagtgaaataactcagaaagtcaaatactacatgttctaatttataagagctaaacagtgtatacacatggacatagagagtagaatagtagacattggaagcttggaagggtaggagggtgagaggaaggtgagggatgaaaaattacttaaaaattttttaagtaaaaatttaaaaaaaatttttacttttttttaaaaaaagtaaaaaaattacttaacgggtacaatatactctcttcagattgctacattaaaaagctcagacttcaccactatacaataaaactgcacttttaccctctagatctataataaaatatttaaaaagggctaacttaaatgagaaaccattttttgaaatcacccaattggcaagatttaaaataaattctagtgtttaaagttgcaggcatcacattacctaacttcaaaaaaatactatgaagctatagtaaacaaagcagtatgttattggcataaaaatagacacatagacccaaggaacagaataaaaagcccagaaataaatccacatatttacagccaactgatttttgacaagggtgccaagaacacacaatggggaaagaatagtctcttcaatgaatggtgttgggaaaactggatatctaaatgcagaagaccgaaattagaactttatctcacatcttatacaaaaatcaactcaaaatggattagagacttaaatgtaagacccaaaactatgaatttactatatgaaaacataaatgaaaagcttcatgacattggtctgggcaaagactcttttgggtaagacctcaaaagcacaggcagcaaaagcaaaaacagacaaataggattatatcaaactaaaaagttttatacaggaaaggaaacaacagagtgacaagacaacctacagaatggaggaaaatatttgcaaactatgcatctgataaggggttaatatcccaaaacatataaggaatttaactccattggaagaaaacaaaaaactggattcaaaaataggcaaaagacctgaatagatgattttttcaaaataagacatatgaatagccaataggtatatgaaaaaatgctcaacatcccttatcatcagggacatgcaaatcaaaactgtaatgagatatcatctcaccccagttagaatggctatgatcaaaaggacaaaagataacaaatgtttggaagatggggaaaaaaaggaaacccttataaactgtttgtgggaatgtacattagtgcagccattatggcaaacattatggaggttcctcaaaaaactaaaaatacatctgccctaagacccagcaatcccactactgggtacatgtccagaggaaatgaaatcagtacactgaagagaatctgcactcccttgtttgttacagcagtattcacaattgccaaaatatggaattaatctgtctatcaaaggatgaatgggtaaagaaaatgtagtatatattcccaatggaatactattcagccatgaaaaagaataaaatcttgttatttgcaacaacatggatggaactagaggacattgttaagggaaataagccaggcatagaaagacaaataccaaataatctcacttacatgtgaaatctaaaaatgtttatctcatagaagttgagaatagaatggtggttatcagagactggggtgggtagtggggagaaggagatggggagatactggtgaaagaacacataattacagtttgaaaggagaaataaactcaagagctctatcgtacagcaagctgactatagtcagtgacgatagtattctaaaaaaatgctgagtggacaaatgcattctccacaaaaatgataactatttgaggtcacgcatttgctaattagctacatttaatttatcccacaatgtacgtatacttcaaaacattatgttgcacatggtaaatacatacaatgttacctgtcacttttttttaaatgtaaaaatgagaagagttcatatttctgtggaatgtgtaacaatatacatttatggttttggcttagaattatattttgttgtttttgttcttaatttctttatttgatttatttattgagacggggtcttgctttttctcccaggctggagtgcagtggcgtgatctcagctcactgcaacctctgcctcccaggttcaagcaattctcctgcctcagcctcctgagtagctggaattacaggtgtctgtgaccatgcccaactaatttttgtattttcagtagagacggggttttaacatgttggccgggctggtcttgaactcccgactttgggtgatccgcctgcctcaggttcccaaagtgctaggattacaggtgtgagccatcgtgcctggcctatttatttattttttaaaattatatttcaatagcttttggggtacaagtggctttttgttatatggatgaattatacagtggtgaattctgagacttcagtgtacccatcacctgagtagtgtacattgtacctaatgtgtagttttttttttttttatctctatcccccctcctaccctctaaagtctctaaagtccattatatcactcaactcaggattatattaacttttctgccttctgtcataatgtagtccaaaaagatcagggctttttggacatcctacggaacatctcattgatcctctacatcagtagcatgctaagcttactgagctggataagcaagaaatggattagtcctctggagaccttggcaagacatacgcactccatagagtgggagataaactctataaagattctagggcctgacatgtcagtaaaatgtttaggaatccagtcaccagaggtacctggaatatgtcctctaaagtgaaaaatgcatcattataaaaaaaatctagggtttaacactgtgaaattgtattagtctgttctcacactgccataaagatactacccaagactgggtaatttataaaggaaagaggtttaattgactcacagttccacatggctgaggaggcctcaggaaacttacaattatggaagaaggtgaagaagcaagcaccttcttcacatggtggcaggagagagaagaggaagcaaaagaggaacttgccaaacacttataaaaccattcaatctcatgagaatgaactcactaccacaagaacagcatgggggaaactgaccccatgattgagtcacctcccaccaagttcctccctcaatatctggggattacaattcaagatgagatttgggtagggacacaagcctaaccatataataaatggacactccctatcattgctggaagcagtgtgcttggtgccatctttctggcacgctctggtgatcattcctataaatgtgagacattgtggaatctggcagcagccgggcggaactttccattttccaggctttgggaagtgcaatttagaggtagaccacgtatttcccgggccatgagccagcaggcagtgaggaggagcttagatattgatccagagactccgaatgggtggggagatgcagatggaattcataatttagggagaaatatagtagtcactagagttgcaaaatccagggcaatagggacaggtaaaagtcaggtcagaaaccttggttaggagccaggcagaaagcttggacgggctcattcattgacaaaaatggagcaggcatgacagaccaggcactgggtatcaccgatggtggtaccacttgttactgatggtgacaagcttgatgtagtcaagcaccaacaagcttacactgtagcggggcaaattggacaaccagattttaaaaaccaagcaaatgagcaaacttcaaaataatgcaagttttcatgagaatgatgaaggaaatagatctggcatccagacagagttagggcagggaccctcatttccagaacaaaacagaaagcgaggagtaagactggcagcagccaagggttttgcagttgggttgcccaggtggcaaataggttcacgatgtctgtttttgcaaaatcaaaaacaaaaaggctgcatgtaatgttcaggtctgcagctctgttttacgcatctgggcatctagatgaggaggtttccccacccggttcaggtgacagaggcagggggcagggcctggtgccatcctgcctttttgcagcttgcttgcatccaccctgggccaggtaaagctgactgaacatgggggagccattctctgcatgtggtttgtgtgtgcttcctctggccttttcagctttggataattgaacatttaagtgattgttccacttcataaagtatggtccagggaggcactgtgcaaattgctaaatcaatttacttttaaacagaaatgaggtttaaacacacacacacacacacacacacacacaacttaaggaaggcttgatgtgttccatcgcaagcgtctccagaatgctgcactgctctccctgtgaagtcaatattacagattcctgggctgcaaaccagaaggacaaattgggggccatgtgcacagccgcattatttttctcgtttgcaaaggtcagtgattctccatgcatcaactatgaagcacaccacacagcacctcagcatcagcagaataaagctgtgagtcagaaccgggtttggagctagaaaaagacctggattccaatttcagtccttcccctatgtgattttggagcaaactatttaacttctgggccctgaagtctcttcatggtttaaaagcgataatacctactttgctaggtcttgctgagaattaaatgactttataataacgatagttgccaacctgtatgcagcacttattatgttccaggaacaatgcatagtgccctatctgtgaattctcagatgtagatatccttaggagatgaaaacaattcaattcccattacgcagctggtatttgtaatgtgcagagcacacacttctagttcttccattggtctacaaaatgacttgtcatgcgcttattttgtattcaaaggtgttagatttgatgatatcctgtccccagggacaaaggattaataaaaaatgtgtatgcatatgcgtgtgtgcgcgtggacatgggggcaacgttgaaacaactgctcttttgaatcagaaatgtttcctataccagattattgtggattttaggtctagctttcgggttattgctccaatcatttttacttggttctgttacccttcagacaaatgattttcttctaggcttctcacttcacacctccagtgagctcagatcaaatcctcttttctctgtctgacctcctgaaccctttggtggccccctttgttgcaggcctccacccaaagtcaaccaatttttggtcctcatctcccaaaaatctgaactcctggtattgcaaaacttgaattttcccctatgcttacactatataattctttttaaaatcatgggctttaaaaaaaatttggaattatttttcttccaatttaggctcaattgcaaaacctggagtttggtcaaggaaagctactttcaatgcgaagtgaagacagaacataaatcacaaagttaacgtcgaaaggtttctgagaagcctggagaaagatcaaacctaaaggtgaccctggaagtctggctgggaatagaagataaaaattcctttctttaatttccaaagttcactgattcacgagaaaagtagatatcttaaaaggacacggaaatgcaccaaaaaaaataaacacaacgatgcataactagctgttttaattcaacaccctctctcctgtgcctgacatggtatctctaccatatcctccaaaaagtaaggacaggcaaggactgaagtgtcctccttattgtgaaagggaactgaggtagagcctcctacagtggtcaactcactaacagcttaagctggacaaagccaagtcaatgtgtccacccccagttccaatgagtcaacttggtccattgattcagggcaaatcagggtgttcttaatcttctatccagggatgtcctttcagggatccagggacgtcctttcagggatccagcaacgtcttattgagcacttcaatgtttgttcatgtttcatgtctggaaatataaccttaatgacttctccgtgacattttattgattgattgattgactgacgggcagacaaggtcttgctctgttgcccaggctggagtgcagtggtgcagtcatagctgactgcagcctcaacctcctaggctcaagcgatcttcccacctcagcctcctgagtagctgggacaataggcaggcaccaacacgcccagctgatttttattttttagagatagggtcttgctgtgttgcccaggttggccttgaacttctggcctccggaagtgctggtattacaggcgtgagccactgtgcccagcctgtatgatgtttaattttgagtttctcattgcggcaagccatctttatttgtcgaatgtatttccttgcgataaaatcaggtatgcaaggattcacatatgtttctcatgcaagcacaccatttattcctccttatacaaacacttactggttaaaaaaaaaaagcagactgctaataaaggctttctgtacttcacatggattccaatggattggaagccaatgagccttggaatattagattgttattatccaataataatattctaagtctgggcatctcagattgagagaatgaaattaggcagacactcatctgaacaggtctggtgtacaatgacaggcttccatacctttttgtcatatttgtggtgtttcaagttgcaaggcagatttctccccaagttacacaggggacgtttggtatcacttggtttccattctctgaatactctatagaacactgtccaaaggggatgcatttgtcaggactgttgagttatgccattggttctaactaccctgaagtctcaggtgatgataaccccttagagacccagtgtattagtcagttctcacattgctgcaaagatactacctaagactgggtaatttataaagaaaagaagtttaatggactcacagttcagcatggctggggaggcctcccaatcatggtgtaaggtaaaggagaagcaaaggcacatcttacaaggcagcaggcaagagagctttgcaagggaacttccatttataaaaccatcagatctcaagagacttattcactatcacaataacagtatgagtcagttatctccagctggccccacccttgacacatgggaattactacaattcaaggtgagatttggatggggacacagccaaactgtatcacccaggaagacagagattctatcatcttatgatgctgccatatcaacgccagacctgagagtttgccatggtggggaaagatatggagaaccacacagcagctcttaaaggcttccatccccaaaccaacccacatcacttctgcccaagtttcattagccaaatcaagccatacatccacatctaacttccaagggttggggaggacattcctcttacgtgccagaaggcgaggagatcaggaaatattggtgaacaccagtaatgtccgtgcaccaaacgtttgtttgttctggctgtcctgcatccacacctaacagacagatgaaccaagttgggccaactgcaccctctctccagggtatcaaatccactgaagccatgttcatttacctgcaataccaagaaactcactgagtctagagatgaaagtctctctagagacttttgttcttgagtagagttatgtaagaacagagaaaaaaagggcttactcattctagcagattctagcagcctcatcttgctaatcctgtcagttaatttcctcttgtccagtccccctgaagctacccttgtttcctgcaccgtttttttctcagcttgtttctcgaactgtcctatgaacctgggcactaccaataccctcccaatgtattgcttttgtgcttagtattaagactcagtttctgttatttgtgccaaacagtttcccaaacagaaagcaaaagccaaaaagaaaataaacgcccaacagaagcaatttgctaggtgctctgagatatacacacaggtatgaacttgtagggggaggtaggaaaattgggttcctgtctcaggtctgtcacctgtcttgctgtgtgaacttcaacaaacccccaaattcatcagtaaaatcaaagtctgggactagttaatcttcaaagtccttactggcgccagcagacaatgactgtgccattttgggattgctgaaacaagcacaaaccctgtattttggtagctgattgaaacccaaaccaggccccacactttgacaaataacctgccaagtctccacatttgctgagaatcacattagcctaggaaatcacggattgcttatattttacatttcaaatgtgtagagatcttggcattgatctgagggtatgccatcaccctggggattcgtctcagcagcagggctggtattcactgcaaggaaccacgctcggtactcattggatgcctatatactgtgtagtatgtcctttagtttgtttgagaccagttggggtcctttatttgcccgtcagcttagtactcgagaggcagaaggacctgacatttctagaacattgtgatgtactaatatcaataaaagtaaattattattataaaacctcagctctccatctctgattagaacttcaggagctgggcagagagaaaaatcctaagtatgtctgtgcaggtgggtgtacagatgaaaaatgagatgactttccctgtgaataagtttcacctctgattaaaattctgcctagaatgaaagggcgatgtgctaagatatgaatgactcactaaatcagaagggcctctctgtacacattattcttcctgcctttggctgcaataaactctctctcattcttacattgataaaaatggaggttttcaggatatcctgccccgataaagtaacgacgaagatgagtttccatcaggagcatgggtgatccttgtctttcatacacatgaaggggcttcaccaaatcccagaacaccacggtgagaggaatttcaggggtcactgattccataggctatggtcagggggcagtctctgcttgtggataattttttcctctctgcaaagctaactgggtgaaacgggctcaatcctaagatctggacctcttcaatccaggactaactaagtaggacttgcactttaaagcggacctcagtgaacgttagtcttctgtgtgggatgagaagagaaaggcttaagtggccggccaaacagaacggaggtccagctgcctagtgatttcagaagatcctgacaagctatgtcttatggaacctgagactttctgctgtgccagagcccttgttcagttcctcagcaaattctcagtggtcccagttgatgataacagacagtgccctgccaaaccaaagttcctggcaactggaaggtgtagttgctctaggatggatctcaagtgtttccaatgcagttttcctgttgaacacagttacaaatgtgataccttgcagcaacttaaaaacacagaaaccggccacacacacaattcgtgcatgtttgtgtttagtaccagaaatgtggcttgtaacttttctgtctttaatacaaggtagggaatttttaaaacaatccactgcttccagctttggctctttctcaggtaggactcacccagtagatataactgagttcccgctgaacttggcagtagagagcgaacccaggaatttggcaggaagtaagttatgactgcacaacctgagaagctacacgtctgactcaggatgccatgggtttgggggttgggattattctccagatcccaagaatccatgtccaatgattcccttatggcctaaactattgatctggcagtactgagtttggttttcagtattcagttccagggcatccacttgtaaaaacaatccataaatgagattctcagactcagcagtttctgccactaccgacttgacggactaagccagggctgtgattgagccagaattccttggaggagaagcctggggtgctaagctgattgtgaagcagcacccatcaagtggaggctgaggagagcatccaggataagcacttgcaggtgatgagctgcgagtgtttatctacttcgtcaactttaataggaaaagaacaagaccaggatgtgcatgatccactcagggttacctcgtcccatctggttgcagctgatgactttcaccagaaagaggaaaagtgaaaagtaaagagaaacgaggagctggccaggccagggcatggaagatggccttcatcaatttccaaattctagcagtaagtcacttctactgtgcattaggtgagttctctgcactttgccacagaaagccttatagccactgttaggattctatgagctggcttctgaaacctcctttagtggcaaattcttcaaaagatcagaggggcagcaacccctgaggataatatttcagccgaggagatgaacagtgctcattgtaggtactaactatagaattcagggccaggcttctctctatgtataagaaagaaggatgttggtggcaaaagccttcccactcccatagtacaatacaagttgcaaaaggttttattgttttttaaaatgtacttaatgttttagagacaggctctccctctgttacccaggctggaatgcagaggtgcaatcctagctcactgcagcctcaaactcctgggctcaagtgatcctcctgcctcagcctcctgagtagcttggactacaggcatgcaccatcacacctagctaagagatacagcacctggtattcacaggtggtctcccatccatgcactaaccaggtctgaccctgcttaacttctgagatcagaaaagatcagtcatgttcacagtggtacatctgcagatgctacaaaaggttttaatacacattatccattcgagcttcatcacaagcctgtacaaggagtgagttaggaatcattgtccctggcttatggatgacagaaatgattgactgaggtgaaatagccagtccaagtttatgagctagtaagcagcagaactgaaattctttcacaccatttctccaaaagcaaaggttttgttttttaacttttaaattccggggtaaaagtgcaggtttgttacataggtaagcttgtgtcatgggggtctgttgtacagattatttcatcacctagatattaagcctagtatacattaattatttttcctgatcctctccctcctcttaacctccaccctccaaaaggccccagtgtgtattgttctccactgtgtgtccacgtgttctcatcatttacctcccacttataagtaagaacatgcagtatttggttttctgttcctgcgttagtttgctaaggataatgacctccagctccatccttgtccttgcgaaggacatgatctcatccttttcatggctgcatagtattccatggtgtagatgtaccacattttctttatccagtcactgatgaacatttagattgagtctgtgtcttggctattgtgaatagtgctgcagtgaacatattcgtgcatgtgtctttataacagaatgatttatattcctttggtatatacccagtaatgggattgctgggtcaaatgatatttctgtctttaggtctttgaggaatcaccacactgtctcccacaatgattgaactaatttatactcccaccaagagtataagtatcccttttactacacaaacttgccagcatctgttatcttctgactttttagtaatagccattctgactggtgtgagatggtgtctcattgtagttttgatctgcatttctctaatgatcagtgatgttgagcttctttttcctatgattgttggccgcatgtatgccttctcttgaaaagtgtctgttcatgtcgtttgcccacttttttattatgcatccaacaaaagtctaatatccagtatatataaggaacttaaacaagtttacaagaaaaaaaataaagtttgcaaaatggttttaactcttactgaaggatatataccctacaactaaacaatggtggcaacaggacgctggtacacaaacacttcctgtgttttgtttaaggcaacatcacaaagggattagtctctccactgccctgggtctctccaggtcaacgttcaagaagcctaaattttctccttttgcaacctgaattctctattataggcctaatctcacccccttagggggccaaggtctccagtgcaacaaaagcccaagagaggattaactctcaaccacacttgcaatgactgccttagaaatgagaaaagcaatgaggtcatctcagtgggactttctttcgaaaagaggtgaaccaattaagtttttgacaacccctttcttctttctcacttcttcctcacatcaggctctgaaaccaaatgtctaggaatgaagacatggcctgctgatgtcaagcaactatgtattaaaataccaatctgggccaggcacagtggctcatgcctgtaatcccagcactttgggaggctgaggcaggcagatcgcaaagtcaagagatggagaccatcctggccaacatggtgaaaccttgcctctattgaaaatactaaaaaattagttgggcatggtggtgcatgcctgtagttcccgctactcaggaggctgaggcaggagaatcacttgaacaggggaggcggaggttgcagtgagccaagatcgctgcattgcactccagccccgcaacagagcgagactccgtctcaaaacaaaaaccaaccaaacaaaaaaaaaacccaatctgcccaagaggtagagcagggccctgaggataaggaactacctttagtggacccagtttacaatttcttgagaaagaaaacccatccctccaacccatcctcccaactcccaggattagaggcaccactgtcgctgcaaatctgcagcaacatgtgtctagcagctaaaatgtcacaacccaagccccaccgtttctggaaatgacttagagcaacagggcaataagacaatagcattcttcctccctgtcctgtccctccacttccacctccaatccagcaaatcttaaaatagtgaatttccctagacatcaatggtaaggattatttgtttttaatgtgggatgtgacacttgagcgaagattggaggtgggttctagaaacacaaagggatgttcccatcaaggttgcctaggatagtagtataagaaagaggatctgagtatatactagcgatataaacatatctgttagtcaatcaaacattcttagtccaggaagagagagaagacttgggaggtaaaatgtagactccttcctcagagaagatggtgaatcaatcgcctgaaaccaagcagaggacaggtttgatacaaatgtgattttttttaatcaagagaagagtcaggcaaagagtgggcagaggagaagaaaggcatcaatgattttctggataaagaaaatgtggtacacatacaccatagaatactatgcaaccataaaaaggaatgagatcatgtccttgccaggaacatggatggagctggaggccattatcctcagcaaactaatgcaggaacagaaaaccaaataccacatgttcccacttataagtgggagctgaataataagaacacttggacacagggaggggaacaacacacactgggcacctgtgctgggggaggaggaaaaacatcaggaagaatagctaatggatgctgggatgatctgtgcagcaaaccaccatggcagatgtttacctgtgtaacaaactgcacatcctgcacatgtaccctggaacttaaaataaaagttgaagaagcaagaaaaaaaaaattcttgcgatgtaagtagcataggttctgaacatccactgagtttctttccctgggccacagacagtcttctgacgtggtaccatcatgttgtctgaggacagctggggtttttatcagactgtgagggcattccacagggagttaggaacaaaaggtcccattttccaccttatagctcacagagaagacaaacaccaacatatttcctctaaagataatggatttaacagcctaagaaatggtaatgagctagttgagaaggtgcttttctgagatgtggaaaccttgagctcagagcagcaaaagcacagtgctgcttcttccaggagatttcactggaattgtctcatggcccattgatacatttggaaatgccatcaaaggctgaggaactttcagaaacaacaggatgaggcaggttgccagaggtcaaagggtggtagaaatggggagacagatgttggtcaaaaggtacaaatgttcagttggaagatgagtatgttctagaggtctaatatacagaatggcgattattgttaataccactattatataattgaaacttgatgagagcagattgttaagtatcctcgccctacatgcatacgaaatggtaactataaatggtgatgaatatgctaattaattgattgctgtattagtccattctcacactgctataaagaaatacctgagactgggtaatttataaataaaagaggtttaattgactcacagttctgcatggctggggaggcctcaggaaacttacaatcatggcggaaggcacctctccatggggcagcaggagagaatgagtgcaagtggggggaggaaatgccagatgcttaaaaaaccatcagatcatgagactcactcatttttatgagaacagcatggggatgattcaattacctccacctggtcccacccttgacgtgtggggattattaaaattcaaggtaagatttaggtgggggacacagagccaaaccgttacaattgtgattatcttacacaaagtatgcatatatcaatcatcacgttgtacacattgaatatgcacaatttttatttgttaactatgtctcagtgaaactggaaaaagaaagaaacctcagatatgaaaatccagagtcacgaccaaatgtgtttagggtcgatggcatgcattataaaatgattctcttcaatttcttattttcctccagtttcctcatctataaaatttggataataacccctgacttgcctagaagataggaattgcataaggatcaaattaaatcatgcacaactgagtgctatgtaaaacacacagctatacttgcttatcaccattcttaggaacattaaaacactgtacacacacatgtgtgctgcctggctgaattactttcatgaggacctgagaacaaagtgtctcttgccatttttatccacctgaagactctcgaagagtcgtgaggcaggttactgacaaaattgcttcctttgaaacaatgcatctgtgtgaatcaggatttctcaataatgagctgatctaagactgaaattcagcaaaaatgctaacagctctgggcctcaacttattccaactgtaaaatgggaacaataactcagcccttgtagggtttctgatgatttaggaggtggggtatgtagactgctttcctactgggagaactgaggcatgccaaggtttttgcttgtttgtttttgcctgcaagcacaagaatgagaaaatctggagggagaaaatgttggcactaggcctgaaattcttgaagacagtgtgggaagcaaagacccccttcatcttctcaggcacaaaatgcacgttcccagaaggaagaaggtcaacctaaagcagcctagaccaaggacatttgctgagagtcactagggaaaggtcattcctactgtccaccaaatgcttaatccagcccccagctccttggaattctatccatctcttaaagccatgttcaagtcttccttcctttgtgagacactcccagacctcctcatttggaatttccattgttttcctagttctactttctttggttgcattatataacatgctttatggtttgccatattttattatttgtgggcatcttaatctttttaagagactttggagagcaaggagcatgtatttttcatctttatgtcccttatactgctccataatgatgtctgcttttgaatgaaatgtgtttgaaatgctcacctcatcattcatttaaagccaattctataaataagcaatgagggctgtctttgccatcaccacctaatgcccgatgctgccacgcttcttaacaggcatcttatcttcagactggcctcccagattcatcatctttaaatgccattttaaaactccttattcaaatttcccactcaaaatcttttaaaggcttcacaatgcctacatgataaggtacaaacgtcaaagccttgaatgtaagactgtccaccagctggctccaatccagctatttaaactcatttaacccacatattcccaaagcagtgggctgacttcattcattcattgattcgtgcatttcattcagcatggattgaatgtcccagtcattttcatagtcattgtgttaggtggtagagatatctataggaaaagacatagtccctgatctcaatgcagttatcatccactgagttggcgggaagtaaagagaatattacaattttaagtgatagtagctataacagaacaatgtacaagagacactgtgagtatggaaaagctggggcccaaactggcctaagggagtcaggggagtgttagtaaaagaagaacaaaaggaagactggttttccaggaagacactatggtggagtaaagagagtgcatttgaaacagagagaaaataatatgccccctacacatacacacacacacaaaaaccctacaatgatgctacaagaatctggtataaagttaccagtggtccgcgaggacctagttgaagctgaactcaaactaaaagggatttcttgtgtctgtaagtggtatttattatctaatgacagtatttcccgatgtgttcctgagcctggttctgagaggcacagtaagtagctcaccatgacggaaagaaaaaaatatcattctgtggtcataaaatgtctgcagagtaaacacatgcttttctccttcttgggaaggtacaatgttcaaaagcatatgaaagcttctgctaagtcttgcaataaaacaagctgtttaaaggattgcagacatgtttatctatagagtatcatgccactatgtacttcctgcagaatgagatccaaggaagagttttggaaacaccggtctgtatctgtaacctgctctttagatgcacctgtactggcctgtaaatagtttatgaaggcacaggcttcaaggacaaacacacttgattttaaagcttgtctgcatcacttagttactgtttgaccttggacaaattagttctttttttttttttttttttttttgagatggagtcttgctctgtcacctaggctggagtgtagtggtgcgatctcggctcactgcaagctctgcctcccagattcacaccattctctcgcctcagcttcccgagtagctgagactgcaggtgccctccaccacgcccagctgattttttgtatttttagtagagatggggtttcaccgtgttagccaggatggtcttgatctcctgacctcgtgatccgactgcctcagcctcccaaagtactgggattacaggcgtgagccacagcacccggccgacaaattagtttttttatggacagtttcctcagttgtaaaatgggcataatatgtactttctccatgtgtagttttattgagcacatatgcctgacacatacctgattaaacattttcttttcattattagtggcaaacatataagctgaactaggtataagaaccttgcggcaatttctcaaggatctataactagaaataccatttgacccagcaatcccattacccaaaagattataaatcattctacaataaatacacatgcatacgtatgtttattgtggcactgttcacaacagcaaagacttggaaccaatccaaatgcctatcagtgatagactggataaagaaaatgtggcacatatacaccatggaatactatgcagccataaaaaaggatgcgttcatgtcctttgcagggatatggatgaagctggaaaccatcgttctagcaaaccaacacaagaacagaagaccaaacaccacatactctcactcataaatgggagttgaacaatgagaacatatggacagagggagagatacatcacacacacacaccgcagcctctcagggagtgggggtctagggaagggagagcattaggagaaatacctaatgtagatgacaggttgatgggtgcagcaaaccaccatggcatgtgtatacctatgtaacaaacctgcatgttctgcacatgtaccccaagacttaaagtataataataaaaaaagaaccttgtaagtaagttatatagatttgttcctcttttagcattctagcagaatttctttccaatggctcaccagtgattcttatttactgatacttaaaccttggcacaaaaggattccctgaaatattgcaattatataaatgagaagagaaagaagaagacaaaaaaccaccttaatacatatattatcaggatggactgattttcctaagtgaggtgccataatattcagaataaccccaatgtcccttactggctgaaaaataaactatgtaaaaaagaaatatctaccacgttaggattaaaattatggcatttagtgtggaagaaatctgaatctgcagatttttaaaagtaggtgaggaagtgctctcttccatgtctagcctgggacacataatctgtccttggtccttggctttgaaaaccctttctcactgtacctctgcaccatcccccccgccgccatcctacccccttcccagacacatcctggccaactcaactcatccattattttcttcaaaaagttgtccttgactccccaggttgaggcaggtaacaacctttggttcccatagcctcctgtgcacacatttccattaggcaacaatgagtgcgttcttactgagtggccgttatggccagggagctggagatgcaattgttggccaaacagaggtgagcctgccctcagggagcttactgtctgatgcaggcagcacataccaaacaggtaaacaggtgagtcaggtatggtcacaaatggagacaagcactatgagcaaataaaagagacgttataattgaaagtaaaatggattctcttttaattacttatcttgtctctttggcacgctatgaaggatttgagtgtaatatctggttcacatttgcataacttggcatggcaatgtgcctgtatacattgagcaagaattaactgcctcatgaataaacgaaagaatgaatgaattcaacgacaaagctgagacctataggactagcctacagtgacaactagttagtgacaatttaaagtccccttcatttaaagtgagtatatataattatatttatttatatttacatataaatatgaatatatattaatataatatataatatataaatacacaatatataacacacagaatatattatatataaatatataacacacagattatatataaatatataacacacagaatgtattatatataaatatataacacacagaatatattatatataaatatataacagaatatattatatataaatatataacatacagaatatattatatataaatatataacatacagaatatattatataaatatataacatacagaatatattatatataaatatataacataccgaatatattatatataaatatataacagaccgaatatattatatataaatatataatatacagaatatatataaatatataatatataatatacacaatgtatattaatatataaacatatatattaatatatatgtatatatttgtatataagcatatacaatgtgtgcttatagatatatgatatgtacatatatagatctatgtatccatctatctctatgtatctatctaactacactatactatactatactatactattctatactatactatactatacagccagcacatccaaacaacctcttaatttccaggcctaagaaatgggtaattttgggtactcaaaatttatttttggcccagccctggctgctgttctttgttggtaaacaagtgagtagcttcaaagtggactttacaccacgcaatgtagagaaggcaccctttatgctcatttgttctttctgacagaaaaagcctacagccaacctcagaatgattacttctgtgctctgttgatgcttgctttcatttggctgtttggttctgccaggccctataaaaacacagatataatcaacggcttcaaaggagaactagctagcttgaaggaagaatgcattttatttgggaaatggtggctcccctatgcacttgtgattaaagggggaagaaaacatttgtgattcatccaattaacctcaatagtatgtcattcaagcaaggtccagacaggagtctcactctattattccaaatctttcattaaaccaattccatctgcagccagcactttcctgttttcccggtgcattcttgtgattacctaatttaaataaagagctagtttattgtttttcctgggtgccaggaagatttagagcaatgacctggagcagggataacattctcatgtaattttcagaatttacaaaaagtcagaaagtgccctcctaaggatgctcatatccttcctggagacagctagacacagatgcacttttttagagcaccacaatagaccacagtgttcccctccctgtggcccccactaacatttgatttttaaaatgtcacccatgttagcatggcctttgaaggctctgcaaccagaagtttgcagtccaagattaggatttcagggctgggcatagtggctcacacttgtaattccagcactttgggaggccaacatgggtggatcacttgaggtcaggagttcaagaccatcctggccaacatggtgaaaccccgtctgaactaaaaatacaaaaattagccaggcatggtggcggccacctgtaatcccagctactcgcggggctgacgcaggagaatcgcttgaacccaggaggcgaaggttgcagtgagccgaaattgcgccatttcactccagcctaggcgacaagagtgaaactcagtctcaaaaaaaaaaaaaaaaaaaaagattaggattaggatttcagatctttttaaaaaagattaggatttcagatctttttaaaaaagattaggatttcagatctttttgcagtgactggtggaacccacctctgcacttcagaccagcctttccagatatagaatatatttccttggcgagaggtataaaattaacctttacatttttaatataatacttaatatatacaaaagaatgtttatatattactttcaaggcaatgatcataataaataaaacacctatgaaattcttatccatctgaagaaccagaacacacccaatacgcttgaagttatagatggggtctttccaatccatgctatctcagataaaacaatatctgaggtttgtgttcctaattccttgtttttaaatagctgtaccttaatctgtttttctctgtattttttttttactctatctgccttcatgatatctgtttacctttggttttcagtggtttgactatgatgtctatcttcaaataatacaatgctcattacacataagagcctgaaaacagtattctcctgatttttttctctccaatcttttgttctattgttgtcaatcatttaactttgacatgtgctacaaatacattatgtcttaaaactattaattgctttaaataattgctttaaaggatcaattatttttagggtgaatcaatagaaattgatttaaaataaaatcaacctttagatttacaatgaaataaatttggccgggtgcagtggctcacgcctttaatcccagcactttgggaggccgaggtgggcagactacttgaggtcaggagtttgagagcagcctgaccaacatggtgaaaccctgtctctactaaaaacacaaaaattagctgggcatggtggcacatgcttgtaatcctagctactcgggaagctgaagcaggaggatcgcttgaacctggaaggtggaggctgcagtgagctgagattgtgccactgtactacagtctgggcaacacagtgagactctgagggggagagagagagagagacaaagaaaagcaagcaagcaagcaagcaagaaaagaaaagaaaagaaagaagaaagattgatttatattgatttgcctttcaactattcctagaaattcttattctttatgaagatgttaagtttctcccattatcataattgttctgctttaagaatgtccttcactattttttatagtaaaggtctgctgctaatgtgttctcaaaacccccctcctattttttgggtttttttggtttttttttttggttgttgtttggtctggaaagtcattatttgtctttagttttaaaaaatattttcctttaattttaaaaataattcatttttaaaatattttcctttaattttaaaaatatagacttctgggttgacagattgggtttgcatcagttatccatttattgcctctcagctctgaatgcatcttccaatacaggcaatacaataaagtgtgagaagcaatggaatccctttgagcatttctcctttaaagtcagcaggatgttgagctttctcggtagagggtgctgaagccaaactggagaaagaggcattctgcaattcctggtgtcatccaagaggggtcagtggtgcagtttgttgttgtttgaaacggagtctctctctgcggcccaggctggagtgcagtggcgcaatctcagctaactgcaacctctgcctcctgggtttaaatgattctcctgcctcagcttcccgagtagctgggagtacaggcacctgccgccatgcctggctaaggtggtgtagttttgaggacaactgtcacaactcagatcgtggtccctctgtggccttgaagcctcagtttggcaataatctttctgcagccctctcaacacagaagctaactccccacatgctcgggctccctaagcaagcttcctcctctccccaaccccctaaccaccacagcctgcacacagctccatgtgtccccgatgagcatttcgcaagtctccagatacccaagcttgctccttcagcactgaaagcctttgcccctgccatcatccagattcccactgcatactgcttcacagccagcactccagaaagttacctattgcttgcccagcaactccagaccagatcttttctgatcaaaccaatgagcttctccactacccagtcatcggaacataccatctccaataggcctattggagagcaaaccctatccatgcttgttctgctgattagacccattctgttacagggttctctgagcatcttggatctgtgatttgatgtcttatattatttgtagatagtgttctgctattatctcttcaagtaggttgtctgtccctatctctttctaatccttctggcattccaattgtacaaatttcagactatctgatattagcccgttgatcttggatgctctatattttttaaaatttattctttttacctctttgtgtttcatttggtcaatttctattgattcacctttaagttcataaattttttctttggctgtgttaagtccagtgataagtccatcaaagtcatttttcatctctgttattgtattttttatttctaagattttctttagactctttcttataacttctgttgaaattctccaccatgcatattgcctactttttccataagagcctttaatatattaatcgtaggtattttaaatttcccgagagttcaaacgtctttgtcatctttgagtctggttctgttgattactttgactcttgacagtgagttgttctgtcttgcatttttatttgtcttgtaactttttattgcacatgaacactgtgaggtatgatagtagagaataaagtaaacagtacttttgcttggtctgccaacataaagaagagtctactggaattgatctgggtttagcctttgttgttgctatggttaccttcagtatactaccagtctcaaattttttgtatgtgtttttttgagacagagtctcactctgttgcccaggctggagtgcagtggtgcaatctcagctcactgcaacctctgcctcctggactcaagtgattctcctgcctcagcctcctgagtagctgagaccacaggcgtgcaccaccatgcctggctaatttttctattttcaatacagatggggtttcaccatgttggccaggctggtcttgaactactgacgtcaggtgatccacccgcctcagccttccaaagtgctgggattacaagcatgagccactgtgcccagcctcaaatgtttttaatgtaatctagttctttggatggggtatgtgttgcatgtaagctgtttctaatattcctgtttatcccttagcttttgtctttctctgtgtgtctgtacctcagagaaggtcccttttttatgctcttcctcttctctcagtgatagattgctactgttacttgatgcctgctggtctagtagtggtgtataggagaagacaggtctctgttttcctagtccagccttggtcttaggaaggccctgtgtccctaagtcttgcagatcaggttttctctgtaattctgatcctcctctctgtagcagccaaatgatgtcttgaatctttggtggcccttgtgaacgggagagtttcttgctcttcccccagtggtaggagatctttaatggcctgggtcaaacacccaggaatggaagacttttcccttttctttctgcttccttgctgcaatggtctttacctgtgtcctagtgaccacaaggtttgctccccttctccagcatcctaaggcttttgatccttagaggactgaccttggtgagaatctgtgctttgccacagaagtgacactcatctcctctctgtcttcaatatggaggagggctttctctcacctcctgccccatcaccaatctttcttgtgagtgcacaacggaggtccatggagaataccctgtaagtgggcgcaagcctatattctcatgcaagtccaccccacgacttcagaaatttgtttaaaaatttcactgaatgattctctcccactgtatggcacctggcatctctacctccttggtttcccatagatgactcaatggttgtgtccaatctctccttgggaatgcctatctttccattgacttcaggccacccaattgccctggggcttcaattctctgagaggtttgccattacttttaatggcaaaaaaaaaaaaaaaaggtctgtccgtgttttgtacagacacaattttaccccgaatatttttgatccacggttatttgaatccatggatgcagaacccgtggatacagaatgccattacttttaatgtcaaaaaatgcaattacttttgcaccaatgtaatagttcacataccatatctttcgcttaaagtatacaagtcaatggttttttgtagagtcacagagttatgccatcatcacaacaacagattctacaactgatcttagaacacttttatcgccgcaaaaagaaatattctaggcctggcgcagtggctcatgcctataatatcaccattttgggaggctgaggtgggcagatcacttgaggtcaggagctccagaccagccaacgtggcgaaaccccgcctctactaaaaatacaaaaatacaaaaaaaaaagaaatattcttgattttcacctaccccccacccccaaacccgccagcaacccctgctgctctcctaccagggacccacttccctgctttctgattcaatggattcaccgatttttgatgtgtcatgtaaatggaattatatgatatgtgaccttttgggtctggctacttccacttagcataatgttttattcacattgtagcatgtaacagaatttcatttttttaatatttatttttccaacttttaagttcaagggtacatgtgcaggatgtgcaggtttgttacatagttaaacacgtgccatggtggtttacctcagatcatcccatcacctagatattcagcccagaatccattagctattcttcctgatgccctccctcctcccactccccaccctctgacaggccccagtgtgtgttgctccccttgatgtttccatgtgttctcatcattcagctcccacttacaagtgagaacatgcagtactggtatttggttttctgttcttgcattagtttgctgaggataatggcttccagcttcatccatgcctctgcaaaggacatgatctcattcctttttatggttgcattgtattccatggtgtatatgtaccacattttctttatccagtctaccattgatgggcatgtaggttgattccacgtccttgctattgtgaatcatttctttttattgataaataatattccattgtatggatatgccacttttgtttattcatcagctgaaggacatttgggttatgtccactttttggctattgtgaacaatgcagctatgaatattcttgtatatggtttttgtggatgtatgtttttatttctcagtattacccaggagtgaaattgatggagtatatggtaattgttcagccgtttgagggatgccagactgtcttcccaattggctgcacaatttgcattcacagcagcaatggatgagggttccaatttttccacatcctttttagtacagctgtccctcggtatctgtgggaattggtttcaggacatctcatggataccaaaatccacggctgctcaagcatcttatataaaatgatgtcgtatttgcatataacctacgcacatgttcctgtatactttaaatcacctctagattacttacaataccgaatgcaatgtaaatgttatgtaaatagttgttatattgtatggtttagggaatagtgactaaagaaaaaaatctgtacatgttttggacagacacaatttttttcccaggctatttttgacctatagttatttgaatccacagatgcagaacccacggatacagagtgccaactgtacttactggtatctgtctttttcaatatagccatcctagcaggatggtgtggtgactcattatggctttgatttgcgtttccttaaagacataatgtcgaacaccttttcatgtgattactggccttttgtgtatcttcttaggaaaactgtattttttagatcgtttgtccatcctttctgtatgttgtctttctatcattgaaagagttctttatacattctagacacaagccctttataaagctatatgatttgcaaatatatgcaccccatggtgtgagttgtctttttagcttcttgatagtgtctttttaaatttttaatacactttttaattttgatgaagtccaatttgcctattttatctttggtcccttgtgctttatgaacatttgctcctatatttacttctaagagttttatcgtttcagatctggaatttaggtctttgatccattttgagttaattgttgtgtttggtgtaatgaagcagtccaacttcattctctcgcgtgtgtgtattctggtgtcccagttccagaaactcttctgcgcttctcacatgctgttttctgggtctcgaaactccttcccttctcttctccatctttaaaatgcttaattgcttttcaagtgcagcataacccatgccaaagtcttctctgacttctttgtctaatttagatgtcccttttggtacttttataacaccgtacatgtttctagacagaggtctgcaaacttttttttctggcaaagcgacagattacaaatatttaggctttgtgtgccagaaggaaaaatcaaggaaactgtggaggtacttaataagagagaaaacaaatttccaaaaatacttgtattgatgaaattaacaaataataatagaggtttttctttttgaaatgtgggtacatgaataagaaaaactgaattctttttttagaggggataacattttgcttaattgggatttaaagttagttcttcctatcatcaaattggtagcatatgttcatctgtgaaaaccattctcttttttttttgtttgagatggagtctcactctgtcacccaggctagagtgcagtggagtgatctcggctcactgcaacctccgtctcctggcttcaagtgattctctttgcctcagcctctggagtagctgggattacaggcatgtgccacaacacccagtcgatttttgtatttttagtagagacggggtttcaccacgttgcccaggctgttcttgaactcctgagctcaagtgatcggcctactttggcctcccaaagtgctggaattacaagcatgcgccaccgcgcccagctgaaaaccatggttttcttgggccctacgaaaacaggtagtgagttagatttggctgatggactgtaatttcacgacatggtagtaggtcagtagttctaaccctttctttcaaagccgttgctactgagggatacagtgcaatcccagtcataactgtggatagttagacagggattctctttgaggagggtgatgatgggaggcttacggtggcaggaattacagattatcttaatcaataatcattcttctgatttgtcttcccaaagtgtagaggagcccaaaactcatttcttagacttctttgcagcaaggggtctgccagcctagcacactttacatcaaaccttgatttggaagtgagacacatgagcagagaatcagggcagttggcatgcagtttgccagtgtgaatgatgacactgctggtgtgattctggaactggcaattaaggtggtagcttctggattcagcaaacggctcactgaatcaccagcttttctgttgtgccactggaggtagccgccttggagtcccaggttgtcagtgtgctttggagagtggttctgggaaactaagaccttccaacaatgctgtgacccaagacccctaataaatgttttatttatttatttatgtcatttctctgtcacccaggctggagtacagtgatcatagctcactgcaacccccaactcttgcgctgaagcgatcttcccaccttaacctcctgagtagctgggactacaggcacacaccaccatgcccagctatttttcatagagatgaggtctcactatgttgtctaggctggtcttgaactcctggtctgaagtgatcctcctgcctcggcctcccaaagtgctgtggttacaagcatgagctatcgtgcctggtggtaaaatggtttaaactatattaacttgaatcttttgtctacaacttgactataagaagtatatgtgccgggcagggtggctcacgcctgtaatcccagaactttcggaggccgaggcgggcggatcacaacgtcaggagatcaagaccatcctggctaacacggtgaaaccccgtctctactaaaaatacaaaaaaaaaattagctgggcgtggtggcgggcacctgtagtccagctactcgggaggctgaggcaggagaatggcatgaacccgggaggcggagcttacagtgagccgagatcgcatcactgcactccagcctgggtgacagagcgatactccatctcaaaaaaaaaaaaaaaaagagaagtgtatgttagaatctaggggggtatgggaagatttttattctgatacgcttctccccattcataatcactacttttgacaattccagatagggcgcatgtcacattgatgtaggagttaagaagaaactacttaggcagatagtgagggtacaggagtccttggtaaggtctccctttttaacgaaaagcagcccccaaatcatattctaacaaagagcagcctgcaaaatcgagctacagacatagacatgcaagctagaagcttgcatgggtgaatgccatcaagaaaaaagctacctgggactaggcatgtccaaaatggtggccccatcttccctcctctttgccagccgtatgtacagtaagaagacaagatggcgccagttaagtgggaaacccatttgcataataagagtagggtgaggtggccaggcttccctgcgtggtacgtaaatgtcacacctgatggaaccaatctgtgggtcctacataaagaagacactgcctcctcaagcctgcttataaaatctggtgaacgccgccgccggctggtctttcctttcggaagcccctctcactagagagggagctgttctcctttctctttcttttgcctattaaacctccgctcctaaactcctcatgtgtgtccatgtcctaaattttcttggcgcaagatgatgagccctgggtatttaccctagacaaccacaccgcttcaacatcgtaaaagaaatggttgctttgcttaacactcatcaagtcacaattttgtgtgggcaggcactttgtcttactcacctctgaatccttggtgccaggcagtcagtagaagcttaacgaaatgtgcatttctaggtttttatgttctagaattaattctctatataaatcttagcttatctcccagtgagaatgtaagttattttatgcggagagactttaacataaggtatcataagtcacacggtcctgctgtgctaggttcggagcagtattgataattattggccttagcagggtcaagggattatcaacaccagggccaggcaggtgacgtgagtgagtgacatgggatgactgcaacacaaaaggggtggcaaagatcaaggaaacctcaaatgtatgtacgtgcaaaggaagcagcttcagtcgggggctgccatatgggaatgtaggttcactctttacagaacagccaatctgagtttttgcattgaagctccctatttgaaaatgctgatatcaaatttttttaaatgtgacttatatttgccagacaaaagagggctgcaggctggaactggctcatgcaacttctagctaaaatagttctcccgacacctcaaaagattgtgaattctcaaagaaagataatattcaatgagaattgttctttcttagatcccatatctgaaggtgttctgttaagtggaatagagaaaactgtggaagattgttagtacttatgggatgtgtgaagtcactggtatagtcactgattatcttagtctattttgcattgtataaggaatacctgaggctgggtaatttataaagaaaagaggtttacttggctcatggttctgcaggatgtacaagcatggtgcctgtatctacttggcttctggtgagacctcaggaagcttttactcatggtagaaggcaaagggggaacaggtgtgccacgtgacaagaaagggagcaagagagatgccaggctctttttaagcaaccagctcttgaatgaactaacagaacgagaactcactcattaccatggggagggcaccaagccattcatgagggatctgtccctatgacccaaacacctcccaccaggccccacctccaacactgagggttgtattagtctgttctcatgttgctaataaagacatacccaaggctgggtaatttataaagaaaaagaggtttaatggactcccagttccacatggctggggagacctcgcaatcatggtggaaggcaaggaggagcaagtcacatattacatggtggcagagaagagagagaacttgtgcaggagaactcctgtttataaaaccatcagatcttgtagcacttattcactaatacgagaacagcacagtaaagacccacccccatgattcaattacctcccaccaggtccctccaacaacacatggaaattatgggagctataattcaagatgagatttgggtgggcaaacagccaaaccatatcagggtcacctttccatatgagatttggaggggacacatatccaaactgtagcactggtgtagatgttgttgtctaaggatctagagtagatgaaaaagcttgaggggtccaggccaaggcaatgatgaggctttactgaagacgaactagacagaaggctgctaacattggtgtgaatctggcaaaggagttgtttcagctcttcccagagcagacagcaagcagggtgcaggatagcagtgggttaaacaagtgaaagaaggaaaaagtgcttctggccctaggaaggaaaaaatgggaggtctttctgccaggaatgagactgtctgcagagtgaattagcagtggtagatggattcattaaaaggcatccctctaggccaggtgcggtgtttcaatcccagcagtttgggaggccgaggcgggcggatcacctgaggtcaggagttcgagaccaggctggccaacatggtgaaaccctgtctctactaaaaataccaaattagctaggcgtggttggcgcatgcctgtaattccagctattctggaggctgaggaaggagaatcgcttgaacccgggaggagaagttgcggtgagcggagatcgcacccttgcactccgcctgggcaacaagagcgaaactccgtctcaaaaaacagaaacaaaaaacaaaaaacatccctcctcctgtactgccagggcactgcttttcattttccatctttcagctgtgagtgaaatgaagacacccatctgcccaatggtagtcttgaggttgcgggatgcttgaccacaaaatgcaatctacaggttacatgtaccttctgcagcttttgcttttagctaaagctttttctgtaacctcattttggcagtgcaggcaaggagggagtgttgacctgtcagtgtagtagagactcccaggtgtcctgggtgaagttgtgcagagcatttgggatgttcttaaaataataccctggaagttcttctctgcatgaccagaagccatgtcagaactctaatggcatcacctgctgagttagaaaaaagtttccagaaaccacaagtttgatttcataataaacagcttctcagggcctcttcggcatggctacataaatctactgcttaaaaatagatgagtggactgggcgcggtggctcacgcctgcaatcccagcactttgggaggctgagacgggtggatcacgaggtcaggagattgagaccatgctggctaacaaggtgaaaccccatctctactaaaaatacaaaaaattagctgggtgtagtggcaggcgcctgggcgactgagcgagactcagtctcaaaaaaaaaaaaaaaaaaaaagatgagcgtagagccttgcttcactcctctggcactgtacaccaagctggaagggccactgatgatactggaaccatcttctaggcccctgggaaattctgggggaggtcaacatggacactgagctctagggcgtgaagattccatttgtctggtatggggctgcagcaaaggctggaaggtgggtatttgggtctcatctgctgaactgcccttgtttctaaggtattcttccccaacccctgttatctactctcctgaaagcttttttcaatttgatccccacttccaaactccattagtcatatggtctggctctgtgtccccacccaaatctcatcttgaattgtagctcccataattcccatgtgttatcggagagcctggagggagacaatttgaaccatggaggcagtttcccccatactgttctcgtggtagtgagtaagtctcatgagatctgatggttttatcaggagtttctgcttttgtatctccctcattttctcttgctgccaccatataagaagtgcctttcatctccagccatgattctgaggcctccccagccatgtggaactgtaagtccaattaaacctctttttcttcccagtctcaggtatgtctgtatccacagcatgaaaatggactaatacaattaggcagctctttaaatatctatctttctaatctatatatcacacgtaggaaaccctgtctctactaaaaatacaaaagtagctgggcatggtggtgcatgcctgtaaacccagctccttgggaggctgcttgaacaggagaattgcttgaacccgggagacagaggttgcagtgagctgagatcgtaccattgcactccagcctgggcaacaagagtgaaactttgtctcaaaacaaaacaacaccaaaaaaaaaccccatacgtatttatatgtgtgtatatatgtagatacacatataaatatgtatatatgtatttacatatacagacacatataaatatgtatgtatatgtatatacatctaatatatatatatatagatgtataatttcacgtgtatatatgcaggtatatatgtataaaactttccctgtggaccagacgggagtccggtggtgcaatcatagctcactgaagcctcacattcctaggctcaagggatcctcccacctcagcctcttaagctgttagggctacaagtgtgtaccattacatccagctaattttaaaatgtttttgtagagatagggtctcgctgtgttgccaggctgatctcaaactactgggctcaagcagtcctcccacctcagcctcccaaactgatgggattacaggcatgagccactgcacctgccaactctttaaatatttgaaggctgtagccataccttcttcctacctggtctgtttaaggaaaaataaaaaaagcaatctatgttccatcacgcagcacccaagtgaaatgcagcctgtgctttcaccaatctgactgcccttttccagaaccacatcatttttatctctgtcactatttattcaacacagatatttatgcagcactcagggaggtcccttgggagggttagggaaagactgacgttttacgcaacatctgggttggggcttgtagaaagagaaagagtttaccaaagaatgggcaagttcccaagagtatcagagagattggcacagagataatcaggaaatatcatacagatgggggctgcattcttccctggggtggaaatttcattccatagccatcatttccagatagggacacatagctgtgcctaccctgcccagaaagacagtgagaaagttgtgatacaatgacgacagacttttttttgcttatttggtgctctatccccagtgactgaaatcatacctggaacacagaaggtgctcaaaaaacattgggtaaataaatcaacaaatgaataaagtgaagtcagtaggaagatcagggaaaggtcagttaatggggcttccaagagattcccataaaggacattatagccataatgtgtgtctgagagtggggcgggggaaagaagaactgagaggagcattataaaaacgtacacagggccgggcacggtggctcatgcctgtaatcccagcattttgggaggctgaggtgggcagatcacgaggtcaggagttcgagaccagcctggccaacatggtgaaaccccgtctctactaaaaatacaaaaattagctgggcgtggtggcaggcacctatagtcacagctactcgggagcctgaggcaggagaatcacttgaaactggaaggcagaggttgcagtgagccgagatggcgccactccagcctgggcgatagaacgaaactctgtctgaaaaaacaaacaaatgaacaaaaaaaccacacacagaccccacagactcactgagaacagagagcgccatggtgggatagcaggagggggccatgaggcttgaaagagcaggagacggacaaacatctgcactaaatcaatgcttgtcaatgccttcatcatcaattcaatgcattcagtcatcaggatgattgaatgattgaatgaatgaatgaatgaatccaaaatggagtcctggaagaaaacaagacacaaggaaaccaaagcttttcagcaatgttctaataaaagaataagagggcagactaaagacagcatgcattttaagcttcttgcaacacaatgataggcaagggaaaatcaggtcaggaattaggaatactaggtcatatcttttgcgatactggatactacttattccgtgtttaacatgtgccaaagtacagcagtgaccacagtctcaatacacttaatgtgtatggatgtggccgggcgtggtggctcatgcctgtaatcccagcagtttgggaggccgaggtggatgggtcacttgatactaggagttccagaccagcctgggcaacatggtgaaaccccacctctactaaaaatacaaaaaaaaaaaaaaaaaaagttggccaggcatggtggcgggcacctgtaatcacagctacttgggaggctgaggcaggagagttacttgaacctgggaggcagaggttgcagcaagccaagatcgtgccattgcacttcagcctgggttatagagcaagatgttgtctcaaaaaaaaaaaaaaagtttacggatggtagttatgatcatcctctccaccccacattccctagacaggaaaatgaggcaagaaacaaaggtaatttgcctaaatacactgcttggaagtggtggagctgggattgggattcacactgtgatctgagacacctctttatatcaactaagacagaccctaacattaaggacacagaggatacctaggggtagaggtcagggcctggctggcatggtgcatttctaaattcctcaggctactaggaaatccatactcttgccaaactccctaacaatgggagctaccagggaagttaccagctgatttacaacccagaccatatcaactccaatggacagaggatacgccttacaaacaacataagcaactgcggaccttaagccagtttcagccagcttatagaggctgcacaaaaactgtgtcccctcctaaacctttgttattgttgttgttttgcagttttccctctcttcaaaggtatatcccttcaagggtctcaactggaaacctggaagtttaccagggttcctccctttttccaggctctgatctccactttttttctcctcagcactgtgagactgacaaaaatctgattaattttttatgctttgagcacctagaaacaaagatgtattgaacttgtattttacagtttatgagttggtgaatgccttgaggtgaaatttcatgcaatctgttcttctgggatggagcccttcaagttcaggctgacttactagccattaactccaatcctgtagactcatcccagtgagtaccacgatctcaatgccactgctttctcttccacctttatacttgttacagcaaatttcctgagagtaaaatgctgtggaaaatatcaggcttatgtcaatgcactcttctctctgactttttggaccctcaagtcttagttgtcttgtttactttccaataccatgaaacagctgttctgttgtttgctattcagtttttatagttcttcttctgttttttgtttgtttgttttttcagagggggcctcaatctgtcacccaggccgggttggtgtagtggcatgatctcagctcattgcaacctccacctccagggctcaagcgatcctgcgatcctcccacctcagcctcccgagtagctgaaaccacagacacagaccaccacgtccagataattttttgtaattttggtagagacaggattttgccatggtgcccaggctgatctcaaactcctgagctaggcaatccacccgcttcagcctcccaaggtgctgagattacaggcgtgagccactgcacccagcctatagttctttgttatagaagcttagttttatacaaattactccactatatccagtcgatgtctaaggaaattattttccaaacaagactccaaggtttaataaaagccccccaaaatcagtggatataattatatcaatattatgaatttctggccaggcatggtggctcacgactgtaatcccagcactttgggaggccaaggtgggcggatcacctgaggtcaagagctcaaaaccagcctggccaacatggtgaaaacccatctctactaaaaaaaatacaaaaattagctgggtgtggtggcaggtgcctgtaatcccagctacttgggaggctgaggcagggagaattgcttgaacccgggaggcggaggttgcagtgagcctggatcacaccactccactccagcctgggcgacagagtgagactgcatctcaaaaaaaaaaaaaagaatttctgttcaataaggacaccataaatgaagttaactgacggggggaagactgagaaggcaatatttgaagcctctaaaattgatggtacctagataacaagacagcagacccagtatcaaaaatgaacaaaatatatgaataagaaattcacagaaaggtaaacccaacagcctccaagtttatgaagagaggttcaatttcattcatgcttagagaaatgcaaatgaaaagcaacaatggtatacacttgacaaccatcaaattggtaaaaattataaagtcagataaatgttcatgagaaattagagaaaaaagaatcttttgtgctgctgggaagagggttagttagcatcatcatgccagaaatcaatctaacaggcagtgtgtactttatatgccagcaatcccattccaaatgatatattctagagaaattcacacaggtatgtaaggggccatgagtgagaatgtttattagaatgtttggggattagggattgggagacattctgactgcccctcattagggacataaaaaagtcaactgggctgggcccggtagctcacgcctgtaatcccagcactttgggaggctgaggtaggcagatcatctgaggtcaggagttccagaccagcctggccaacatagtgaaaccctgtctctactaaaaatacaaaaagtagccgggcgtggtggtgcacacctgtagtcccagctactcggaggctgaggcagaagaattgcttgaacccaggaggccaaggttgcagtgagcccagatcacatcattgcactccagcctgggagacagagcaagtctctgtctcaaaaacgaaaaacaaaaaacagaacagtcaactgactctgccagaccgccacgccgccgtcatggacaccagccacgtgcagcctatcaagctggccagggtcaccgaggtcctgggcaggaccggctctcagggacactgcacgcaggtgcgcgtggaatttatggacaacacgagccgctccagcatccgcagtgtaaaaggccccgtgtgtgagggggacgtgctcaccctgttggagtcagagcaagaggcctggaagttgcgctgaacttggctgctcactgggtcttggatgtggggtttgaccacttggctggtgggaatggtgtgccacgatctgctcctatattttattttttgcccgccacacgggaattgagatgcgcctttaaagcatttgtgcttcaaattaaaaagaaagagtaagctgagatggatggatgtgatggaatgctctgtggcgatccatcaactagtgatatctttagcaggtgattagatcttaaaagcataatgtagaatgaagaaggtatgatatagaagggtatctgtagtacgaaaggaaaatatcttgggccactaatatcactaaggaaacctaaagccgggaactgcttagggcaaacctgcctcccattctattcaaagtcacccctctctgcccactgagatagacgcatatctgatttgcctcctttggaagggctaatcagaaactcaaaagaatgtaaccgtttgtgtatcacttgtctgtgacctggaagtcccttcccccgttccaatcttccgcctttgattcaagttgtctcacctttccagaccgaaccaatgtacttcttacataaattgattggtgtctcatgtctccctaaatggataaaagcaagctatgccccaaccacctcgggcacatgtcgccaggacctcctgaggctgtgtcacgggtgcatcctcaaccttggcaaaataaactttctaaattaactgagacctgtctcacattttctggtttcacagtagttgcacaataacattcaaatacattttaaaacacacacgcgaaacaacacagtatattttaaaatatagagtagatacagtactgcagagtgctagagctcaggttttatgtagcctggattcgagtcctcacgctgccatatgctaaatgcatgatcttgggaaaattacttcacatatccatgcctctgtttcctcttctgttaaatgggaacaacaaaagaatttttctttttttgagacaggatctcactctgtcacccaggctggagcacagtggcacgatatcagctcatggcaacctctgcctctggggttcaagtcattctcgtgcctcagcctcccgagtagctgagactacaggcatgtgttatcacatgggctaattttttttatttttaatagagatgggggcttcaccatgttggccaggttgatcttgaactcatgaactcaggtcattcacccacctcggactcccaaagtgttgggattacaggagtgagccaccaggccaggccaaaacaatgtttctcatagtgctgttgggaggatgaaagaagagaatgtgtataaaagtgcttggaacaggaccttggaaaattaaattggagtcggcaataatatttattttcaaagacatctatgtataggcaggatgaaaatggggagtgagcatggagataaagaaaaaataataaaataacccaacaaggtgtctttcatgggcttatggtaagggtgtgccctgaattgacaggaataatgaactcaagttttggaacctgacattccccaaatctgcaagagttaagcctaaaacaaacagaccaaagccccaggttatgaatctagtcactgttgagcagtgagctttcgccatcttccttctgagaaggagctcagtggttatatggtttttgtagtgttaaacaatgctgctaggcagggtgcagtggctcaagcctgtaatccgagccctctgggaggccgaggtaggtggatcacttgagcccaggagttcaagatcaacttgggcaacatggtgggaccccatctctattttaaaaaacaaaaaaataagaaaacaatggctgggcgtggtggctcacacctgtaatcccagcactttgggaggctgaggtgggtggatcatctgaggtcagaggtttgaaaccaacctggtcaacatggtgaaaccctgtctttactaaaaatgcaaaattagccgggcatggtggcacatgcctgtaatcccagctacttgggaggctgaggcaggagaatcgcttgaacctgggaggcagaggttgcagtgagccgaaatcgtgccattgcactccagcctgggcaataagagtaaaactccatcccaaaaaaaaaaaaaaaaaaaaaaagaaagaaaacatttctgaatttatgtaataatttacctattgtgtctaagctgttctttaaaaaactaattgctatcaaaatgcttaatgagtcaattactaattataaatcagtgaattaatacatccgaagtcaagaatctgttatgtttacaaacaattgctaccctctgtctaatctttgaatttgtgctcatgaagaaattggctaccaatgtggtaccagtctcccagcatccttgaagaagagttaggaggcaggagaaaacacatgtacgtctttccctagaggtgactacactgaaatctagctaagtgatatagtttggatgtttgtaccctccaaatctcattttgaaatgtgatccccaatactggaagtggggtctggtgggaggggcatgggtcataggggcggatccctcatgaatgtcttgaggccctccccacagtaataagtaggttctcactctattagctcaaaggagagctggctgtttaaaagagcatggcatctcttgctttctctctcaccatgtgatgtacctgctcccccttcccttccaccatgaataaaagcttcccaaggcctcaccagaagccaatcagatgtgggtgccatgattcttgtacagcctgcaggaaccaggagccaagtaaacctcttttctttctaaatgacccagttttgggtattcctttatagcaacacaaaatgggctaagacattaagtcaacaagatacacaaaacaacgcagttaagtaccaacacaaggcacaacccaatgagaatgaaataggcattgcagagtgccagtgctcgagagcagggctcctcatcgcccaggctgtggaccagcaccagtctgtggcctgttaggaaccaggctacacagcaggaggtgagtggcaggtgagcaaacattgccgcctgaactctacctcctgtcagatcagcagcagcattagattctcataggtgctcaaaccctattgtaaactgcacacgcgagggatctagattgtgcactccttgtgagaatctaatgcctgatgatctgtcactgtctcccatcacccccagaggagatcgtctagctgcaggaaaacaggctcagggcttccactgattctacatgatgtgtaattacacgttgtgtaattatttcattatatattacaatgtaataataatagaaataaagtacataataaatgtaatgtggttgcattatctgaaaaccatccttcctcactggtctgtggaaaaactgtcttccacaaaacaggtccctggtgccaaaaaggttggggaccgctgctccagagttcagagaagttagggcagagacgacctgggcaggcttctgaaggacttccccatgaacggaattctgctcagcagaggcatggggtgagggccgctttagggactgcatctggtggaagctcaaatgcagactttgtggattagctaggcaattcaagttccaaaaggatttttggaaattgtggatcttagggaaatggtagatgttgggctcattttgttttaattagctgaagaacataacaagaaaaaaagtttctccaaaggagggaaatcagaatatcttcatacatttctatttttgtctgtttcccaagaccctgagtaaaaaaatctaattcttatagaaatagtgacaataataatggtagcctaaatttatgttgccttacatctagcgggttccatttctttctttcttttttttttttttttttgagacagggtcttgctctgtcacccagagtggagtgcagtggtgcaatcatagctcactgcagccttgacctccggggctcaagtgatcctcctgcctcagcctctcgagtagctaggactacaggtgcacgccaacagactcagctaatttctttttaatagacaaagtcttgctgtattgcctaggccggtcttgaactcctgggctcaagcaatcctcctgcgtttgcctctaaaaatgctcagattacaggtgtgagccaccatgcctagacagccaagaacgttacatacacatacatcattttcccacatctgtcatgaggcaagcatgaaaaggccttttttcctccttgagatggaaaataaactgtaaggcattggatggtacctgacacggtctggaatcaggatttcctgactttgaattcggtgccgtgagtgatggcaaggaaactgctgtttttcagtcacctgaaactttaggtgagttgctgtgttgcccaggcttctcatgaactcctgggctcaagcaatcttcctaccttgacccaaagcactaggattataggcatgaaccaccatgcagaagccacgtttggtgggagttgtgtttttgttgttgttgttgtttgtttttttgagacagagtctcgctctgccacctaggctggagtgaagtggcgtgatttcggctcaatgcaacctctgactcccaggttcaagccattctcgtgccacagcctcccgagtagctaggattacaggcacccaccaccacgcctggctaatttttgtatttttagtagagacggggtttcatcatgttgcccaggctggtctcaaactcctgacctcaggcgatctgcccacctcggcctcccgaactgccgagattacaggcttgagccactgcgccccgccagtgggagttttatgtacattatctcaggcaatgcaaccacatcatgaactaaggcaattttacagaaatggacagagaatcagagggcatctttcagtttgagttaaaatccagtacaatgaagatatgatactgatagtgagaatgagatcagacatggaagccagagactctctagacacacccttttcctatgctatggtatgtcttgaatttctgaaaatatcactgggcttaaaagtgaagaaaattatactggaggttttttcttcttctaaaaatctccacataaatgggtcaccttgaaatactgttctcataatgcagttacaatttttaaaaattgctgccgggcatggaggctcacacctgtaatcccagcactttgagagccccaggcaggtggatcacctgaggtcaggagttcgagaccagcctggccaacatggtgaaaccctgcctctattaaaaatacaaaactagccagttgtggtggttggtgcctataatcccagctactcgggaggctgaggaaggagaattacttgaacctgggaggcagaggttgcagtgagctagttgcactgcactccagcctgggcgacagagcaagactccgtctcaaaaaaaaaaaaaagaaagatgtggacatgcttttttcttctcttttccagggaggcaggtatgtaggaagatccacagaggggcagtgcatttttgggggactgatgcccagattttgttcaggtgataattatctgccagacttctcatcgaaagggcgatagtgcatgcagggaaaaggtaccttgagccagcacccctgaggaagatgtttgtattatgaggactcacaatcggtctggggaaggtgtggatgtcagcagagaaggagccgcaccaccacaaggactctgttctgagtgggggggaagaggaccacatagtctcttcccttgcccaggcagcaaaggtccctttttgatcagcaaatcaaatcagcaaataaaagctgatttgatgggtcttccaaatgctcagtttctctattactcccatgacccaaggaagccatggccttctaagagagagtcatcatacatgtgacactgagctccattagaatttggtttcaggccgggcacgattggcttatgcctgtaatcccagcactttgggaggctgaggcgggcggatcacctgaggtcaggaattccagactagcctggccaacacggtgagatccccgtctctactaaaaataaaaaattagccaggcatggtggtgcattgcctgtaatcctagctacttgggaggctgaggcatgagaatcgcttgaacacaggaggtagagattgcagtgagccaagatcatgccactgcactccagcctgggtgacagagagagactctgtctcaaaaaaaaaaaaaataataatttgttttcagccaggtgcagtggctcatgcatgcaatcccaatgtttttggaggccaagatgggatgactgcttgaacccaggagttccacaccagcctgggcaacatagtgagaccctgtctttacaaacaaatttaaaaaatagccaggcatggtagcatgtgcctgtagtcccagttacttgggaggctaaggtgggaggatcacttgagcccaggagttccaggctgcagtgagctgtgatggcaccactgcactccagcctgagtcacacagcaagactctgtctcttaaaaaaaaaaaaaaaaaaaaaaaaaaaagaatttgttttccatgctgccagtttgtcactatgacagtgcggtctggactgaaagaatggccataaatattgtggacattcagagtaaggaagcgaatccctgacaggctatgaggcaggagaatagggtttggagacagggaacataaggacttcctagagctaaatcaaatggaaacacttcagctatgacagaactatcctctccatttacaaagggtgtacgtcgagtaagtgactgtaactttacttcatcctcttcatttacataaggcgtataccaagtaaccaatggaaacctcgagagggttttttgtttgtttgtttgagatggagtctcactctgttgcccagactggagtgcagtggtgtgatctcagctcactgcaacctctccctgaggttcaagcgattctcctgcctcagcctcctgagtagctgggattacaggcatgcatcactgtgcctggctaatttttgtttgtagtagagatggggtttcaccatgttggccagggtgatctcgaactcctgacctcaagtgattcacccaccccggcctcccaaagtgctgagcttacaggcatgagccaccaaacccagccttagagggtatttaaaccccaaaaaattctgtaacagggctctcgagcccctatgcctgggcctgctcccaacctgtggagtgtactttcttttttttttgagatggagtctcgctttgtcgcccaggctggagtgcagtggcacgatcttggctcactgcaagctccgcctcccgggttcacgccattctcctgcctcagcctcccgagtagctgggactacaggcgcctgccactacgcctggctaatttttttgtatttttagtagagacggggtttcactgtgttagccaggatggtctcaatctcctgacctcatgatctgcctgcctcagcctcccaaagtgttgggattacaggtgtgagccaccgtgcctggccactttgatttttaataaatctctgcttttgttgcttcattccttccttgcttcatttgtgcattttgtccaattctttgttcgagatgccaagaacctggacaccctcccctggtaacacctggagagtgagccccttatgggaggagaattgctcacagttgttttagccacagcacaagtatgggcagggcggaaaggggtctttcatgtaatctgttccaactccatcattttacaggtgaggaaactgaggcagagggactcattcaaggtcacccacagatacatggaagggttgagaataggatctaggtctccgacaatcactaccacgcatttttggatattgcagagtacttgccaaaaaacctaggcatcatctttgattctgtgtcttccttcaacaccccattcctatgaccaatccatcaccacggtcctcttaaagacttgcaagcatagcccgaactgatcctctccccaccactctggccccaaacagctcatactgagttcctccctgacccagagtagtcaagtccttcttttgtccctaacacccccgatccacagagccacccgagtcagactttgaaactgtaaatccagtcagaacacacctctttaaacttaaagctgcttcagaccacacagggaatcacgtccatactcctacctgatcagcccactgcacatctggcaccagccagtctccctcagtctgctccagccagactggctttcttaatgctctgggaacatgccaagctgctcccaccttaggactttgtatctactgttccttctgcacagaatgccattcccagagttcttcataaagccggctccaccctgtcattcctttcctagccatttcaccctctctgagaagcctgccctaaccaggcattcctgaataggcccccgtctatccccgttttatttctaccataacatttatccataaatgacatttccttgtttgttcatttattgcctgtctgccccatctctctcattcacggccagtgcctgaaacctgctggacacatagtaggctcttagtaaatatcagtttaattactcagtcaaaagatgacagcatagctgcctctagggcacaacacccttttctttttatatggcataagggactttgatcaaagagctctctaacaccatgtactctccagaaaacactctcagtaaagaaatgcttttacttacagtaaagaatagcagaaacggccgggcgcatggctcatgcctgtaatcccagcactttgggaggccgaggcagctgcatcacctaaggtcaggagttcaagactagcctggccaacatggtgaaaccccgtctctactaaaaatacaaaaattagctgggcatgatggtgcgtgcccgtaatcccagctacttgggaggctgaggcaagagaatcgcttgaacccaggaggcggaggttgcagtgagtcgagatcatgccactgcattccagcctgggcaacagagcagtactccatctcaataacaaacaaacaaaaacaaaacaacaacaacaacaaaaaacgaataacagaaacaagtttttccagcttctgcaagaactcagtgaggagtctggtctgctatagcatctctaaatatactttttggattggcagatgtcacataccctactaagacaaaactgatcacagccagaaacctggcatctatggctcagtggctggttctggttggctcaccctgagccaggatttgaaatcaaagtctttgactttgaaatcatgcaagcgacttgcagaatggtggatcttctgatgtcttgcactttttctgtgctctagtttgtcaaactgctgcagcctttttttttttccattcccctcctgggagtcagacccaaccaatccatcacttgcccaaaccaacagatgcggctgctgatggtggagggagaaccaggcaggaccaccccaggatgtgagtgagtctgctttctgggacatcttcaagagaaacagttgctagctgaagtatgaaaaatgaagagtctgcccagcagcttccttcttgcatctctatcaaatcactgatctgttgaattggatatgcgacctgcaactgctaaattgaagataccacaggtcacctggcaggatcttcctaaatcatgaaactttcatgcttagggtcctcccattcttggctccaccctgacgcctcaacagcggctcagtggctcccagtcatttctgcctttcccaagtgcacccccctcacctccttgcctgaggaagatgttggtattaatatgataataactccacagttggtccagggaaggcgtgcatgtcagcagagaaggagctgctctgccacaaggactcggctctgggtgaggggaaggggcccacataggcttgtcccttggccaggcggcaatgctccctttttgaggctagcggcacataaaagctgatttgatcggtcctccaaatgctcaatctctgcatcacttccgtgacccaaggaagccatggctgcattactttcatgacccaagaaagctagtgtagatcgctagcgatctcaactcattcctggactattacaagtacggccatacggacgccccaggtgccgggctgttccctcttgcacaatctgctgaattcttttttctaaaaccaagccccaccatgctcttgtcggctcggcccctgtaggatccctgcatccttcctgccttcacattcaaagctcatcaatacctgtccagcttcttctaatccccagaaagtcttcttcgattcctctaataggagaaagtgccttcctctttagcttgtcataaatgccttttgcatggctttcgtgactcagtcctccataatttattatttggagataaagtcttgccctgtcatccagtttagagtgcagtggtgtgaccacagctcactgcagcctcaaactcctgggctcaagcaatcctccttcctcaacctcttgagtagctgggactacaggcacgcaccactacacccagctgctgtttttaattttttgcaggaacgggatctcgttatgttgcccagggtggtcttgaactcctggcctcaagcaagccttccactttggcctcccaagtagctgggactacgggcatgagccaccacagctgcctcagtcctccacactttatcttaatctgttggtgcccacggcttctctcctccatcctgttcttcatcttaatattttccatatggccttgttccctgcactatttaagtagatgcgtatcaacacacacttgtggtagaagaatggatttatcatcttaaatgaccactccaggccactcgaattgctgtctcattggcaggagaaagatatagtcacctcttcttctcctttatatactgtcaaggctttggagaaaagccaattttctgctttaatatacatattctctttctggtgttttccgcattctaaggtgctttcacgcctattaacagcattttaccttcataatagctcttttgagatgtgtgtaaaagtgttttgaataattgttgataaagtttcctgagaaataaatatttactgagtgccatttatgtgttaggcattgtgctgggagtggggacccaagggccagcaggactttgcagagactgacaagcagaggaccagtttccatgtcatggggcagatgctctgatggggctgggctgatgtttctacaggggaacataggaggcacctgtctcctggggggtgagggaggcagctaggaaatgtcttcatagacagggagagctaggcaggcaaggtggggttggtggttggcagtgtggacaaaaaaaacatgatctcagtctctcaaagaaaagagaacctgagaatctggcttactggaacaactgcaatgaattcactattgctagagaatcaggggtaaaggctgggcacagtggcccacgcctgtaatcccagcactttgggaggctgaggcaggaggattgcttgaggctaggaatttgaggccaacgtgggcaacatagcaagacatcatctctatgagaaattttaaaatggggccaagcactgtggctcatgcctgtaatcatagcgctttgggaggccgaggggctgatcatgtgaggtcaggagttcaagaccagcctggctaacatcttgaaaccctgtctctactaaaaatacaaaaaaattagccaggcgtggtggcacacacctgtattcccagctgctagggaggctgaggcaggaaaatcatttgaaccagggagatggaggttgcagtgagctgagatcgtgccactgtgctccagcctgggcaacagagtgagactccatctcgaaaacttaaaattaaaaaaaaaattaaaaataataataaaaattagctgggcatagtggtgtgcatgtgtagtcccaccttctcaggaggctgaggcaggaggactgcacgagcctgggaggccatggctccagtgagctgtgatcacgccactgtactccagcttgagtgacagagtaagaccctgtctcaaacattaaaaagaagatacggattgagaattgactgtgggatttagcaacatggtggtcatcagtgacctccactagagctgttttgttttatggaatggtaagaatgaaaatcaagacagagtagattcaggagtcagtgggagaagagaactggcagcagtgagtacagactactacctggggggttgattcagagcagtgaagaggagtgaggtttaactcttctctacaggggaacagacagtttcatttgactattattcttcttatttattttacccacatcttacaaggcgtggaatgttgttttttaggatgagagttgtctaagtatgtttgtatctgtattagtcccttctcatactgctaataaagatatacccaagtctgggtaatttgtaaaggaaagaggtttaatggattcacagtcccacatggctggggagacctcgcaatcatggcagaagacgaaggaaaagcaaagggacatcgtacatggcggcaggcaggagagagtgagaaccaagcgaaacggaaaacccctgataaaaccatcagatctcgtgagacgtattcactaccacgagaacagtatggaagaaaccgtccctgtgattcagtgatctcccaccaggtccctcccaccacacatggcaattatgggagctacaattcaagatgagatttgggtggagacacagccaaactgtatcagtattctaatgggaatgacacagcggagaggttgaaaagctgatcaactttttgcatacgttcctttatttaaatctcaaaatgctctttgaggtcaatatgacccctactccctaagtgagaactgcaagaatcagtgaatttagagattccacacttaagtcaatggcacagcaggggttcaaatccaggtctgttgaaccccaaaatgaacgctttccccactggtctaagtggaaaatattacagaacatactgcattgccttccttagattaaaaaactgatcaacatagaggtaatatagggtacagatcttaagttttgagcatgccctggctcaataagcccctgatgttctggaactcaggagatccgtcctggaaggagtcagattccaacatgacctgactatgatgcacttatttcagaccaagcagacagacaacctcctctgggaggaaagtcagaagtagaatgtactctaagagggcttgagggctgaagattgaaaagccgctatttagtctggcacctgggtggtacctggtgatctcagagccggcagtttcactgaaagcccccaaccgagatagtatagactgggccatgtatgttctggatttttttttttttttgagatggagtctcactctgtcacccaggctggagagcaatggcactatctcggttcactgcaacctctgcctcctgggttcaagcaattctcctgcctcagcctcccaagtagctaggattacagacatgtgccaccatgtccagctaatttttgtatttttagtagagacggagcatcatcatgttggccaggctggtctcgaactcctgacctcaagcgatcctcactcctcagcctcccaaagtgctgggattataggcatgagccactgtgcccagcccgttctagaattttaatagcagaaaggaactttgtttccttttgtgatgagtaggatgattgagggcacatatgtatgctgtaggggaggacttgggagctacagaaagactgcagataagagtgcccggaaattttactattgggcattatttcaatttaaagtattttttttaaaaattattattatttttgttctgataacttttttttttttttaaacagagggagggtgtcgttatgttgcccaggctgatctcaaactcctggccccaagttatcctccagcctcagcctcccaaagtgctgggattacaggggctgactgtgtccagtcccaatttaaagttttgattgtatgtagcagtgcaggcacacagcaagccaggagcatttacattttattttattattttattttattatttgagacagagtttcactctgccacccaagttggagtgcagtggcacaatctcagctcactgcaatctctgcctcccaggttcaagcgattctcctgtctcagcctcctgagaatctggaattacaggcacccaccatcacgcctggctaatttatgtatttttagtggaggtgaggtttcaccatgttggccagtctggtctcaaaactcgagacctcaggtgatccacccaccttggcctcccaaagtgctgggattacaggtgtgagccaccacacccagccctatactttatttttttgatagtcaatcccttcatctcccttcacgggagctttatgaattggtggggaggtggtgaaagcgaaatgagacaccgagagaagctctgaaattaatcatcttgtttctatcgcagccgaagacatggtctggatgctgaagtaatcaagcagccactctcggctttgatggacaattcactttcatcttctgtgagagaattttgatttacttctttcagaaagattgataggaggtgggtgggactgtgacttttaaatttttggttagatctaatatttttcttgactgtaagaatttatcattaatgattctggaaagacaaaaacgtgatgaaatctgatacaaaagcctaaaaaggaaataaagaggtttaaaaaaataaaacaaagacactcttttcgtagtaagcaactcagagatgaaatatttcactctgcaaaaaatcaaaccccaaaaaagacaccactctcaaaccttgacactctttctctaccccattacgatctgtcgcctgtactgatcactgcaaacctaaaatgccttcctcaacttacaaatggcaaatctcttaagtaacttcagttctcagacagattaatgcaattttccggtgagttagacaggcatgaagtgaggtgattctccggattttttgttttgtttttgaagaaggagaagaaactaggaatgttctcattttaagactgaaaaatttaggctgggtgctgtggctcacacctcgcactaagaaagtgcaggtttctgctgggcatggtggctcacacttctaatcccagcactttgggaggccgaagcaggcagatcacctggggtcaggagttcgagaccaacctggccaacatgatgaaaccccatctctattaaaaatacaaaaattagccaggcgtggtggcatgcacctgtaatcccagctacttgggaggctgaggcaggagaatctcttgaacctgggaggcagaagttgcagtgagcccagattgtgccattgcactccagcctaggtgacaagagtgaaactccatctcaaaaaaaaaaaaaaaaaagaaagaaagaaaaaaaaagaaaaagaaaaaaaaagaaagtgcagtaattaccaatctcttacatggtatattccatcatggtgaagtctgagattttaatggatccatcatcttaatagcgtacattgtacccaacaggtaatttttcaaatctcacctctcccaacctccccctttatggagtccccagtatctactgttcccctctgtttgtcaggtttcttgccctattctcatactggtcttgttaaaatgagcttattattagtttgatccattctctgtctcatgagactcttggcttcctccagttccctgtcttcattgtaagacacaacagacaactcagggaggcccctttgtgtagtcttcctatctgtcaaagaccttattggtccttcacaaagtaccaatagactaccaagtttgcccaggcacatgtggtatatacagttcctgggagaaggggaagctcattttcctttcctcaaaaggacttgcctctccacccatcttaggaaagttttccaaatatataaaaacagcaaagtctggattctccaatcctatgtttgcgatctccaagaaagaacaggacacacttccggacaacttgcgttgccatccttcagagctgaccacaatggtgctagccacattatgtggtctcttctgttagatttcatgttagctgcttgttcaaaatcaggcagaaaggcagctcctcctgcactgtgagacctgacccatcactgctaccttaacagactgagtctcccacccagcctcacaacagacattgcccagagttctttcttgactgacagatcagaccctcagatcactttccaacatgctgcctgacttctccgagtggctttccttatgacgggaaacctggagtatcaggctttcacatgcctgtattttgggtcacttgttagttataaaagataggcataggctgctcaattaaagcaaggatgttctggaagctgtggcactatcaaaggctaggagagaaagcaaactgaatggcttgcccctctccttttcaccagacttagtagcagtgaagcacctgtcatggtaggcagtgatgagtcaggtctcatggttcaggaggagcttcccttctgcctggtcttaaatgacaagctaacatgaaatctaatattcacataatgtggctagcaacattgtgatcagttctgaagtttggacaagttgtccagaagtgtgttctgttctttcttggagatcgcaaacacaggattggagaatccagacttggttgtttttatatatttggaaaactttcctaagatgggtgagaggcaagtccttttgaggaaaggaaaatgggcttccccttctcccaggaacatctaccaaaacgactatgttcctttcccagagcatagagcataggggtataccagttctcctgatgagttttaacatgatatagatagaagagacttggagtttaggacatctctacatattccagggttttgacttttttacctttccagcttttttttttttttaagtgggggaagggtatgtgtggtggatactttcagcaaaggtgagacacgatggtcacccagtcccaactccatcagcacaagaggacagtggtcagactccatggtgctcataggactagaatctatttctagttctagtctatttcaattcctgggcaaaccaaatgtgatgtctcttcacagttgtattcttttttaaaaatgcatatttaggccgggcacagtggctcaggcctgtaatcccagcactttgggaggccgaggcgggcagatcacctgaggtcaggagtttgagatcagtctggtcaacatggtgaaaccccatctctactaaaaatacaaaaattagctgggcgtggtggcgggcacctgtaatcccagctgctctagagactgagggaggagaatcattgaacccaggaggtggtggttgcagtgagtcaggatggcaccactgcactccagcctgggcaacagagagagactccatctcaaaaataaataaataaataaataaataaataaataaataaataaataaataaaataaaataaaaaaataaaataaaagcatatttagaggatacaaatgcaggtttcttacatgtatatattgcatcatgaacccatcatctggacagtgtacactgtacccaatagggaatttttcaaatcttacttccgtcccagcctctccctttatggagtccccagtatctatcattccctccgtacatccatctgtacccattgtttagctcgcatttgtaagtgagaacatgtggtatttgactttctgtttctgagctatttcactgaggatagtagcttccacttccatccgtgttgctgcagaagataatgattgcattcttttttatggctgagtagtattccatggtgtctatgtaccacattttctttatccattcctccactgatagatatttaggttgattccatatctttgctattgtgaatagtgctgcaacaaacataccagtgcaagtatctttttgatataatgatttctttcctggtagtgggattgctggattgaatggcagttctaattttagatcttttttaatagttatattcttccactctctacctccatgcaggtgcaaactcctacaccattacctggtcgtgatattaagactttttattttattctaatttaattgttttttgagacagagtcttactctgttgcccaggtggagtgcagtggctcaatctcagctcattgcaacctccacctcccaggttcaagcgattctcgtgcctcagcctcctgagtagctgggatcacaggcttgtgacaccacacctggctaatttttgtatttttagtagagatggggtttcaccatgtttcccaggctggtcttgaactcctgacctcaggtgatctgtttgccttggcctcccaaagtgctggaattacaggcatgagccactgctcataagactttttatcttaaatgaatttcacataatcagcaaagttactatcattgtcagtccaattagtctatacctataatacataaggtatctgaaagattacttctcattcatttattcacaatgccaggaactgtgccagatactgggtatacaatagcaaacaagacagacaaggaatcaaaccgagcttacatcccctcttctaaagacagatatttacatcctaatagaaatttccctaccaaatgtatttatacataaaacccagttctgttttaatgttagcacatgagatctagctgatgaaaatgttacctgtatttcccccttgggagtcagccccatagaccagtaattaccaatctcttttctgccataaaacccgtaatagattacgttcacttgtgtactgtactcccatgggtactgttacatgaaatctgcaaacttctttctctcactattaaaacaaacaaaaaggaataagaaaatgtgtgtgcgcaattctccatttgccatctccacaagccattccctccctgcacctctctgccctgggcccttggaaactgatctctgtagattgcatctcctagacaaacttgctgctagcttctgtttgggttaggccaattcagacaatggcaagaaattcaagggcagcagaagagagagggcagggtcctcctcccctgcatactttctgacaaaactctgctactctggcagtagctatgtctcttcacaagcctatttcccgctgagtggcacctcttccagacctcgtgaggttccagtaaccctttcccttcagcccttggagtgggaacaatttccagctattgtagcctcagggagcctcattatatcttgtttgttcctttcacctgcctaccctatgtccatcatctcttcatttgtatctgcgtattccgttttctcataaaacaagatgcaagtgcaagataggaaagttattataagaataaccttgtggccaggcacaatggctcacacctgcaatcccagcattttgagaggccaaggctggaggatcacttgaggccaggagtttgagaccagcttgggcaacacagcaagaccccatctctaaaaaaaaaaaaaaaagtttaaaaaatcagtcatgcctggtggcatgcacctgttgttccagctacttgagaggctgaggcaggaggatcacttgagcccaggagtttgaggctgcagtgagctatgatggcaccactgcactgcagcctgggtgaaagagagagacccagcctccaataaattaattaatgtgagcagaagccaattacctgtaacaaataccaataccgagtccatgctgcgaactgctggcaaaagccatgccatatttgagccctctgcatttgctaccgtttgaatggacattctggactatatagagagtgaatatttcccctcatctcaacctttcacactggtgagctcagggggctagaaagtgtgagactgactaagaagatttcaaattcccctagaaacctttcattatctaataccttttaaaattccactttgggtgccgtgaggagaagatttctcttccacatcttttctacaaattgctgaaagctttaaaccagttttatctacagtatgtcacagcaaatgtgggtcttttttccttctagtgcctgatctgtcaggaattgccaggccaaaaagaaaaaagacaatccctggtgagatgaacaaagtaacaaggaaaaatgaaatcagaagagatcagcgggatctcatcaattcaacgcttactcaaattctagtaaccttgaaagattcaagtataataaattctcatatataaggatctcagtttggccttcaaatactacaaagaggacaggtttaaacataggtatccaagatttgtaactggtatttaagttttggaatctcagttaccaggtaaacctggaaagtttactcttgctagtgtcacaaaattagggtcacctgtactaaacagtaagctctaagaaactttgttatttttattattattattatttttgagacagagtcttgctctgtcacccaggctggagtgcggcggcgcgatctcggctcactgcaacctccgactccctggttcaagcgattctcctgcctcagcctccagagtagctgggattacaggtgcacgccaccacgcccggctaatttttgtatttttagtagagacaaggtttcaccatgttggccaggatggtcttgatctccttacctcgtgatccacctgcctcagcctcccaaagtgctgggattacaggtgtgagccactgtgcccagcccacacagctcatgtttgtatttttagtagagacagggttttgccatgttggccaggctggtcttgaactcctgacctcaaatgatccgcccaccttggcctcccaaagtgctgggattacaggtatgagccaccgtgcccagcctaggaaactttttctcttctttttttcttatcgtctctccttggtccccaaattccactttttttcccttacccccttggtcaccactttatatgttttatatgtaatactgatacatgtactgcaataatagattacacttattagcacttattctatattttaaatgctacacgtacattaactcatcaaatctggatagcaatgcaatgagattatcaccattttgcaaatgggaaaactgaggcacaaaaattaagtaactcatctaacataagaggtaaatagtggagctgggattaggacctatgaagtttggctgaggaattcatattcttatcccctctgatatactgtccccaaaatatgtcttgttttcaatgtccgtgtatttaaacataaatgtttcctgctatgaatctcattgtttcttttttgactaaagggagcattgttaaggtttatccacactgctatgtatgtacatctgaactgttgctaagtatgtcatatcatatactttggcttacgcattcccctacggatggacactgaaatgggagtgttcctttatcccccgtcacaggatgtgcgacagggttgtgactcttctttgctgccctgctgctcaaactcctaaggaagcatgcagacaggcaggtgtaggggtcgtggggagcatttttgggctctgaccccacagcagtgtctaagggtgagtgtttacagctcctgaagccttggtgggcgtctgttacagtgtgctctttcagctttgccgtctgcagacagcttgtgttaatgagctcaattagaccctctgcttatcgcaaggacagagggctttctgtatcctgggttcttgccctagtgtactggaaaacttggatcacatgtgggcttggagaatgagtgtaaggttttattgagtggtggagatagctctcagcaagatcattaatatcattttcaaaagaacaaccggctgggcgcagtggctcacgctgagatcacgccactgcactccagcctggcaacagagcgagactctgtctcaaaaaaaaaccaaaccaaaacaaaacaaaaaaaggaacaaccctttatttcattccaaagtatagatatatttaacttattgaacacttcattaaaaatgcatgcctgtttccctctgtataaatgataagtctgggctttgcaagaaatgttgggaatgagatgggctttgggtaagagtcttccaatactgaccaatgtaatgttctatcagtccatgaagaaatctgtaaggaatagatggtttcactgacttgggctgagctcacaatcagcaccttaaaaacactgccagactttgagttagtagagaccgtttttgaggattcaggggaaaataagaatgttttctggctcacgttttatttttaactttttaattttggagacatggtctcactctgtcccccaggctagagtgcagtggtgccatcgtagctcactgcagcctctacctcttgtgttcaagtcatcctcctgcctccaccttccaagtagctgagaacacaggcacatgtcaccccacccagctaaactttttattattctttatagaaacagagtcttgttatgttgcccaggctggtctcaaactcctgggctcaggtgatcctcccgcctcagcctcccaaagtactaagatgacaggtgtgagccaccatgcccagcctcactttttaaaaagtatccctttaattgtttagatactaagatactacttttggaaaagcacaatctttagtgtgagtcctagaaagaaggtgccaaccttctgtaaggaaaactaaaagcttcctctcacttgcagatgacataattttatactcataagccaggagtgactttaataggtatctcattcattctacaaagaagggcttcagagctgctatttgaaaaacagtaacaacaaacaaacaaacaaacaaacaaacattaaatgcacttaaatggtgtatagctaaattcctacatagggacttaccttattcatttaaaagagatccatttttcaactgatatggtatatgcacaaccaaaagatatattggtgaaagttcaaagttaggcatatggtagtgaccacttaaaatatttcacaatttaaaattattgcagctatgttctggggcataaaaagatgccccagtatcactcaattgagtgattcctaaataatttacaaagataacttagtatttaaaagcctagaggatctttcttggtcttcttcctgtagaaaaggacagtagcggtgcttcttagagcttttcactgttgaaatatggagttttgcaaaaccatcaacaccacacttctgccctccaagtactaccagggagtataatcttgcattcaatctacacaatactcaatagaaaaatcagctgagacaatttctattttgcaggttaacctgaaggatatacagtctgtctatgctcctgtgcaagaccagataacaaatagttctggtgctccttgtagtttctatcccaacaattcaactctacagtcaactctgtcaccataaagcaagcagccatggacaatacaaattagtgtggctatgttgcagtataactttacttgcaaaataagtggcaagctggacatggcctgtgaaccttggtctgtggaatcctgccctaggtcaatgtttgatatggtttggatctgtgtccccacccaagtctcatgttcaattgtaatcctcagtgatggaggtggggtggtgggaggtggctggatcatgggggtggatttcttatgaatgatttagcatcatccttctggtactgtcctcttgatagtgagttctcatgacatctggtcatttaaaagtgtgtggcacctccctcctctctctctgtctcctgctcctggtcctgccatgtaagatgcacctgcttcctctttgccttctgccattattgtaagtttcctgaggctttttcagaagctcagcagattccagcatcatgcttcccgtacagcctgcagaatcaagagccaattaaacctctcttctttatatattacccagtctcaggtatttacagcaatacaagaacagactaataccatggttcttaacgttttggggagcaagtggtggtcactacccccattgaaagcctaatgaaaattatagttcttctcttccagaaaatttaaagctagattaattttacatgcaactttgtaagttgtaaatccccccaaatgaagaggctttctctagacactctaaaatttatcattgaattctgtcagaacaacagaaagatatgtccttgttcagcttccccagtagaagctgtttctggaatattctttgccatgatgtcattggtttttattgagaactgtttaggaaacatatctttgaaacccattcacttgtttattccaataacgtagtggataaacagttcaaaatggaaacaacttaaatattaaacctaaaactataaaatatacagaagaaaacagagaaagcctttatctaggcaaagattttttagataagatgcataaagcatgaataatgaaggagagaaatagcaaactgaacttcacaataactgaaaacttttattttcaaaaatcactgttaagataatgaacacacgagatataatatggcagaaaatatcacaaaacaaatacctgttaaagaaacctgactaggtgtgatgactcatgtctgtaatcctagggctttgggaaaccaagtcaggatggctttaactcaggagttccagaccagcctgggaaacatagcaagaccttgtctctactaaaaatcaaacaaattaactgagctcagtggtgcatgcctgtagtcccagttactcaggaggctgaggtggaaaaatcgcttgagcccaagtcaaggctgcagtgacccgtgatcgtgtcactgcactccagcctgggcgacagagtgagaccctgtttcaaaaaaaaaaaaaaaaagaaagaaaagaaaagaaaagaaaaaagtctgtgcccagaataaagaatataaagaactttcaaactcaataataagaaagcaatcaatacaatttaaaaaggggaagatttgagcatacatattactaaagaatttactaaagtaaatgaaaagaaagcaaacaaaaaccacaatgagatgccactgtagacttattaaacaggctaaaatttaaaagcgaacaaaagaagctaagaatatctattgctagcaaagatgtaaagcaactggaactctcatatattgctggtaggaattaaaaatggtatcaccactttggaaaacattttggcatctctgtataaagttaaacatacatttctcattttattcagtaatcccacacctaggtatttacttgagagaaatgaaaatatatgcccacacaaatgcctgtacatgaatatttatagcgactctattcatagttactccaaactggaaacaagtcaaatgtctactaactagtgaagggataaatgcacagagtgtaagctatggtagtacactcctgaacaaaaaaaagaaacagactcgtaatacacacatccacactgatgaatcttgaaagcattatactgaatgaaaaaaagccaggccaaaaggttatatactgtttcattctatttctgtggcattttgaaaaatgcaaaactacaagaagtgagatcagaccagcagttcctaggggctgggactagggctactgactccaaaggtacatgaggccttctttggagtgacagaaatactctcttttattttcgagatgaagtcttgctctgtctcccaggctggagtgcaatggtgcaatgttggctaactgcaccctccgcctgccgggttccagcaattctcgtgcctcagtttcccaagaggctgggattacaggtttcaccatgctggccaggctggtattgaactcctgacctcaagtgatctgcccatctccgcctcccaaagtgctgggattacaggtgtgagccaccgtgccgggacccggggtgatggaaatattctctatctttaatgtagtgctagttagatgagtgcataagttttatcaaaatacatagaagtggctggctgtggtggctcacacctgtaatcccagcactttgggaggctgaggtgagaggattgcttgagtccaggagttcaagaccagcctaggcaacacagcaagaccacacctctacaattttttttttttttaattagccagttatagtggcactcacctgtagtcccagctacttgggaggctaaggcagggggattgcttgagcccaggaggttgaggctgcagtgaactatgattgtaccactacattccagtctcggtgacagagtgagcctctatctcaaaagaaaaaaaaaatcatagaactgcacacctaaaggatgaattttggaaattatatctccaaatacttcattcagtctccccttcatgtggagtcaaagaagaaacgtttcagcaccagaaatggttatacagcacttctcttgagtactggagttgtttttatcttttgcagcctgtgaaccctgtaactaattagtgttaccctttgcccaggctcttagcaagcagggcactgggtgtctgacatgcattctcggtattaaccttctcctcagcatcatcttactttcctactttcatttgccttttgtcctgatttctttctaacaaaccgttttatcttaatgtggtctagatacttgtcagagactaagtatttttttaatcaaggtacagtgtacataaccgaatacatacatacataaataaatcatgacagtgtctcctcctgacacatattaataaacattcaagccataaaaacataattcattaaggcttactatcatgcagaatctaccatgctttattcaatttgggatgtttctttgtatgaggaataaggatctgaacatagcattatcagaaaaaggtaaacaggatggtacttagggaacagggaagtttatcccggagaagagaaagagagacagtgaaaacacaaaagctttctttaaatattttatgagttgtcaggtagaagggaagtaaattaattctgacttgtcccattgaattaggtgtggggccaatgggtacaggctactgtaggaccatttttttttttttttgagacagggtctcactctgtcacccaggctggagtgcagtggtatgatcttggctcactgcaacctctgcctcctgggctcaagtgatcctcccacctcagccttccaagtagctgagacaacaggctcatgccaccactcccagctaattttttgatttttggtagagagagggtctcaccatgttgcctagactggtctcaaactcttggactcaactgatcctgaactcttggactcaactgatcctcctgccttggcctccgaaagtgctaggattacaggcatgagccaccacgcccggcccagcaacccattcctaatggggcacagaacagatacaatgtactgtccgagaaaagacagagtttctaggcagtggttatcactatatatacaggttggatagtcatttgagaaggatctcctataaagattcatttagataaatgattgcttccttccaatcccaagacttaacagttacttaatcctgcgagaaaacagtacccttctgatatgaaactaacttattctgactaagcaaacaccctcattttcttacttatcaacttacgttattatattaagttatatcacaatcccagcatatttgaccaagtagcaatgaaaaggctataccaagaagacattcttatactcattttaggctttggccgttaagaaatccaatgcaaaatggcaactaggctttttgggacttgtatctgcaaaatataccttttttttttttttgcagccagctacccttttatgccctccagaaataggcaggcaatacaacattctctgaatggaagttaaagtgatttcccacttcgtccccgcgctttaacacttaggcaataaagctcgtgacattttcaataaggagcagagaagggaagtgctccttattcacaaaagggctcaagtcatcaccatcccagcgttttcctatttgacaaggcccagttactgccaaatggcaagacctacaatttaaaaaccactttgatcagcaccagggatctgaggctgataggttcagcaaaattgagagccaatttcaggctggcttgaacacctagattccaagcctgtgcaggttcactcggcattcccagcggaggcaagaaagatcctgaaggcatcttaggtgtgattatgacactaggaaccagtaaaggaaagagcaaaagcaatactgcaatatgactgagaattacaggcacacagccacaaaagaggactggtaaatagggagtaatgagtgtgtctgctggaaggcacgctataaaaagaggccaaagaaaggagatgaggccaggcgtggtggctcatgcctgtaatcccagcgctttgggaggccaaggcgggcaaatcacctgacgtcaggagttcaagaccagcctggccaacatggtgaaaccccgtctctactaaaaatacaaaaaattagctgggcatggtggcagatgcctgtaatcccagctacttgggaggctgaggcaggagaatcgcttgaacctgggaggcagaggttgaagtgagctgagatcgtgccactgcactccagcctgggcaacaagagcgaaactctgcctcaaaaacaaacaaacaaacaaacaaaaaaccccgaatatttactgagacccttgtatgtgcaaagtatgaaactaagtattctatatgcattatctcatttgattgtcacatctgcaagaagcaaggtcatattattattctcattacacaggtgaagaaatacagggccgtgtatgatggctcacacctgtaatctcaccgttttgagaggccaacgcagggggatcacttgagcctgggactttgagaacagcccgggcaacatggtaaaaccccgtctctacaaaaaagtaaaaaattagccaagtatggtagcatacacctctggtcccagctactcaggaggctgagatgggaggatcaccagagcctgggaggctgaggctgcattgagctgtgattgctcatagctccattcacagtcactccaaactggaaccactgcactccagcctgagcaacagagtgggaccctgtctcaaaaaaaaaaaaaaaaaaaaaaaaaagaaagaaagaaagaaagaaagaaagaaagaaagaaagagaaagaaagaaaaaaagaaagaaaagaaagaaagaaagaaagacacactcagagttgacgctatttgctcaagctcaacccaactaaaaagaggtgaatacggacgtagtacccacgaatagacaagtaaatgaatacacaataccctccagacatctggaccctgatatgtttaaatttgcatctctctctgaaaccttcagccttctaggggtccacaggcccaaagcttaatgatgacattcaattcgttctgaacaccccacaggatttttcaatagtgggcgtttgcattttgttgcacgctcagggagaagaaacttcgtgtatatctgactcgaaaattgtgtgggccaaaagacttctggttatagaatggcggcctttgtgagaaatgatcctttggaggtctgatccattttttgttttagtttatatctgaaaggagaatatttttaccttctcttttatgttcatctgctaagagagcgtgcaatacttccacacaggcagaaagaacagacctaaagtgggataatttggccaaaggtgtatcctcttttcctttggtattttgtcgcaagtgataaatgatgtcagacaaagctgtcagatgagatttagatggtgtgcagagagacagcaatcaatttccaacttaggaaatttaatggattttaatgagccactctctgttgattaccatgcagctttcagcttcgtgcgtgcttcattcacacgtgtgcttggcagtgattgatgggccgttaagctcccctcatttgattcctgtatagcaatcaaggctgtctcagctgtaaccaggagaggctgatgttgagacctgcaaggcgtgtgggcagagtgtgatctcttgcgatcttttgtttgttccccatattttgcagcttggaacagtcacctgatgttcactcatgaaaagagggacagttctataaacattgagccccaggaattgccagccaggtgagagaattgtcctccaaagccctcacaccatcccctcactggagggtgggttctttgagggcaaacgctgatctattccagttgatggtctcattaacagcaacataagtaggtgctctctatttttgaaaaaataatcctgcactacttaacaggcacattccctgaaaattgaattctgttttgggttttttttttccctttttttaagacacagttctcactctgttgccctggctggagtgcagtggcacaatctcggctcactgcaacctctgcctcccgggttcaagcgattctcctgcctcagcctcccaagtagctgggattacatgtgcgcaccatcacgccgagctaatttttgtatttttagtagagacggggttttgccatgttggccaggctggtctcaaactcctgacctcaggtgttccatccgtctcggcctcccaaagtactgggattagaggcgtgagccaccttgcccagcctgaattctggtttgagtattccttgcttctgatgtttgcaccatagaaataatgggtaagccagaagatacgtatctgtgagccaatatatggttatctcaccgcgtggcaagagcagaaatgtgtcttctccttgcttaagatgaggcttttaaaaccagagacgtgtttatgaactgtaaaccctcattaagaattttagatttggcacatttaagatgcatgataatttgatgaggggagggcctaagtcttcatctccattatcactgaaaatgagctcccttgccaaacaaagggtaaataaaatgacgcagctacgtttaagtgacttaagtaaaaagaaaacttccagagactttggcgttttaattgagggtataaaaggatgctctaattatcaatgtgtctcagagattccatttaaaaatactttttaaaagtagcagttagtttcaattaccttcgatatacaaaaatgtggggatgtgctgtaataaagccccatttcttcaaaatgtctaaataatgaggtatctctaagtagtccaggctggccttccctgcatagtctgaattgatgtaattcaaccaaatatatggtaaacaaaatgatgatctttattaacttggatcatccttgcaataaagacacagcttggctgggcatggtggttcacgcctgtaatcccagcactttgggaggccgaggcaggtggatcacctgaggtcaggagttcgagaccagcctggccaacatggcaaaaccctgtgtttactaaaactacaaaacttagccaggcatggtggtacgtgcctgtgatcccagctactcaggagattgaggcaggagaattgcttgaactcgggagggggaagttgcagggagctgacatcatgccactgcactccagcttgggtgacagagcaagactccatctcaaaaaaaaaaaaaaaaaaaaaaaaaggaaaaagaaaaagaaaaaaaaaccccacacagcttatattgctatctagtcctttttagaaaagaatacacaggctaggtgcctgttccaccaccccttgaggtgttttcttctgctacgatgcttactgaccattctgtccttgaagattctgggcagaaagcagtagactatagtgacaatctgtgatctggatgaattgacaagcattaagtgggcaggtattggcaagttctggggaacaaaccatccgcagagatgtctgtgacttggaaagtgcagccacagacgttcttttcccctggccctgctgtcagttggaacaaactttctggcactctgggaaggaagacggtcaccacctggcctacggctctgtagctccgaggttggactggtgcaattccgctcggattagcaattaggttggaagccagcacaggctccatttgggcaatagttctgggagatgagatgaaggcccctgagatgttttgctctctgttctcattaaccttctgtctggggaaagaaggtcctgtccttaagccaggaagccacagcagggcggcacatcagtcaccaaatcccacccaaccagctggggctttcaccaaatccaattagtcactggctgtgtttcttctcatcagcaagaagggtgctgtgcagggacagatactcttctctgggcaaacccatcccagcaaacaagcccagagacaggtcctgcaacagaggcacatttagggagggatgtgagccccgtgctagcctcttgttccaccaatttgacattcattcctctggtgggtggcatctgtgtcctcagtcataaaaaacaataaagtttaaatccaatggcagaatcaatatttgtagtctctatcccatccaccacctcccttgttaattttcctggcacaatccatatccaatatcttccatgtgcttcatggaacatacctgtgctctttcatttttatttttatattttttaaagaagggggtcttgttctgttgcccgggctagagtgcagcagtgcaatcatagctcactgcagcctccaactcctgggctcaggaaatcctcctgcctcagcctccacagtagctgggactacagacatgcaccaccacaaccagctaattttttatttttatttttctagagataggatcttgctttgtgacccaggctggtcttgatttctggcctcaagtgatcctcttacctcagcttccaaaagcgctgggatgataggtgtgagccaccacacccggcctcttttttatttagttttttaatgagatcacaccaataattatttttaaccatgaagacccatgccccttaatcctccctccatgcactaactttcactctcttgctcttccatcctcttttcatgataccagtttcagtacaaaacacattaggttaggttggtgccaaagtaatggcagcttttgccattacttttgatggcaaaaactgcaattactttggcaccaacctaatagtattaccagctatattaaggcttttaaaatttgagatctcgagtacactctaattatgccagactccggtctccacaagagacaatttccaaccattcacaccagactgagaggattctcaagacaaacatttatttctggtcactggtcttgggtccaccattgactttatttgaacaatgatttcggtcaagaaccaaagaacttcagaggatacactgatgtaaaacacatgggggtagatcccaaggctggccatctggtcatggcaatgactgaaaggtgatgaatcacgtaacatccccaagcagggtggactgagaaccagagagaaaggcaaatatgatagctggacgtgaccttccagggacccttcctttgtggagctaggtcatggggatggtcttgggccacacattcccagcactgagcctggctccttctcccagagattctccctccccaaatgcagaaatgggagcagcctgtgtcctggagcatagatggcctctacagactcttgcacggaaccctagcctaggttctgtccagagacaggagcgctgggcgcagggatggctgagatgttcccagagatgggaaatgaacgaggtcctccctttgatccttatcctattgaaaatggataggctgcttgaaaggctgcgtgcagtgactcacgctgaaactgtgcccccaaagagttaaaagaaaccaaaagtgaatggaaattcttgagtctgcaggatggcagatagaaaaagaaacaactggctgaaactccctctgcttatgagataaaagaactgactgaaatcgattggaaccaagatggctggctggagtttgcacagaaggagcctgctgatgtcacaacctgaatttcccctgcctgtttcagactaactccccctgcaatttgcacgtgcaacccgtgagctaacatgaagagataactgcgcatgcccaaggactttccagagcactttctttccaccaatcacctaatctcaaaatccacccgaaccttttctaataaaaatactgccttgaagccaaccacaaacagacgaatttgatcttgacacttctgtctgcttatgagttgactttccatataaagcttttcttttctaaaaaacctgatgtcatagaactgattttggtcaaaaaccaaaatcaattctagtgcattgggcacccttttgcttgataacaatgtctctaatctcagtgctttgggaggccaagggaagagtctgaaaccagcctcggcaacatagcgagaccctatctctaccaagaaaaagaaaaaaatcagctggcacagcggcatgcacctgtatagtcccaggaacttgggaggctgaggtgggaggatcacttaagccaaggagttcaaggctgcagtgagctttgatggcaccactgcactccagtctgggcaacacagcaagaccctgtttcaaaatttttaaataaataaataaaaatgaaaacgtgagtttgatgagaatttagaccagacagtgttgcacctgcttcctctcatcagattttacaatcagaggggctagtgcctggcactcagccacacaggtctgtctcatgggctatggacacctgctgggagtttacctgagacacatgtctccacagtgcttacaaaaagcaatgcaaagagccaggtgtggtggctcacacctgtaatcccagcactttgagagactgaggccagtggatcacctgaggtcaggagttcaagaccagcctggccaacatggtgaaaccccatctctactaaaaatataaaaattaaccgtgcatggtggcgggcgactgtaatcccagctagttgggaggttgaggaaggagaatcgcttgaacctgggaagcagacgttgcagtgagctgagattgtgccactgcactccagcctgggagacagagtgagactctgtctttaaaaaaaaaaaaaaaaaaagcaatgcaaagaaaaccaaaatcatccctcttcatgcccaccagctcctgaagcaaaagcagactaacacacatcttagcagctgccaaagatatgtgtccaagcaaagtgtaggctcaagatctgcattcctttcttacgtctgggagcttccccaccataagagtcttggtgggaatttgagccacttctgagaataaaccctcaaacaagtcagcttctatgcctaaggatcgtccaaccagatgcaggcaatcacgatgctgaatcttgagtcagtattgcaaaaactcagggactctagagaattctttttttttttttttttttttttttttgagggggagtcttgctctgtcacccaggctggagggcaatggcgctatctcggctcactgcaagctccgcctcctgggttcacgccattctcctgcctcagcctcccaagtagctgggactacaggcacccccccaccacgcccagctaattttttttgtatttttagtagagacggggtttcaccgtgttagccaggatggtcttgatctcctgacctcgtgatccgcccacctcagcctcccaaagtgctgggattacaggcatgaattctttacggtgctggccgaagaacagtagcagccttagcactgagggcaggggcagcgccagctgtggctccaggtgttgtcacgagacctattgttgacaggcttttgcctggtcctattacttcccattgtgcatatagagagagaccaaacttccctgaattgactgcagtttatcccagagtcataggcaacactagagatccatcctccatctctggtgactattatgctttcactatatcctatcactgtagtacatttatgcacataatgaaactgcggaaaagacttattgagcaactatttgttggaagacaattctctgtggatctcttacatttctgtatgtcttataagcacaggcaccaaatgcttttgttcagtactgtcttttcaaggatgtttgcagagagaacagcctttgaagccacagtgtctccctccagagaaagtgcaaatttaattactgcccagtatggtagagatgatgtctccctccaggactgaggtcaggcaagcctactgccccttagctaaggggtcctcccctataattttatgcagatgacactgtgtcctctgagcatcactctatggtagtggtccccaacttggcaccagggactggtttcatggaagacaatttttcctaggactggggagaggggatggttttggggatgattcaagcacattatatttattgtgcactttacttctattattattagattgtaatatataatgaaacaattatacatctcatcataatgtaaaatcagtgggagccctgggcttgtttccctgtaactagacagtctcatctgggggtgatgggagacagtgacagatcatcaggcattagattctcataaggagcgtgcaacctagatccctcacatgcgcagttcacaatagggtttatgcttctatgagactctaacgctgccgctgatctggcaggaggcagagctcaggcaggaatgagagggacagggagaggctgtaaatacagatgaatcttcactgactcacccacctctcacctcttgctgtgcagcctgcttcctaacaggtcatggaccattactgctccacggccggggggttggggacccctgctctatgggaactggggctcaggggaccaactaaaaataatgatactctgcctactgctatggcttgaggaataaagttctttgtataatttaggtgtctcatgtcttctgctagcatccagaaaaccatggcaggtcactggttagcatgcaagtagtataaaatctcagacacatcaggattcttttttttttttttttttttttttttgagacagagtctcactctgttgcccaagctggagtgcagtggtacaatctctgctcactgcaacatttacctctcaggttcaagggattcttctgcctcagcctcccatatagctgggattacaggtgtgtgccaccacatccagttagtttttgtatttttagaagagacaggtttttaccatgttggccaggctggtctcaaactcttgacctcaggtgattctcttgtctcagactcccaaagtgcaggattacgggcgtgagccaccatgcctggcctcttctttttctttttttttttttttttgagacagagtctcactctcttgcccaggctggagcacagtggtactatttctgctcactgcaaccttcacctcccaggttcaagtgattcttctgcctcagcctcctgtgtagctgggattacaggtgtgcaccaccacgtccagttaatttttgtatttttagtagagacagggttttaccatgttggccaggctggtctcaaactcctgatctcaggtgattctcctgtctctcggactcccacaagtgctgggattacaggtgtgagccaccacgcccagccaacacatcagaattcttgacaccactttacaatggcatagtgttcctcatagggatatagaaatgaaatactttaaatggttcttatcctcaagtaactcaggatctagcagcagtacaccagtccagtgggcgatagaagggcctgctctgagcaccacttccacgccctctgcaacataaataagggaaagacactgtccatttaaagaacaaagtaatcatttctataggccaaaaacggaacccaaatgtaatgcagaaaattgccctgaaactgaaggcctgctgacttcgggtacagaaacagagagaggtagcggggtgctcctcccctcctgtggaaagatgtctaaaattgccccctacaaaatgagacacctgggctcagctcattccttgaaagcaggtgctgagagcaggctcctcgactcaggaaaagaggccacagggttctttccaaccctggggctgacatggagctgatcttaagaaggccacaggaagcagaaaaaccacacaccaggacaccgccacactgcccgtggctccctggctaagactacaggagtctacagtgggaatgtggacaccgggaatcattcaccgcagtgctatgatatatattagtttttatccatggttcctggtccataactcccttagccctcgttatagtcttttgttataatatttagtgtgttagatcttaggaacaagtctcaggagacagaatctctctgattttcccctgcccccctttcatctgcccaaaggcaggactctaatcttcccctgcctttctgattgtgggtcttaagaccctttccagagagggtcctcccctataccctgggggacaaaatgctgacatcgtgaggcatccataaaaacccaagaggggctgggggtggtggttcatgcctgcaatcccagcactttgggaggctgaggcggaaggatcacctgaggtcaagagtttgagaccagcatggtgaaactctgcctctactaaaaatacaaaaattagccaggcacacctgtagtcccaactactcaggaggatgaggcacaataatcgcttgaacctgggaggcggaggaggttacagtgagcagacatcacaccactgcactacagcttgagcgacagagcgagaccctgtctgaaatgaaaaaacaaaaccaaaaaaaaaaacaagaggacagggttcagtttggggagcttctggatagctgaacacgtggaagttcctggagggtggaactacctacctctctctaggtagatagtgtcagaatggaattgaaggactcccggcttgtgtctgctgcttggtgtgggaggaaaacccctgcgcatctggtcacagaagtcttcctctgtgttgacagttgtggtggtggtggtacgagagtcgaggaaaaacacagctgaagagtttttctgaaacactcactcttttcctgcaatgggaaacactgcaggctcccagctcatcccagccaggcacgctgcctggcttccctcgccttgcctttggtgttttctcactttttagttgacttctagctttctctcttaggtgatctattcagtatgtgattatcgactggctgttttggttcttctttgtgaaggaggtgagtaccagatgcctctggtcagccaatgtgaagcccctctgtctccctgcctctgtgatattatcagggtcacccaaaaaatcaagaaaaaatgaaggtggcggtggccacagagatgctgaataattaattttgaacttcattaaaacattttaaaagatattaaaatgcaagggtcggccgggcacagtggcttacgcctgtaatcccagcaatttgggaggcggaggcaggtggatcacctgaggtcaggagttcaagaccaccctggccaacatggcaaaaccctgtctctactaaaaatataaaattagctgggcatggcagtaggtgcctgtaatcccagctactctggaggctgaggcaggagaatcacttgaaccggggaggcagaggttgcagtgagtcaagatcacgccattgcactccagcctgggccataggagtgaaactctgtcgcaaaacaaaacagaataaaaaataaatgcaagggtaacctctaaattaacagaaatacaatttatagcttccaaaccaaggaagtgaaataggagttaagaagaaatgatttgggcagatagtgagggtaaggaagtcctcagtaaagtcttcctttcagtggaaagcagcccccaaatcatttccttttctaacaaacagcagcctgtaaaactgagctgcagacatagaaaggcaggccagaagcttgcatgggtgaatgccggcagttgtaccagtaggaaaggggctacctgggactaggcatgtccaacatggcggctccatcttcccttctctttgccaaccacgtgtgcagtaaggagcagacaacctggtgcaggccaagtgaaagcccatttgcataataagattagggtggggcagccagcttcccctcacactatataaacatcacacctggtccaaccaatctgtgggccctatgtaaatcatgcactgcctcctcaagcctgtctataaaatccagtgcagtctgctgccagctgggagtcccactcaggcacccttctctctcgagaagagcaagctattctcctttctctttcttttgcctattaaaccttcactcttaaactcacttcttgtgtgtgtctgtgtccttgatttcctcggcatgaggcatgaacctcaggtatttacctcggacaatgatgccaattcagaaggaaacaaaatgagaagagggttaatctactcaacaggtaaagaatgcaacctaaccaatgatatagaaaacacaaaataaggatagtacaaatgagtccaacagtgtctctattcacacatacacacacccacatatgtgcacacacatacacacagaggaagtggattaaactgatctctttaaaggcaaagactatctgattggatgctttttttttctttttttgagacggaattttgcgagtgttgccgaggtgggagtgcaatgctgtgatcttggctcactgcagcctctgcctcctggttccaagcaattctcctgcctcagcctcctgagtagctgggattacaggtgcccgctaccatgcctggctaatttttgtatttttagtagaaacggggtttcgccatgttggccaggctggtctcgcactcctgacctcaggtgatccacccacctcggcctcccaaagtgctgggattacaggcatgagccaccacacccagctgattggatgcttttaaatccagctatatgctacttacaaagacaaacccaagtaaaaacacacagaaatgctgaaaataaatataatcaaactatattaaagagacattaataaattatgatcgaaaaaaacagaggagatgataaccgcgccaaaagataatagtttgtaaagactaataatatagatggacctctagctaatctaaaaaatatatataaactcttaagagtaaataattaatcaaaagaatactctcttacaaaggaggaaagaaaagatgatggctttctagctagcgaggttaattcaggtgaaacagcacagatgagccaaaaaaacactctttctctttgcatagtggagggtggaagagagagagtgaggggggaacaggcagaagtgtgaaatgattgggagcctttgaccatttaaatgagaaggccaagaaagtagtaggaagccagccaagtagaattaaatgcttgatcaaagtcgcaaggtgtgtaagccactcctggttgctttagaatcagaatctactcatctcatgaaataaacggtaatttgaagagagatgtagtgtatcatccttcaaagtcacaataaccaaaatagcaagaatgatgttatccaggtgaagaatttgagtcatgtatagaagagttaacttgcccccacgcactggagagaacatttggaccatgctgactggttccagcctccagtgactcatgaacatgtggaggtgcttattctctccctcttcaatcctgccccaccatgtgaacatcactggaggggtacaggagacccatggcaggggctggtacccttctggagagatatgggagacccatggcaggagttgggtcttgccacccaaggccatcccagaccagctgcagagtaaatgcacctgacagcaataactttagcatacacttagagtaaccctgtatggcaaacacacctgaatgactctggctaagcttatgtaggaaatgaaccatggagttgcagattcacgcaattaagtatccacacatggttggctgttatcctcattcattactgcccagattcttctacttggcaaagatggaagttctttctctctcctggggacgtagcaagttggcttgagtttggagccgtccaggcagactgtagcttgagttattatttctctgcttgctactgcccaggagcactgagttactccatgtaagagtacaacaatgaatcaaaacaaagaagaaaaagacacaccaccaaattgaaaaacctggcaaagacgatgaacaggcaagctacaaaagagagaacccaactggccaataaagacggggaaatgttcagcctctctgaagtgaaaagcagagcaaatcaaaacgactatgaaatatcatttcacactctgcgtattggcaaagattaagttaccaaggatgcaggtaagtgggagctttcataaggtattgatgagattgtgcattgaaacaaagctctttagaaagcaacgcagcaggctgggtgcagtagttcatgcctgtaatcccagtactttgggaagccgaggtggaaggattgaatgagcccagcagttgaagaccagcctggacaacatagcaagaccccatctctactttaaaaacaaagagagaacaacttaccaattcttaatggaactaaagatatgtattcccaataacacagtcctaaagaaactcatgctgtacaggtagttttctttttttttttttttttttttttgagatggagtattgctctgttgcccaggctggagtgcagtggctcagtatcagctcactgtaacccctgcctcccaggttcaagcgattctcctgcctcagcctcctgagtagctgggattacaggtgcacactactatgccctgctaatttttgtatttttgatagagacaggatttctctgtgttggccaggctggtcttgaactcctgatctcagatgatccacccaccttggcctcccaaagtgctgggattacaggtgtgagccactgtacctggccagtagttatgatttcaatagcaacatgacttgtaataataaaaatttggaagcaatctaaatgatccatggtatgagactggatgtattgatgatggtataatgaaatattctgcagcatttaaaataatctatattgacacgcatcaacatggataaatctttctcttttttttttgagacagagtcttgctctgcacctaggctggagtgcagtggcactatctcagctcactgcaacctcctcctccctggttcaagcaattctcctgcgtcagcctcccgagcagctgggaccacaggcatgtgccaccacacccaactaatttttgtatttttagtagagatggggtttcaccatgttggtcatgctggtctcgaactcctgatctcaggtgatccacctgacttggcctcccaaggcctgcctcaggcctcaaacctgaggattacaggtgtgagccactgtgcctggccagataaatcttaaaaagcatcttgatgcttaaaaatataaacccagctcattgcagtcttacaccatttagataaaattatacaagatattctcaacacgcacagtgtgggtgaacagaaactggctgagcagaataaaggtcttgatcttcagctgcagacatcacctttcattgatgccttttatgtaaagcacattactgtttacactacacacctacatagaaaaacagaaaaatgtggttagaaaagataaaagccaatgtggcccagtgggaaaaagagaagaacttaaaaccgggaagaaaactaagaggacacagatctacaatatttcacctctttagaaattctgaagcaaatgctgcatagtttaacatttgttcagtacaggtgatttgttatataacatggtgtttcctatatttgctctgtactttgttgtaggagtaaaatatttagttcttaaaagtcttgtggggccaggcacgatggctcatgcctgtaatcccagcactttgggagactgaggcaggcagatcacttgagaccaggggtttgagaccagcctggccaatataacaaaacaccgtctctattaaaattacaaaaattagccgggcggtagtatacgcctgtaatcccagctactcgggaggtggaggcaggagaatcacttgaacctgggaggcagaggttgcagtgagccgagatcccgctactgcactccagcctcggtgacagagcgaagcttcgtgtcaaaaaaaaaaaaaaatctcctccacactgaagtcacaggcctgccagaattttcacctagggacaaagtgacatttctctgatgggatacattttaaaggggcaacagaaggaaacaaatataaaagttgtgctttgattatgtcacgagttgtgcttattcagtgtctgtgaacacgaggaaccactggcttcaggacaggggcccgtgtgctatttcacaagtccatgcgggggctgtgaggacacaggagcagggcccccaggggtgggctaggcagtctgcttccccagcaagccctgactactaagcagcctatgaatgcatgatgcaggcattagcttcagggaggagagcagaaagggaggggcccatgggcacagggaagagccactgggcaagtgtggaggtgcgaggacatgtgttgggaccatgagtaatttgggaggttttcagggtaggcttgtgaaagtgttacgcaacccccatgagaggggactgggcttaggaggcagatcatgaagggtttcggaatttgcactgtcctcagggagaagtggagtctttgaaagattttgagcagaggcgtgaccttgaaggatcatgcagttcagtctcttgcctgcaggcagataaatgtctaaatctttccggatagcaggctcgtctcttttttattgtctctaaggacaggctctagagtctccatcctttatcttttttagtgttgggcatatatagctgggagtggagaaggtgactgcacagtgcaggacagatggggaagggaatgagacctcactcctcgaatccagcgggtccagggacacagactggagagcagtgggggaagggaggccgtgtcagtcaggcagcagggcacagagtgcccaggtgtgacaacaggtgtcagcaaacagtctgcagcaagagacaatgtctgatgacaacgacaaggatggccatcttcatcatcatcatcatcaccaccatcattgtcgtcatcacagcagacactgatacagtacttgtcatgtgtcaggaagtgtttaatgctttgcacagttccatcaaccctaggaggtgtgtaaatcatatccccactttaaagatgaaggaaatgaagcaaaaataaggagaagaagttgactgtgcttccacagcttgtaaggggcatctggcactcagaagcagccagttggctccagcatctatgagcctaaccacaacaccatatcgtatctccaaaggtgtgtgcgcgcatcctgccaggcacagaaactgcggcagaggcggctctcaggaaggcatagccggtgccccaagcccacagtcatgtggaatagactcagagagcatacttgttggtttcattctacatcctttctccgacacatggctgaattagtggaaattcctcccagatataggcctgtggtcatcttttatctccaggtcacagttggcactgactatatttttaatttatttctgtgtgtattcttctgggaaattaggagaagtctccacgtatgagacgctaaaagcagggccctagctatgagaatgagatccaggcacagacgctgacccgggccatcgatcagagctggttcacaagaaatctgatgcttgctgtttccatgtagagcactacatgggaataggagggaggggactggacacacagtgagtgacagtgtgtccagcatctcagatgtggtctctcatttcatcctcacaatgaccttgtcatgcagacattcctatgagagctaaggaagcaggctcagaggggcacaataacaggctcacagtcccacagcaaacaggaggcacagctgggagtaagtttatttgcctcaaagccctgtgcttttttctattactcctcactgggaattttgcaagtatcagccaattgcatgctggcccagagtcaaaccagatttccttgctaatttcccagaagaatacacaaagaaataaaaaagatagtgccaactgtgaactatagataagagatgactggctgggcacggtggctcatacctctattcccaacactttgggaggctgaggtgggtggatcacctgaggtcacgagttcgagaggagcctggccaacatggtgaaaccccgtctctactaaaaacacaaaaattagctgggcgtgatggcatgtgcctgtagtcccagctactcaggaggctgaggcaagagaactgcctgaagccaggaggcggaggtttgcagtgagcagaggtcgcatcactgtactccagcctgggcaacggagtgagattccatctattaaaaaaaaaaaaaaaaagatgatcacaaggccaatatctgggaggaatttccactaattcagctatgtgtctaattcagccgtgtgtctgagaaacgatgtagaaagaaaccaccaagtacactctctgagccacaagaagacaaacagccccaaagaaattggaaaaccaagatagataacctttgcactttgcgacaaatcgcaggatactgggaaaatacggatccggggcgagggttggaggggagttagcacaatagttttgaaaaggaaatgaaggaaaataaacattatcctgattagaggagaaaaacaactccaaaaatcactgttagcaaacaaagatggtgctttaacacagcttagtgtcttaaaaaaaatccaggcacactatggaacagaagcaggaggagaagaaattgaaaagggaatgaagccgaaagggattcaagaaagacagaagaagatactaggaaaataaaaaaccaagagcaaaatcaaaattacgttgtaggttgtgtaggctttgaaaccagggtgactccatcttgaataggggctggataaaatgaggctgagacctactgggctgcattcccaggaggttaagtcattctaagtcacaggatgagattggagtttggcacaaaatacaggtcacaaagatgttgctgataaaacaggatgccatgaagaagctggccgaaacccactaaaaccaaaatggcgatgaaagtgacccctggtcgtcctcactgctcatcatatgctaattataatagataagcatgctaaacgacactcccaccagcaccatgacagtttacaaatgccatggcaatgtcatatggcctaaaaaggggaggaaccctcagttccaagaattgcccacacctttcctggaaaactcatgaataatccatccgtcgtttagcatatcatcaagaaataactataagaatactcaatcgagcagcccatgccactgctctgcctgtggtgtagccattctttaattcatttacttttttttttttctccattctgtcacctaggctggagtccagtggcgtaatctcggctcactataacctctgcctcccaggttcaagcaattctcctgcctcagcctcctcagtaactgtgattacaggtatgcatcaccacgcccggctaagttttgtatttttagcagagatggggtttcaccatgttggccaggctggtctcaaactcctgacctcaagtgatccaccagtcttggcctcccaaagtgatgggattacaggtgtgagccaccacgcccagcctattcccttactttcttaataacgttattttactttgttaataaacttgctcttactttactctaaggactcgcaccaaattctttcttgtgcgaggtccaagaaccatctctttggggtctggattggggcccgtttctggttaacagtttcatacagcacaacatacactccagaaatcaaggagtactaacgcagaggaccaacattagaatctctctaaatcaggagtactaacgcagaggaccaacatcagaatgtctctgaattcagatggaaaaggtatgaaacagtgagggggggggtcgacaaatatgaaggaagagaacagaagtaagaattcgatgtgttgcacaggagaaaaccataaggctgagtaagaacaaaacgaaagcataagcaagaattaaaaaagaaaataataggccaggcaagttggctcacacctgtaatcccagcaatttgggaggccaaggcgggcagatcatctgcagtcaggagtttgagaccagcttggccaacgtggtgaaaccccgtctctactaaaaatacaaaaattagccagatgtggtggtgggtgcctgtaatcccagctactcgggaggctgtgacaggagaatcacttgaacccaggaggcagagctttcgatgagctaagatcatgctactgcactgcagtctgggcaacagagtgagattctgtctcaaaaaaaaaaaaagagaatagcagaaaactgcactggatggaaggcctgtgcctacattttagaagtgcaaagcaaagtaataaagatgaaccattctgaccaatcaatctataacatgattttaaacaaataagaaaaaaaaatcataagcaccaggcaggttgtacaaaacagattctctacaaggaatataatcaagccaagttcaaacttattttctacaaagaacaagaaaacaagggacagatacttaaaagtagttccagtgaggcattctgcctacaattttacttagaggaaggttgtggctggtgccatttgtggtatggccagaagccactcacttcccctcttcctttcttaaaaaacaaaacaaaacaaaaaactgatttgatttgataataatgagttgtaaaaataagtaattcaaaatctaagctgttggaactttaaaatactttgacccttaagggcatgtgattatgggaactgagtcacataaacaggcagctgtaacctaggcagctataacctttgtttgtatgattatagattattcttcttccttacctgttaatacattgttttagaaattgtaaatgatgaaagcacatcagggaagaccccttctctgttcactgtttatcttcattatagattaacttcccacttacctttctaacacaaagacattatgactatcacattgtctaagatggaatgttaaatacacttgtttaaattggaaaggaaatgaaaacaagctgcatagaaaagaaaataaactgtaactaactaaattgctgcagctcataaactagccttgtataagaaaatgttataattctactaaattcctttgtttactgcctatataagcaagactttcacatttttttttactattatttttcttagagaaagagcctcattgttgcccaggctgggatgcagtggtgcaatcatggctcactgcagcctcaaactccttggcttgagccatcctcccacctcagcctcctgagtagctgggactacaggtgcacatcaccatgcccgctaagttttaaatttttcttgcagagatggggtcttcctatgttgcccaggtttgtctcaaactcctggcttcaagcaatcctccagccttgaccttccaaaccaatgggattatatgtgtaagccatcgcacccagcaaagaccttaacttttaacttgagagcactgaccccatttctctggagtttgtgtttcctgaatggctattcttacctttgggctgcaataaactctatacttaatcatattttcgagaccagccgaaatatcgttattaaatctcgttacttaaggttgacagactccagcaccaagggtggatcatagcagatctaagccaatcacgatcactggcctcttttcctattttctcagcttctcttgctgctaagagtaggcataccattctgatcttgctgatgaaacttacagggaaaagctgctaggagatttctgagaaagagttcccttcgctcataagaaagagaaccattggagaagaaagagaaccattggagaagaaaggcttttttttgctaccacccccaccccattccaaatatagttctggtgtctgaggctgtagcagcccttttgtagccagaaggcaacatggatgaggatgtacttcctacaggctgaggatgtaaagtggaagacggaggtgcagaggcccaggaagacatatcaccagcctctgttgccaccttgactgcccatttttgttaggtctgtgtctttagtatttaagtcattgtcaagttctcttttagatataagtaagtgctcacttattatatctcttagtggatggtgtgtgcctgtagtcctagctacttgggaggctgaggtgggaggatcactcaagccaaggagtttgaggctgcagtgagctatgattgcaccgctgcaccccagcctgggcaacaatgaggctttttttttttttttgtctgtcatggagtctcactctgtcacccaggctggagtgcagtggtacaatctcggctcactgcaacctctgcctcccgggttcaagcgattctcctgcctccacctcctgagtagctgggattacaggtgtgtgtcaacacacccagctaatttttgtatttttagtagagatggtgtttcaccatgttgggcaggctggtctcgaactcctgggctcaagtaatccacctgccttcgcctcccaaagtgctgggattacaggcgtgagccactgtgcccagcctgaggatataaatattaacaggaaaagcacaccacacaaaaattccatcatcatcattttatcacttgagacacgatacgctaaacaaaattaaacaaccttctcaaatgaaggccttaattaaactaatgtacattatgaacctgcaagagatgaactgatatgaagcatttttactacaaaaaatgttgaattatacgactgaaatttaaatgttgtgaccccaaactctatattcagtcctattttaattttattcataaagttaatggaataatattttcagatctgcaaaggcctagaaaaatatgtctcttgagtaatacccaacccctactataaaaatttttaagaaatgtttaaatttttaaaaattttatgagattaattataattaacaattcagatgtaagaaatttaaagtacaaaggaatgacaatgtaaataaaaactgtttacagatagtaaaattgggccaggcacggtggcccatgcctataatcccagcactttgggagactgaggcaggcggatcacctgaggtcaggagttcaaggccagcctggccaacatggcaaaactccgtctctactaaaaatacaaaaattagctgggcatggtggtgggtacctgtaatcccagctacttgggaggctgaggcaggagaatcatttgaacctgggaggcagaggttgccgtgagccgagatcgtgccactgcactccaccctgggcgacagagcaagacttcatctcaaaaaaaaaaaaaaaaaaaaaacagtgatagtaaaattgaagtggtgttattcatctggagtaatacatgagattcgttgcctcatgctaaggaaattaaggataccaacacaccagagtgaggttaagagcaaaagtttaataggcgaaagaaagaggagagccctctgtacagagaggggtcctggagaaagatgagttgccagttctgtgctgaaatgcagaaggtttcatagagtagcttaaggaggtggtgtctgatttacatagaggacgaaagattggttggaccaggtgtgccatctgcatagctcacgaagaacctggctgccccttcctattttttttttttttttttcgagacggagtctggctctgtcccccaggctggagtgcagtggcgcgatctcagctcactgcaggctccgcctcccaggttcacgccattctcctgcctcagcctcctgagtagctgggactacaggcgcccgccaccacacctggctaattttttatattttcagtagagacggggtttcaccgtggtagtcaggatggtcttgatctcctgacctcatgatccgcctgcctcggcctcccaaagtgctgggattacaggtctgagccactgcgcctggcgccccttcctaattttttattacgcacatgggttctctacctgcccagggccatgttgcctggtccttactgtacacgtgatgaagagagaagggaagacagagcctccgtgctgaacgcacctggcttccaggttcctcctttattagcacagctgctgtcattcacccgtgcaagctttagcctgctgatttatgtttgcagctggagtttttaggctgctctttgttagaaaagaaattattttggggctgctttttgttaaaagggaaaccttgctgagaattcctttagcctcactatctgcctaagtaatttctttctagctcctgtatcaaaattaactgttgtaaatatgatacaaaactaaacacaaggccggctgccgtggctcacacctgtaatcccagcactttgagaggccgaggtgggtgaatcacctgaggtcaggagtttgagagcagccccagacaaaccccacatgacaggcaaggaggatctattggaataccactaacagtaaaaagctaagggaggtgctttccttccctggcaggcctgaaatctccctctctcaccaaaatataacacgacagccccagcaaggtagatctccaccaaaacaaacagcctgatccttgtggttgaatccactatactgttgcccagagattggaggcaacagtatagtggattcaaccacaagtgcgtggcctggggaatgctctgttccccacagcagaggagaatctcgtcataaaaagcacttggcttaggaagcctccttgttcctgcttaagaatctcctcccgcaaagagatacacctgccatctttgcctaagaaaatcttttctgccccgtcaagaagcaccaggaggaaccactgggaccccagcagccctgtataaaccaggctggctaatagagcaccataaaggcactgcaaacaagttctcattgcaaccatagtccgcaaaagtataccagaatctaaacctaaacgaggtgactaaacctaaacatgactaaacctaaacaagataactgcctactaaaagaaaagatttaaatagaatccagagtccatgaagctaccagatgaaatatctgcgataataatagaaaatcactcatcacatcaagaaccaagaaactcacaacttgaatgagaaaagacacttaactgacttcaatactgagatgagtcagacattgaaatcatccacaaaggattttaaagaaaccatcatgccccagtgagtgttgttcccctccctgtgtccatgtgttctcattgttcagctcccacctataagtgagaacatgtggtgtttggttttctgtacctgagttagttagctgaggataatggcttccagctccagctatgtccctgcaaaggacatgatctcattctgttttatgtctgcatagtattccgtggtgtatatgtaccactttctttatccagtctgtcaggagagcaagggggagggagagcatcaggataaatagctaatgcatgcagggcttattaccctggatgatgggttgatatagccaccatggcacatgtttacctatgtaacaaacctgcactgtcctgcacatgtatccttaaaataaaataaaattaaattaaaaaaagaagtcaccatgatgtttcaacaatcaattaaaaagtctactgaaacaaatgaaacataagaaaatctcaacaagtaaataagagttataaaaaagaaccagctgggcttggtggtgcaagtaaataggagttataaaaaagaaccagctgggcttggtggcgcacatctataatcccagtactttggggaggccaaggtgggaggattgcttgaggccaggagttcaagaccagcctggaaaacacagtgagactttatttctacaaaaacaaatttaaattagctggttgtggtggcatgcactgatagtcccagctactcatgcgagtgactgaggcaggaggatggcttgagcccaggatttgggggttgcagtgaactatgactgcaccactgctctccagcctgggctacagagcaagatcctgtctctaaaaaaaaaaagaaagaaagaaagaatcaaatggaaccaaatggaaattacaaaactgaaaaaaatcaaaatgtactggataggagagtagaggacagatgacagatgtcaaaatcagtgattgtgaggacagatcaataaaattcactcattatgaacaccagaaagaaaatagatgaaatgatataaacagatcctcaggggcaattaaaaaattcaacgctcatcagagtcccagaaggagaggagacacaaaatggtgctaaagagtattcaaagaaggaatagccaaaaatctccaaatttggtgaaaaacacaaaccaaagatgcaacaagctgatcaaacctcatacagaaaaaatccaaataagcctatgcaaaaacatgttacaattgaacttctgatgataactaaaaactcagaaaaattctagaaagcatccagaaagaaatgatgcattacttataggcaaaaaaaattcaaatgacaataatgtccctatctgaaattatggaggccagaagtggcacaacattcttcaagttgtgaaaaataaaaataatttttatttatgaatttaattttattatttatttagttttgagatggagtttcgctcttgtccccctggctggagtgcaatggtgtgatctcagctcactgcaaactctgcctccagggttcaagcgactcttgtgcctcagcctcccaagtagctggaattacaggtgcacgccactgtgcttggcttatttttgtatttttagtaaagatggagtttcaccatcttggccaggctggtctgaaactcctgacctccctaggtgcctccacctgcctcagcctcccaaagtgctgggattatagtcgtcagccatggtgcccagcccatctatgaattttacatctggcaaaattattctctagaaatgaggggaaataaaaacattcttggataaagaaaaaccaaaaaatttaccatgatcagatttacccttaaaaactgccctaaaagaagttcttcaaacagaaaagaaatgggaagagaatcaagcttggggcatcaaggaggaggaagaaataagaggaacagtagcaatctgggtacatacaatagactatccttttccttctaaattgtgtaaattatatttaatgattgagacacaaattattaacaacctcttgtactcaagacaatgatatttaagagcagggaaggtaatggttctaaaaggaaatgcggttttcatgttccacttgaagaggcaaaatgtcgataccagtaaagtctgatgtcacagagcaaccactacaaaaactatacgaacagatatactttttttttttttttgagacagtctcactctgttccccaggctggagtgcagtggcatgatcttggctcactgcaacctctacctccccagttcaagcaattatcatgcctcagcctcccaagtagcgtacaccaacatgcccagctaatttttgtatttttagtagagatgaggtttcaccatgttgcccagactggtcttgaactcctggactcaagcaatcgcctgccttggtctcccaaagtgctgggattgcaggtgtgagccaccgcacccaaagagatatactttaaaatgcaatgaaaaaatcaagatggaatcctaaaagctgttcaagtaccctacatgaaaagaaaaacagaggaacaagaatccaaggaaccaaacagaaaaaaattaataaaatggtagacttacatagataattaacttaaatgtaaatggtctaagtacaccaataaaaaaacagattggcaaagtggacagagacacaatccaattttatgctgtttacaagaaactgacttcaaattcaacaacataggcagaatggaaaattatataacctgaaaatattaattttaagaagcagcagtggctacatcaatacaaataaagtcaacttcagagcaaagaaaatcactatttaatagaagcaaagagggacattatataatagtcaaaggatcaatccaccaggatgatatgcaatcttaaatatggccacatcaaaaagcttcacaatacatgaagcaaaaacagagttaacagggaaaacagacaaattcacaattatagttggaaacctgaacagccacctctcagcaaaggacagaactactagggagaacaatcagtatgtatacagagaactacatagcagaatcaaccagcaggatctagctcatatacacagaacactccatccaacagcagcatatgcattttttttttttgagttggaatctcactctgtcacccaggctggagtgcagtggcataatcttggctcacttgcaacctctgcattctgcctcccaagttactctcctgcctcagcctcccaagtagctgggattacaggcatacaccaccacaccctgctaatttttctatttttagtagagacaggttttgccgtcggccaggctggtcgcaaacttctgacctcaagtgatccaccagcctcagcctcccaaagtgctgagattacaggcatgagacactgtgcccagccatatgcattttttttaaatgactacggaacattcaccaagacagataatataaaggctataaaacaaaccacaaagatataaataactgaaatcacacagaatatgttacctggccataatgaaatcaaactagaaactagcaacagaaagacaccaggaaaacctctaaatacctggaaaattaataacacgctgctgaactcaaggttcaaagaagtctcaaagtaaataaaaatacagagaactgaaagaaagtgagcgtggaatgtcaatcaataatcgaagttcctatctcaagaaactaaaaaaagaacaatacaaaacaaaaagctacaaagcaggtggaaagaagcaaatagtaagctaagagcagaaaacaatgaaattggatatagaaaaataagagaaaaatcattgaaacaaaagcatatttttcaaaaaaaaagaataaaattgacacacctctagcaacagtgacagaaaacagccacagaaaacacaaatcaccaatatcagaaatgaaacagggaatattattatatatcctgcaaccattaagaagagaataggggaatactatgaataattttatactcataaattcaacaacttagaagaattggaccaattcctggaaaaccacaaacccctaaaacagatgaaatagataatctgaatgatgctacaccattaaagaaattgatttcataatttaaaagattttgaaaaaaagaaaaaatctccaagcctaaatagttacattggaaaattctaccatttaaatatgaattaaaaaccattttataccatctctcccataaacagttttacacaactccccacaaaataaaagaaatagaaacacttactaattcattttacaaggcctcataacaaaaccagacagcacaaaacaaacaaacaaacaaaaattgcagaccctatctctcatgaacttagatgtaagaatcttaacaaaatactagcaaactgaatccagtaatgtataaaaagaatcatacaccatgactgttacagtaggtagtcaggcagacatcagcagggccggagagggttccctctcgaccaggaatgtcagaagaccatcaggtgatgggcaggtagttgttaagttgtctctctaaaatagtaattggtcatagctagcaccagggaaaggcagtctcccaataggtagaaaaacctgaagcaggtgatcaacttctcaataagatctcaggagttgggtgaatggactcatgtatatgcactaaataacagtaattggttgtagccagcatcagggaaaggcagtctctaaacaggtagaaaaacctgaaactggtgatcagcttctcaataagatctcaggagttgggtgaatggactcatgtatatgcactaagtaacagtaattggttgtagccagcatcagggaaaggcagtctctaaacaggtagaaaaacctgaaactggtgatcagcttctcaataagatctcaggagttgggtgaatgggctcgtgtatgtgcactaagtggcaaagtggcagagtttaacaggtgcatgaccttctaggagcatccaactcaagagagcatgagtgcaactccagtacacccatgtgtactgtacactgtatacacatgtggcctctcctaggtgctggcaggccactgtgcatgtggacagcccaccccaaggggagaataaggggagaagggacacaagaccctggaagtatgccaacatataaaaccctaagtcaaaggtcaaaccacgcacttgatagctcacactgcccacttggccttcttccaagtggactttacttccttttgttcctgttctaaagctgtttaataaactttcactcctgccttaaaatttgcctcagtctctcactctgccttatgccccttggttgaattctttcttctgagaaggcaagaattgtggttgctgcagacccatacagattggccactggtaacatgacaaagtcagattcatgtcaggtaagcatgtctggttcaacagccaaaaatcaatcaatttagtcatatttaacattttaaaagtcaatcaacataatccaccatatcaacaaactaaagaagaaaatcatataaccatatcaagtgaaacagaaaaaacatctgacaaaatacaacacccattcatgataaaaactttcagaaattaaagaagagaagaattaactgaacttggtaaagaacaactacaaaaattctacagctaatgtgaaggactgaaaaaattgaatgctttctctataagattgggaaggagccaagaatatttactcccaccactgctagtcaacatcatacagatgctccttgagttatgatgagatttgatcctgaaaaaccactgtaaattgcaaatatggttaagtggaaaatgcatttaatacacctaatatactgaacatcctagtttagcctaacctaccttaaacatgctcagaacatttatgttagcatacagttggacaaaaatcacctaacacaaagcctattttataataaaatgttgaccatctcatataatttattaaatactatactgaaagttaaaaagcaaagcagatatatgggtaattgaagtacagtttctagtgaatacatatcacttttgcatcattataaagttgaaaaattgtaagttgaacaaccataagtcaggaaatgttggtaccagaagtgctagccagctcaataaaataagaaaaataaaaggtatacagattggaaaagaaggaattaaatggtctttatttgaagatgacatcaactttgatgtagaaaatcccaagaaatctacaaacgaatccctcctagaactaagtgagatcagtaaggttacaagacagtattatattcagcttttaaaaagaaggaaatcctgtcatctctgacaatatggatgaacttggaggacattatgctaaatgaaaaataaaccaggcaagcactccatgatctcacttatatgtagaatctaaaaaagttgaaatcacaaaaacagagaataaaattacagttatcagggactgaggagttgtgaggtggggagatattgaggaaaggatacacaatttcagttatgcagtaggagaaagttcaggagatctattatataatatggtggctatagctaacagtctattgtacacttgaaattcctgagagattagattttaaatgatctcagtaagtatgtgaagtaattgatatgttaattagcttgatttagccattccacaatgtatacagatatcaaaacatcatgtaactataaatctatacaatttttatttgcctatttgaaaaattaatcctattaattaacacaaaaaatcacatttctatttactaacaataaacatgttacattcactccaaagaagatgaaatacttaggtatacccttgtcaagacaagtataggatctttattcttaaaattacaaaatgtgggtgaaagaaatcagtgacttaatgaaaggagagacatattgctttcatggatgaaaacaggtgtccccaactcccgggccatggaccggtaccagatagcaagaggtgagcggtggttaggaactggactgcacagcagagggagaacggcaggctagagagagaagcttcatctgtgtttacagctgcttcccatcgctcgcattaccacctgagctccacctcctgtcagatcagcagtagcattagattctcatagaagtgtgaatgttattgtgaactacacatgtgagggatctaggttgtatgctccttaggagaatctaatgcctgatgatctgtcactatctcccatcacccttagatgggactgtctagttgcaggaaaacaagctcagggttcccactgattccacattatggtgagttgtataattatttcattatacattacaatgtaataataatagaaataaagtgcataatcaatgtgatgtgcttgaatgatcccgaaaccatcccccaccttggtccatggaaaaattgtcttccacgaaaccagtctctggtgccagaaaggtgatgacgctattcctagaccactggactagaagactcaacataataaagatgccaattctcccaagttgacttataggtttaaggcaattcttatcaatatcctggtgaattttagtaggcacagacaagtttattctataatttacatggaaatacacagatcttagaagagttaaaacaatcttgacaggaaagaataaagtacaagaaatcacttaactgatattaagtcttactatatagttacagtaatcaaaatagtgtagaattggcagcaggacagacacatggatcaatgaaacagaacagagaacccagaaatacacccacataaatatgcccaattgatttttggcaaagtcatcaaagtaattcaatggagaaaggacagccctttcaacaaatgatgctggggtaagtggatatttgtaggtaagaaaatgaatcttgacctaaaggtgtgaaccttatccaaaaattaactaaattctggatcatggacttaaatgtaaaacatagaactataaaacttttagaagaaaaaaataggagaaaatcttcagtatctagggctaggcagagttcttagacttgacactaaaatcacagtccatactgggaaaaatcgaaaagctagaccacatcaaaattaaaagcttttgttcttccaaaggttgtaagaagagaatgaaaagataaactacacacttgcagaagacatttgcaaacaacatatctgaccaaggagtagtatacaaaatatataaagaattctcaaaactcaagaacaaaacaaaacaaaacaaaacaaaacaaaaacaactaaccaatttgcaaacaacatatctggccaaggagtagtatacaaaatatataaagacttctcaaaactcaagagcaaaacaaaacaaaacacaaaaacaactaaccaattagaatatgggcaaaagacatcaacagacatttcacagaagaggacatacagatggtaaatgatcactgttaaagattagccatcagagaaatgcaaaactgcagttgagagatcactccacacctaccagaatggctaaaatataaaatagtgacataccaaagctggtgagaatcagaaaacctgaatcactcatacattgctggtgagaatgtaaaatgctaccatcactgtggaaaaaaaatagcagtttcttataaaacaaaacatgcagttatgataccaacctgcaagtgcatttgagctcttttatcctggagaaatggaaacatgtttacacaaaagcctgcatacaaatggtcgcagcagctttattcataaaaaccaaaaacttgagacagcctaggtgtccatcaacacgtgagtgggttaaataagtttcataccatgaaacagttcatcctgtaaaatactactcagcagtaaaaagaagcaaactgttttttctgttttgagacagggtctcgctctttcacccaggctggagttcagtggcgtgatcacggctcactacagcctggaactcccaggctgaagccaccctcccacctcagcttcccaggtagctgggactacaggcacacaccaccatgcccagctaacttatgcattttttaaatagagatggggtttctgccatgtttcccaggctggtctcaaactcctgggctcaagcaatccccccacctcagcctcccaagtgctaggcttatggacatgagccacccatgcctggcccagagcaaattattgatacaacaatttgaatgaatctcaagcatattatgatggaagaaaaacgcccactccaaaattacatagtatgtgactccatttatatacaatttttgcaatggcaaaattttagactttttagaaaaccaagacctagttgacagagttaggggtgggggtgggaatgaggagatgttgtcattaaagggcaacaggggtgatggaattgttcaatagcttgattgtggtggtagacacagaaacctacacacatgtgataaaactgtatggaagtcaacacactttcacatgtgagtacaagcaaaactggggaactccgaagactattagcagtttgtatcaatatcaaaatctcagttatgatattgtattatggttttggaaaatgttaccattaggagaaaattgggtggagtgtacatgggatctttctgaatgatttcctacaactgcatgtgagtctacagccatttcaataacttaaaaaaatccagcttgcatagtgccagatttaacagacattgggaagtaaatggggaaagtaaatataagccaaattttcttccaggaaaaataagaggttagtttttcctttgaatttaatattcagacaaatataattttaaatacatatttcatgaaggtaaagaaaatcagtaaaaggcttctaacaagaagagctattgttccatttaatttaggagataaaatatacaaaacaatcaatagagcaaaagatggaaaataaaatagcttaaaagcaaaaagaataatatggggccactgaactgtgaacaagcaacagttataacaggattgccaatggattaaaccactctattaaaagacaaattctctcagactggcttataaaaataattctgacacgatgatttttatagagagggacatctaaaaaagtagattttttttaaagaaaaaggatgaatgaggttatacccagtgaaaacaaataaagagaaaatgagatgaggttagtattaatattagaaaaggaggattcaagaaaaaaataatggatggaccacgaaggctatttataggtataaatggtaatcatggatgcataatggaagtgccatatattaatttaatgaacagctgtaattcaaatataaagctcatgtctgttccttacacaccatctcagctcctccaaccctagtccgagtcatccgcatgcctcccagactcctaaaataacttcataactgggtccccatttccattctagcccctacactccttcacacagcaaccaatgatgtactttgcatacagattaaatcaatccactcaagttcttaaaacactccaatgagaactgcttgtacatgaaatcatatccaaactccacacactgatgagatgagagacagttcttcctcacgtgtcaattcaccctttcttaatggcaaccaaatccccaatttttaaaattcttggaccaggactgttcggaataaagacgacatttcccagcttcccttgctgccacgtatggcacgtgactgacttccaccagccacgtgactaacatctggccggggaacataagtagaagtgatgcttgcaacttcttaaagaacttgtgtccaggtgaagtggcttgcgcttgcaatcccagcactttggtaggccgaagtgggcagattacctgaggttaggagttcaaggctagcctggcaaacatggagaaaccctgtctctactaaacatacaaaaaattagctgggtatggtggcgggcacctgtagtcccagctacttgggaggctgaagcaggagaatcacttgaacccaggaggcagagattgcaatgagcctggatcgcataactgcactctagcctgggcaagagagcgagactctgtctcaaaacacaaaacaaaacgaacaaaacaacttaatattatctgaaatttccttattcattatcaatttatttaatgcctatctttctcctaccccttacactaaaatgtaaattccatgagtgcgagagccttgtttattgatcaccacaacatctgcgctctatgcaagagactttttaaaaattattttgttaaaaaacaatagagatggggttttgctatgttacccaggctagtcttgagctcctggcctcaagtgatcctactgcctgggcctcccaaagtgctgggattatagccatgagtcactgggcccaacctcaaaagactttcaataagcctctgttgaatgaatgaatgaatcaatcaaataatggcaggcaatatcaaatacacacagacacacacaaagagaaagtgtcagaaacagaattgagacaaatgttaacactatcagtctaagccagtgagtagataaaaaataaatgaggacattcatgattttaatgtaatttttagtggaaaggggtcatggatcagtagctctatttcttataaattgtgcaagcaatctattcaattaccatattatgtttgcagaaatcaaacacatattgagacacaataaatggatacaataaatagtatgaagatattatatatctgacattctatgattatgcaaaaaaatgaaaaaccaataacaagtatttaaacaaggtattcagtaacattctcccaaataactattgagtgaatgaaaatattatctacaattatagaccatatagtaagtgatcacaatacatataaaaatctccagaatggtaaagctatacgaagaagaaaatttatatctaaattatttcattaataaaaaagaaaactaaataaaataatttacacaaattattattataaatgataataaatgatcagaacaagaagcaagagaagggaaatgaagagaaaagctgaaaatactagaatgaaaacagagaaaaaaggattattcattaaatagaagcatagattttccccaaaatcactaaaatagacaatcatctggcatatcaaattaattcaaaccatggtatgagaagactttcaattttttttttttttttttgagacagtttcacgcttttgcccaggctggggtgaggcagtgtgatttcggctcactgcaacctccgcctcccgggttcaagtgattctcctgcctcagcctcctatgtagctgggattacaggtgcccgccaccacgcccatctaatttttgtatttttagtggagacggggtttcaccatgttggccaggctggtctcaaacaactgacctcaggtgatccacccgcctccgcctcccaacgtgccaggattacaggcgtgagccactgtgcccggcctcaaataaatttttaaacaatgttatatgtaagtaaatgctaataaactaagtaattttgaggaattggtaacctgaagataatataagttttcaaaatagactgaagaacaattaacttctaatatttatcaaataatcacctcaaaaaaatgagaacaaaacaaaaaagcagtttatgaactagcaagcctaaagtcaaagttataaatcaattccatactgtacagaatttattatacatcacagaaaataatataaagcaaacaaattaatttcatcatgctaggttaactatgtttcaagaactaacaatgacacttgtaattttgtataaactataggtcacttttatttataaatatgaataaaaaataaaaatggcaaatcaaattcaaaacttacactacaaattcaaattgcattaagaaaatgggctaccatgacaactaatattaaccctaagaatacaaaaatgatttaataataggaaatctattaattatcacatcttgtccaaacaagaataatcacatgatcctattattatagattcaaaggccatttgagaaaaagctatcatatattcatggtttttaaaatgttggtaagttagatatggtttggctgtgtccccacccaaatctcatcttgaattgaagctcccatcattcccatgtgttgtgggagggaccatccctgggggagatcattgaatcataggggtggtttcccccatactgttctcatgatagtgaacaagtcttacaagatctgatggttttataacgggtttccctttcatttggctctcattctctcttgtctgccaccatgtaagacatgcctttcaccttctgccatgattgtgaggcctccccagccacgtggaaacgtaagtccattaaacctcttttactttataaattacccagtctcgggtatgtctttatcagcagcatgaaaacagactaatacagtaggtaagaggttaatttcctaaaatcaactatcacccttactgtttattagtaataaataggtgtcagtcaacacaaatgggataaaatatacactgctgaaaggaaggtaacaaaattgctgcaatttgtagacaaagtcattgcagggataaagagcctaagaaaatcactggaaaaatccatgactgctgtctgtgttttcccaaaattcatatactgaaatcctaacccccattgtgatggtattaggaagcgggccctttgagagctgattagatcctgaaagtggagactcataaaaaggattaatccccttatcccaagggatgaagggataaaaggacccaaggaaatcagttgatattctgcaatctgggagagggccttcaccagaaccttctagaactgtaagcaatgcatttctcttgtttataagctacctggtctgtagtatttagttactgcagccgaaaccacctagactcttgctaatgagagaattcaataaggcagccagatgaagcccaaaattccaaagccattttccatcatactggcagaaaggggttagaaacatttaatgaaaaattaaaatcaggtgcggtggctcacatctgtaatctcagcactttgggaggccgaggtgggcgaatcacctgcattcaggagttcaagaccagcctgaccaatatggtgaaactccatctctactaaaaatacaaaaattagccagcatgtggtggcgcgtgtctgtaatcccagctactcaggaagctgaggtagaaaaattgcttgaacccaggaggcggagattgcagtgagccaagatcgcgtcactgcgctccagccacagaggagaccctgtctcaaaaaaaaaaaagaaaagaaaagaaaagaaaaagaaaaagaaaagaaaaggaaaggaaaggaaaattagccaggcgtggtggctaatgcctgtaatcccagcactttgggaggctgaggtgggcggatcatggggtcaagagatcaagaccatcctggccaacacagtgaaaccttgtctcttctaaaaatacaaaaattagctgggcgtgttggcacgcacctgtagtcccagctacttgggaggctgaggcaggagaactgcttgaacccgggaggcagaggttgcagtgagccgagatggcgccactgcactccagcctggcgacagagtgagattccgtcaaaaaaaaaagaaaaaaaacaaaaaagaaagaaggaaaattaaaatcctattcaccatggcaatataggaaaaaacaaaaaaaaacaaaaacaaaaaaccagacagcagtacctccacaagacagtatagggcctgctccccagtgtctggctgggaggaggtcaggagtgtggggatcagggcccactgaccagagagtcaggtggctgtagccacctccctggtctcttggctgcaccgttgaacctctgaactctgcgctgtgggtcaagagcattggagccgtggtcagaggctcctccaggacaccatccctgaagcacaggaagacccctgttccctctcctgaacctgcctttgatcacttctggtttggggtttgaagggatttacctgactgaccccaagaggtccccatcagcttccatgcctgtctcgctcctttctctgcttcctctgaagtttaacaagttcagggccaagattctacttctgatagcatccatcctaatcatctttcctttctctcctgtttgcttcattgagagagagtctcactctgacacccaggctggagtgcagtggcacgatcctagtgatcctcccacctcagcctcccaagtagctgggaccacaggtatgcaccaccagacccagctaatttttaggttttttttgtagagacaaaaaaatgttgcccacactggtcttgaactctgaactcaaacagttctcagcctctccaagtgctgggattacaggcatgagtcaccatactcagcccatttagataactttcaatgaaaattctgcaccttcctgggcgtctacagttcacatcataccctatgggttaaacacttgaggataagtagattgaataaaaaaaatacttttaaatataatttgggaaggttctatggaacagagatatgaaaccagtggtgccaggactttcccgataatgtgaccagtgatttttctcttctccccacctacagccgctggtcagctcatctcagctacaggctgaagtaccagccatgaggttattttgaagcaattttttaaaattacttttaatcggccgggcacggtggctcaaacctataatcccagcactttgggaggccgaggcaggcggatcatgaggtcctcttgagaccatcctggccaacatggtgaaatcccatttctactaaaaatacaaaaattagctgggtgtggtggcgggtgcctgtagtgccagctactcaggaggctgaggcaagagaatcacttgacccaggaggcggagggtgcagtgagccgaggtcgtgccactgcactccagcctggcaacagagtgagactccgtctcaaaaaacaaaacaaaacaaaaattacatttaatcaatttattttttgtgatcataaaatcatttcagactttttcccaaaatatgagttttcagcatattaactggacataaggctggtatgtggagagcagcatctgtgacagtcctgccttgcgcctcctgcagcctctgcagcagagggtcatacagtggctttgggtgacagctgccactcagtggtctccagtgagttcttttcctcctggcagctggcagctgcattaattttgattttaggctttatttatttattgattgattttgagacagagtccccttccgtcacccaggctggagtgcaagggcgtgatcttggctcactgtaacctccgcctccggggttcaagcaattctcctgtctcagcctcctgagttgctgggattacaggtgcacgccaccacgcttggctgatttttttgtatttttagtagagacagggttttaccataatggtcaggctggtctctaactcctgacctcaggtgatccacctgcctcggcctcccaaagcactgggattaaaggcatgagccactgtacccggccggcttttatactctcatatcaactttgtgctccatttaccataaccatgggcgtgtgaactagaaatgctttaaattccaatcacttctcccctttttgtttttgcccctgaaaacaattgttggataatgtaattttgctaatttgagattttttttttttttttttttttttgagacaggatctggctgtcacccaggctggagtgcagtgacgtgatcatggctcactgcagcctcaacctccttggctcaagtgatcctcctgcctcaacctccccagtagttgggaccacaggtgcatgacaccacacccagctaatttttttatttttggtagagacagagtctcactatgtcgcctaggctcctgtcaaactcctgggctcaactgatcctcctgtcttagcctcccaacgtgttggaattacagacaggagataccatgcccagactaatttgagattttgttaactttactgaataataacagaatagaccgtatagcctaatacaaacaagtataaagaaaaaattattcacttttgtgccagtcaaaataagtacaatcagaattttttccatttttttctatgactataaatggatgcataatagattaatataatgggcataatagatgtaggatggtaatgtaattatactgtaaattccatctctatcttggcttttccatttactataaagtgaaaatattatttctaacaattatataatattttatctttataattgcattttcctacatctctgactgattttatatggtagattactaaatgtagaaaattattttaaatcacagggtttgaacatattttaaattatagggctttaaaaattatggccaagtgtcaccaaatagttttctgaaaagttgtatgatttacaaatttacatttctacaaagaaattgtaaatacatttctttctatttacatttctatcagtgttatatgagttggctcttttttttttttttttttttagatggagtttcactctattgcctaggctggagtacagtggcttggtctcagctcactgcagcctccgtcccctgggctccggtgattcccctgcctcagcctcccaggtagctgggactacagatgtgcgccaccacgcccagctaatttttgtatttttagtagatacagggtttcaccatgttggccaggctggtctcaaactcctgacctcaggtgatccgcccacctcagcttcccaaagtgctgggattacaggcgtgagccactgcaaccagctgagtttgcctattttatcttgctcctgacaactttgagtattacatgatttattttccattctgagaagataactgttaaccaatccctattttaattaacatttctaagatttccggtgaggtcgagctgttttaatgtttatttcaaatgtctatcagttgtctattgctctttatcccatttattgtcaagaggtttcacatagctttagaaatgttctgtacctgtgttttattctacaaattgccatatttttgccagtttgttagcttttctgtttgtttactttttgagacagggtctcgctctgttgtctaggctggagtgcagtggcatgatcatggctccctgcagcctcgacctcccaggctaaattgatcctcccacctcagcctccctagtacctgggactacaggcatgtcccaccatgtctggctaatttttgtatttgtttgtagagtcaggatcttgctttgttacccaggctggtctcaaactcctgggctgaagcgatcctccgcctcagcctcccaaagtgctgggattacaggcgtgagacactgcgtccagcctttgttagctttttaaatattcttataatctaatagtataagttagtattatttgattgttccattgcctccaatgcttagaaaattatttcctacttagaaattagctacatattgataggtaatttctccaccttttcaaaacagtttaaaattatagtgttaaatagactaaagatcaattacacttatgaataaggataactaaaagaaaaacccaaattaccaagcctggaaggaagcaagggtcagaaccagatcagtaaaactaactcgctgccttgtcccaaatgtcaggctcattaaaatcctgtaactaagtggatctcaaactcaagccagcgttgacgtcacccagagggctaatagaaacagattgctgggccataggcctggagtttctgattcaacaggtcagtattgaatattcaatttaataggtggggcccaggagtttgcatttctttctttctttttttttttttttctctttttgagacaggctctcactcttgtcgcccaggctggagtgaggtggtgcaatcatggctcactgcagcctcaactgcctggattccgacaatgtcctcacctcagcctccagaataactgggactacaggcatgtgccaccacgccaggctaattttttaaattattatttctagagatggggttttgctatgttgcccatactggtcttgaacccctgtgctcaagagagcctcccacctctgcctcctaaagtgctgggattataggtgtgagtcacttgctgggccagaattcccatttctaacaagttccaggtattactaatgctgctggtccaggaaccacactttgagaaccactgttaacatgaatgcttcccatattccatttttccacacttggtaagatccctgtggggaatgaaggcttgctgtcagtctagcaggccttgatatagacatcactgctgaaaactattaaggttccattagatgattaagaatggaagagaggccaggcacggtggctcacacctgtaatcccagaactttgggaggctgaggccggcacatcacctgaggtcaggagttccagaccagcctggccaacacggtgaaaccccgtctctaacaaaaacacaaaaattagctgggtatggtggtgggcgtctgtaatcccagctacttgggaggcagaggcaggagaattgcttgaacccaggaggtggaggttgcagtgagctgagattgcgcccctgcactccagcctgggcaacggagtgagactccatctcaaaaaaaaaaaaaaaaaaagtcactgtcaatgattgaatatatttccttccagtctttttatgcataacagatttgcagtcacattgtattatagctttttgtatgtaatatttccttcacatgtcacaaccatgaaatgcaaatgctctcaactgtccatgggtcaagaattttatttattttattattattattattattttttgagacagaatctccctctgttgaccaggcaagagtgcagtggcatgattatagctcactgcagcctcaacctcctgggctcaggcaatcctcctgcctcagcctcccgagtagctggaactacaggtatgtaccaccatgcctcgctaatttttgaattttttgtaaagaaagggtgtcactcattgcctgggctgctcttaaactcctgctttggcctcctgaagtgctgggattataggtatgagccactgtgccaggcctaaagtcagtaattttaaaaccaaaccacctgcccatctctgccatcacggtgggaccagcttataaaatgtcccagacaaaagcctgggcctgggctgggaagaactaggttttgcatgaggacctgagacagagatcaagattcctagaccaggctgggcacggtggctcatgcctgtaatcccaacactttgggaggccaaggtgagtggatcacttgaggccaggagctcaagaccagcctggccaaggtggcaaaaccccgtgtttactaaaaatacaaaaaaaaaaaaaaaaaaagctgggtatggtggcacacacctgtagtcccagctacttgggaggctgaagcatgagaatcacttgaacccgggagatggaggctgcagtgagccgagatgatgtaactgcactcctgcctgggcaacagagagagactctgtctcaaaaattaaaaaaaaaaaaaaaaaaaaagagtccaggaccaaagcagaaatggaaagccacaggagacacgagaccacagcaagaactgggatggagagacaaaaggtaaagcctttccggaaaggtttctggggagtagatgcaggtattttactgcacctgctgcatattctcccaccagatgagtgaggattggacagcagcagacctatgattgataaccagggagaggcaaagcaagtcagcgtggcaaacagactttcatcccaaccaaattggggaacgagtaccctatgcactttcaggctagggtaatttacaatgtcttgcacattgcacacagctgtgggataaacaagctattctaaagaccagcttgcagaatggctccctggacttcgtgtgtgctcgggagtattgcccaaaagtcctgagcatgcaaaaagaccagggagctattatgggcttcttgtctcccgacctttagccccggactcattccaacacgaccagcaccatccaatgagcagatctatttgctcacaaactgtgaatatttcatttcttaaaacagaaagtctaaattagtgaagtcttcatgaataaggtttgattgtgaataagattaaaaatgtgagcaaaggaacccagttctacatgagatgttttcggcgtcactctggccgaggtgttcttgaacctcacggtggcaaaagtaagacacacaaacagctcagctctcctcaccaagtgtgggactcatttctctgtttcttcagagggaaaagaggttaacagaagtgttggctggcccccaggactggcagacctgtttaatctcccatgatcctttcacatatgctctctatagcttgctgtctgcaaactcatggcagaacacggttgcacggggcttgaggtcaagcagaagaaaatgaaaaaggctgctggggtaaattcatgaaaacaccatgataaaatagcagggctctttcctctgccacttggggacatctactgtatcataagcctcttattcttggatacaagtaggcacatgatgtgtggcgtaaataaatggtggaaaagcagggaccctgaggaccgtgcttgacttcttggcaggtgcaattaacctgcagcattgagcaggaagcctaccccccagtcctgagtctcagccccgctcagtcccttccttccctcctctcctctctgccattcccatataccatatcctaaggctgactccatacacagtttcacatttcctcagcaaatataccactgcagtaacaaaaaaacacacagaagcttgatgaacgaagactaagaacacaatcacagctttacaacttatgcataggaaagcggttctgaactggctgccaagagtctcacacccagagggctgagcgtatgccgggaggactggagaccctggggcatgactctcagaccatcctccccggaaaggaagccgcatttgtagccaactatattcccccttcactgttaatcaatttcctgcaaagagccaggggctcataacttttgcgactagtaccaaccaataaatagctgtttttgctgaatcccatttgattttattctacccttggcactataggctagaacaccagtaaggaaagcactggaaaaaaattattttatttatttatttatttttgagacagggtcttgctctgtcacccaggctggagtgcagtggctcgatctcagctcactgcaacctccacctcccagaatcagatgattctcatgcttcagcctcctgagtagctgggattacaggcgattaccaccatatccagctaattttttttttttgtatttttttttttcagtagagatgaggtttcaccatgttggccaggctggtctcaaactccccgcctcaactgatccgcccacctcggcctccctaagtgctgggattataggcataagccaccctgtctggcctggaagaaggattttattaggaaaaggcacctagtgcttgataggattgcttctcagtgatacagagaatagccttggttataggtttcctctaaggtaggaagaaacccaagcctggggaaaatggaaggcttggggcagcaatgtcagatcagaagttgaagtccaattacagaatctttaccctttatggtagctagcctccaaagtgatccacaatggctcctgcctcctggcattcaccgggaggctgttctctcccacacttaatagggatgacctgtgtaaccaagagaatattgcagaaatgattgtgtccaacttgatagctagggcataaaagatatcattgctcttgcctagcactgtcctggatcactggctttgagggaaactggctgccatgtcaggaggacactcaagcagcattgtggcaaggtctgtgcagtagggacctgagggctcccgtcaaccaccagcgtcaccttgccagccaggtgagtgagccaccaggaagcacatcttccagtccagtcaagcccaaggctggtcacagctccagccagcatcttggctgcaactggattagagaccctgagctagaaccacccagctcagccagctttcaaattcccaacccacagaaactaagtgagatagaaaatatttagtgttgttttctggccctagattttggtgtaatgtattatgcagccaaagaccacaaatatatacccttctagaagtagtctcaggtctgtttccacggaaaactgactatgtcactgatgggaagccttgctagagtctcttaagtaggatggtcttctttcaaggatatcagtacctcctaagatcaatatcttctgcctggatatctggaggtgaaaagctacttttcctattttttatttttgttttattttttgagacaggtctcagtctgtcagccaggatggagtgcagtggcacaatcacagctcactgcagcctcaaactcctggcctcaagcaatcctcctgcctcagctccagagcagctaggactacaggtgcataacaccatgcccagctaatttttcaatctgctttagagacaggctctcactgtgttgggaaagcaacctttctgcttcttttttgtatattatcttcaatcacttcaaggaaggaaacacacatgtatatatatgtgcacacacacacatgcacacactcagctttcttctaaacctgaaaaaccacccaagcactgggaacctgaactcttttccagaaacaagccaatgctgtagaagttttaagtaccattttttcacgctgtctctgaaggggcaggcagtcgcagggggaagaaggggaggctgattactgagaattgatggatgtttttgttcttgcttgctagtcgtaaaattctgagctgggtgagcactagcaggagaggaaagccacagccactaagtctgtgacttccagcattgatttaaatatttcaagatggaattttccctcctttctccagcctatcttttcaccctgagtggggaagaaaatcttgagtaagacaaaaacatggagactttgtgagcattatagcatgtctgaattaagctacaggcagtccatatattgtaagagatatatttccttgcagtgtacacgctctactgtgatgaacctggaagacaggaggagtaggagtgtagattaagtagccatagctccttctcatccagatgagggccagaaagaagaatgcttagaactcacaaggccttggaacattctccttagttggccctaaggatggaggtaaagagtaggaagcattcaggggctcaggtgccatggctcactcctgtaaactcagcactttaggaggccaaggcaggaagattgcttgaggctaggagtttgagaccagcctgggcaacatagcaagacaccatatctaccaaaaaacacagaaaaatatagcagggtatggtggcttgcacctgtggtcccagccacttggaaggctgaagtgggaggatcacttgagtccaggagttcaaggctgcagtgagctatggttgcatcactaccctccagcctaggtgacggaatgaaaccctatctctaaaatacacaaaaaacaagcaaaaaggcattcaggagaatagatggagaatgagagaaagaagaaggagaaacgcccaggggagaagcaactcgccaaggcccatcatcagagtggacctccatgggtcaaaagatggccagatgggaaacaatattccttcatcttctgaactctggggtcatttcttatttccaccaggggactctacctattggtccttgcaagtgtcaagtcataactgaaggttccatgagcactgcaatattctccttgcatggtgagtagggtcctggagatgttctggatcctaacaacagttcagggagatggcgttttcctgtcagcagtgggggattcacgagcccctgtctcactctcccctgatcctggatgtcctctgggaccaggtcccatctctctgctcatcctcttttatgcaccttccctcggtgagctcatccttgcctataattttacccaccagctctcatgaatctcaatccggtgttccagccccaactgatttcagctgtgcatagacttcctccctttacttggctgcttgaccctcaccttctactcagcatgtccaattgaggattcaaccccacaagacttctctgttgctccatgatctgacccctgccaataacagcaagttgggaactctggaatcagcctcacctcttctgtttcttcaggccctaaatccattctgccagtgggttttgaggtcttgcccttcaaacggtatcttagtcatggtcaatgacttccccatgccaaccccttttcaaactctcatcatggcagaactgaaatgccctcttttctttctttgcatttaattccacccatacttcaaggttcaaagcaagtgtcacattccctaaattcttttctgacccttcaagactgtattttcctcctttcttgcccttccattcatctattgaaacaaatagttattgagggcttgctgtgtacagcatgcacagagtgagctacaactctgaagccctgtgcttcaaggagttacagtctagtgaccatcacactaattaatcacttgtttgttttccctctcttaattgtgtttccctagccaaattattatttttgtttgtttgtttgagacagggtcttgctctgttgcccatgctagagtgcagtggtgtgatcatagctcactgcagctttgaactcctgggctcaagcgatcttcctccctcagcctcaagagtagctgggactacaggcatgcgccatcacatttggctaattttaaaaattgtttgcagagacgggatctcgctatgttacccagactggtcttgaactcctggcctcaagcgatcctcctgtcttggcctcccaaagcactggaactacaggcatgagccaccaaattcagcttccccagccaaattgtgaaatagctaggtctgagtcttaaatgccttttgtaaaacccacaagcactgatagattatagcatatgtaagttcttactaaatacttgttggttctatgcaagatgggtacctgaataagactagaaagacacaccaactgcaacccttatctaggttagagaaatctcctggtgaagggaaaaaacaaaaaataaaataaataaaattaaaaaaaaaaaaaaaagaaatttaaaaaaaagaaaaatcatgctgtgtctgaatggcgttttacgtgtctaactggtaatttaatttaatttgacagacaacttacgtgattcaaattttttaaaataatgattgataacccactccctaaattttataatcataaaataattgtcacattttaagagtagagaactaatataaaaatgatttcattatactttaataattacaatgttagatgtttggaatttcctaagagattttacaagatagaaacaggagctaattgagaagcactgaatacacattcttagacaaaaccattctctctcattaagtgcaaggatattgacgggatccaaatgtaccaggcaaccatgccattctctcagcaaagatatcccggaactggggtcaaacacagaaccggttcagataatatcagtgtgcccctttgaagtgtccccaggaaaaagacttttgtgaatgtgcagtagaataatttcatttttccctaatgcaaaaaaaaattgctacaagaaaaaaatggggagatatttcactcctccaaaccctaaaaaagtagttgttttgattctttgttctggaacatatgtcgctcagcccagaagagatcttcacgtgccaaatagaagttcaagaattcagtcaaaagttagtctcagacacatttactgtcaaacttagtctgaaaaaaaatattcttactcacctgccagaatatgctgtctatcgtgttcccaagaaaaccatcgcgaccttctgaagacaccagtttggggccaagaatggtcatgaattcatcaaaatccacctggccatcccctgcaaggagaagatgtaaatatgagttgcaaacaagctgaacttgacctaccgtacctgatgcaataaacacctctacgcttttcttcttggcatgacctcaatcaatgaagaagagctggtaacattacttaaaactgttcaatgttcttcaatgactgaaagtaccacaagaaactggcaattattagtacaaccaaaaccacatattcctaaacatttgacagtatttctagctaaatgtccaaccatcacttcccacttaacatggttatacctcacccctgcttctccttttactccgaattgcccagttgtacatgatggaagtggcagcttcaccccatctcttccaccatccttgtcacccacatatacatgtagtcatcaagccttcttgatttcacctcttaagtatctgtggttgctgtatcttcctcattactcaatggctagttcccttttcaaccatgaaggtgagaaaatccttctaagaattaatgttcctagctacgattctgttatgagtagcacggcttttacactcttaccttcgcagtctcttctatgcagttctgagtttaattccccaagaccaaatctcatcatgctttctatatttgaacagcactttttttgttgtttttgagatggtgtcttgctctgttgcccaggctggagtgcaatggcgtgatctcggctcactgcaacctctgcctcctgggttcaagtgattctcatgcctcagcctccagagtagctgggattacaggagcaagccaccaagcctggctaatttttgtatttttagtagagacagggtttcaccatgttgcccaggctggcctcaaactcctgacctcaagtgatccgcctgccttggcctctcaaagtgctgggattacaggagtgagccaccatgcccggcctgaacagcacctttgactgaaaatagggataccacctcagcatagtgttcaagcctcactatctcttttgcatcaatttgtccccaacctttgcataaaatacaagctcctttacacctctgcgtgcatgtgtatgcctatccctctgtccgggatgccttccctcacttgtctatctggtgaattctctttctctaagacggagctgaaatgtcatgttctctttttgttttgttcctgatctcattaggcagaactggtcgaactttttttctctctctcctactaactccatgtgtacctactgtagaatttaaaaccatgtatcctggccaggtgcggtggctcatgcctgtaatcccagcactttggaaggccgaggtgggtggatgacctgaggtcaggagttcttgaccagcctgaccaacatggtgaaaccctgtctctactaaaagtacaaaattagctgggtgtggttgtccatgcctgtaatcccagctacttgggaggctgaggcaggagaatcgcttgaatctgggaggcggaggttgcagtgagccaagatcgcactgctgcactccagcctgggcaataagagcaagactccatctaaaaaaataataataataaaacaataaaataaaataaaaccttatatcccagtcactgatttgcatgcctatctcacaagcaaaagattgtcagttctgcaaggtcaaggacttggtctgaaacatctttgtatattgaacaccaaagcaggcattcagtatgtacttgtacaatgaatgaatgatgtctcttgctcgttctttctttgttcaattcagcatctgctggatctttcatgctagagctgacagtaatcagaaggtggacttgagccaactcaacagacaagagcgaaccttcaaggcattgttgggtcctccaggagtcatcagtgtagcattctgcaccctctgaactgctcaaaagggcaactccatcaaaagttcaccacatccctaccttggctgcagccagcacagacagccaggtgtctgcacacaagagtttgtccaaatgcccacacataaatcaatgccctctcagagtgcattcaccttcaaagaatattcattcaaaacctatttcacaatgccaagcagatgtgagcatcaagatgccaataattcagaacagattgtccaggaacagattgtccaggaacagatcccagcagaggtaaaatttcctaaaggattagggaggcgtggcaagtcaatgggaaagggaggatttaaccaccaaatgaagaggggcagtcggtggcctctggagaagaaattgatttatcttatcatccaacaagataagtctaaaatttcactcttgctggtaatcgtaagaaagctaattcaagcaacgagttaccatcttgccttcaaaattatcaaatacttccaaaagcacactagtcgatgctgccagaaatacagagagatcacctctataatgcattcctggtgtacttgtcccagatatagacaggaagtaccaatcaagatcctgtaaagtgctgtttcctttggatctaacaatgcacttaacaaaatagaggggggttgggtgaggtggctcacacctgtaatcccaacactttgggaggccgaggcaggtggatcacctgaggtcaggagttcgagaccagtctggccaacatggtgaaaccccatctctacaaaaaatacaataattagctgggtctggtggcaggtgcctgtaatcccagcgattcgggaggctgaggcaggagaatcgctgaacccaggaggcagaggttgcagtgagccaaggtaagaccactgcactccagcctgggcgacagagcaagactctgtctggggaaaaaaaaaatagagagggggtcttgctatgttgcccaggctggtcttgatctcctgggctcaagtgatcctccttcctcagcctcccaaagtgctgggattacaggcatgagccaccatacctgaccttaataacttcatttttagagaaaaaataaaacaacatttatcttgaatatagaacaagatatttgcctacagatagatactcaactggtatttgtaaaagtgaaaagtagaaagctagagggaaaggagaatggcccagtctacctagaatttgacacctctgaaagctaactccacgtggctccacgtcttggatagacatgcttgttacatttgtgcagtaactctctgctcaccccaaatcacctccactagtcacaggtggggctggatggccaaacagtcttgaactaaactatacattctcaagagtgacagtatcacccacaatggggtgaaaatggcttcttagggaacaaaataacattagccaatgttagatattacaatggcttgcggctcttctagggctacagtacataatacacagtgtatctgtacaaaatttcaagagggtgggacaactagaaaaatgcatatctgaaaaggttcttgggaggtgcttatttaaaaaaagaagaggaaggttaagaagcactggactaggagacgccccaagtactgtggttcttttgcccaggtactccctctggaatgtcggtctatcagcagtgggcatcatctcactatctgcacccacagtgaggtctaactgttcatagaggcttagaagctcaaggacacgaatctatttttgcaaagacatcatgagggccaggtgcagtggctcatgcctgtaatcctagcactttgggaggccgaggagggtggatcacttaaggccaggagtttgagaccagcttgggcaacatggtgaaaccccatctctactaaaaatacaaaaattagccaggtgtggtggcgggcacctgtagtcccagctacgtgggacgcagaagcaggaaaatcacttgagcctgggaggcagaggttgcagtgagctaagatggcaccactgcactccagcctgggttgacagagtgagaccctgtctcaaaacaaacaaacaaacacacacacacacacacacacacacacacacaaaaacacatgagacctggccgggcgcggtggctcacgcctgtaatcccagcactttgggaggccgaggtgggcggatcacgaggtcaggagatcgagaccatcctggctaacacagtgaaaccccgtctctactaaaaaacacaaaaaaattagccgggcgtggtggcgggcgcctgtagtcccagctacgtgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaacacatgagacctgatctaagatatgcccaccaggctgctcctgaccgtgatataatgggcaccattctctcccacttgggaacctcatagtttacgagatgtggcaaaacccatgcttgccagcaccaggagaacgaggctgtctttgaacagtgcaccttcaaggtagcaagaggagcaagaccacccacctctgaaacctcgactcagggtgcagggagcgcagcagtttggaactggtgcatttcacaggtccacatggagctctgggccaaatcatcacagtaccaggcagtgctcacagatggtgcacttggctgggaactacagaccaaaagctgacaagcagaaatgatgcttctgaaacacatcttggtcctggcaaagggagcagctcatttgctattccaaattgttggccagagaagaagcgatggagaagggcactcaggatcctatgggcagggccaactatggcgtggagtacacgtgacttggcagaagaggtacagatcatggaaatatttgcttctagtcatttaggagaggacgtttggaattccagattggccaatgtatgtttttcgcttgtgatactttgatttataataagaaatgcatattggccaggcgcagtggctcatgctgtaatcccaacactttgggaggccgagatgggtgggtcacttgaggtcaggagtttgagaccagcctggccaacatggtgaaaccctatgtctaccaaaaatacaaaaattagctgggtgtggtggtacaaacctgtaatcccagctacttggtaggctgaggcaggagaatcgcttaagtctgggaggtggaggttgcagtgagctgagatgatgccattggcctccagcctgggtgaaagagcaagactccatctcaaatatatacatacagatagacagacagatatagctatagaaatctttgtctctgtttcctggtacacagctcataaaacactgataattccctaagtaatagagttgcaaagagcatcttttgttctaatatttggtctttttttttctttttgagacagagtctcactctgttgcccaggctggagtgcagtggcacgatctcagctcactgcaagctccgcctcccgggttcacgccattctcctgcctcagcctcctgagtagcccaccaccacacccagcgaattgtttgtatttttggtagagatggggtttcactgtattagccagtgaagattagccaatcttctgacctcgtgatccgcccacctcagcctcccaaagtgctgggattacaggtgtgagccaccgtgcctggccaatatttgatctttgaccccatttcctggccagaactcctaaatcctttggaattccctgggtgataggaatgtcttttgttctaatgaagcacttcttggtgggcttccagtgggagatgatcaccagaaacaccaaaccatgattagaaccttggaaatttcagtgccatctccccaacctccagggaggaaagaggagctgaagactaggttcataatcaatcaggcgcacatgatgaaatctgcataaaaatccctaatgtatgaggttcagacagttttcaggttggtgaacacatggagatgctgggaggatggagctctcagagagggcgtggaagctgcatgtaccactcccattaccttacgcctctctgcctttccctgagttgtattcttttctaacaaatgggtaataattagtaaagtgctttcctgagttatgtgaactgctctagtaaatgaatgaacccaaggagggaacctctgatttatggtcagaagcacaggtggccacgtggactttgaaatggtgtcctaagtgggagcaatcttgtgggactgagcccttgacctgagggacctgatgcaaatggaaattgtctaaacaggtgctcctcaaataatgttaactccagatagatagtaacagatagtaacggaattcaatttaattgtaggacatccagtccagtgtttgcagataattggggaatttcttggtgagggagaaaaacccacactttggtatattttgtcttgagcgttagagtattgggaaaacagtcttcttttctcatgcactctctttgttactcaatgagcaaagggggatgtctccaggcccatggttggaggaacaatcaggataggtcccccatatctccagctgtctcccgatatttctcagctctggttcctaagtatgtaaggacacagcacattttctgcagaccttcagtaaatgaagactcttccctctaatctacaattctataccaaccctactggtaacataaacattcagatttagactacagaaatgacctctttaccagattttaatttaacagacaaacagggctgggaataccccccaaaagttatcagcattgtacccagaggtctgatccctatgcccccacaccctcaaccttaggggaacggaaacaaatagaatctcagaggtaggttttacactaagtccctaaaaaccactcccaagctgccaggctgaagcaaggtccaggaaacctgataatcataataatatctaacatttactgggcacgcacaacgtggtggacatggttttttaaaatacccacacaatttttttttttttcttagaggcagggtcttgctctgtcacctaggctggagtgcagtggtgccatcatagctcactgcagccccaaactcctcggctgaagggatcctcctgcctcagcttctggagtacctggaactacaggagcatgccatcacacttggccaatcttttaaaattttttcagagacaaggtcttgctatgttgcccaggctggcctcaagcaatctacctgccaccgcctcccaaagtgctgggacatatactaattcatttacatcttcctgctgcccatttgacaaatgagaaaactgaggctcaaagaggttcagtagcttgcagaagcttacgcagggagtagagctgagattccagccccagcagtctgcctgtgctttttgtgacctttcaaaaggtcactcactgacatggtctgtctggatcactgtctcctgatcccagcttttcttaccaagcgagtgctatggcgaccaggtacacagagtcaaactgaaatctaaatggctccctgtggtctagctcttgcatctcaggtcagccaccagaggccattcttcatcatttcagagagtaataataaataataggaactacttatttaacacttgctatgtgccaggcactgagctcagggctttacatgtattcccttgttgaattccatgccaacactataaataggttctccccttccacatcttatcaatgagataacttagaaaaaaagaggttaagaataactgtatcaaggccatgcagctaccatgaggcagagtgggggctcagctcagaatcttaattgttttgttttctgttttgctagagacaggatctcactctgtcacccagaagtgcagtggtgcaatcatagctcactgcagctttgaactcctgggttcgagtgatcttcccacctcagcctcacgagtagctaggaccacagttatgtgccaccacgcctggctaatttttttttttttttttttttttttgagacagaaactcgctctgtcatccaggctgaagtgcaatggcatgatcttggctgatcgcaacctccgccttccgggttcaagtgattctcctgcctcagcctcccaagtagctgtgattacaggcacccaccaccatgcccagctcattttttgtatttttagtaaagacagggttttgccatgttggccaggctggtctcaaactcctgacttcaggtgatccgtccgccctcctccacctcccaaagtgctgggattacaggcgtgagccaccacacctggctcctggcttttttttttttttttttttttttgagacagagtctcactctgtcacccaggctggagtgcagtggcacgatctcagctcactgcaagctctgcctcctgggttcacgccattctcctgcctcagcctcctgagtagctgggactacaggcgcccaccactgcgcccagctaattttttgtatttttagcagagatggggtttcatcgtggtctcgatctcctgacctcgtgatccgcccgccttggcctcccaaagtgctgggattacaggcatgagccaccgcgcccagctactcctggctaatttttaaattttttgtagagacagggtctcactatgttgcccaggctagtcttgaactcctggcctcatgtgatcctcccacctcagcttcccaaagcactgggattacaagcgtgatccactgcacccgacaagaaccctggtattaacccccgtattgtactgccttcccttgatatcagagaccccagcccttggtcctggcataggatcacaggatctcaagctcttttcaaagtttgagagttatagtatgttttcctatctgggtgtttaggaagaaagttagtgggaaattgggagagatagctatcaggagctttaatgcaaatggcaattgtcaaaacagatgctccttaaatcgcctctttgtctgcagtcaggatcttagtaattctctatgggtgctccattcccagggaggggatacaggtcgttcacagagaaccctgcacacgtctgaagtctcttccaccagaaaagaattggtctgatgaacaaaacctgttcaggccctgcagggtcccatcaaactgccattacagaatcacatgcccccaaaagacaatggtgagtctcttcctagatctgcaacctttcatggaatgcaggaggtcctaaatgcaaaagctttgattaaattcttttatcactcttgaatgagcaagtagctgcaggaagaaagaatgtaattcactcagaccaggcctcattttcccttctctagcttccaaatatcatgatccacttagcaagaagcacagaaagctagcctgccaaggactgtgtctcgtggtttccccactgctatgtgagtcaaagtaatgaacttgaactagggcaggaagctgcaggagtgccaggactgtacaacattcattaagaccaaccagccaaaattctcataaggaggtaaaataatccttaaaaaaatcactgcaaaataaaagggaggagaggaatatacaggaaaagtgggtgggcttcaaagggtaacaagaagaaaaaatgtctatctgagactccattcaaattagttgatgaaatctccaaagcataaggcgcagcttagcttccaggggcttgcaatccattactcaaggcagaatgaagggagtgctataattgacctaaaagcattgtgttaaggcaggacaaagtcaggaacgcagggtccagacaggtcattttccatgattttgcagtgagcctttaaaagagggaaggattctaatgaattgcaaagggagataagctgagtggcctgagcaatggtgaggatgccaggaaggagggaaggtgaccgaccacccttcatgctggatagaggatccccataggaagagagcaggacaagctgggcccagaaggtcaaggcaggctgaggggctcatcttcgatgcagagtcagtagaacctgcccaggcttgggtatgaaagcgccagaactttgctcaccaaagatcaatctggggacagtatgaaggttagacttggtggggtagagctgactggggaaagggtcttagttaagacaatagggaaggcagccagtgtggaggatggggattggagaagtctggataaaagaaaagggcatttcagatggaactaacgagacatggcaactgactggaagggcaggaggcaagagtgatgctgaggtgtctggtttgcgacaccaaagggaccatgaaactaattaggaacaacaggccaggtgcggtggctcacgcctgtaatcccagcactttgggaggccgaggtgggcgtatcacaaggtcaggagattgagaccatcctggctaacacggtggaaccccgtctctactaaaaatacaaaaaaattagctgggcgtggtggcgggcgcctgtagtcccagctactggggaggctgaggcacgagaatggcgtgaacccaggaggcggagcttgcagtgagccgagattgtgccactgcactccagcctgggtgacagagcaagactctgtctcaaaaaaaaaaaaaaaaagaaaagaaaagaaactaggaacaacaaagaagtcaggaggaggacgtactggggaaatgctggtttcaaggtgcaggcaggatggtgtcaaggagtgcctgacagctaaaaaaatgtggatttgaaagtctccaggatgtgcccgggaacggtggctcacccctgtaatctcaacactttgggaggccgatcagacagatcacttgaggctaggagatcgagaccagcctggccaagatggcaaaccccatctactaaaacacaaaaattagccaggcatggtggtgcttgcctgtaattccagctactcaggaggctaaggcatgagaatcgcttgaacctgggaggcggagattgtggtgagctgtgatcatgccaatgcacttcagcctgggcgacagaatgacagagtgagactctgtctcaaaaaaaaaaaaaaaaaaaaaaaagtctccaggatctataggaagatccctaagatcttcaagatagcttctcaagttgaagaagcaaggtacagaactgtattttagtatgctacaatttggttaaaaaaatggggaggtcaaggagaatatatagtctgatttctctgcataagtatttatataaaaatatccagacatgtacccactcccgaaaaactaataatagcaatttattcattggcacgtctggcaggtggggcataggaatagtagagcatgttctcatgacagctccttcttttttcttttagtaaaatatacataatataaaatgtaccatcacaaccatttttaggtgtgcaggtctagtattaaatgcattcataatgttgtgtaaccattaccaccaccatccatcctctgaattcttttcttcttgcaaaactgaaacccccacccatgaaaccatagctcctcattccccctaccctccagcccctgatgaccaccattctactttctctcggattttgactactccaagtatctcatgcaagtagaatcatgtcctttttgtgtctggcttatttcatgcataaagtccctcaaggttcatccatgttgtagcatatgccagcatttccttccttttttagactaataaggaggaacttacttctgtcattttcctatttgtttccacatgccttaaggcttttggttcctcattttctgcattgctgtattcttttgtgtgtagttgatctttttgtagtgaaatatttaaattcctttctcatttcctttttgtgtatattttatatctattttctttgtagttaccatggggattacatttaatatactaaagttatacactctaatttggatttataccagcttaactgcaataacatacaaaaatactactcctttacatttccattcccactcctttcaattgttgatgtcacaaaattacctctttatacattacatggcccaaaccacaaactagtaatttttgaaaacgcattaatgtcttaaattatgtagaaaacaaaatgtagagttacaaaccaatgttacaataatattagcttttatgattgcccacataattgcacctttattgtgatctttattgcttcatatggcttcaagttactgtctagtgtccgtaaatttcagcctgaaggactctccttagcctctgttgcagggcaagtctagtcataacaaactccctcagatttttgtttatctaaaaatgtcttaatttctccctcacctttgaaggacagttttgctggatattccattcttgattgacaggtatttttttcttttatcattttgaacatatcagcccactgccttctggcatccaaagtttctggtgagaaacatgctgacaatcttactgacaatctcatatgtgatgagacacctctctcttacggctacaaagattctctttgtctttgtcttttgaaagctgataatgtgtcttgctgtgggtctctttgagttcatcttacctggatattgtcaatctccttgaatgtttaatatttttcatcaaatttaggaagtgttcaaccattctttcttcaaatattccctctgctccctcccctatcttctcttcctctgggactcccacaataggtcaattggtccacttgatggacacgattccttaggttttgttcacgttccttcaatcttttttctttcatttccccagtcttggtaatttcctttgtcctatcttcaagtttactgattgttccttctgcctgtttgaacccttctagtgagtttttcatttccattattatactttttggctttagaatttctcttatgtttcattttaggttttctatctctttactgatataaacttacttcaaaattattttcttgactttctcaatgtctttctttattctttgtgtattcgatctgctatcaggtctttttcaggaacagcttatttttttttcctttgaatgggccattctttcttgtttcttttatgctttgtgattttttttttgctgaaaactggatatgttaatgtaataagtggtatctctggaaatcagattctcccctctcccaaggatttattttttgttattatttttgtcattttttatttgttttcatttacttgtattgttttagtttttgtttactgttttggttgttgcccaggctggagtgcagtggtgtgatcacagctcactgtaaactcaaactcctggcctcaagccatcctcccaaagtgctaggagctaggactataggtgtgagccaccctgcctagccttaaatatcttttcataattttttttttttgagacgcagtctcgcactgtcacccaggctggagtgcaatggcgcaatctcggctcactgcaagccccacctcctgggttcgcactattatcctgcctcagcctcccgagtagctgggaccacaggtgcctgctaccaccgcagctaatttttttgtatttttagtagagatggggtttcactgtgttagccaggatggtctccatctcctgaccttgtgatccacccgcctcggcctcccaaagtgctgggattacaggcatgagctattgcacccagcctcctttcataatttttgatagtcgaaccatatcatttattacctgtttaaaaaataaataaaatgtaaagactaaacaatgaattcagttgtttgtatccagccagatgaactcatcaaggttcagaggaaggaaacactgcaatcatcagtgaccagaacacagatccctgatatttcgaggacaggatgtttttatttaacctagttcttggaaactgtgtgcaagctactcctggaatgcatacacagcttcctgaaacactagtacagggttgtgggtggggaatggggagctgtctttaccacccaagcctgaatatcttgtctctatgccaatgatcaatctgactaaactgaatgtcttctcaggtcttttctgtgcctgtacatttccctgggcctgtgtagtcactttctagcgttccttgtagaggcaattgcttttgaatgtcccactccttaatgtctggctccccacagggggaaaataaaagtggagaagttggggaaggcgagatggaggaacaggatactggaccttaaaatcccctgaaagcaacttcaaccagaggggaaggggcttgcaatagggggccaggtgcaccaccaatggcttccagcctctttgtctgcacctctgtagtcagaaccactgatcagtggtcagaacacacgtccctgatatttggagaacaggatgtttttatttaaccgagtctcgcaaattgtgtgcaagctactcctggaatgcatacacagcttcctggaacacaagtacagtgttgtaggtggggaatggggagctgcctttaccccacccccaaagcttctcctggaagtttcaggtctccatggactccagaattcccattacatcagcatggcaaaaactgcaattacttttgcaccaacctagtatctatttttttttttttcttttttgagatagggccttgttctgtcacccaggctggagtgcagtggtgtgatcacagctcactgtaactttgaactcctgacctcaagccaccctcccacctcagtctcccagagtgctagtgtcagaggtgtttgaaccagagcaactccatcttgaataggagctgggtaaaataaggctgaaaccctctgtgctgcatttccagatggtgaggcattctaagtcacaggatgaaataggaggtcggcacaagatacaggtcataaagaccttgctgataaaacagattgcagtaaagaaaccagccaaagcccaccaaaaccaagatggcaacgagagtgacctctggtcctcctcactgctacactcccaccagtgccatgacagtttacaaatgtcatggcaacatcaagaagttaccctatagggtctaaaaaggggaggcataaataatccacccctggtttagcgtatcatcaagaaataaccataaaaatgggcaaccagcagccctcatggctgctctgcctatggagtagccgttcttttattcctttactttcctaataaacttgctttcactttactctatggactcaccccacaatctttcttaagtgagatccaagaaccatctcttggggtctggatcaggacccctttcctgtaacactatgagctagaactacaggtgtgagccaccctgcctaaccttaaatatcttttcacaattttggatatttgaaccatatgactttttacctgttcaaaaagtaaataaaatttaaaaattaaacagtgaattcagttgttcgtatctagccagatgaactcatcaagagcaaaggaaggaaaggaccaaggcagggaagagaagaggactcagcaaagggcttgaggagcagctatgtaggtggcgtgttggatgagctagactccacaggatgcaagcagaaacactttgctctttctcacaactccctgttcgagcttccctgtctcatatctttccctggagagagtactgggctggtcccattgctttgttataaactcttaaggaatcaaaagtcatccagtaacttttagataataaaagattccgtgcaggctactaatcacattacagacttccttcctttgaaagaaaacaccttccttcttttgacttgggtttgacccagtctagtaaacctagagtggggaagaggaatagatcagggtctcccccaccaccaccaccactcttattgagtccacctccttccccactgtgcagctgtggtttctagccacaccatagttggacaggcttagaaggaggagtaagggaaaagggggcccaggcctctcacccttttggctactgaaaatgtcctccccaaacctctgggcttctgaaggtctctccctcctctggggcaacattagcactctaggaggtcctgaagacccccccaagcaggctcctccattgccccatgtgtcattgagatggcagctcttccaaagccagccctctcctgctctgcttggttactaaactcaacagcagctccagctccagcccaggcctttaaactttttgcaggtggctgaaacataagctgcctttatgctttatactgcagcaatcacaagtcaatctctacaaatggctcttaggaaacacctttagctcaaattgaatgagaaaacaccccttccccaccctgagaaggttaggaaaaaattcaactatttcccaaggaaattcttttgcctaatcctttaatgtcaacctcttaaaaagtgttatgaggctgggcatgggtggttcatgcttgtaatctcatcactttcagaggctgaggcaggaggatcccttgagcccaggagtttgagacctgcctgggcaacatagtgagagctcatccttacaaaaattacaataaaaaaaaaaaaatagccagctgtgatggtgtgtgcttttagtcccagctactcagaaggctgagacaggaagatcgcttgatcctgggaagttgtggctgtagtgggctatgatcatgccactgcaccccagtatgggcaacagagaaagaccctgtctcaaaaaataaattaattaaatacagttgaattaaatttaaaaagtgttatggactgaattgggtcccatcaaagttgataggttaattcccaatatggttgtatttggagacaaggcctttaaggaagaaattaaggttaaattgtctcataactatggagccctaatccatatgcacacatgcgcagagaaaatgtccaagtgagggcactgataaaacgtggccatgtgcaaaccaaggagagaggcctcagtagaaaccaacccaaccagcatcttgaggttgggcttccagccttcagaactgcaaaaagtggtcatgtgcaagacaggaagagaggcttcagtagaaaccaaccaaaccagcatcttgaggttgggctttcagccttcagaactacaaaaaaataaacaaatttctgctgatgaagccaccaggtctgtggtatcttggtgtagcagcccaagcacactgagccatagagaagaacaatgggatagtggcagcagagctgatgccatcttagcttgagggtggtctagcatgtacttctaggaggaaaacttggcatctactgtattattcttcagctttatggcctaaaattgaggcaaaagagtgcccttttgatatcctgttgcactctacataagaggcaggagacaaaggacaatgggaacaaaatagtctgagaagagaaccaagagagaggcatgtgcctgagagatcaagggacacctccaatcaagggcaggtggttagtctctagtaatgttcaatgccacagagggccaagtaggatgaagactgagaaagggacactgtggggctgataactggagtgaggggatgggggtgtgatatattttggctgtgtccctgtccccgcccaaattttttttattttttttatttttgagacagcatctggctctgttgcccaggctagagtgcagtggtacgatttcggctcactgcaccctctgcctcctgggttcaagcaattctcctgcctcagcctcccaagtagctgggataacaggtgcacaccaccatactcagctaatttttgtatttttagtagagacagcgtttcatcatgttggccaagctggtctcaaactcctgacctcaggtgatctgcccacctcagcctcccaaagtgctgggattacaggtgtgagccaccacacctggcgcaaatctcatcttgaattgtagctcccgtaattcccacgtgtcatgggagggacccagtgggaggtaattggatcatgggggtgggtctttctcgtgctgttctcaaaacagtgaataagtctcatgagatctgatgatccgataaaggggagttcccctgcacatggcctctccttctttgcctgccaccatgtaagacgtggctttgctcctccttgccttctgccgtgattgtgaggcctccccagccatgtggaactatgagtccattaaagctatttcctttataaattacctagtctctcgggtatgtctttattagcagcatgagaacaaactaatacagagtagcaaggtggcaaaaaccatgttcttgtcctgacagcagcaccagaatttttataaaagggacttagcagtagcaacttggtttgaaggggactgaaggctttcagatgggttatgcattggagaaattaaggttaaattgtccagtgtaacccacctaacccacgttaggtgggtgggccatgtgttggaggaacccccaagacccattaccatgttcaatagtttggtacaagtcctcccaagactgagcatacagttgtatgtgtagctatgatttaccatggagaaagaatacaacacacaatcttctgaaggatccagagtgtggggcaaaatctagaggaaaccaggctcaagatttcagaatcctctcccagtggcatccacaggacatgcttcactcccctaacaacgagtagcggcaatagatgtgaaatgctgctcaccaggaaagttcatttgagaatgaatgtccaaggttttcattgggagctggtcatgcaggcactctctgcctggcatgtactcaaattcaagactctcaaacaggggcaggagcagtggatcacacgtacgtataaccccagcactttgggaggctgaggctgcaggattgcttgaggccaacagattgaggctgcagtgaactctgattgtgtcactgcactccagcctgggcaccagagtgagactttaccacttaaaaataaataaataagactcccaaaaggaaaaagggtgcttagcataaaccatattgtttgaacaaacagtttggccttgatgaaccactcttaaaagttttaggaatggtgggacccctccaaaactccaattctccagaaaccagctaagggccaaccttgcaaatgtgccatcctaaggatatcttgctaggccaacacttctgcacacacccccactctcactctcagttcctgagtcattcagccaaggccacaaaaatttatagaaataaacatttcgacctagagcaggaatagatgcatggcttctcgtggttcagaggccctaatatagatcttgcagctgctggtgacacaaggtagggtccttccagatctgggatgtttaactctgtgcagtgcaagggtgctgctgttattctgaaagaactagcacagtctcgtcattctcttgcttctgttcatggaattttacattcagcaggctctcctagttcctgaactaccttatcctcacacagctggtcaaagtaaaacaaaggtctggacaacccagagaggttcattgccttcagcagtccagaacccccaggaagcccatttcccaggggagcagaacaacaagcacaaagtttgtatatgtattacataatgcagaacaataaaaatagaaaaaaatgcttttatgcacactttacattagaatgaaaaatatcagttaaccatagcagagtaagaaaatcaagccaggcatggtggctcatgcctataatcccaataagttgtgaggctgagctgggaagattgcttgaggccaggagtttgaaaccagcttggacaacatagccagacctcatctttacaaaaaataaaaaaaacttggccaggcatgatgtcactatgctttggtcccagccactctggaggtcgaggcagaaggatcgcttgagcccaggagtttcaggctgcagttgtccggtctagacaacagagtgagaccctgtctctcaaataaaaaagaggtaaaggggttgtattagttcgttttcatgctgctgataaagacacacatgagactgggcaatttacaaaagaaagaagtttaattggacttacagttccacatggctggggaggcctcacaatcatggcggaaggcaaaggaggagcaagttacatggatgttggcaggcaaaggagagggcttgtgtagaggaacacctctttttaaaaccatcagatcttgtgagacttcttcactattacaagaacagcataggaaagtccccccacccccaccatgattcaattacctcccaccgggtccctcccacaacacgcgggaattcaagatgagatttgggtggggacacaaccaaaccacatcaggttgaatatgagagttggggtaggctgattgcacttcctagtgctgctattgccccctctctcccctctcctccaaatagcagaacaggaggagcaaatcagattgggttggctctcaggatgtgctcaaagtttgtgctcagagctgaagcccatttctggtcatgtttctcatctatgtggtaggttcatccagagccggcctcctcatagtaggccaagccacctcacccctgtcttcttttctgcatggggagatgggggatgagcaaggcagatacaaagggggactttatttcccattccaacttctcctatacacacacctctctcagggatccatatggaagagaaattatccaggcaagagagaaacaggcctctcaattgcatcaaacctccccttctatctactccgacggttgcagggtattttttaaccttcagagaataatttccgcttaaaacttttttttttttttttttttttttttttttgaggcagagtgttgctctgtcacccaggctagaatgcagtgatacaatcacagctcattgcaggctcgaactcctgggttcaagtgaacctcctgcttcaggttcctgagtagccaggactacaggggtgcgccaccatgcctggctaattttttatttatttagttattcgaagagatggggtctcactatgttccccaggccgatctccacctcctggcctcaagcaatcctcccacctcagcctcccaaagcaatgggattagaggcgtgagccactgcacccagctacagcctaaaacttctgatctgaaatatgttaggcattttgagaatatggatgcaatgactgcagaataatcttgacttcaggattaagaggcaaggagataccaatttctgatgtgtttttgctcaacttctcacggaagtctccatgcaactagaaaaagacacaaagtcacagcggtcctagaagctgaagatagtcatccatttgaatgaatctggggaaacgtacactcaccatggctccagtgaagcggatggagaaataaagctggtggtctctgcaggcactactagaaagcacctgccaggaaagggtaggaagagtcgtgaacagcatgtgctgcctgctccaagctgggagacccaggtctgcaaaatccaggcacccagacaaccagctcctgactatgtgtgcttggattactaggaagtctggcatcttgtcccccttcccttttatccatttcctctcccttcctggtgcctctgttttgatcttgaattgcaggaacaaccccagcatattacatgggaagaagtttcagcacctgcaagtaatgcaatgagtgagagccacaggcagctccctccacaggctctcctgttttcttccttttctttttttggagacagggtctctttctgttgcccaggctggagtgcagtgacacaatcacagctgactgcagcttccaattccaaggctaaggcaattctcctgcctcagcctcctaagtagctgggactacaggcacacaacaccatgcctgattcattttttaattttttcgtagagagaccaggtgtggtggctcacacctgtaatcccaacactttgggaggcagaggtgggtggatcacctgaggtcaggagtttgataccagcctggccaacatggtgaaaccctgtctctactaaaaatacaaaaattagctgggtgtggtggcagttgcctgtaatcctgctactcgggaggctaaggcagaagaatcactcgaacctgggaggcagaggttgcagtgagctgagatcgtgccattgcactccagcctgggcaacagcgagactccctctcaaaaaaaaaaaaaaaaaaaaggattcagaactaaggccaggtgcaggagctcacccctataatcccagcactttgggaggctgaggcaggagaattgcttgagcccaggagtttgagaccagcctgggcaacccagcaaaaccctgtctctataagaaatacaaaaataagctgggcatgggggtacatgccgacagtcacaggtactcagaaagctgaggtggaagcctcaggctccagtttccttctttttttggagacaaggtctctttttcttgcccaggccggagtgcagtggcacaatcatagctcactgcagctgcagcttccaattccgaggctaaggcaattctcctgcctcaacctcctgagtagctgagactacaggcacacaccaccatgcctaattcattttttaatttttttgtagagaggctgggtgtggtggctcatgcctgtaatcccaacactttgggaggcagaggcaggtggatcacctgaggtcaggagtttgagaccagcatggccaacatggtgaaaccccgtctctactaaaaatacaaaaattagctgggtgttggcaggtgcctgtaatctcagctactcaggaggctgaggcagaagtatcacttgaacccaggaggcagaggttgcagtgagccgagatcacgccattgtactccagcctgggcaacagagcgagactccctcttaaaaaaaaaaaaaaaaaaaaaaaaaaaaaggattgaaaactaaggccaggtgcggtagctcacacctataatcccagcactctgggaggctgagaattgcatgagcccaggagtctgagaccagtctgggcaacctagcaaaatcctatctctacaagaaatacaaaaatctagcaaaaccctgtctctacaagaaatataaacattagctgggcacggtggcacgtgcctatagtcacaggtactcagaaagctgaggtggcaaaatcacctgagcccagggaagtcaaggctgcagtgagccaagattgtgctgctacactctagcctggacaacagagtgaaactgtctcaaaaaaataaataaataaaaatgaaaactagtggggaaacgtaaggtttaatccagcagagaagggaagcactgccctttaatgtacaaaaacaaaattaactcctccaaattattcactatcagagacagaagaaaggttaagaaacacctgctttgtgttagatatggccaatgaaagccttccacaaagaagatttgtccacaaatagacatacgaagatgaaaagacaagaggctgaaacaggaacggaaggaggctgagagtcgtggctacctgtaatttcagcactttgggagatcgaggtgagaggctgggagtttgagaccagcctggacaacatagcaagaccccatctctacaaaacaaataaaaaattagctgggtgtggtggtgagtgcctgtagtcccagctacttgggaggctgaggcaagaggattgcttgagcccaggacttagagactgcactgagctatgatcacaccactgcaccgcagtcagagtaacggagcaaaaccttgtctcaataagataaaatagaaaagaaaatgagcctggcttcagtgaggagaacaaacaagaacaatgacaatgcaccagcaaagtcaaagcctacctgggacgcgctggcagggaactgcaacttctaactcatgtcaataaatatttacccaaacccatgacgtggcagccatcgtgctcggccttggggatactgcagtgaacagggggcatgtgggcactgccctctaggaaattaagagtgcagctgcaaacagagacaaccaaggactcacaagggtgtgtgtgttaaaaacgggaaagtgctgcagaaggaaaatgcagggaaattggatattgtctgggacagtggtctccatgatgtgagcaaagtaagagatgctcataagcatctaacacagtgtgggcacagatttcagaggcttcattcattcatattgcttcttcttcttcttcttttttttttttttttgagacagagtcttgctcagtcacccaggctggagtgcagtggcatgatcttggctcactgcaacctccgcctcccaggttcaagcgattcccctgcctcaacctcccaagtagctgggagtacaggtgtatgccatcgcacccggctaatttttgtattttagtagagaccaggtttcaccctgttggccaggcaggacttgaactcttgagctcaagtgatccacccgcctcggcctccaaaaatgctgggattacaggcgtgagccaccacacccagcccatatctcttcttaatcatccttttcaatttgttttttgggtatgcattataagggccgccatgtgtgagtagagcagcacctgcatgtgacatgataaagaaataacagggaaggggtaggacacaggacctgggaagggcagaaagagaagccattgtgtaatggaaaagttgaaatctgcatgatatgaactttttacttatacacttagacttcatatactcctctgttatgttacttaaaatagcatattagtatattaattttatagaggtaaatataagtgctttctgaaaaatataatttccttccttttcctccctcccttccctccttccttgtctgcctccccttcttcctcccttctttcctttttccctcttctttccttcctttcttctctgcctccttccttcctttcctccctgcctttttccctcccttcctccttccttttttccttccttccttctctttctttcgacagggtctcactgtgttgcccaggctggagtgcagtgccgtgccatgattatagctctctgcagccacctcaacattttcggcccaagcaatcctcccacttcagcctcccaagtagctagaactacaggtgcacaccaccatgcccagctacttttatttttttgtagatacagggtcttgctatgttactcaggctgctctagaacttccaggttcaagcaatcctcccaccttggcctcctaaagtgctgggattatcggtgtgagccaccgcacccagccagaaaatatgatatcatattacctggtgggtggggggagaacaattccagaagcataataaatagcaacagccacagcacagataatcacatcaataacctacagccccaacctagtctagacagggaaaataaaaaagaggtaaaatgatgagagaaagataatacatgaaacacagaaattggagacttgaactttacaagagagaaagacaaaaggatccgagaatactagaaggtatagtaatgagacattttttttggagctaagaaagggaagactttcatgtgctatcaatcactagcagatcaaataagcaaatattaataacatcactcactgtgatgaactatagggcaggcacattgttaagctattttacttatgatagcaataaggtaggatttatttatttagagatgaaatttcactcttgttgcccagtctggagtgcagtggcaccatcttggctcactgcaacccctgcctcccaggttcaagcgattctcctgcctcagcctcctgagtagctgggattacaggcatgcgccaccacgcccggctattttttgtgtttttagtagggatggggtttcaccacgctggtcaggctggtctcgaactcctgacctcaggtgatccacctgcctcggtctgccaaagtgctgggattacaggtgtgagcacccgggccaagtctatttcttttttttttttttgagatgcagtctcactctgtcacccaggatagagtgcagtggtgcaatctcggctcactgcaacctctgcctcccaagttcgagtgattctcctgcctcaggctcgtgagtagctgggactaggggctcacactaccactcctggctatacttttttttttttgtatgtttagtggagacggggtttcaccatgttggtcaggctggtcttgaactcctgaccacaaatgatcctcctgcctcggcctcccaaagtgctggggtttcaggcgtgaggcccctcgcccggccgaaggtaggtattaattgatgtccctgttttaataaggcataagggaggttcagatattaggtgacctctgtaagattatgccactaattgtaataaaattcagttttgaaccctgatttaccttcactctaaaacattctttccattatgccatgttgtctttcaagatgaaaatttcagtagtacaattgcaattactagattattaaccatacacacagaaaataacagataatatacagaatgctgtaggaaaaaaaggctgtacctcttaaaacattcatgaaacatttataaaaacaggattatatggtagatcgcaaaaaatcaactaatttttcaaagctgaaataagcagacctcattctcctactcaaacccaaagaaactaggatttaatattaatagtaaacattgaagcagagccctagatcactccgaaatggaaaacactctcctgatcaatgaagaatacaaatgcaagatagtatcttttaaagaaaatgacagtgagaaaattacataactcaaatatgtaagtattaatcaaacttgttttcagatgtaattcataacattaaaataatttcattattttgggctgggtttggtggctcacgcctgtaatcccagcactttgggaggccaaggtgggaagttcatttgaggtcaggagtttgagaccagccgggctaacatggtgaaacctcatttctactacaaaagtacaaaaattagccaagcatggtataatcccagctacttgggaggctgagacaggagaatcgcatgaacccaggaggtggaggttgcagcgagccacggttgtgccactactgcattccagcctgggtgacagagcaagactccaccacaataaataaataaataaataaataaataaataaataaataaataaatattttgttatttggaaaggaaaaaataaaacatttttaaaactttagaaaagttagacttaaaggtaataggggtaatgatataattagggtgatggtagaattagttaattgggaaattcacaaatagatatgatatgcattgtatcaaaaagagagttatttgagaaaactataaaatatatgaatgattgacaaatcgaatccagaaagaagaaaatataattacaactgagaaaagctatgcagccacaaatacagaagagataaaaattatgaaatactgtactttgtataaccaaaagctaatctatttcaaattttttgtgaaactattgactttattaaaaaagattattacagatttaagaaaatgcagaaaatcaacaaaatcagatttctaaaactgataacctatttttaaaaaatacctgaaaagcttctcaaattaggaaaaattatatctgagttttttcctgttgttgagaaatagacactcctcatgttatattaactgttccaggatgaagaaaaagtggaaaagctaatataactctcatacaaaaatacacaaaagaaaaccaaccaacacatctcacatgcaaaaacgctaaagctggaactggaaaatctaatttaaaatatgctccaaacatagctgaccacagccaagtacagatcattccagaacttgagtacaatttaatactagaaaaatcaatccatgtatgaaatcaaatcaatagacacaataaaaagtgtggtggtctctatggaagctgcaaacagtgctggggaaaatactagattccttcaggactttttagaacaaggacaagaataatcctttctcgacaaagtaagagtgatctatctcaaggcagaagcatattctcctacaccagaggaatttccattaacataagcaatgccccaaggatgcttgttatcatttttattcaatgttgttttctgtgttctggccaatattatgacttgagatacaagtgagaaagatgactaaaggaattcatgagacaagatgatcactattcaggagatggtatgattgtctatctagaaaaaaagaaatgactccatcgtaattctgggaatttactaacagtggctgggtcctggacaaacatttaaaaaatcaatcgtttccttgtgtggcagcaataaccatttagaaaatggagtaaatgcggagttaaggggctgtgaatatataacagcaagaactcctgatctgccgtcccgacaagtcgcctccggagtggacaccggccagggaaggcaggtctctggagggaaggtagagagaagatacggaggatctgccccttccccaggaagctccccgagaaagggccacaactgtttactccagcaggctctggggggattcaggcttgggggtgatggtcttgacctcactgactactgaccacccgaagaaaatctgctctatagcccgtgtctcctgctcctgggtgggatgtaccctaaagagagggggcttcctccttgacctcaggaaggaggcacacttgtttctggtcaggtgaacatgaaaaccaccgggcttcccctaacctgttggtgtgcctttgccctgacttggcagagaaggcggatggaaatctacagccaggcagagaaatgacaactcacttcagtctcagaaatgacaactcaccccgtctcagtgaccagagacagggtgactcaatgagcctttgaagcacttggttcccactgactacaactaaagaaagaagacttaggtaagaacttagagggtggccaggtgtggtggctcacgcctgtaatgccagcactttgggaggccaaggccaggtgtggtggctcacgcctgtaatcccagcactttgagaggccaaggccaggtgcggtggctcacgcctgtaatccaagcactttgggaggccaaggagggaggatcacctgaggacaggagttcaagaccagcctggccaatatggtgaaacccagtctctactaaaaatacaaaaattggccagacgtggtgacgggagcctgtaatcccagctactcgggaggctgaagcaggagaatcgcttgagcccaggaggtggagtttgcagtgagccatgatctcaccactgcactccagcctgggtgacagagcgagactctgtctcaaaaaacaaacaaacaaaggaatatgtgctcccaaagagtggaatcagagtacaccaaagactcccagaaagtaaaaagcatgattttcaaatatgcagattcatagacactctgaaattaccggctggtaggtgataggaactgagacagtagcctggaaccactgcacagaacaacaactcagagcacatacccagtaatgggagtgctgggttgaatggcagttctgtttttagctctttgaggaatcgccacactgcctttcgcaagggctgaactgatttacactcccaccaacatatatgagtgttccctttactccccaaccttaccagcatgtgtcattttttttttaagatctatgtagcaactttggttttctttcgcaatctttatcaaagtttatctattttttttattttatttttccataagttactggggtacaggtggtatttgattacgagtaagctttttagagatttgtgagaacatggtgtacccatcacccagcagtatacactgcaccatatttgttgtcttttatccctcacccccctcccacccttccccccaggtccccaaagtccatcgtatcattcttatgccatcgcgtcctcatagcttagctcttacgtatcggtgagaacatacgatgcttagtcttccattcctgagttacttcacttagaataatagtctctaatctcatccaggtcattgcaaatgctgttaattcattcctttttttggctgagtagtattccatcgtatatatagatatataccacaatttctttatccactcattgattgatgggcatttgggttggtgccatgattttgctattgcgaattgtgctgctataaacacgcatgtgcaagtaccttttttgtataatgacttcttttcctctgggtagatacccagcagtgggattgctggattgaatggtagttctacatttagttctttaaggaatctccacactgttttccgtagcggctgtactagtttacattcccaccagcagtgtagttatttttgactttttcatagtagccattcttactggtgtaagatgatatctcattgtggttttgatttacatttttctaatggtcagtgatactgagctttttctgtatgcttgttggctgcatatatgtacatatatatatatatacgtgtatatatacacgtatatatatatatacatatatatacatatatatacatatatacatacatatatatatacatatatacatatatatacatatatatacatatatacatacatatatatatacatatatatatatatataatggaatactatgcagccatgaaaaagaatgagatcatgtcttttgcaggaacatgaatggagctggaagctgttatccttagcaaactaatgcaggaatagaaaaccaaatactgcatgttcttacttagaagtgggagctaaatgatgagaacacatggatgcgaagaggggaacaacagatactggggcctacttgaaggtgaaggagggacagtaccccaaataattattgggtactaggcttagtacatgggtgacaaaataatccgtatgacaaacccctgtgataggagtttccctattataacaaacctgcacatgtgctctggaaactaaaataaaaacaaaacaaaacaaaacaaaacacacagagctagagactgggaggtaaaagctgagagacctggagactaagatccctgaggtctaacctgatgaggacaggaattccaaagaaagaacaaaagaacggatggaagagaaatgctgttcatgatcgctgacatccacagagcattttttatctgccaggcatcatagtacatgagttaactcatttaatcctcacaccacactaacgaggtagatattattactatttcatgtcctaaatcaggaagtggaaatcagaagagcttatgctcaatttgcatgggccagacctggggctgggtggggcagggtgaggcgggggttctgaatttggcagtctaactccagagtccatcattttaaccaagctggtaaagattaacagaggctgattaaacaaataatagaaaaagtaaccccaatgcaaataaagacataaatagcaaagaaattaaaacttagaaaagttaaacataaatatggtaataggggtaatgatagaattaggggaaaggcagaattagttaactgggaaatacacaaatagatatggtaatcatcgttgcaaaaaaaagaggattctttgagaaaactataaaacatatgaataattaacaaatctaacccagaaagattcaaataaaattgcaacagacaaaaactatgtagcaacaaatacagaggagataaaaattatgaaatactgtactttatatagctgaaagcaaatacattttaaaacttttgtgaaatgagtaattttattgaaaaattactagtttatgacatttagcaccaagctgagtggctcacatctgtaatgctaacgctctggggggctgaggagtgaggattgcttgaggctagaagtttgaaaccagcctaggcaacatagcaagacctcatttccacaaataacaaaaaaataaaaaaaattagccagtcttggtggcacacacccatagtcccaactactcaggaggctgaggcaggaggattgcttgagctcagcagctgaggctgcagtgagctatgatcgcaccactgtaatccagctggggcaacagagcaagatcctgtctcaattaaaaaataaaagacatttaggacccatatgaagaaacctatacaactttagtgatatatttttaaagcctttaaaagaaaacataaaagaataccatgcttcctggtagaaggattactctaacaattttatacttcttaaatgaatggatatgtttaatgcaatttcaggataaatccctatggaatttttttggaaatgtcccagtgaattggtcatttggaagaatgagcaggaaagaaaacctctaaaaggaattaaggacagtaatgctatatctagtaataaaatctattataaaaccacaataaaaaagtactgatgaaggttaagtaggagataaacaaaacagggcaattcagaaataagccctagtaaataaagataataaacataaaaaatcgaatggaaaaaaggaggcttagttaacaaatggtgctgaaaagacaggtaaagaacttgaaaggaaaaatcgattttattcctcacttggcattttactctagaacatgaattagaggataaaaaattagagaaatatataggtaaaatgaagaaaatcctatctaagcttaaaatcaataaaggaataacaaaaaaatagagattcacagacttgctaacatactctgcatgttaaaaacatcagggactaaattaaatatttagcaataatctaggaaaactctatgcaatgaatatggcaaaagaatagcattcttcaaatacgaagaaattcattaaaagatgaatactaaaagataaaaacagataatccacaaaagacaaacacaaatattaaacatgtagaaaatgttcaacttcaataatatgaaaataaatgcaaattaaagcaatagtgagctagcattttccacatccccagtatgcaatgttatttcatttttgttgttgttgttgttttgtttgttttaaaaacaaggtctcactctgttgcttaggccggagtgcagcggcatgatcatagatcattacagcctccaatttctggcctcaagtgcccctcctgcctcagcctccccagtagctaggattacaagcacatgccaccaagcccacctgttttttaaaaaaaaaaagtttgtagagatggggtctcaccatgttgcccagactagtcttgaacgcccggcctgaagtaatcctcccagtttggcctcccaaaatgctggaattacaagcttgagccatgaagcctggccagattttaagtgaaaagacagagtacacagtttgctgagtcttctcactaatactgatggtaacagacatgagcatagactttctggatactaatttggcaatggcatttagataaaaagttcctttttaaatgttctttttttttttttttttttttgattcagtaattccttttctggaatctgtcccaatgaagtgttcagaaatttggtcatagatttctgcatcatgctgtttatcataacattatttgtaacagtgagaaatggaaaagaataaggaatataaataggaaatgaaaaatcaacccatcgcccagaagtaacatacgtgtattttttcttcattttcttctaagcaaataaacaaaataattaaaattatgttttccagtcctttttacttgatattgtattgtgaagattacatgttattaaaactctttacaataatgagtgtagaagacttattgggaaaaaaaaacctcttcataataaaattagttgtatgacatcttacagaaagccatagatttctccattgatcccctattttggtgtggtcttatcgtttctgtattggcatgaaatatgtttgtaatggaacaggaagttgtttctctttttcaagtcttcaagcgtctacatgaaagcgttcttgaggggtaatggttctggcaagcgaatactgcagctgaatgctgataatttcctctgtggaacacgtagcacagttttctaagtcgtgcagaagttaaaatgtcacttggcaccagcccatattatccagaatgttatacaaccaccatccggatcatttcacgcaaaattagaattgtatagaaaattgctcttctggggccccaccactataccacatatattaaataatcacgccacgttaaacacctacacgtgctaccaagtcttatccagatgagaccctggatgatcgtaagtgcaattgtttcacctccagaaattaacttgcttgagtaaaaagtgggagtaaatatctcttagtggctgctgggggttgctacaagctgcaacaagctggaatctttttttttttttttttttttttttgagacggagtctcgcactgttgcccaggctggagtgcagtggcgccatctcggctcactgcaacctccacctcccgggttcaagagattctcctgcctcagcctcccaagtagctgggattacaggtgcccaccaccacactcagctatttttttgtatttttagtagagatggggtttcaccatgttggtcaggctgatctcaaactcctgacctcaggtgatctgcctgcctcggcctcccaaagtgctgggattacaggcacaagcgaccatgcctggtcaacaagctggaatctttagagaacacccaagagtgtctgtccacaccctgggcagagggccaagggggcaggactttggaagatggtaagctctgaactgaaatagtggagaagaataacttcacaaagctctctatgaaaaatacgcctttgccccatatagatcatagacactggggatgctgagttgcaatgcagtgcaaaaggacagtgacgtgcaaaagaagccatggtattctgcattaaaaaaacaaaagtcgaaaacgaagaacgctgtctggctttaaaacccagctgtcaacaggaggaagtgtaatcattttgacatgtttccgtttcgttgaagattcaaggttttaaacttggacttaaacctaaatgttatgcttcctggattgtgaacatccaatttcatttatatttttaaactaaaactttagaaatggattaagcagttgaaaacttctgggattcacaagagatgtacagaatatattccttttaaatcgtcagtttcagaaacctttatcaaggaaaattaacaaaccactcttaggaatgtcattccatctatggtcttcaaaatctgtctccatctttccaagatctagacctcctaaaagtaggtcagagggattactttttcctgccacttacctggtcttcattagcaatggtatgatagggatggtatattaaaggaatgctcaaatgacaacagtagggatgaagatttcttcaataacccatgtcaagaaaatatgggcagattgaagcaaaccctgacaatccctcatacttaggaactcccaaccctcattcttgccttggcaaaagttttctgaaaaaaaaagccagtaagtcaatacttcaggctaaatttaaaggaaactacttggaaattaccttgctctgaaatcttgttagaagcataatatttccaaaaagaaattgaactataataggtttcagagcttagctttcaaggttgcaaatgaccgtcaattgtgaactcagggtacccacagcaaaagactcatgacagctgatctccctatattttggtgaatccttacagcattcactcagtattttataatcccagtcctcctgtaatttcccataacttagttatagtgacctcatttatgatgaaacattcaattaaccacttaggttgaaaaaaaactgtgaaaaatttctgagaggttctgatgatgggtagaggaagcaacactctaccctgcttctttccactgctggcagctgtggaacatgcagagaacgcatggaacagctatttggggattctgagaagtaagttgtagtagcaggtgatttggagaagacctgaatttaaagtaccaccaaaccagcaaagagtttgctacagtttttcctcgagtacccccagctagatgcaatgctaaagaccccgggcagtgggcattggtgtgggtggtgagagctccaggaagcctctagttttggcttgaggggtaggaaaagggtctctaacattcagagagagtgggggaaatacttcctgtcttttcatttcaccatttcttcatgcctcaacccatggtaacctgcaggtgcttacatgctctgaaggagaacctttccttctgatcagtggaaccattgtctcgagtaggaacaaatgcctgatgcctttttctctttctcttctcttgtagcttggatcaggaagctgatacagccaaggaaagtatgcataagagtaggacaaataaagcctcagcttgctggacataggaatgaaaaatagagtcctaaataaatggtagtaccaaggaggtcttggagagtgaagaggttggcaaagctaccccgccattttgtgtatgaaatcctgggctcacctgtaagttgttcatgcctgtctaaccctaaacagtctgccctagactctgaaaactggaaaacatgtgagatggtttggatatttgtccccttcaaatctcatgttggaatgtgagccccaatgttgaacttggggcctgtgggagatgttggatcatggtgatagatccttcataaatggcttggtgctctccccaccgtgatgcatggtagtgagttcacgcaagatctggctgtttagaagagtctgggatctcccccgtctctcatgctttgtgacacaccagctctacttcccttctgccatgactgaaagcttcctgaggcctcaccagaagctgagcagatgtgggtgtcacgcttcttgtatagcctacagaactgtgagccaaataaacctgttttctttataaattactcagtttcaggtatttctccataccaaggcaaactcctccatagcaacaactaactcaatgggacaaaatactacacagctcccagaatggccaacgggtggagcacgagcagaacagatctgaatagtgttgcaaagccttggaaaactgaacagaccacaatccaaagaaagctggtcagaattttcagcctacacccaaccaactcaatctgcctgctcaaacaaaaatatcaacattctctggaggatttaaagaagagccgggatctcataacgtaatattcaaaatgtccagacgataatacaaaattaatcagcatatgaagaagcaggaaaatttgacctgtataagaaaacacaatcaccagacgctacagacacagttgttggaattatctgaaaaagatgttaatgaaaccattaacactgtgttcttatttatatcacttatttctttgttgagaggtttttatctttttctatctttccactcctctcatttgcaaatcctctcgagaggaatgggaaaatagaaagtctagacaaagaaataaatgatataaacaagactacaatgaaaatttcagaactaaaaaaaaaaaaacagtaacagcaaagaagctctatagaggggctcaatgtagaaatggaggtgatagaagagctagtgaatttgaagataggtcaataaaaaatgtgagtctttctcctcttcttctatgattaatgttcctactatcagaggcataaaaggagatgagaaaggctgcagagaagaaaaaatatttaaagaaataatagccaaaaactttctaaatttctcaatagaaataaaacggcctgggcgacagagcaagactctgtctcaaaaaaaaaaaaaaaaaaaaaagaaataaaccaacagattcaccaagcccctaaagccccaaatgggatgaacctaaaataatacatcctcaaacatatcacaatcaaattgctgaagaataaagacaaagaaaaacatcttacaatcagacagaaataaatgacgcattaccaacagaaagcaatgattccaatgactatagatttctcatcataaaacactgagaccagaaggaagtggaacaacattgttaaagagccaagagataaaaaactgtcaacccagaattctacatccagtggaaacatccttcaggaatgcagtcaaaatgaagacattttccaatgaagaaaagtaaagaaattcattgtcagcacacctgctctaaaaaaaattttaaaggatgttctccagaaagaaataaaatgataccagggctgggcacagtggctcacgcctgtgatcccagcactttggccaaggtgggtggatcacttgaggttaggagtttgagaccagtctggccaacatggtgaagcctcatctctactaaaaaatacgaaaattagctggatgtggtggtgtatgcctgtagtcccagctacttgggaggctgaggcaggagaatctcttgaaccagggaagtggaggttgcagtgagccaagatcatgccactgcactcaagcctggacgacagagtgagactctatctcaaaaaaaaaaaaaaaaaaagaaaaaaaataaataaataaaatgataccagaagggaacttagaacataagaaatgccaaatatatgggtaaatataagattattcttaccctgtttggttctttaaaaatgttctatggttgaaaacaaaaattataacattgtctcatgtggttttcaatgtaggttgatataacatctaaacctttaactagaatgacaaaggaaatggattgattcttcagataatacaaaactcaccaacgaagaaagacacatcctaaatagtcctattaaagaaattgcattcacagtttaaaactttccaaaaaagaaatcttgaggcccagatggcttccttggcaaattctaccaaaacatttaaagaatttttttctttatggataaataatgccaattttacacaatctcttccagaaaataaaagaggaaggaacacatctcagtttatttgataaggttaacattgtcctgataccaaaaccaaagacattacaagaaaaaacaaacaaaaaaacacctagagtctaatacctctcatgaacttagacacaaagacataaggttttctttggtgtcaaaacctgatcaaaaaaaaggatcaagctgttcttgagctgtatcttgaatgtgctgacctgtacatgtatatgaatttacacgtgttaaaattcacagaacggtacaccctcaaatgtcaattgtatgttaattcaaaatttaaattttaaatctaaaaatgttttagggccataactctcagattgcattaagaagccagtttcaacatctgcaaagccatacaataatctttcaaaatggtatgacatgcaatgccataagtctcttgggaaagttttcctctctcttaaaaggggacagccctggctttgcatattgtcctgtgaagatgcaatatatagcagccatcctgtatccacagggagaagccaagagaactgcagagttgctgagctagatagaggcctggcatcttgagtggctgcattcaccagccaagagctcatcttatctccagacttgccatgagagccaacaaaaccaaatcattccatgtactggcagctgaaaaaagcaaaacttggatagtataactgaatatctatttgaattactttatacaggttgagtatccctaatcctaaaatctgaaatcagaaatgctaaacaatctgaaacattttgagtgacaacctgacgtggaaaggaaatgctcattggggcatttcagattttggattttgggattgtggatgcccaatcagtaagtataatacaaatattctcaaatccacacccccacccccaaaataaaatccaaaatccaaacacttctggtcccaggaatttcagataaggaatactcaacctgcatagcttttatggatgaattggacatatgccttcttgtaatagcaaatttaaaaacttctttttctggccaggcacggtggctcatgcctgtaatcccagcactttgggaggccaaggcaggcagatcacctgaggttaggagttcgagaccagcctgtccaacatggtgaaaccccgtctctacgtctctactacaaatacaaaaattagctggtcatggtggtacactcctgtaatcccagctactcaggaggctgaggcaggagaatcacttgaacccaggaggcagaggttgcagtgagctgagatcgtgccactgcactccagcctgggtgacagagtgagactccatctcaaaaaaaaaaaaaataattaattaaaaataagtaaaaataaaaatgaaaactcgtttttctctatgaagattctatgaccccctcaaggtgcaagtgaactttctgaggagaaaattactcaaaatcaattaaggtaaggcaaaactaatcacttttggcaggtgctctttgtcagccagatggacaattctaaacagctctattagattgggtaactgatccagttaggtggggaagggttttgtagccagcaaatcctgacaagctatcctgatataaccccagtaaaaatcatatattttgcaacaactattattttaacatagacagggatggttgttaaatcctgacatagaatcttctaactcaaggtcatctctttcatgatccatgatgcaagactcctagccttccagatttctgattttggattttttgattagggatgcacaaccagtaagtataatacatatattccaaaatccatcccccctcaaaaatccataatacttctggtcccaggcatttcagataagggacactcaacttgcatagcttttatggatgtattggtgcttgctcaggcatttaagctgatcctaggctgatctttttaaaaaaaaaaaatctgagctctgttattatgtggctctaggaccacttctgtgcagaaacatagctgcagtgcacttgggcacaaacagacatcaggctatttgtaaaatatattaatattctgaaatagtgatatacatgtaaaatatatttatatgttaatatatgtaaaatatatttatatgttaatattaatatatgtaaaatatatttatgttaatatatgtaaaatatatttatattttaaaatattaatattaaaatattaatattttaatgacctttatcacctagacatttgaaatccaacaaaacatgggctacctttaaatcaacaatgcatcatggccagcaatctcaactattagttgtactgtttgttcatactacagcccaatctgttgactgctgcaagttttagtagccacataactctactttccatcaaactcttgccttcacagcagtggcctccccgcccccctgcccctgccccagctggtccttgttatagtcttgagagccaccccagaaacagactcattcttcttttgcatgacaacccttcaaataccaagtggcaacctaaactgcttaaagacaactaccatatcttcacctattcttctctataaagcaagcatccccaatcccatctcggattcattacagtatgtattctggagtcccattgagatcccggttcttgcctccaaatgtcctctgtgggatctcaaggtgaggaaagcaggaccgaaccccacgcttcatctgtgtggaagtcaggagttcaagaccagcctggccaatgtggtgaaaccccatctccactaaaaatacaaaaaattagccaggcgtggaggcgggtgcctgtaatcccagctactcaggaggctgaggcaggagaatcacttgaacctgggaggcagaggttgcagtgagccaagatcacaccattgcactccagcctgggcaacaagagcaaaactccatctcaaaaaaagaaaagaaaagaaaaaaagaaacagcaaggataggaggataattacttattttgatatgatgcaatacctctaacagtgcagcctccaagtaaaattcgcattattgatagtcccatcattctgtggatccacatccaagctcaagtctgtcacctgcacctgtgctggaaactggtcctgctcttgtcacacttttcttctcttgtttttgtatagttgattgtttggatgcaaatgcaggaccttacaattgtttctgctaaatctcatcgtgttggattcggcctaattgtctcagcctgtcaagacctttttggatcttaattccatcaggcactggcttcagggaagcactgctaaaacttttcaacacaataaagtgggggacagagccctggggcacgttactgggagtcttcctttgggcataattattcacccagtcctacttctacctaattgcagtagcatccagctcatatttttctatcttaaccacacacataccaaattcgtcaatgtaaacttgtcaaatgctttggtgaaatccagattcactctgtctaaggcactcattttcctttttttcagtactttttttttttgataaaagtgaatgtttccaggaaccaactgtccctttctgcttactgctttacaaccaaatgcaaccgtacctgcttcgatctgcctttgtagacagctactatatgtatgactcttttttaagagacagggtctctttctgtcaatcaggctggagtacagtggcgccatcacggctcactgcagccttgaactccttggctcaagtaatcctcctgcctcagcctctgagtagctgagactgcaggcatgcaccaccaggcccagctattttattttattttttttttttgagacagagtctcactctgttgcccaagctagaatacagtggcacgaccttggctcactgcaacttctgcctcctgggctcaagatattctctcgcctcagcctccccagcagctgggattacaggcacgtgccaccatgcccagctaatttttttttttttgtattttagtagagatggggttttaccatgttgcccagggtggttttgaactcctgagctcaggcaatccacccacctcggcctcccaaagtgctgggattacaggtgtgagccaccacgcccagctggaactataattcttaagtacttactccccaagtaggatgggtctgaaatcaaaggaaaggcttcttccatgttttggtcaagtgacgcagagatgggaaaatagaggcagaaatttaggtagagcctgacatctacagagccaaaataggtttctccataccttttcttagacacaaggtctctctctgtcacccaggctggagtgcagtggtgtgatcatggctcactgcagcctccaccttccaggctcaagctatcctcctgcatcagcctccagagcaactgggactacagatgctatattaccatgcccagccaattttttctattattatttttaatacagacgaggttttgctatgttgcccaggctggtctcaaactcctggcctcaaatgatcctcctgcctcagcctccggaagtgttggaattacaggcatgagcaaccactctcagccactccataatttttctatgactctctcaagcctccagagcactctggaaagcagtatcttataaagaaaaatttaaaaaaatcagctatctctcaataaaaagttataggggaatctgtcaataagttacaaccaatcgctatgctaaggaggagtccagtgagctgactgctgatccaccgaatggcatgcctctctcatgtacctgggcagcggcacttggtatgcttgggccccaggtccagcaagggctgacctcagaccaccttctgctgtcctcttcatctgcatttggtggcagatacagaccaggaaggagtcacaggcaaggaaagtcagctgattctacacggccttgcaactttgcagaatgttttaatttttcaaagttattccctctgtatctgcttctgtgtgctttgtatcttagtcattatttacaagtctggcttggctaccagataatgaggtaaactaaactaattcagcaatctcattatcaccaaccaatttgtgcccacgtgttaatgcataaatatcatcctcaattaaagcttaaatagtcaatcttggctaaaatgaacaacgatggggcagggtgaggggagagcaatttccctactttttaaatgcaagcacctccaccagcaaaagattttaaaatatacatgacattcatttattcgcaaattatatacatacactatttactcatcaaatattaacagagatctattcttaattttagatgagaaatagatacgagaaggttctaatattttctttttataccccaatggatttttcccacaaccctttaactacacgcacaccactttgaatcccagtggtatcaaccatgatgaagttaaacaaatcctggattgtaatcatggcttattgacctaaaccaagtcattcctcctctttgggcctcctgttttgtttgtttgtttgagacggagtcttactctgttacccaagctggagtgcagtggcgagatctcagctcactgcaacctccacttcatgggttcaagcaattctcctgtctcagcctctcaagtagctaggataacagacgcccgccaccatgcccagctaatttttaaattatttttagcagacatggggtttcaccaggctagcgaggctggtctcgaactcctggcctcaagtgatctgcctgcctcggcctcccaaagtgctgggattacaggcatgagccaccgcactgggccgggcctcattttgcatattttttgttggattaataatactcacttagctacctgacacaagatgattaaagaaaaaatctcccaaatggttaaaccatcacatagatgtaaaataatgccatttttattattgtgattatcttattgattgaggacggtggaaaaactggaggaaataggtacactgaaaacacttggaagtagatatagactgattctaagttgcaggagagttcagaactgcttttgagtacaatgaaaattgctttcccatcaagaacaatttggatggccatccagaggagcagatgccagtgcacacagagagggcaagtgacactgcaaagtggctggagacgtccgtgcggaatcgcagacttcaggagaaccactgcaactgtcagaactctgacctcaggatgagatgtcacagccaggtaatgggtccccgctgctcaggcagacaccaacctaatgggacactggccttggtggatgggtgtaatgaggtgacatcttggactagtttcctgaggcagttgtagccaagtatcacccacctggtggctttaaaaaaacaaaacatgacctaaatgaatgatctcacagttctggaggccagaagtctgaaatcagtatcactggggccaaatctaaagcactccctctggaggctctagggagcataaattctttgcctcttccagcttgtggtgtctccagtatcctttggtttctggctacaccactccaatctctgctccatcttcacaaggccttcttttctctgtgtgtcaaatctccctgtgcctcccttgcagagggatacaggatggcaattagaacccaccctgattatccaggataatctccccccaaatccttaacttaaaaaggattgcaaagacctcttttccaaataaggtaacatttacaagttcaaagagggagagcttgatatctttgggaggccatttttcagcctaccatacccctacccaatctccctctatcttgagatactaggattctatggtttatgcataagcaacagtatttggtacgaataaagtaaagtgttacataagtggcataatgagtgcaaaagcagtcagaaaagggagggagagcccaactatgacctcttggggatgtcctgaggtcctcaccaggagtgtcccttcccaagaacaacatctgtccccaaactctatggggcacagaagagagagattcccagagcctgacagtctccaggcaactccctctagccttgatccatcctattctctattctacctaatattttctaattgctttaggaaaaatccttgtcactgcaaagaaaacagcctctctgtcaaaactagtttggtcagtcaactataacaacacatatgaaaagggagggcagaggaaggtgaaatgcctttgggaatgcagaatcattatggcattcccatctttctctctcccaaaacgtaaaaacttgcactaaaagaaaagttgcactaggtcctcgcttttacattgcttcctcaggagcaaggcagaatatatgaggtatgtcctgagtcagagaatgtgtccaactgctgcaggtccatgaggctctgcctggcccagcattctgttgtttacggaaacctcagagactcagctaggttctccttcctgatggcaacctcaaatattaaatatattccacctgctcttcataattattggtgattcatgaatctgcttgggcccttttagaatttatttatttctcccacttcgttcttcttcaagggatatgaagagttccctgactttattgtggctttatgaattaggatttaattttgtatccaaaacttctcattcaaggcaaaagggaccacaaggtattaatttccaaatctgacatatgattctgggcgaatgctctgtacttacaacattatagattttaatctcgtccccctgttagactttgccacttcagtctgaagggaccaaactttgcagtttttataaggtctcctcccctgtctataattcaatttcttaagtcctattggacatttggttcatgaggcctgctgtgaaataacatagaagagcttccaatgcaaaggcttaattgagttcacccagaaagtcaaaacaaaactggatggagaagatggcaaagcagagagcactaggaatctgtttccccacctggacaacaatcatgctggcagaatttgtcctgtgtgactattttgaaattccaggctattgaaggcttgcaacttccagggaaaggcttggttggtaaattgcagttaatttccatcaatttcagctcttagcacagtagccgctacccatcccctactcccaatcccatggcagggagatgtgcacatgttcctggagcagcttgcatgcagccagcaggaatcaggttgggcaaaaaagcaccctgtcctccaaatataggggttccgtgctctgaccagagaggtgcagacaaagaggcaggggccactgttgctacacctctgcccattgtataagctccaccccacccccaaccctgccctgcagctgaaatgatttccagaggatttagaggcagcactattttcccccgtttcatttttctctttccatcttttggaagtcagacatcaaagactaagatatttaaaagcaatcacacatacaggagaaataagaaaaaaaaatcatgcatatccatgaaaaggtgcaggctcagaaaagacctgagaagaccttacatttacacctcaaactgatcgttggcccaaagacagcctatgacaattaaaaaacaaacaaaaacaacaacaaatgctggagaatggggagaattcaatttccagaggtactccattattagcttcaaatgtttagttttctaacaaaacgtcacaagacatacaaagaaacaggaaagtatggtccattcaaaggaaaaaataataaatcaacaaaaactgtctttcaaaaagacctactggtggaattaatagacaaatactttaaaacaaccgtcttaaacatgctcaaagaaggaagacatagagaaagtcaagaaaacaatgttataaagaagatgggtgatttgagcaggcagaaggaaaaaaagatcagtgaacttgaagctagcttaaaggaaattatcacttcttcagagcagaaggaaaaaaagactgaagaaaagcaaacagaacataaagtatgtgtgagacatcatcaagtggaccaacatatacattatggaaacctgagaaagagaaaagggtaggggaatatctgaagatatagtggctggaaactcccccaatctgatgaaagatattaatatcaacatccaagaagctcaatgaacttcatctaagatgaactcaaagagacccacatcaagacatactatagtcaaactttcaaaagacaaagagaaaatcttgaaagtggtgagagagaagcatatttccacacaaattccccaacatgagtatgagcagatttctcaccaaaaactttagaggccagaaggcagtgggctgatatagccaatgtgctataagaaaaaaagcctgtcaaccaagaatccaatatccagcaaaactgtccttcaaaagtgagggagaaattaagacattcctaaacaaaagctgaggcagtttgttatcactagacttgccctgcaacagatactaaagggagtccttcagggtgaaatttaaggacactagacagtaacttgaagcgatatgaagaaataaagatcacaaaaaaatggtgcaattatgtgggcaattataaaatctagtattattgtaacattggtttgtaactctacattttgttttctacacaatttaagaggttaataattttttaaaagaaattatcaatttatagttttgcccatataatgtataaagaggtaattttgtgacatcaacatgtaaaagtggggatgaagttataaagcagcattttttatatgctattggagttaagctggtataaatccaaattagaatgtataactttagtatgttaaatataatccccatggtaactacaaagaaaatagacataaaatatatacaaaagagaaatgagaaaataatttaaatatttcactacaaaaagatcactacacacaaaagaagacagcaattcaggaaatgatggacaaaaagctttaagacacatgggaaacaaataggtgaatgacagaagtaattacctacttatcagtcaatctaaaaaaggaaggaaattctgacatgtgctacaatatgggagaaacttgaggattttatgataagtgaaataagccactcataaaaagacaaatattgcatgattccatttatatgagatacttacagagtagtcaaatgcatagagacagaaagtgtctatggttgacaggaactggggggaagggagaatggggttattgcttaatgagtacagtttcaattttccaagaagaaaaacgttatgaagatggacagtagtgatgcttattaaacaatatttacttgcttatttccactgaactatatacttcgaaatggttacaatggtaaaatttatattatgtttattttacacaataaacaaatggaaaacaaaaacagttgtagtgcctccagtaagatctgctttccttttgcttttctgtggcttcaaaaacctacaatttcagactacaagtgtggtgattaaacaccagcctggagaaaaaggggaggggaataataaaagtgtttatctgtgtggaattagggctgcatttagtcctttctttctttctttctctctgtctttttccttcctgtcttccttctcccctcccctcccctcccttctcctctcctctcctctcctttccttccttttcgggacaggatctcattctgtcacccaggctggagtgcagcagcacaaacatggctcactgcagtttcaactttctggactcaagtgatcctgtcacctcaacctcctgagtagctgggactacctgtgtatgccaccatgactggctaattttttaattgttttctagaaatgaggtcttaccatgttgtccaggtcagtcttgaattccccagctcaagcaatcctcctgccttggcctcacagagtgttgggattgcagggaaaagccaccatgcctggcctggtccctctttcaataaatatttgatcagcacctattaggtgcaaggagtcggataagaactggggagaatcaagtgtcaggtctctgccctgaagaaactaaccatcgtatagcaggttaaaacatgaacaaaactactgtattagtctttctagatcagacagtcaaaaccagccttcggttgattaattgagaaagcgaaccagtgaggagatataaaagatcatgttttgggttcagagaagaaaaatatcatattggacccatgaacgaaaatgtttccagagagaagacacagtctgatataggtctcagaggaaacacagtgccctagtcatagcggcaggacctctcagggccacctcaatgactctttgtgaccagttcccctctgccattaacagatgagcaaatataccttgtttttttgagacagggtctcgctctgtcaaccaggctagagtacagtggtgcaatcttggctcactgcaacctctgcctcccacgttcaagcgattctcctgcctcagcctcctgagtagctgggattacaggcacccaccaccactccagactaatttttgtatttttagtagagatggggttttgccgtgttggccaggctggtctcgaactcctgacctcagatgatccgcccaccttggcctcccaaagtgttgggattacaggcttaagccactgcacctggccccaaatctaccccttttacaggaaacctggcatcagattcagtgccctgacaacctacttgccaagcccacaaacattcacttactccactaatcaacaaatactcatgagatgtctaccatgtgtaggacatttaggctgggaacctggggaaccaaacataaatcggagtagatcacacttcgaagaagttaatagtctcatgagataagatctataaataaacagaagtcaaaaacttattaattaaatggtatgaaaacaaagaatggaagcattacttctagccacattggagacccaggagagctgatggtgtcattccagtccaaaagtctcaggagggctgaggcccaagaaaagccaagatttcagcttgagtccaaagtcaagaaaagactgaggtcccagctgaagcagtcaggcaggaggagctctctctaagtcaggggacggtcagccctttgttcagttcagaacttcaactggtaagatgaggcccacccactagtgggaagataatctgctttacacagtctacctatttaactgttaatctcatcctaaagcaccctcacagcaacatctagaataatgtttgaccaaatatctgggaacccggtggcccagtcaagttgacacataagattaaccacctcaagcaggaataaagacaatcaggctgaaagttaaaatgcataggctggaacatctcaccttttagttcagctgaaacaaagtctctatctttagagaattttggaacttacctagtttactgtagttttctgtctaccggttgaacctgtgccttactctacagcctaccctgaagggtgacggccacagagaaagtgctcagtaaacactttgtgggaaattaatgctcctcttccagcctgtgttgaccagctttgtccctgtcttggcctgggtgacaatgctcaagcccaaccctggccctgctcagctccatccctgcaccagcgtattcagattccctgtgacactggtggcttctcactgtcaagtttgctccttttgtctgatagctgcatctggccccctgccctatcttcaaagccctcaggccatgggaggttaggtttcaacaaatagagacatctgggtgtcaggggaagctaaacagcagagagaacaaatgtgctggggaggaagggtaaaagttctcaaggatctgagagtggatgtctctctggggcacagggcataggcactcatgggcatgggggagagggggtgtcaggaggagaggaaggataaagcccaggacagatgaggccaattcatttattccataaatacttcttgagcacctatgaaatgccaagctctgtcctaggctaatagagaagcaagctcagtgaaaatcttcaggggtgcaaagctcacagtggccaaggacctcatttcaaaatgtgaaactgcaacagccaaaaagagctaatgcatgctggacttaatacctagatcatgggttgataggtacagcaaaccaccatggcacacgttcacctaggtaacaaacctgcacatcctgcacatgtaccccggaacttaaaaaattaaaaattaaaaaaaaaaagcaggccaggtgcggtggctcactcctgtaatctcagcactttgggaggccgaggcgagcagatcacttgaggtcgggagttcgagaccagcctgaccaacatggagaaaccccgtctctactaaaaatacaaaattagccaggtgtggtggcgcatgcctgtaatcccagctacttgggaggctgaggcaggagaatcgcttgaacccgagaggcggaggttacagtcagccgagatcacgccactgcactctggcctggggaacaagagtgaaactccgtctagaaaaaaaaaagcaaaaaaaaaaaaaaaaaaaaaaaaaaaaaaaaaaaagcaaagacatgccctcctgctgtctgtccagttgacacccacttctccagaatgaaaacagtagtgggcagccactcctcagagactatctcctatcctttggaaaattcttttgcaaatctaaaaccaattccaggttgggtgaagggaactttgagaaggttactggattgggccaggatactagaccagcaaggaacagaaacaagttgaaaacacatcgttctaagtgtctccagtatcctttctctctcttttatttatttgttttgttttttattttttattttttttgagacagagtcttgctctgtcaccctggctggagtgcagtggtacctctttctctgcctcttgctacagcaaaaccaagaatcaaaaccaagggagaagtatttctttgatacacaaatttctttcctttggataaatacctagtagtagtggcattggtgggtggtatggtagttctgaccgttacaccttctatgcatgtaacaaaacatcaccaggactccatacgtatttgcaaatattatgtatccataaaaaataaaattggaattcacagttctgaaatcaaacaggaggacactagctggggcaaagaaggaatatttattttattttattttatttattttgagacggagtctcgctctgtcgcccaggctggagtgcagtggcacaatcttggctcacttgaatctctgcctcctgggttcaagcgattctcctgcctcagcctcctgagtagctgggattacaggcgtacaccatcacgcccagctaatttttgtatttttagtagagacagggtttctccatgttagccaggctggtctcgaacttctgacctcaagtgatctgcccgcctcggcctcccaaagtgctaagattacaggcatgagccactgtgcccagctcttttctctcttttttattctcttccttttcccaacccctgtctctcttcaaaggagtcttgttttccctggacaaaatctataggaatgtgtgtatatgtgtttgcaaaccaggatctcacacagataggtgtgtgtccaaggggacaaatgacactggtgaaataagaccacacccattgtgcttgcatttgatcatcgtgctcccagggacaagagaggcagtcagcaaaccaaagccatcactttgcagactattttccagcaagatgctttccttcctttctatgccaggtacctgataattgtcacttacagactgttggaaacatcgaggctcctcctgccccctgaaattctcctcacctgtcaaacgctgagagaggagcacaaggcttctagacagtttccaaaatgaagttgtgctaggcccacaggtctatgtctggaaggtacagttgccatagcaatcccggctaatgactaggtatgtaaatgagggaagaatctattcatcatttgccagttgttccaagtgcttgcccttttggaagcttaggggagcgaggagtggtgtgttagaaaagcatatgtttggtaaaatttttgaataaatgtttgctttcagagctccccatgagaaatgattattttgggtggtatcctcatagagtggtttactctgcagctaccccgagaagggaatgaggattaaccaaaaacacatacgacgatcccacctgtactctgggtccctctgggaaaactgcagccatcacttttatcacaagcagtgggtttttggtcctcttgggtagttgggagtcttaagtaaggcctcagagactcgcaagctgtccctggcagcagatgagcagtatctgacttctcctcccctgattcctaattaaaatgcccatgaaaatccataaacagacaaaaactggcaacagtaactgatactggagacaaccaaacactgaagcccagattcccagattgtcgagcaactctactgcccaggagaggaaccgagaagggcccctccgccttctgagtaagaacactgtcagggagggtcgggcgcagtggcttgtgcctgtaatctctgcactttgggaggtcaccaaggcgggcagaccacctgaggtcaggagatgaagaccagcctggccaacatggtgaaaccccacctctactaaaaatacaaaaattagttgggcgtggtggcaggcacctgtaatcccagctacttgggaggctgaggcaggagaatcgcctgaacctgggagatggaggttgccgtgatcacgccattgaactacagcctgggtgatagagtgagattccgtctcaaaaaacaaaacaaacaaacaaacaaaaaacagccagggagacaaagatgagaaaggaagctgcccgtctgtactggaagtcagtcctgttgagcacttgctttactcggctgctgcagtttcgcattttgaaatgaggtccttacgaaatgccaggctctattctaggctaatagagaaccaagctcagtgaattcttcaaggatgcaaagctcacaatggctgaggaccttcaaggatgcaaagccgagtaaagcaaagacatcattgttcagatcatactgggagacctcgggcaatcgacttaatttctctgtgcttccgtgttctcatctggaaatgagaacaataaaagaacctacttcctagggttactgtgtggataacatcgagttaagatatgtaagaggagtctattcccactagaatataaactccatataaaaccaaggtgttaatttgaccaggtcttcctgacctgcttgcttttggccacttgctttttattatttttgttacttttccttttgccacgtagctcacggccacacagctattaagttggtacgagagtaattggtgtttgccattttgaaagtaatggcaaaaaccgcaattactctcgcaccaacctaataaatgctgaaacttaatgaaggttaagtgaagactggctactgtacaggtcattcctacatttctgggtcaccatggtcgtagtcgcttctgttgttttttaggaacttgggccagctcctgaccagttcagactcactgaaaccactggcccttcaactaggcctgtgcaaatgcccaagaggttgcctttttccttttttttttttttttttttttttttggagacaaggcctcactccgtcgcccaggctggagtgctgtggcgtgatctcggctcactgcagcctccacctcctgggttcaaatgattctcctgcctcagcctcccgagtagctgggattacaggcatctgccacgatgcccagctaatttttgtatttttagtagagatggggttttgccatgttggccaggctggtctcgaactcctaacctcaggtgttctgctcgcctcggcctcccgaagtgctgggattacaggcgtaagccaccgcacctggcccaagaggttgccttttgacatcagtgggtgaaaaaccccaccttcagatcatactaatgccacgtttactgtaaacatgtcctatgaaatgccatgaacccaactacacctgtgcagaacgaacctgttacttcatttttttccccaccactaatcacttttccctatgccttaaaaccaccccacttgcctaactcacaaataatcctttagccttatctttggggaagtggatttggcagctgttctcctgcctcctcactccgtgcccttgcaaataaatcttttctcttttgcaaaacccgtgtcacagggattgatttactgcgtgcaggcagaacagacccggacctggcaggtaacacacagagggagggattttgtttgtttcatttgtggatctatgccaagtgcctgggatggcacatagagggtgttcaactaatgtctgtggaatgaacaagctggttgttaattgtgaatgtggggtgtagagggtagaagcaggataagacagtccctagtgtactgtgccctggggtatttgacagaaaaggaaagctgtcagcacaagaatgaggaagtgcctgctgaacaaggtgtgctaggaggggtgggtttccacacagactccaggcaggaaggcaccacgcaccctgtatgctctgataggtcagagaactgggcagaggtacctggaatgggaaagacgcctgctaagatcagcaaaccactcttttactagcccaggggaagctgatggctgttctcaacaggtttgagatcgtgttagtgtgcgtattacagagaaaggatactggagacacttaggtgcattttcagcttgtccctgtttgttgctggtctagtatccgggcccaatccagtgaccttcttaaagctcccttcgcctaatctggaattggtttcagatttgcaaatgagaactttccgagggatagctgaggacaatgcacccacgctcacttttcgcaattgatcatgtcaggcctggacatttgttcctcatttaaggactgatgtacagcagtgagagcattctatctgcagggtgtgtgaaggattttgctatggaaaaaaccatcttcagaaacagcatactcttgacacaaactgtaccacagaaaccaaaagaaacatagtagaaagggtctaggttatgttagcagaaacttctagaaaacatgaactgtgaaagacaagccaaaagaaactaggggaaattcaattacggttagaattgcaggaagtcacaagaccctatctccctcaccccaacaatgagaacagttggcataagatgcaaaatcatagggtgtgtgtgtgtgtgtgtttgtttttggtgtgtgtgttttttttctttgagacagaatcttgctctgttgcccaaatgcaatcatagctcactacagcctccaactcctgggatcaagcaatcctccctcctcaacctcctgagtagctgggactacaggtgtgcaccaccatgccgagctagtttttatctttttgtagagacgaggtctcaccaggttgcccaggctggtttcaaattcctaggctcacgtgatcctcctgtctcagcctcctaaagtgctgggattacaggtatgagccctgctaagaaacctactgagaacagccattagctcctccctggactagccagaactcatccagatggcttcttaattggagcgggcatctctcctaccccagatacctctgctgagcctgatttatctttctaatccatcaaagagctaagaaataaagaaatctaaaaaagataaattctgcaaagtgatgagtccttcctagcagagaagaggctcccagaggttttcattcatggtagacatgggcttcaagaggaggctgcctaacctggaacaaacctttttttttcttttgagacagagtcttgctctgttgcccaggctggagtgcagtggtgcagtctcggctcactgcaacctctgcctcctgggttcaagcgattctccagcctcagcctcccgagtagctgggattacaggcatgtgccaccgggccggctaatttttgtatttttagtagagacagggtttcaccacgttggtcaggcttatctcgaactcctgacctcaggtgatctgcccacctcaccctcccaaagtgttgggattacaggtgtgagccacctcgctccgccggaacaaacttttaacagctgctgtgacagagtcacattccaaaatgccgcagcggaacagcatgctgtacccaccactactttagtccttagaccttaactgggtgcaggcagttagtacggtgaaggttggatagggcaggagagctgagggaaatccctctgagaccctccctccatggctgaggtccctcctgcacctgctctttgaggactagaaacagaatggaaggagacctcctgaaaacccagaaaaccatggtggaactggacagaaaaagacagtgagcaaaatgtcagcatggttcagaaagcttggcagctccactataaagcataaagacatctgcagagttttctcattgctcgcatcacaagctctgcaaaacagaaagtcctgatgttaccctcgaaatctttgaagttgctgtgaaccaacttcaactaaagctgtaacagaactcctatccaactcaactacggattacattgcgtgaaagcctgactccagtgcctggcaggagggttctgccattctttggtgcgtagattttatttattttagacttgcagggttttcttacatgcagtatctggcattcaatcaggaattatgagaagatgcaagaaagcaggccaggtgtggtggctcatgcctgtaatcccagcactttgggaggctgaggagggcagtcacctgaggtcaggagttcgagaccagcctggccaacttggcgaaaccctgtctctattaaaaatacaaaaattagccaggtgtggtggcgggcgcctgtaatcccagctactcgggagactgaggtgggagaatcgcttgagcctgggaggcggaggatgcagtgagccgagatcgcaccactgcactccagcctgagaaacagacagagactctgtctcaaaaaaagatgcaagaaagtgtgactgatatgcaagagaaaatttcacagaagcagacttaaaagatggtccagatgttgtaaggatcagaatttaaaataagtatgataaatgtgccaaagatctcatggtgaaatacaaaatgtgaacaaattgggggtttgagcagagatatggaaattatttaaaaagaaatagtgagacccccatctctacaaaaattgtgtttaaaaatcagccaggtgaggtggcatgtgcctgtaatcctagtgctttgtaaggccgagacaggaggatcacttgagcccaggagcttgaggctgcatcgagctatgatcatgccactgcacttcagcctgggtggctgagcaagacctcatctataaaaaaaataaaaataaaaataaatgaaaatgcaaggaataaaaaatacatataggccaggcacagtggctcacacctgtaatcccagcactttgggaggccgaggcaggcagttcacgaggttaagagatcgagaccatcctggccaacatggtgaaaccccctctctactaaaaatacaaaaattagctgggcatggtggcatatgcctgtagtcccagctacttgggaggctgaggcaggagaatcgcttgaaccatatctaagtacagcacagactgccaaaaacttgcaaaaaaaaccttaaagacagtcaatgggaaagacatactacataacaatcgctgggtgtggtggctcacgcctgtaatcccagtactttgagagaccaaggtgggtggatcacttaaggtctggagctcaagaccagcctggctaacatagtgaaaccctgtctctactaaaaatacaaaaattagctgggcatggtggtgtgcacctgtagtcccagctactcaggaggctgaggcaggagaatcgcttgaacctgggaggcagaggttgcagtgagccaagatcacgccattgcactccagcctgggtaacagagtaagactccatctcaaaaagcaaaacaaaacaaaacaaaacagattacacttagaataactaaaactttgtacaggggaaaccaaacctcaacttctaccacactccacatatgaaaactaatttctaatggctcacagacctaaaagtaaaagctaaaaccataaatcttccagcagaaaatgtagtaaaattttttttttttttttctggcatgcagtgggctgatcttggctcacactgcaacctgcgcctcccgggttcaagcaattctcctgcctcggcctcccaagtagctgggattacaggcacccaccaccatgcccagctcatttttttgtatttttagtagagatggggtttcaccatgttggccaggctggtctcaaacttctgacctcatgtgatccacccgcctcggcctcccaatgtgctgggattacgatacttttgtaacattgatgcaggcagagatttttttcaacaggaaccaaagagtactgaacatgaaagaaaaaagtgataaactggatttaatcaaagtttcaaatgtctgctcatcaaaagatactacagtagttccccctcacctgtggattcactttctgcggcttcagttaccccttggttaactggtcaactgcggttggaaaatattaaatggaaaattccagatataaacaattcataagtcttcaactgcacactgttctgagtagcgtgataaaatctcatgccatcccactccaacttgccagagacgtgaatcactcctttgtccagcatatccaagctgtctatactacctgcccgttagtcactgctgccatctacttttgacattgtcatggctccatgatgaccaggatcaccgaagcacatgatcctctttctgacttacggtcagaaggtcaatagcagccaaacgctatgtcattatgcccacgccattcacctccatctcatcacaaaggcactttatcatctgacattatcacaagaagaacatggcagctcaagcctgtgatcccagcattttgggaggctgaggtgcaaggattgcttgagaccaggagtttcagaccagcctgggcaacactgcaagaccccatctctacaaattttttaaaaatattttaaaaaggggagtacagtataataagatatgttgacagaaagggaaatcacattcacatcctttttttacagtatattgttaagattgttctattttatcattagttattgtaatctcttactgcacctgatctataaatttaactttattataactatttatgtataggaaaaagcatagtatatacagggtttggtattatgcacagtttaaggcatctaatgaagctcatagggcatatgccccttggataaggaggggttattatattaagacatgaaatgtaagccacagagtgggaaaaattatttgtcaagggactacttggggtaatagaaatgttttatactttgtattggaataagtgttttactgctgtttataattgtcaaaattcatcaaactgaactcaagagctttacattttacggtatttgaattatgtctcacttaaaaagtaaaaaatcaggtggtacaggctgagatgaaaaagaggctgaagaaaacaaagaaaaaatacaacaaactagaataactcctagcagaattaaaatccacaatgcaaatcttccctccaaaaattgacctaacaccactattaatcaagacagtgatataattctctgggtaaaaatagatgtataaggaaaatcatctgaaagtcaggttacgaaaaaagagataaaaaaatatataaagttagagatctcaaagatgatatatttacagaattaaagaacattaaaatataaaagaatggcaagtatacatttatgttaatacatatgaaatccaaaagaaatcagtgatttctgaaatgaatagatcattggatccactaaagaaaatgatcacttgtgtacattaatgaacgtgacataaactaaatattgttaaagaactgtcctaaactgttttaagtttcatgtgatttcacagaaatatgtgttcaaatactcgaaaatggttattatgtaatctcttccagtgcaaaaaagatggaaaagtcccaaataccctatacatttcgcctaaccctggtattaaaaacctgaaaatggaaagaaaatgaaatggatcaattattgtagttgttattattattattattgttattattagagaggagtcttgctctgttgcccaggctggagtgcaatggcatgatcttggctcacagcaacctctgcctctggagttcaagcgattctcccacctctgcctcccaagtagctgggactaccggcccgtgccaccatgcctggctacattgtatttttttggtagagatgaggtttcagcatgttggtcaggcttgtctcaaactcctgacctcaagtgatccacctgcctcagcctcccaaagtgctgggatttttacacaggcgtgagccactgcacctggcccaattatttttatggatatatttgcaaaacctaaattaaaaaataaaaaaatagtcaaacttaacaggatatagagagagaagctcagctaaagagaagtaatccatgaactgtagcagtttttcaattatcgtaaattcaattaaataagggtcaaataataaaagtcaaataatgaaaagacctgacttcatcatgaagtcaaataataaaaattacatgattatctcaatagacgtcaaaaagttactcaaagttgttactgacttaaaaagaaaaaaagggtaaactacaagtaagatattaccctaaccataataaataatgtccatctcagacaacaatcgatgtaattttcaagtttaaactcagaactctggggaacagtactattaaagtcagaaacaaaagagcgtctgaaataacaattactattgttttgatctaaatgtttcacccactgaaataggccagaaatgaaaaataagaagtacctctcatagcacagacccagaacctcagggagcattttgttactacaagaaatgcctttgggaggccaaggcgggtggatcacgaggtcaggggtttgagaccagcctggccaacatggtgaaaccctgtctctactaaacgtacaaaaattagccgggcacgctggtgtgctcctataatcccagctacttgggaggctgaggcagccaccaccaatcaatcgtctgactcagcaactgcccagctctaaaacagatccaccaaagagtgttagaaaagtatctagtttatgtcctcgacaactaactaaaagatgtcacatcagccagattagaaaagcgacaagagataattccacagagaggagaaagcattgttacaaaaatgaaatccagtgatcagtagactactcactggaaaacctccaagtagtgaagcaggaaatatatgtatgagaatataaaaggctgaggaaaaacatagagaaagaacagctatgaggggtattggaaggccatagcccaggatctaagctgtggataaggctagtaagagagattgaaatatgtggagcaaaagcaaaaaacaaaaaagggttgaacaaatgttttccagaaagaaaactcggtctaaaaattgagagtgtacgctgggcgtgatggtgcacgcctgtaatcccagcactttgggaagcagagacaggaggatcacttgaaaccaggagtttggaaacagcctggaaaacacagtaagaccccgcctctaccaaaaagaaattgaaaaaatttgccaggtgtggttgcacgcgtctgtagtcccagctactctagaggctgaggcaggaagatcgcttgagcccaggagtttgaggttacagtgagctttgattgcaccactgcgctccagcctgggacacagagtcagaccctgtctctaaaaactgagagtgtgaatcatattccaaggaaccacaacaacaacataacaccaggcaccaccactactagaacacacagatgaatatgaactggtgacattttcaaacttcctggataatgattacatcctaagccaaattagattattcacaaggaaggaaaagcaggttatcacaaacttaacaatattaaaccctaacaataatgaaggagcactcgtagaccttcaaaagaaaagggttatgggccgggcgcagtggctcacacctgtaatcccagcacttagagaggcccaggcaggtggatcacctgaggtcaggagttggagaccagcctggccaacatgttgaaaccccatctgtactaagaatacaaaaattagccaggcatggtgacgcgtgcctgtaatccgacctactcgggaggctgaggcacaagaatcacttgaacccaggaggtggagtttgcagtgaaccaagatcataccactgcactccagcctgggagacagagtgagactccatctcaagaaaaaaaaaaaaaaaaagaaagaagaaagaagaaggaaggaagggaaggaaggaagagaaggaagagaagtaagagaaggaagggaaggaaggaaggaggttacggcccaagaattttttatctaacccatttgtttatgtgtgttaagatattctcagatctgtatgaatatgtgtgaaagatattctcagatttaatactaagaggattaatgcttgaagtagacttcctgaaaaataaaatgaaatttgggaaactttatgtcagaacaaatatatattaattaaaaataagaaacagaaaacgagttaagtatagctgagagtaagcactaaagacagatatagagacaagataagtgtttctaatattattataaaactgatattttttaaattgaaaataataaaagttgtaaaaaatgggaggaacatatttataaccaccttacattaaaattaacaaagaacagaaaagagaaagagataacatttaatttcttatcttccataaaaaaggtattaatcatttgtaactgatattagctgttagagataatctcacaaaaaattttacggccatcactaaagagggtaaaagtaagatatctaccttccacacagttgggtggataatataaaaaagaaaaacacaaccgtagtcacaaaataataacttcatactaggtacacaggagaacccccacaaaacaaaatgacggaattaagactcagccttaatgtgaaataaatataaaaggctaagtgtaccaataaaagggctctcagaataattaaaaatgacaacataatcacacatattgggtaaaagtttcacccctaacaaaatcacagaaaaaggtagggcatcgtgtaccgtattcctggaaggaaaagaaactgaataattgtgaacggtcccagtgaccactgcgcataaagataaatgttatgcaaacacaagcaaaaaggttatgtggcaaaaatcaacaggactcaaaagcatttaaagaacatttgcactgataaaaggtgaaatccactatgaggacagagcattgaaaattaaaatacaaactgttggaagtaaatccaggaagtaacataacatcaatacatcacaataatttatcttggacaaaacaaccaaaaatagggctacaaggcacatgggtaatgtgaagataacttctatgcacatacaaaaagccttgtagcatagagccagtaccttcatgaaagttcatcttattcttggttacagagaaaaatcttagcaaatatcaggttatacttactttgcataatgcaatgaaaatagaaaattggctcacgcctgtaatcccagcactttgggaggccaaggtgggcagatcgctggaggtcaggagttcgagactagcccggccaacatggtgaaaccccatgtctactaaaaaaaagtacaaaaattagccagacctggtggcgcatgcctgtagtcccagccacttgggaggctgaggcaggagaattgcttgaacctgggaggcagagattgcagtgagctgagatcgcgccactgcactccagcctgggtgacagagctccatccgaaaaagaaaggagaaaagtaaaatgtaaactagaaacttaaaaatcccagtgactcggaaattaaattgtaagatggttttctataaaatttatgaagtagcagagggaattttaaaaatacaataaaatattataatgaaaacatcaaaaccgtctattaaaatttgagagatattactgagacttttctcagtgtccaatttcccatcctagttgccttaattattaaataataaagaatttaaataagtaatctattgaagtagctagaaatggtaacaaatacacaacaaaaacccacaaaaacatcaattcccttatctgcactttcgtgtttacaacagcattattcacaatagctaagatatgaaatctatccaagtgtccatcaatggatgaatggattttttaaaatgtggcacatttacacagtggaatattagccataaaaggaaggaaatccttttacttgcaaccacatgggttgaactggaagacactatgttaagtgaaacaagccaagtgcagaaagacaaatatctcatgttctcactgatctatggtagcttaaaaaaaatattgaactcgtggagaaagagagtagaacgatgattataggggcaaggatgggtagtgggtgtggggtaagaagagatggctaatgggtataaaaatacagttattgagaaggaatgagacctagtgttcaggagcacaatagggtgattattattaacagtaatttactggcagggcgcggtggctcatgcctgtaatcccagcattttgggaggcagagggtgggcggatcacctgaggtttggaatttgaggccagactggccaacatggtgagactccctttctactaaaaatacaaaaaaaattagccaggcctggtggtgcacacctgtaatcctagctacttgggaggctgaggcaggagaatcgctggaactggtaggcaaaggtagcagtgagtcaagatctcaccattgcactccagtctgggtgacagagtgagactccgtctcaaacagacaaacaaacaaacaccccagtaatttattgtatatttcaaaataactaaaagagtgcaactgctatgttcctaacacaaagaaattgtgagcactttaggcgatggatacctcaatcaccctgatttgatcatcacacatcatatgcttgtatcaaaatatcacatgtaccccataaatatgtataacttatatccataaaaaataaaaattaaaaactagaaaaattaattccctataattaagggaaatgaggaatgaaaatagaatggtaaaatattcccttattgctggtctgtataggtagggttgcaaactctaaagcctatagagaccaagccagtccatcagtaggcaggcatagaacactaatgaacagtggagactgtggcagatgccgtacccagaggggatggccactcaactccaccaaattattgcaatgaaggaatgcaggtctagtcttgccaaattctccaatattttaacaggagaaatgtatatttttaatgtgagattttctgctttataaaatggtgtacggccaaatataacatggctatgagctgtatttggctggtaggctgcaagtatgcaacttctgatttagactattgacttcagcttgaaccaatttcaataatttacatttttccagaaaaatttccatttcatgtagatattcaagtgcattaatatgaaactgtatcaagtattctttttaaaaatctcccatatttacttttcatatctagtttattttagtggtaatgctttccttcttaattaaatatgctatctttgtgaatttgttgcttttcttttccacagaatcagtgcttggatctgttcatgagattgaaaggtttttggtttttaatttttaaatttccaagtgggtgggattcttattcaaacttttgttattaatttctcgtttattgtattgtagtcaaagaatgtgcctatattacttgttctttacgatttaattaggttgtctttgtagcctaatacatagtcatgttttatttaatgttccagaatcacttaaaaagtaagctgttctctttttaagggtacaaaatttataacacacacacacacccacacacacatatatacacacattccgtgtcattcaaattctgttactttgctttatccacttgatcaaatggaaaggaatgtgtagagtctcccataataattgtgtttcgcccttcttcatggtacttctaagaacttgccctgcaataaaacttttgcaatgaatattgtattctagtaaaaaaaaaaaaaaaaaaaaaaaaaggagaagcctaaaattctaaagttatcattagtgttgttcaccaagtatttctactttgttcccttctgggcatatagttgggttgtactcctcaacaccctttgataataatcatggccatgtgacttgctttagccagtgaaatgtgaatagaagtgacaaaacccttaagaatcactgtgtgattccccgggtctctttcccctgccttagctaacatggaaggagagacgggctggagtctctttctgccacaactcttgagtgaggatgtcacagagaaaagacccaaccaactcgcgatgacacacagtctgagtgacagctttaattttgtggttttaagccactgctatttgggggtatatttattgctgcagcataacttagcctatccttactgaaacagctctgaaaacaaagtacgcagcctgcaaaggggaaaaaaatgggtaaccaatcaatatatttaaaaaattcttcctctcacatactagttaaagcaaaatgaattgccacttttcaccatcatgttacttatgatttttaaaaattataatacttaatattggtcaaaatgttctaagacaggcattctcatacattccttttggtaaaccctgcctaagaaaatgttacttagcatgaagaattttagcaatttcctatatttcacatagaatctcacttctaggaatccagcacggtttctgcattgaagatggcaccgtacactcgtaccagggagaaaacaaacttcccaagtgggattctgagattggtttgcttgcctctaaccttaaatgaagtgctgacctccttgcccactgaaaaggggatactagtatctactgcatgcattagcattatgattaattaactgtcatctgtggtttcttgggatacaataattatttaaagtaaggctttggaagacctaagtggctccaaggtttgacctttatggtaacgatgatgactaccaggactgccagctgggatggctgcttctgaacacccttgtaagaacaaacaagctcagacctttaaactctcagctcaagtcacagagaactagattgcttctgcggtggttctaaaataatcacttatttcttataaccctgcagggaagatgccaaatttaactgtgtgctctgtagaattatcagttgaaatcacagactcatcaaatctcttatgtgaaatttcaggtcctgatggaaaaggagtgggacctgagattcagaacaggaatttttaggtggatttagaaaactgattcccaaagtctcccttacgtcctctcttacagctcagacaagatcaacttgaagaccatgaaggcctgtaataaacacaactaaggcagttgccttgataggggatgcctatttcttcaaggtctacccctaccaggtttgtctctaagcccatggctagaatcagattggcatatcccaagaggaaacattctaggtctgatgtgaatgaacagagaattgcaatcagcttacatctggggaataggtgtaacaatggactctaggtgttaaatcaaagaagatacactgtaatattggatgaggctgctcttattgaaataggtgcacataccagaattttttttttaactcttgttgcccaggtgggagtgcaatggcacaatctcagctcactgcaacctctgcctcctgggttcaagtgattctcctgccgccacctcccgagtagctgggaatacaggcgcacaccacaacacccagctaattctgtatttttagtagagatgaggtttttccctgttggtcaggctggtctcgaactcctgacctcaggtgatctgcctgcctcagcctcccaaagtgctgggattacaggcgtgagccaccatgcctggcccagaatttttttttaatatattggcttgaatagctagaagggactcaaatagtctagttagtcattggctgaaacttgaattcaacacggtcagtgttaataagatggagatggcataccttcctgggcatactgtagaagacagacttgcttagggagataggaatgttggagaggaactgccatgatcatccactaccattccatgtcccaagcaagtctgaagaattctcccttcaccaaaacaatgagaaacctaaagactgtcttcaattcacatcctctgctctcatacaaggatattttggggagtggctagggtctttcgcccaaccaaaggtaacctcatgagaaccccatgtttctagagactattttggaaagcaattggaagccaaaacattcacatataggtttgaaataccaaggtatttatgactcaggggcgtgtgtgtgtgtttttcagagtttcaatgtcctgttgtcaccctcagtgacctatatccactaaaattgcaaaaagaatactatatctaaaagctatctggttaagatcttagagtcatatggctcttactagtggcatgacctgtgcaagtttctagaaacctcggtacttcatttttctcatccacaaaatgagaatcataatagttagcacctatggcttttgtgaggactaagtaagttaataaataaagtgcttagaacagtctttggcccatgatgaaaactctgcatgcattagctagtattattgttatccagggttattattggggtcctggtgagcattacacaagtgttatttatcattaattacccagttaaaacttgccacagtaaagatcaaaagcacacaagccataattcactaacacagagtgaaatacaaaagagtttaatgctaattatgcttattcacaaatgcaggcatttgcagagacatttttctttagttgttcttcaccaacactagtggctttgtgaattatatcgtttgtaaacttacaaatctccaggcactgagctccctgcaggagactagggaggggcttcactccctagagagactctcaaagaaggaaacataattgggtttgctttccatttgtcaaagtgtgcctcagactagggtatctccaacttcaatgtgtatatgaaacatctgggaatcttggtaaaaggaaaattctgggccaagcctggtagctcacgccagtaacccaagcactttgggaggccaaggtgggagactgcttgaggccaggagttctacaccagcctgggcaacatagcaaaacttcattgctacaaataataaaaaataaaaattagccaggcatggtgacgacgcatgcctgtagtcccagcaactcgggaagctgaggcaggcggatggcttgagcccagggggcaaggctgcagtgagctatgatgacaccactgcattccagcctgggcaacagagcgagaccttgtctctaaaagatagatagatagatagatagatagatagatagatagatagatagataaagatagatagatagatagaaggaaaattctgattcagcaagtcaggggtagggcctgagttggagcatcttaaacatgcttccaagtgatgctgactctgcctgtccctggaccacacatggaggagagaggacaccaggtctctgcacatgcaagcactttgagggccacctgcattcagacaggggtgactgaacccctaaggacagactttacttccttcatcaggttttcaagggaaaaactcctcatcatctcacatgtatcttccactcagaccttcttgctcctgcaaatatccacaagctcaatgacttctctgtagccaaagagttttcttttaaccaagggtccccccgcccccacccaattgtgtcaatggacagattgctgcacaataacctgatgtgattgttaaaggatcaggctcatggccgggcatgatggctcacacctgtaatcccagccctttgggagaccgaggagggcccctgagctgccaagaacgcttcctggttcgactgtttcaggaaagcatttgcaaagctagctggattcactccagatgacctagtagtgtggttgtggagaaacaggaaaagttttacactgatggtgggactgtaaactagttcaaccattgtggaagacagtgtggcgattcctcaaggatctagaaccagaaataccatttgacccagcaatcccattactgggtatatacccaaaggattataaatcatgctgctataaagacacatgcacacatatgtttattgtggcactattcacaatagcaaagacctggaaccaacccaaatgtccatcaatgatagactggattaagaacatgtggcacacatacaccacggaatactatgcagccataaaaaaggatgagttcatatccttcgtagggacatggatgaagctggaaaccatcattctcagcaaactatcacaacgacagaaaatcaaacaccgtatgttctcactcataggtgggaattgaacaatgagaacacctggacacaggaaggggaatatcacacaccggggcctgtcgtggggtggggggagaggggagggatagcattaggagatatacctaatgtaaatgacgaattaataggtgcagcacaccaacatggcacgtgtacacatacataacaaacctgcacgttgtgcacatgtaccctagaacttaaagtgtaaaaaaaagaacactgaaaatgcagaaatcagtcaaatacatcccttaggtcttgaggatatcaagcctttattccccagtgaatgatgcaggaagctctgagatcacccaaacagctgctgtggggaccacagagctaaggggaacacacagggtgtagcacagcccacagtgacttcaagaagccattcttctcaacctgcttctataattcagctgtggctgggtgtggtggctcaagcctgtaatcccagcactttgggaagcggaggtgggagaatcacttgaagccagaagttcaagacagcctgagcaacaaagtgagaccccctatgtctacccaaaaaaaaaaaaaaaaattaaacagaatacagctttggagacaattttttgactatttttttttcttttatatatatattttttgagacagagtctcactaggacacccaggctggagtgcaatggcacaatctcggctcaccgcaacctctgactcccaggttcaagcaattctcctgcctcaacctgctgagcagctgggattacaggtgcctgccaccatgcccagctaatttttgtatttttattagagatggggtttcaccatattggccaggccggtctcaaactcctgacctcaagtgatccacccgcctcggcctcacaaagtgctgggattacaggcgtgagccaccacgcccggcctttaagtgactattttgtcaacgaatccaaggatgatacagaactaatacgatgcaggggatggaagtcgattcctgacatgcaaaggacaccttgggaattgggcttaaaggtctcaaggagcctggtggaaaagagctgcaggcttccagaatcagggctgatggagggatcctggcccccaaaaaaggcatccaggaaaggtgaatcttggtccccaactggtgcttggtaaaagtcactttagctgcagaggctgatgaaagagaaatggaagagtgaccacaagagaacaaagaactgagttaaagttccaagaaataacttttgcagtgatgagccaaggaggagaccccaggcactgggcagaagtttgggctttttgtttatttaactctgaatagttcaggctgtgcccagtggctcacatctgtaatcccaccacttagcgaggctaaggctggagaatcccttgaggccaggaacttgagaccaacctgggtaatagagtgagacttcatctctgcaaagaataataaaaaaacttagctgggtggggttgcacacacctgtagtcccagccatttgggaggctgaggtgggaggatagcttgaaaccaggattttgaggctgcactgatcaatgattgcatactactgcactccagcttgggtaacacagtaagaccctgcctctataaaaaataaaataaaataaaataactctgagcagttcagcccatttggcgcgcacacacacacacacacacacacacacacacacacacagccagtcccaccactgagggcaaactggctccaggccaggtgagcaatcccagaccctcctgcctgccttccattctgtcccctgggaatgtctggatggatccgtgtccaggaaatccaggcgagatccctaatccagggagatgactgttccatgtgtagccggcaaggcacccccgctcccagtgagccacctaatgaaaacctcatgtgtcaacttgagttgcacagacaaacccaggcgaattccagccgggcctcgtgccgaaggtatgacctcactgtcgggcaaagcggcagggaccccagagaaagaagactggtgtgtgggccagacctgcttctaatcacagccagatgggacggatggaggcaccactgccatcctgcctgcccagatactggggtgtacggaccaggaggcatggtcatcctacagcgaagaatcctaagctttgccccaaacactccttttttttttttttttttttggcatcatccacatactagtttggtgtgattacttttgcatcaacctaataaacatcactgccattccacatgttccacaccaaagagaaacttaattaggtaggctcgaatctctggaggattcccagttacagaagcgaggaaggaaggatataattagaatcttttttttttttttcttaacagaacagctcaaaaggccccactaaggacaattaaatgcagtcattccatccataaccagaacctggtacctgagaagtttactcattggcaacgtgaaatttgcaaaataccttcaagacacgcacttcaacctcagactgggcatttttcatttagctcttttcacacttagggactgtataaatttttgtggcagcaatacccgtagcctacactgatgcgttattttcatggattttgtactaaatcttttgtaggcaacaaaacaaaacttcaaggaagctgagcttcaaaaataaataaatgtgcttttacgtgatgggtcaccgtgaaatagttgatgacttgggtttttgttaaaggaacaaatagaaattcgctgcaagatttgctcagaagttctgctttcagcattggtagctgagtatgatgagttgcaaataaactggtgaaacttgtagtctcttaaaccgcataccagatgcctgagccctgatgagctctttgaacaatatcatcacataaagccccaagggactccaagctctcatgaaatcagggaggatttgcaataatctaaaaatttccccacaagctggggtccaatgagagaatatacaaacaagcatgaacttggggccgaagacgcttaaatcttttttttaatttttttgagtttttttgttttttttttagagataagggtctagctctgttacccgggctggagtgcagtggtacaatcatagcttactgcagtcttgaactcctaagctccagcaatcctcctccatcagtgtcaacaatcctcctgcctcagcctcccaagtagctgggattacagacgtgtaccactatgcccagctaattttttctgtttttgcagagatgggttctcactgtgttgcccagaccggtcttaaattcctggccttaagcagtcatcctaccttggcctcccgaagtgctgggattacaaaatgtgggccacggtacccagcaagatccttaaatcttataggaataactctcccacaattataagaataacttctgagccgggcgcagtggctcatgcctgtaatcccagaactttgggaggccgagacaggcagatcacgaggtcaggagatcaagaccatcctggctaacacagtgaaaccccatctctactgaaaatacaaagaaaactagccgggcgtggtggcgggtgcctgtagtcccagctacttgggaagctgaggcaggagaatggcgtgaacctgggaggcggagcttgcagtgagccaagatcgcgccactgcactccagcctgggcaacagagcgagactccgtctcacaaaaaaaaaaaaaaaaaaaagaataacttctggacataactaggaataacactctacaagaaaaatgagtccaacctatgtgtaaagaagttgctaattgctaattccattcacatttagtccatttgactaggatttttgtttgttttgtttgttttttgagacggagtcttgctttgtcacccaggctggagtgcagtggcgtgatctcagcttactgcaacctctgcctcctgggttcaagtgattctcgtgccttagcctcccgagtagctgagattacaggcacatggtaccatgcctggctaattgttttgtatttttagtagagacaggatttcactatgttggtgaggctggtctcaaactcctgacctcagatgatccgcctgcctcggcctccgataacaggtgcgattgactaggttttattacaagagttgtgtgagcagaatcaaagacccaaagccttcttagttccagaaacagacgtatagattaagacttttcttatttcaaggaggaaacttttttccctgcaaatgtatctctgaaataatgatggaagtcactggaagtgagatcttgctgtaaaaggtgtgctttgctccagcttttcagaaatatctctaaaatataaagcaacgtcaaatcaggcctacaaagacatggtgagtcaccatcaatcagaattgggagaacaagctgagaaccgctcacacaactgaataccctggataaaacatctctatcctgaaccagaaaataaatgtctacagctgcacttggcggttggccctagggtccattcaccatatggtcacccttattatcatcctcccaacaagtccggcaagataacaggctaaaaccacgctcttgcaactggcctgcaggccaagcaaacatctccttatcataaccttggtctgttcttccaaagagacttcctgcccatctcctctgtccttgcttcttggtgtatatctaatgctcaacctgggcacgccaaaagcccagtcctctcgtgcccgatgcctagaattaagctgcttttcagagggaaagggtatgtgttaacaaaacaaaacaaagaggcctccttcctggacctttatctaaggcaggatctagctggtttgggataaaacctagggttttagactagggaagaaacttaaagattatcaaatgcagtcatttttcaaagcttattttatttttaagatggagtttcactctttgtcacccaggctggagtacaatggcacgatcttggctcaccgcaacctccgcctcctgtgcccagtccatttttcaaagctttttaaacattacgagggctgggtgcagtagctcatgcctgtaatcccagcactttgggaggctgaggcaggcggatcacttgagctcaggagttcgagaccagcctggccaacatggtgaaaccccatctctactaaaaatacaaaaattagccgggcgtggtggcgcacgtctgtaaccccagctactcaggaggctgaggcaggagaatagcttcaatctgggagatggaggttgcagtgagccaagatcatgccactgcactgcagcctgggcgtaagacagagtgagactctgtcgcaaattttaaaaacactacaaagttgtattttttccagtgaggttgtatgcagaaactcagtaaatagaaaatagacataaaacaagctgttatgtccatacagtggaataggaatatggccatcaaaagaaatgaagtcatgataaatgctacaacacaggtgaaccttggaaacactatagtaagtgcaagaagctactcacaaaggaaggcaaattatatgattccattagtagaaaatgtccagcagaagcaactatagagacagaaaatagagaagtgcttgtgtagggcttggggaaatatggggattgagaggtgatggctaagaggtacaaggttttgtctgggtgtggtggctcacatctgtaattccagcactttgggaggccaaggcaggcggatcacaaggtcaagagatcgagaccatcctgcccaccatggtgaaaccctgtctgtactaaaaatatgaaaattagctgggcatggtggtgggcacctgtaggcccagctacttgggaggctgaggcaggagaattgcttaaacccgggaagcggaggttgcagtgagcagagattgtgccactgcactccagcctggtgacagagcgagactccgtcaaaaaaaaaaaaaaaaaaaaaaaaaaaaggaagtgcaaggtttctttttggagcaatgaaaatgttctaaaatcgactgtggtatgcgttgcacaaatctctgaatctagcctggcctggctgacctggcagaacccctacatactcctctcctggatatgcccaccaatcacctggatattgagaccatcgatatcctggaagacaccatcaatgagtttgagggtggtatgaagctagtcagctatgactctggactcattcagcaagtgaggtcctggccaggtgtgaggtacagcagagagtgtctaggtggttgggtggagcagtcatggcatatgaaggggcgtagtacttgcttactgaattaagaaaagaggctcagagtgtagacacaggtggcaaggaccagatcttacggctctacttatggggctactttgaaagtgttaaatgaaacacttcatttcttcagtagctacttggagatgttaaccaacttgggattgttgagccaaatggggcagagagttgggtagaaaacagggtgcttttgctactggtcccaggattcttcaatccaaaaacaggattctactaagaagggcgtggactagacaggggactgccactgtcactggagaataagctgcaggtcatttctctgaagctttggagaagatggaaatggagggggggggaaggaggctgagagtgaagcctctgaacagatctggacaatgggaacgtccagacagaaggaagtgacaatgggaatgacacagtagctccagcttagaaggctccaaagcttgcgggttatcgtgtccttgggatagaccatcccaaaaaacttagaggtagtgaggcagtgtgcaggatatgggcttgtggggtagggcaggaagataatgccattttcttccttagaatccccttccatcagtctgctgggcaagaatggggacagtgactgggccaggattaagtctaggatttgttttccaggttgcctaggaaatgtgtgtctgtgggaagcagagaatcaatgaatggcctggagacaccctggcccacagggaacacctcaagtccaagctggtagatgagaatccccagctcaccagaagaacatacaacacatgagccctctggtcttgggttaggacctccgtctggagaccaacaactgctacccattgaccagtctctcagacaacgtagaaaagtggttgcctagggcttgcagggacagggggattgggaggtgatggctaagagatgtggaattcctttttggagtgatgaaggtgttcttttattttccttcaacttttattttaagttctggggtccatgtgcaggatgtgcaggtttgttagataggtaaacatgtgccatggtggtttgctgcacagatcaacccatcaccttggtattaagcccagcacccattagctattcttcccaatgctctccctccccacccccaacaggccccagtgtgttgttccccactatgtgtttatgtgttctcatcatttaactcccacttataagtgagaaaaagcacaggtatcttggaacccaaaataatacacaatttaggccgggcgcgctggctcacacccgtaatcccagcactttgggaggccgaggtgggcagatcacgagatcaggagattgagaccatcctggccaacatggcgaaactccgtctctactaaaaacacaaaaattagtcagttgtggtggtgcatgcctctagtcccagctactctgaaaggctaaggcaagagaatcacttgaaccgggaggcggaggctgcagtgagttgagatcgcatcactgtactccagcctgggcgacagagagagactccgtctctaaaataaataataaataaaatacaattaaaaaaattaaatgaaaataagataaaaatgttaaaatagacctgtcatgaaaaaaaaaaaaggtgagaacatgtggtgcttggcgttctgctcctgtgttagtttgccgaggatagtggcttccaactaaaatccattgtggcgctggttttacaaatctgtgactctcgtctggctacactggggctacaccccggcactgctgcagcactgctcccctggctcctcccctgcccccgcacctgccttagctgcactcttaactacagcgggacagttacctgtttcatgtcctccttccacttatatttgtccatgtctggacttgactggctgttccctgcagcctcttgctggtgaacttttcctgagtgtgatgtagccagagacactgagggttagcccaggagcccaaggccaggctctagcccatggaggagcttaggattcttgtttgaggggttttggtgatgttggaggaacattccccaactcactgcccccattcctttttgcttctagtctggagctctggaccaagaccctggtcttggtcaatttttaaataatttctcaacaatgtaacttgtagatctgtgtgacatctacaaagcatccaataaagaaagaggaaacaaacaaacaaaaccctgcacatccactaagcaccactgaattgtgcactttaaatgtgtgaattttagagtatgtgaattctatctcaacaaagctgttatttagaagaggaggaggaggaagaggggcagggagaagaggaagaagaaggaggaggaggaggaggggggagggagggagggaggaggaggagggggagggagagggggatagggatggggatgagggagggggaagagggggatggggaggtgggaggggacaagaagggaaaaaacaagatgctgtaactgttccaccagccaggcctctttcctcaccccatcctatagtggccctgaaaccatctctacaggcccctagaactctatggaaagttactgaaaaagcctgttctagtccaagtttctgcttctcaaatgtaaaccaagtctctggatttaaaagtgcaaggccctgcataaaccgaaggtctcactgatgagaccggggcatgtctcaggggagaagctgcttgtccgggtcttaccgtccatgtccaagcgctgcatgatgatggccagctccacctcgcttggcatgtaccccaaagagcgcatggccatgcccagctcctgcttggagatgaagccgttcccatcccggtccagaacccgaaaggcctctcggatttctacaatggaaaagcaaagaaagtccagtggtcacatggctggctttattgcactgcagttattggtgattgcctactgagaactcctaactgctttaaaaacagtgatttgttaaaactctttaatcagataaaagggaggacagaagaagaacagaagaaaagaaacgaagaaaagaaaaaggaaagagaaaaaaggaaatggaagggagaggaggagaagggaaaatgagagaggaagaaaaagaaaaggaaagggagaaagggagagagaaaaagaggaaggtggaagggagagtggaagagaggaatgaagggaggaaaaaagagaaagaagaaaggaagggagggagggggaaaagggaaggagggagggagaaaggaaggaagaaagcaagggagggaggaagggagggagggaggaagggagggagggaggaagggagggaggaaggaagggagggaggaaggaagggagggaggaaggaagggagggaggaaggaagggagggaggaaggaagggagggaggaaggaagggagggaggggaggaggagggaaggaaggaggaaggaaggaaggaaaaaaggaaagaagaaagaaaaaggaaggaaggagggaagaaaggaacgcaggcagacaaggaaaaaaagaaaaagaaatgaagaaagggagaaagagagaaagaaagaaaggaaagaaagaaaaatagaaagaaagaaagagaaaaaaagaaaaagaaagaaagaaggaggaagggagggaggaggcagctcgacctgagcatcctccaactctggaggaggcacacaattagatggtggtcccagcagagaatcatgttaaccaaggacactttctgagcaaagatgaggatttggtttcagctgtgaggagaaagctgcctcttaactgcagtcctcaggaggaaaggagaatgcagctcccctctgcaggcatatttcagatccctgctgctgtaggagctgtgcagaaagctcttccagcctcataggaggagaagagttaagtatccggctgtttttgactcattctcctaatttacaggtgttttgtagatataaacaacctcagatcaataagagcatcgtgaaaactcaaaagatgcctttaatcactttgcccctgggctagcagagaacttgactctgcggtcagcaagggctgtttcacttggcaggcaatctctcctcttcccctaaaccagagttgctctaaattccacccagagtccccttctccagagccactgcagctgtcagtcctggattggatgtataacacaaggaattggaggtcacagtgtgaagatgaaaggttcgttaattgtttctgagcacaccagacctagagcagctttgacttttcatcaataaacccagtgcaagcccagatatgtcagctgccattattcaccatgccacgctagttgatagaaagtcaactagtattgactttctattccgtgagaagcacagtattaataaatacggaaaaataaaaatgatccaccaggcattggggttctcccactcagctcgactccactcaggatggtaagatgcatgcagaaaccttctatcactcttcaaacgcatacaagcccctcggttctgactcatttacttactaccgcactgaatatctgaccatgccctggcatgatcattaccacaaacttggtgatttaagacaatagaaatctattctctcacagtctggaggccaaaattccaaaatcagcatcattagatcacaatcatgatgtcagcagagctgtgctccccgtgaaggctctaagggaaaatccatttgtctcttccagctgccagaggctgccagcattccttggcttgcagccccatcactccaatctccatcttctcctcttctgtctgtaattctccctctgtcctgctcttaaaggacacttctgtttgcattagggaccactcagataatccaagataatctccccatctcaagattcttaacttcatcacatcttcaaagacttttctgtaagatagcatttataaatctcagagattaggatttgatatctttgggggctggttttgagattgctacactattgcatccagtgcttctgcctaaaatatcttcccttcttcttttccctgcccaaaattatatccatccttcaaggtcaagtgtggatgctaaagtgactccatcttggatgctaatctgccatgttgacttctgacaaactctaattctgggaatgcctcccaaatttctatgttatctactgttccttgtgtaagaccttgttcttaccatacaccctgcccttaggcagactcctgcctttccctacaatcgtctatacattccttccctatgatatataagtcctgggtctggtaggtgatggctgggggcatccaccatcttgtctcaccatgccgcaagacacagacatagcccaagtccctattaaatgtttctttctgacaagctagatatatcagcctcttttttcagcctctcagcttccttggactttgggagtaagtttgcatggacttgcccattgcaaaacaccaaaccaggggtcatggattccgcaaaactgtctttgctcaccatagccaagttatctccctttctgctgactgttcacagcaggtcattcattcctttcttgtgacatccagcatactccatctagaaatactaccattggcttcttttctgagcggtaagcacctcctacccttctttcatcttagtgtgttccccgcccacattgtaggaggcgctagacagatagctgttcaagggatgatgagtctgaatgggtaaggatcatatattagtagtaaattcattatcaatactaatccagcatgctgaattctttctgggaagaattgtgggccccagcagagagaagaccaccctgtgcaccaggaccctaggctcccagccaggcgtattagctaattaggtccacggccaaaccctggaggcctcagtttgttcatgcgtaaaatgagctgtgctggctgcatggatccctcaggtcctccagcccttctttctgtgcatccgtggacatcgttgaagtgtttaagtgaagaacaggaagcctgtgttctcttacacaccctattaatctgctgttcaacacctcctcccctttctttccatcaatggtatagaaacaaattttagtccaacccaaattctgaatcaaggcgtttgtctgcattttgagcttttcccatcaatgaaatatgcccaaggttacctaaaacagccatatgttttcctaccaagtcccgactggcctggaaggagcgtggagccactactcagcttgaggtcatggcacactgtgctcaaggacactgtggtggaggacatggcctcatgtggcctgagctcagatccccaattgccaaggatgggaggacgcagaggccaggcctcccgacgtgagagtcagcccatgaggcagccagcgccaagcgccagctctgctctgcaagctggtgcagccttccccctcagcctcaatttccccatctgaaaaaatgggttaggtgtgatgtccttccagcctctatagcagggttttacactggggccaggacatacgatgcaacagtaggaagtgtcagaggatgacaaggtctgcggctgcagttactggatagccagttgtaagctaagtcttgctcttagttctccggaaggctccttcccaaggcatcatctccacttcccattccttctgactcaatcctgaactctctgggttactgatatggctggacagggtgggtcccttccattgacagacctttgttcctgtggtcttcctgtatgccctagaccttacaggtaagcatcaacctacatccttacattgggcgacaccccagcgggccctagctgggggtgtttgagaacatggcctggaaatgaggacccggacagctgagcctttggacctccgagttgccccacctttggggctactggatttagcaagtcagaccatagatggaggtcactccagaacttccctcctctaaagggacctgctccttcgaagccttgaatgcctgtggcttactctgtagtctgtagcaaggctggcctcctccaaccaagcccaggacagcgcaggccacacatcagctcagggttctattttctgtggcatgcaggtaagtaggacaaagctgtccttctttattctctatttgcatagggagctcctggctcccacgtagagaattcgtgtgtgtgtctatgtgagtgtgtgtgtctgtctgtctgcagaagcagacaaacctcactaactttttttttttttttcaaaatagcagaaacaggaaaaaaaatacaaaactagaaatccataataggcacctcgggagagttaatgtttctagggtaaggaaagcccaggcaaaccgaggcttattagaaggaaatgggtcttgcagtctgggaaagacatgtgatgtgtgcctcattttatttttaatagcaaaacagggtgtgaaaaatatgcccgtaaaacccacggagacattggaacaggcaggatccctctggctctaggaggacggctcccagcattgagtgggctttggccactttcccatccttgggaactagggaccacagatcaagttttcaagaacaggcagtaatgttgtgtgcttttcaccgaaacgtactccttctttggcctaaagtctctggtgcgccagggctacgtgagcacgctgtatctttggtctttaattaaactttactcctccatctcatgcaacacgtgcacgttagacactagtatgccaattttaaccacctccaagatgtctttgtgggccacagaaatgctctctgcaatggtgataggaacctgtccaactgtcattgtgtggagtatgaaaagacacgtggcaacacgcatcgtctgaaaggactccagtctctgcaagcatatggagtcgcccagaatcaaagttggcgttcccacagggatctgagcccctcctccctaaagggaagcagagagtcttgagccaagcaaggacttggaaagaaataatcctgttattcagcccaagagatttacttctcattatgctggtaacttattttttttttctgagatagtcttgctctgttgcccaggctgaagtgcagtggcaccatgatagctcactgcagccttgagctcctgggctcaagagatcctcctgccttggcctcttgagtacacaccaccatgctcgactaattttttatttttcattttttgtagaaacagggtctcgccatgttgcccaggctggtctcaaacacccagcctcaagcagtccttctgcctcagcctcccaaagtgctgggattacaggcatgagctggtaactcttttttctttctttttttttttgttggagatggcgtctcgctctgtcacccaggctggagtgcagtggcatgagctcagctcactgcaacctccgcctccctggttcaagcaattttcctgcctcagcctcatgaatagctgggattacaggcgcccaccatcacgacggctaattttttgtatttttagtagagacggtgtttcactatgtcagccaggctggtcttgaactcctaacctcaggtgatccacccccctctgcttcccaaagtgctaggataacaggcatgagccaccgtgccaggctctcttttttcttaaaaaaaagtctgcattgggacctagtgccctctgagaatcaggcctcagctccatgatgcttcctaatgacacagccaattccaggcaggaacaacagcaaaagcacagctatcgcagggaggagactcatttctcaggcatcagataaagtccagacaccagccagcatcgatattagttggctgatgttctagctttgaagaatcaggtgaaatttacagtactaatttgccacctcaaattggtaatgaagaacaacaatttctcctatctcagtatgtgtacgatgcaaaatctgcttattcttcacagaaatatatcttcaggaagaatgtgggtcttcattgcataaagtgatggctttattaacaaagaagatgcgttgtgaggctagatggcattgagacactgcaaaactggagaaagatgcagttcagcgaggctaggcaaggcagttatttaaaagctatggaaatgcaccggaaaatgtaagatacaaacctagagttatttatgcaaaggaagaaattgggcagggactgagcctatgacaaagagatttagaaaggttttcaccttctctaagaaaggcaaaaaatgaatatttacagatgattaataagccattcattctgcaaagagttgctgtttacttatatgtcaggggctgtgccaggatagataagtagcaaaagaaactttccaggctgcaataaatctgtattacagttgaagagacagagaggtgaccagatgttcataagcaagaatgacaagtgctataatacaagtatacacaaaatcccacggaggtcgagatgttgaagggacaactctgaggaagggctgttggggttacgcttgaatcttttaaatctcaagtctatcaagagaagggtaaacaggcaggggtgggaaaatgtggcaagacacgggcatgtctacaattctggctgcccggtgggtggagaaacgagaaacactgagagatgagagtggagaattgcactagggcgatgctatagtttggatgttttttccccaaaatctcatgttgaaatttgatctccagtgttggaggtggagcctaatgggaggcctatgagccatggggccagatcctgcatgaacagatcaatactctctctgggaggaggaggaggggttgcatgagtcctcaattagttcctgcaagagttggttaaaagaaaagaacctggcacctccctctctctctcttgcttcctctcttaccatgggatctttgcacacactggctcccctttgcctttctccacgggtagaagcatcctgaggtcctcaccagcagccaagcaattgctggtgccatgcttcttatacagtccgcaaaccatgagccaaatatatattttctatataaattatctagcttcaggttttcctttatagcaacacaaaacagactatgacaggcaatattgcaatgggccttcacagccatctgggctctaccccgcaggccaggggttggcaaaggatggcctgtagccaagcctagctcaccaccttctttcacaaataaagttttattggaacacaaccatgcacatttgtttctatatgtctccactggttgtctattttctcctgtttttgtgctataccagcagaatggaataattgtgacaggaactgtggggcccacaaagactaaaatatttatactccggacttttctttttaaagtgtgtgaccctttcatgtaggccacagggagctcccagtggttttaaaatatatattttttaagggtgagatttttagaccaagagctcaggcatcagggtggctacagctggaatgacaagagataagaggctgtcacagagtctaaggggaagatgaggaactcagagctaagccagcatggtggcagaggacactgtggaaagaagagtttgagagacttttcagagatagagtggatggtgctcaaggagagctcagatgtcagagtctgggagagggatgatttgaaagacaatgctggagggctgggcacagtggctcacacctgtaatcccagcattttgggaggctgaggtgggtggaacacttgaggtcaggagtttgagtccagcttggtcaacatggtaaaacccaagaaagaagtaaagtaaaagtaaaaataaaagttgaagggaagggaagggaagggaagggaagggaagggaagggaagggaagggaagggaagggaagggaaggcaacactgtagtttacgtgatggcattaacaacaaacaattcaggagggactgcaggctgtcttggagggaagtgaggtttggccacactgaggataggtgtctgagtgataccctggtgattgcttctagcgagcagctgcaaatacttggcaagagtttggagacaggtgatgctgaaaatatgacaagaatggaaaatggggataaaatgatgatcgctgcatagaaaatgctggtttaatcccagggagggctttagtgtgaatgagttctgatttaattacaacctatcagtctgcaaataatgatcaactgacttcagaaattaggaaacatagaggtgaaagggacagagctacgaaggcagagggaagtgtgctagaaaaaggaggctggggctaggcatggcggctcatgcctgtaatccccacactttgggaagccgaggtgggcagatcacctgaggtcaggagttcaagaccagcctagccaacatggcgaaaccccgtctctactaaaaatacaaaaatgtgctgggcgtagtggcacatgcctgtaatcccagctacttgggaggctgagacaggagaatcacttgaacctgggaggcaggggttgcagtgagccaagatcatatcattgcactccagcctgggcaacaagagaaaaaggaggctgggcatgcaacaggagctcagaagtgttcccatttttagtaatgtgggacattatggacattacattatatatggacattacattatatatggacattatactatatatatagtataatatatatagtataatataaatatatagtataatgtccatgtcccacattattatatactgtatagtatatattatacaattatatatattaatgtataatatataatatatactatatataatatacagtgtataataataacatgggccacaggaacaagccacttagatggaggggtggatacactgctgctttgtataactcactttttagcaccatcatctccacctggatttttttttttttactttttcatggaaagatctattttattttttaatatttttaattaaggtcaaaaatataatttaccatctttgccactgttaagtgttcagttcagtaatgataaatacattacacatatacattctttttttttttttttttttttttttggagacacagtgactgtcacccaggctggagcacagtggtgcgatctcgactcactgcaacctccatctcctgggtccaagcaattctcatgcctcagtctcctaagtagctgggatcacaggtatgtgccaccagacctggctaatttttgtatttttagtagagccgggtttcgccacgttggccaggctggtctcaaactcctggccttgtgatctgcccgcctcagcctcccaaagtgctaggattacaggcgtgagtcaccgtgcccggccatatacattcttttttatttccatcccccaccttctctcccctccttccttacctctggtaaccagcaacctactctctattttcatgagatcctctttttttagctcccatatatgaatgataacatgcaatatttttctttctgtgctttacttatttcacttaacataatgacctccagttccatccatggtcctgcaaatgacaggatctcattcatttttatggctgaataacagtccattgtgtatatggactacatcctagtttttattttttctgggcacacttttaaaaagggattgtgactccttaggtgatttgctatttgaggtgtgactgcatctatttcaataaatactcattgaacgtgcctctactccaggctcagacttgaaaagaaggctcaagtgagacatggcagaggcacgcctgagccgagcccagtcctgaaggcacttcctgcttttgtttgttgaaatggaatcttatttcacaaagcattttaggcagtttcaaggacttaaatgagactagcctggacaacatagcaagaccctgtccctgtctttttaaaaaaaggcttaagatttacctaagggaaaaacatgcacaggagctggaggagagaaagatgaaatagaaatctctgaggaagtatacagggaggtgagatttagaggctgagagaggctgaggcttggaggaagcatggcagagaggcccttcaaagagggcacaacagggtacggaagcaggaggggactgagctggggctttgggcttctcctggatggcgccatgcaaaagggcacagctagcactagcggccagccatacctccaagttagctgcaagtattaatctggaactagtcactgcatctgtgctgttaagatgagaatctagtgtcgaacaggactcctgtaaatcagtaaattacccagcccagattcaccttggccagctaccacccagctattgaccaaaggagccaaactctgtaaaatatttaaagaggtttattctgagccaatatgaataaccatggctcaggtacagtctcaagaggtcctgagaaagtgcccgaggtagtcaagttatagtttaattttatacattttagggagataggaattataagcgaagacataaattaatacatggaaggtgaacattaattcagccagatatcttcaagtggaggtgcttacaggtcgtagggggattaaaagattttctgaggctgagtgcagcagctcatgcctgtaattccagcactttgggaggccaagacaggaggatcatttgagaccaggaattcaagactaacctgggcaacatagtgagaccccatctctacaaaaaattaaaaaccaaattaaccaggtgtattggtgcacacctgcagtcccagctactaaggaggctgagatgggaggattgcttgaacccaagagtttgaagctaaagtgagctatgatcataccacacttaagaagtcagaagaaaggaatgcttgagttaaaataaggggactgtcgaagccgaggtttttgttacgtagatgaagtctcatagatggcagccctcagagagcatgtgatgctataccggtcaggctggatttggtatgttattaccttaagacactgtttggtcagtcttatggtctgcattttaatcttaatgctggtcagttatgcctaaactctgaaagggaagggatataacaaggtgtgtgtgtgtgacctcccttcccatcatggccagaattcagtttttcagggtgcttgggggtccctttggcccaaactggggtctgttcagttggctgggggcctaggattttatttttggtttacattgcttaagaatgagtcactgttggccagacacggtggctcccacctgtaatctcagcactttgggaggccaagctgggcagatcacttgaggtcaggagtttgagaccagcctggccaacatggcgaaactccatctttactaaaaatacaaaaattagccaggcctggtggtgggtgcctgtaatcccagatactcaggaggctgaggcaggagaattgcttgaacccaggaggtggaggttgcagtgagccgagattgcgccactgtactccagcctgggcgacagtgcgagacaccgtctcaaaaaaaaaaaagaaaaaaaaaaaagaatcactgttgaccctgggaacagacagcaggcagtgttggggaaaaaggtgcacaggcccagtgctcagggctggtgggccattgataggatgaacctactatgcatctcagatgtccctgcatgtcacattcctggcctttctcattacctcatagccaaaaccacattttttaattaaaacatgaatctgactccttccctagctatcattcttaaagaagggcatttttgtaacttattaagtggtgaaattataccaacaaacactatctcaggttatgaaaaataataatttctttcatggtcaaaatcacatctttaatggaaaaattaagtcaactccttccctagctatcatactgaaagcagagcattttggtaactttatgaggtggtgaaattctactactcaggtcatgaaaagtatttctttcttaagctagaatggcacaagatagtcagaaagctagaggcatttctaagggtttaagaactagagcataaagttaatctgtccccaaacgttacacctggacagattaagctgaatcgattttagcatgccaggtaggttaaagctaatggaaaattcctcaacagtgaaagaacaaagcaaattagaacagaaacaaacaaagaaagcccagcccggccagagatactgaaagctccaggcagggccaaaaggaaaatgagtggatgagatttaaatatgtatgagagtgataatcactggagggtctccatacaaaatgacaaatgacaaaattctcagggctgacccctctgggaagatgtcaagtcagaaggaagggatctcgcattgctggaacacatcagttccatttgtctggaatggttctagactccactgctaggtcatcaacagctgcaagtccagaggatcaacaaggcaactgctcctccaaaaaagcatgaaaaactgttcagaatgggttttaaaaatcaaaagacagatttcaagcagtatctacgttgtgatcttattttagtaaaataaaaatgatatatattttggaagactgtaagaatagacatcaaaatattaacagtgaactttctgtgtggtgagattacagctgatgtttattttctttgctcatgggtattttcaaagtctctattgtaaacttgctgtattagtccattttcacgctgcttataaagacatacccaagactgagcaatttacaaaagaaagaggtttaattgacttacagttccacatggctggggaggcctcacaatcatggtagaaggtgaaaggcatgtcttacatggtggcagaaaagagaagagagaggacttatgcagggaaactctccatttaaaaactgtcagatctcatgaggcatattaactatcatgagaacagcgcaggaaagacctgaccccatatgattcattaacctcccaccgggtccctcccataacacattggaattcaagatgagatttgagtgaggacaaaaccaaaccatatcacttgcattatatggtaaaagaaaggaaaaaaaaaaaccagagctaaccctacataggatattgtattagtctgtttttacactgctgataaagacatacccaagactgggtaatttataaagaaaaaggggtttaatggactcacagatccacatggctggggaggccttacagtcatggtggaaggtgaaaggcatgtcttgcatggtggcggcaggcaagagagaacttgtgtagggaaactcccctttataaagccatcaaatcttgtgagacttgttcaccaccacaagaagagcatgggaaagacccatccctatgattcaaatacttctcaccaggtccctcccatgacatgtgggaattgtgggagctaaaattcaagatgagatttgggtgaggacacagccaaatcatatgagatatgctacattttccagattacatgtagttttttaaaagtaatttcaacttttactttagattcagggggtacatgtgcacgttcgttccatgggtatattgtgtgatgctgaggcttggggcaagaatgacgctgtcacccaggtagtgagcatagtgtctaataggtaattttccagcccttgacccccagtagtccccagtatctattgttcccatctttatctccaacacgtatttttcaatgaaaaatgtccccaaaatgtatatagaaaaaaaaattatctatatttcactggtctgcaataaccattactaacatattagcacatttcattccatactttttaatatgcaaatgttcttaattcaactaggatcatgctctctatatagctttatatcatttttttcacttaacacactcaattttcaatcttccatattggtaactagtctgcaaaacagcatttttgatggttgatcagtattccatcctatggccatagcaaaattgatttcaccaaactcctattgtgggatatttagataattcccaattttacataatgttgcaatggaaatctttgtacacaaattgtcatgcattttcatggccatttccttaagatgacttcctaggaatacaatcactgggtccaagggcagaaacacttttcagtcacttaatacacattgccaagttgccctcaaaaaggcagtatcaattacaccaccctctgcttcccatgaatttcaggcacagaaatatagtacccttggaaacacacctttcatccaactatctcttaggttttagttcttgacgttcaagatccagaggattacaaggctacgcttcaaggaaaaggaggcaattcagattatgtctgaaaaaggcctgcagggtgatcgtgggatggtgagtgaaccccacatgcagcacagggcctggcccaaaggaggtccccaagaaagacacacgagcatctgaatccaggtgaggggaccaggactcagtgaggggaaaagggctcccctgaaaagggagaaggtgaggtttgagtggggagaaagctactctcctaactcaaggaccaggactgttttgggggtggaacgctttatattatatacatattatctattatatatctatattataacttatatatgaattatatattatatataaaatctatatctattataatttatatatgaattatatattatatataaaatctatattatatataattatatattatgtattatattatatataattccatattatgtattatataactatataattaatatattataatacatatctattatatatctatattatataataatatataaattatataatttataaattaagtgaatatataaattaaataatatataaattatattatataattatgcaatatgatatataaattacgtattatataatatagatgttatataatatgtactatgtataatatagatatcatgttatataattatatatagtatagatatatataatatagatatataattatgttatttataatatataaaaatcaaaaatcaacacggacatgagtccctcagcttcctcctggactctgagccaggtcactgtctctttagaggaaatacaatatgatttgcgtgtgtgcacatgtgttctggaatagttggcttgctcttgtgattcgcttaggattacatttctgggtagacagaattatctatctacccagaaacatgtttgattattacagacatcaaatgtttattataataaaaatgttttgattactataaaggttttatcataatgattattataaataagcatattataatatgtgttttgattattgtaaacatggttggttattataaacctgtttatcattataatatctattatataattatatattaattataaattatatataatatatattttatatataaatatatattatattacatgtaatatataatagtttgttctacagaaagatcgaccttttcccatgttccagcaaactccacagcagcaggagagaagcctggcaccccctccacaaaatagtcattcgtcacacagccacaggcatcttctcagggaaaattagaccaaatgcctgccgaagacagaaagtaggaactgcatcatttggcccatacggcaatattggatgtgcctccaagtggcaaactgagtggaatgtatccgtgaacaacatggcaataatcaatacagttaatttgtcattagatcacactgttcctaagctgcaaacgttaatatacggagattagagactccttggcatctgaggaaacaaaatcattttgtggatttagcatagatatgcaggccagaagaacaaaatccaagttccagaaagaaactagagaaaaagtgaatggagagaagggagcaactctctcaggcatggcaccacctcccctgcccccagggtcttgagaatcctttcaagaagctacatttggctgggcatggtggctcacacctgtaatcccagtgatttgggaggccaaggtgtgaggatgacttgaggccaggagttcgagactaacctgggcaactatctctatgagaaatttaaaaaattagtcgggcatggtggcacatgcccgaagtccaagctactggggagactgaggtggggggatcacttgagcccagaagtttgaggctgcagtgaactgtgatcacgccgctgcactccagcctggatgacagagcaagacactgcctctaagaaacaagcaaacaaacaaagctaagtttatcttcggatcattcaattcaactcaattcaacaaacgtttcttaagcacctactgtatgtcaggcagcattctaggtgctaagaccaggtcccagaaaaccaaggtataaatagcaacaagacatctaagcagtactaaagaaaataattgttcaatgatactcgtgaaagcacaatcaggcagcctttaaatcagcaccacagcaatagctatagagaccacggcaatgggattttgttatgggggagagagactgggctcaactctgaatactgcatagccaagagagaattcagagccagggagcggactgggggtcacagctatttaccactgttgcagtgaccccgatagaacaagaggacagcgatggtcacacattcgcttgacttctcactcctaattcactcattttgtagtgtcttaaaccaagacagctcaggtgcctacaacagggtccaaagacttctagctgcctgctagaagtgagcagaaaactttttccttgtgtagctcagcccatgaaacaaaaaattcttctaaagccatctgtcaattaactcatggcactgaggtgtggaacaaaatgataaatggtgggagttggaggaactggttctaatctaaacaagaactcctcttctgttgtgtgatttttttcccattttaactcatatcaaccttgtccttcctgtcatcatgggcaagggcacgcgtaaacaccgcgccatgtcttgtttctaatttgcttgcaaatacgagaggccctggaatcgctatctgtaaaaagttagccagagagaatgcgagacaacttgagggtaaatcgtggaaaggattgagactggctcacggaagctcaggggaagcccagggaaccgctcccctctgtagctcatcaaatccctgcacaccagcactcccatttgttctctgctgcattatttttcagtccatttggccttcctgataattgataaagagctgactatgaaggaaattgttctccactgcagggtgcataaatatcccattatcaataggaagcaatttacttgcttaaaattgccgactctctcattttgttttaacacactgtttctctatcgaaataagtctacacctttgaaaaggctatctccaaagcctcacactggctccagcttgaaaaataaatctgaaatcagctgaggcagaatgacctcatcccagccctctgatatcaaaagggcagctcagaaaagtggaaaaattgctttaggaattctatctaccagaaatgtaatcctaagcaagttacaagacagtaggccaactatttcagaacacacgtgcacacacacaccaatcattccgtatttcccctaaagagacagcgacctggctcagagtccaggaggaagctgagcggctcatgtccgtgtggatttggggattctgaaggtaaatagtgtggtaaaggtaacactgcaatctattggagaaaacaggaagtactcaatacatagactacaatgaacagttaagaacttggaaaaaattaagttacaactgtgcatcacaccatagacccaaattcacttttggaaaattaaaaagcagagggaattaaaacaataataattagatgacacttcgggaggccaaggtgggagaatcactttgaggccaggagtttgagaccagcttgggtaacacagccagaacccgtttctataaagaattttaaaaattaactgggcatacaccaggcacataactgcgtgcctgtagtcccagctacttgggaggctgaagtgggaggattgcttaagcccagaagtttgaggctgcagtgaggtatgaccctaccactgcactctaacctgggagacagagcaagaacctttctctaaatagtaataataatataattagatgacaaaagatctttgtaaacaagaattggaggcagattgacatatcaaaaaaaaaagaaacaaagaaaaaaaaacatgaagataaagacaacctgaagaaaaaaaacaaatgaactgacctacagcaggcaaggaaatagtctttgatatgtgaaaagttttaccagaatgtcccaccagagcaatgcaaaagacaaacagattttccccaaaaggaaaaacacagatatgcaaaaattacataaaaaaagaattacaactcattatttttttttaactcacagtatttttttactattaattttctagttcaagtgaatatcaccataatataccatggtttttgttttgctttgttattttgttttgaaacggagtctcactttgtcacctgggctggcgtgcaatggtgcaaccttggctcactgcaacctctgcctcccaggttcaagcgattcctgtgcctcagcgtcctaaatacctgggactactcccagctaatctgtgtatttttttggtagagatggggtttcatcatgttggccaggctggtctcaaactcctggcctcaagtgatccgcctgcctcagcctcccaaaatgctgggattacaggcgtgagccaccacacccggcccaccatgttttatctatcagatgcaaatgcagccaataaatacttgctgattgtctcctatgtgccaggcactgttctaggagcaggatatggcagtgaacaaagcaaggatccctggcctgcgtgcttgccatccactaggggaagacagacgatgggcactttgtaaagtaaataacatggtgtatagaaaagtgataaatgctacagaaattttttttaaaaaaatggaagagtaaagtagacagcggtacagaattataggatggactaaggaacaggttacagtgttttaaaattttatttcaacagtttttggggaacaggtgggttttgttacatggataagttctttagtggtgatttctgagatctctggtgtacctgtcacccaagcagtgtacactgtactcaatatgtagtcttttacccctgccgcccccaccttcctgtcctccccaagtcccaagtccactgtatcattcttttttttttttttttttttgagacggagtcttgccctgtcgcccaggctagagtgcagtggcgtgatctcagctcactgcaaaccaccacctcccgggttcaagcgattctcctccctcagcctcccaagtagggattataggcgcgtgccaccacgcccagctaattttttgtatctttagtagagatgaggtttcaccatgttgaccaggctggcctcaaactcctgacctcatgatccgcccacctcggcctcccaaagtgctgggattacaggcgtgagccaccgcgcccagctcactgtatcattcttatgcctctgcatcctcatagcttagctcccacttataagtgagaacatacaatgtttggttttccattcctgagttgcttcacttagaataatggtctccaactccataaaagttgcttcaaaggccattatttcattccattttatggctattattccatggtgtatacataccacattttctttatccactcattggttgatgggcttttaggttggttccataattttgcaattttgacttctgctgctaaaatttcttccagttcctgactccagcaactggaagaaagatccacaaggcttgttggctgctataaacatgtgtgcgcatgtgtctttctcatacaatgacttcttttcctttgggtaggtacttcttttcctttggatagacacccaaaagaaaagtggtgatttctgagattctggtgcacctgtcaactgagcaatgtacactgtacccagtttgtagtcttttacccctcacccctttcccctacctttctcctgaatccccaaagtccattatatcatgtttatgcctttgcatcctcatagcttagctcacacttagaagtgagaacatatgatatttggttttccattcctgagttgcttcacttagaataatggtctccagctccatccaatttgctgcaaaggccattatttcattctcttttatggctgggagggtgggaggggttgagggatgaaagactataatacatattgggtacaatgtacactgcttgggtgacagatgcaccaagatctcagaaatcacccataaagaattaaatcaccactaaagaatgtatccatgtaaccgaaaaccacctgttccccaataactattgaaataaatatataaataaaattttaaaaaatcgtaacccgttccttgggcctccaagggtaaaaacccaaaggagaggaagtagtgtatttaagtggtaccattccatccagcaatcattccatccagcagattgctggatggaatggtaccatttaaatacagaggttagggtattgaggggacatctgagcaaagacttgaggtaagggtggtagccatgggctgtctagagaagagtgttccagacagaggaaacagtcagtgctaaatccctaggtagatgtatgcctgatgtgttggaggaacagcaaggatactgagtcactgggttggggtggagtgagtcaggcagggagagaaaaacaggtgagaagacccaagagggaatgggtgggaaggcagattatgcacattttgtgtttttactgtgaatgaggtgggagctctggcaggttacagagcagaggagtcacgggatctgacttgtgtattaaaaagatgcctctggctactggactatcctgagagcagagagaggctgcttctgaggtccaaaggatgacagcagcggaggagggaaaagtggtcaacgtatatatgggttttaaggtacagccagcagggtgttctgaaaactggggtttgggatgaaagaaaaggagggacatcaggagggctccaaggtttctgactccagcaactggaagaaaaatccagaaggtttgtttgatgatgtgcctggtatggtgtagggtgatggcaacatttgccgtgtgctagtgggagtgtaaattggtacaattgaacagtaactaataacagccttcaaaaatacagaccttgtttattcagagcaaatcttaaatgcacatttttgagataactagagaaatttaattatgagaaatatgctgatttaagctagagagagagactgatgtattttataaatgaaatgatatgacatatgggttttgcttcacaatattccatgaaaaaaaatggtgggggcaggagtgatcaatgaaatacaatcagcaaaatgttgaaaactgttgaaactcagtctttgggtatgtttgacaatatcaataataaaaatatttcttaagtgtgcacaccctggacccagcaattccattgtaggaattcatcctaaaaaagaagagatacatattaaaagatatttattacagcctcatttgtaataatgaaaataggaaaacacaagcaataggcgattagctaaataaataatatgaagccatttagctgaaaaatagtagaaagattagaaattggtctgtatgcatgcagaaatttagtatataacgagtgacacttcaaataatggggaaagatgaatccaaaaaataacgtggggacaactaagtagatacctggaaaaaagtaagaatgaaactgcactccacaatttataccaaaatacatcccaaaacaatcaaagattaagtatattaaaacaaactcataattcctattacaaaaacatgagaatttttaaataattttaagagtgaataagggaggaaacacgaaccaaaagccataaaataaaagacagtaagttctatataaatcttaaaacgggccaggtgcagtggctcatgcctgtaatcccagcactttgaaaggctgaggtgggcggatcacctgaggtcaggagttcgagaccagcctgcccaacatggcgaagccccatctctactaaaaatacaaaaaattagccaggtgtggtggcaggcatctataatcccagctactcaggaggctgaggcaggagaatcacttgaacccaggaggcagaggtttcagtgagctgagatcgggccgctgcacttcagcctgggcaacaagagcaaaactctgtctcaagataaataaaacttaaaacatttgtcagggcaaaaatcaggataagctaagtgaaaaatcagaaacaaagtaaacatgtttgtaatttatgttacaaaagaggagctaatttccctcacattaaaaaatttatatatatagcatcaataagaacaaaggccaacaagccaaaataaaaatggtcaaagaacaagagcagacagttcccaaggccagaattacatatggcttttaaacatataacaccaagttcagcccaactcataatcagagaaatgcaaattaaaagtacatttgtatacttatatttcacctagaaggcagataaagatcaaatggtttgataacacacagtgtggataagactgtgtgaaaacaggccctctcaaacattagtgatgggagtgtgtgttactataaattctttgacgtgcaatttggcaatttatactggttataaatgcatactttaactcaatgattccacctctagaaatgtattattcaagcatacaaacacatagaataatatatgaaccaggctagtggctgtaatattgtgcggtgtgtgtgtgcgttatagatagacagatagatgaattttaaagatcatatttaatgatactaaggaattattgttacacctgttaggagtgatattggttctgtggggtttcttaagtcctcatatttttggagatatatgctaaaataattacagacgaaatgatataatgtctgggatttgctctcaaataatataggaagaaggagggttggtagctaggagtgtaaataaaaatgcttggttcaagttaaagcttagtgatggcccccttagcattcatgacactcaaatcttcataataaaacctcaactattaaaaagctcagaatcaactcaaatagccattaatagaaaagttaaataaactatgatacacccaaacaatggaagagtattgctatggtttgaatatggttcatgatttgtctcctccaaacctcatgttgaaattttatccccagtgtgtcaatattggaaggtggggcctggtgggaggggtctcggtcacgagggcagatccttcatgaatagattaatgccctccctcaggggtgagtgagttcttgctttattagttctctcaacagctggttgttaaaaagaacctggcaccaacactcccccaccccccaccaggcttcctctctcaccatgtgatctctttgcacacatccgctccccttctgcttcttgccctgatttgacacaacctgaggctctcaccagaggctgatgcccaattttgaactttacagccaccagaatcatgagccatataaacctgttttctttataagctacctagtctcaggtattttgctacagcaacacaaaatggactaagagctgttaaaagagtaagctaagcggattttatatcctgatgtggaatgacctgcaagatgtattgttaaatgaagaagccagatgcaaacagtgtgcatcaaatgtttaccatttacttatgaaaaaaagaagaaagactagaccaacgtgcttgttagatgggtcggtggtatagtggggagcgtagctgccttccaatgtgcttgtaaatattaggttggtgcaaaagtaattgtggtttttgccattaaaagtatggacaaaaccgcaattgcttttgcaccaacctaacgtgtagagtatgtctggataatacataagaaacagatattcctgggttgcctctgcagagggaaaccaggtgatggtgataaggaggaggagggacaggtgttatgagggacactttcagtatatgcttttctacctgttgaaatttgtaccattaatgcattatctatccacacaagtaaaatttgtgattgtaaaagtacacactaaatcattaacagtggttattgctgaaggatgggattgtgggtgatttttattttcccagtattccacaaagcacatatttttcttaggtaatttgaataaacaggttatttttgaagaggcaaaaatcaggaaatgacttaatcaaagagcttgtctcaatcagcaaacagaaagtaacccactaattcctagttacaggacattgccacagccctcttcctttgacaatcacacctcttggtgtactaagcacccatgggtcatcaaggatggcgtaggtaaggacatgatgctgagtgagatctgtttctgcccttaaagcactcgtgaaggggcagagtggagagagaggcagaaaagccagcagaccattacagcacgaggagataagtactataatatccataactgaagaaatctgaagagggaggtgggaaggggtcatgggaggaaactgatttttcagcggggatgtacaagatccttaaagatgaatggtaattggattcaagatgctatggtgatgattctgtttagtgtcaatgataaaatggctgactccatttgtgaattgacctcccctgatgattcagcactgaaacggtgcctaataatttgcatggtcctccagtggggagctgagctaaatttatttatcgctgctcttcatgcttttaaacttttaccaggtatcagaacaaaaatcttgctccattcccagattttggttactgttctaagtgaattcaatacccgaactgattctctaacagctttacctccactccattcaagaaacccaacacatgggcaaattctggatcttgccctgacctaacattgttcacactctaaaatttttaactctaaaatttcagtctcatcccatgacctcgtatttgcccaaccctgccactcccaccatctgctcatcaacaatccaagactttgactcttcagcatttctctggattgtcagccttcgttgtcccttcccactcaacccaactagttacgttgcctggaaccactctctttccaaaaccctaactccattacctcctagctctctgtgaatctgttctgtgcctctaaggagtctttccactcctgtggccagacacaattctttccccatcccacatgattgttgttcaagatctgcattatcctcttcaaaccctcaatcccatttcccaaatccatccccaaactctcagtgaataatgaagtcctccagtcgctcaatgtatatgcaatatatgtttattgatatatacaaataactcaatctacacaaaaacatattgatcaatatcgctctatagatgccccctcaacttaggataaggttatgtctcagtaagctcattataagttgaaaacatcacaagtccaaaatgcatttaatacacctaacctactgaacatcatcccttagtctagcctctcttaaacatgcttaggacacttccatcagcctaccattgggcaaaaccatctaacataaggccaattttataataaagtgttgagtatctcatgtaatttctgcaataccgtactgaaagtgaaaaacagaatagttctatgggtactcgaagtatggtttctactgggtgtgtgtcgctctcacaccatcatgaagtcaaaaatgtgtaagtcaagccattggggaccatttgaagttagttcattttcattactatagaacattccatctccagttaactgacatataggttgcttaaaaaaattatatgaagaatgccaccacaataaatatatgtttgcatcttgcacaggcagtgtttctcgccggcagctgcacagccagtctaccaggtgggggcccagaaaaaattatatcaacatatgctgaatctgcacttatatgctactggagtgtgttaactccatttctgacaatattgtatgtccccggctaatcaaatgagggtattagcatgcaagacggctctctccaagacaatgtagcccatcagaaaagttaaagtaggggtccccaacccccaggctacggaccaatttcggtctgtagcctgttaggaaccgggctgcagagcaggaggtgagcagcgggcgagtgaacattactgcctgagctccatctcctatcagatcagcagcagcattggattctcataggagcgggtaccctattgcgaactacacaagctagggatctaggttgggcactctttatgagaatctaatgcttgatgatctgaggtggaacagtttcatcctgaaaccatccacccacaactatccatggaaaagatggtcttccatgacaccagaccccggtgccaaaaagggtggagaccaccgagttcaagcattaagttcatttgatggacactacacaatgactaaaaataatgcttatagactcctaatgacgcgagaaatgttcgtaatttattgtcaagtggaaatacagagtcatgtgaccatcactttgactaatgagattatgccaaaaggatttaagaaccagcttgaagaggctactactatattaaaataaacaataacggcagtagcttataatctgttgaataaaataggaattaaagagtccatactgatatgaatgaatgaataagacaaggctcttacttacagaataatgccaaaaaatgttgaaaagatggtggacttagaaaaactgttgtatgattatcatatggttacacatggtaaccactttagtaataactgattcaggcaaaaatcactaatggacgctaaacctagtgggtaaaagtttgacgattatggatattcatatagtttcaaagtattttcccactgaacactaattacaaagggggaaagagccactttagagtggaaaagcctggcggactccacctgaattcaacaatcaaagtcaacatgaacagtaatgggtcaaatcacccctacatatcacctgattaggttccaggacaaggatacatcattattacttctgtgatatttctgcaaaagctgtataacttaatataactatgaaggaacatcagacaaatccaaaatgaggaatatgttacaaaataactggcctgtaaccttaaaaaatatccaagtggtgaaagtgaaaagctaaatgctacagtttgagtatgttctcttcaaaattcttcaaaattcatgctgaaatttaatccccattgtggtggcattaaaaggcattaaaaggcctttggggaagtggttaagtgatgagggctctgccctcttgaatggattagtgccttctgagaaggctggagggacctagcttaggccctttttgctcttctgttcttctgccatatgaggacatggcattccttccctccagagaatgcagcaacagggcgccatcttggaaggagagaacagcccttgccagacaccattcctgctggcaccttgatcttagacttctcaacttccagaattgtgggaaataaatttctgttctttataaattacccagtaatccaaggtattttgttatagcagctccaaaggactgagacactaaacaaaacacaaaacctaaggaaacttttcagatgggagaaaacagaagagacatcacagatggatgctaaattcagacacacctcaaagatattgcaggtttggttctggactactacaataaagcaagtcacaccaatttcttggtttcccagtgcatataaaagttaaatttacattatacttttgtctattaagtgtgcagtagcattatatctttaaaaatgtacttttatttaaacatattttattgctaaaatatatgaacaatcatctgagcattcagcagttcataatcttttactggtagaaggtcttgtctaaatgctgatggctgctgactgatcaaggtggtggttgctgaagtctgaggtgcctgtggcaatttcttaaaataagacaacaatgaatttggccgcacatagatggactcttcatttcataaaaaaattaatctgtagcatgcaatgctgtttgacagcattttacccacagtagaacttatttcagaattggagtcaatccttttaagccttgccactgttttattatgtaaagaatatgctgatggaatattctacaacgttcacaatgccatttcaacaatgtttacaaagcatctttaccaggagtagattctatttcaagaaactactttcttagctcatccataagaagcaactccgcatccattcaagtttgatcatgagattgcagaaattcagttccatctttaggatccgcttttaactccccttctcttgctatttccaccacatctgcagcgacttcctccactgaagtcttgaacccctcaacatcatccatgaaggctggaatctacttcttccaaactcctgttaaatgttgatattttggcctcctcccatgaatcacaaatgttcttaatggtattgagaacagtgaaacctttccagaaggctttaaatttacattgcccagatctatcagaggaatcactacgtatggcagctatcgccttatgaaatgcgtttcttaaatattaagacttgaaagtttaaattttaactccttgatgtatgggctgcagaacggatgctgtgttagaaggcatgaaaacaacattcatctccttgtacatctccattagagctcttgggtgaccaggtgcattgtcaatgagcaggaatattttgaaaggagtcttttcttctgagcagtatttctcaacagtgagcttaaaatattcaataaaccatgctataaacagatgtgctgtcatccaggctttgttgtttcatgtctagagcataggcagaatagatttactatcattctgaaggtccttaagatttgggggatggtaaatgaacactggcttcagcttacagtcaccagctggactggcccctcacaagagtcaacctatcctttgaagttttgaagccaggcattgacttctcctacccagctatgaaagtcctagatggcatcttattccaatagaaggttgttttaggctgggtgcagtggctcatgcctgtaatcccagcactttgggaggccgaggtgggtggatcaccttatgtcaggagttcaagaccagcctggtcaacatagtaaaaccccatctctactaaaactacaaaaataagctgggcgtggtggtagatgcctgtaatcccagctacttgggaggctgaggcagggagaattgcttgaatccaggagggcagaggttgcagtgagccaagattgcaccactgcattccagcctgggcaacagaaaaagactctgtctcaaaaataaataaataaataaataaataaataaataaagggctggttttttctgcattgaaaaatctgttgttgagtgtagccaccttcatcaattttcttaactggaacttcttgataacttgctgctgcagcttctacatgagcacttgttgcttcaccttgtacttttatattatggagatgacttcttaaacctcatgaaccaacctttgctagcgtcaaactttttttctgcagcttcctttcctctctcagccttcatagaattgaaaagagttggggccttgctcactctggattaggttttggcttaagggaatgttgtggctggtttaattttctatccagacctctaaaactttctccatatcagcaataaggctgctttgctttcttatcatttgtgtgtccactagagtggcacttttaatttccttcaagtacttttcctttgcattcgcaacttggctaactctttggctcaggaggctagctttcagtttatctcagcttttgtcatgccttcctcactatgcttaatcatttccagtttttgatttaaagtgagagacatgagactcttcctttcacttgaacacttagaggccactgtagcattactaattggcctaatttcagtgttattgtatctcagggaatagggatccccaaggagagggagacagatagggaagggctggttggtggagcagtcagaacacacacaacatttattaagttcaccattttatatagatgtagtttgtggcctcaaaaaaatcacaatagtaacatcaaagatcactgatcacgatgtaagaattaaagaaagaggaaagaaacatgaaatgtggctcaacagttaaggacaggtttattttagagaaaacaaacctgagaggggcttctggccaagttaggtcagagagcccttctctcttacacactaagtatatttaagggttttggaaaggggggcttgtcataggtttggaatgtttctatgtgaaggaaagtttattgcagggttggagtgtctctggtcggaggggagcctatctcagggttggtatgtttctggtcagagaggggtttatcttagggttgggatgtttctagttatgctgacattagccattaggctgatgttttggggctggatttaggtggtttttaaagagaacttacaacggtggtgttttgttcaagatggcgatgctcctgctctgtcacacagatcatcctaacagatataataatgaaagcaaataatgaaaaagattgaaatatttgttggaatcaccaaaatgtgacccagaggcacgaagtgagcacatgctcttagaaaaatgatactgacagacttgcccaaccacagggttgccacaaacctttaatttgtaaaaaacaaacaaacaaaacaaaacaaaaaaacacagtatctgcaaggtgcaataaagtgaagtataaaatgtggtatgccagtatgatcctggattgaatgatttagctgtaaaagaaattatttggataactggggaaatttgaatagagtctgtggattaggtggtggtatatgatgttaagttttcttattctgatggttatagtatgcttatgctgtagcgtctttgtgaaaaatatactctagcatattcaacagtggaggacatcacgcctgctgcttactgtaaaaaagtttagaaaaagaacaaattttagtataaatgatataaatatagcatatctatttgagagagagagagaatgatacggaaatgtgctccaatgtctacaatcaggaaatctgggtgaaagacatataggatttctttgtactgttcatgcaactttctgctatttttgaaattatttaaagtaaaatagtaaaatgaaaatagactatgggatggcaacttaattatatccatgtggtgaaatattacacacattcaaaaaccacatttagtaaatgacatgagcaaatatgttttcttaagaaatcagtatataaaactatatgtgtaatatggcttaacctgtcaaaacatgtgcctaagggaaaaagacataaaggaaatatatgacatgtaaagatggaattatcatcaaatgatgctaattctagatgatcatgtatttttattttggatttttttttttaaacgtctccaggtgtctggctcttttaagaagaacaaaatgttattctacaaaatgaaaccaacaatgagtaaactggaggctcgaatacaagtgttctctccatgctggggagcattttcccgacgccatctgaagcctcagagtagaaatcttgtttcacaaaattcaaagcttctgttcttacacctgattcctcgggaaactcttttctcctacttgtattaaccaattcagctgtgaggagcaaaggagacggggactgcccttagctgggctctgaaggtgcgtattttagcaccggctgagaactgagttagctaatcttcaaagaggctgcctgccatcccattcaacaacataaaaagcaatttgtttacgggaagaaaagccatttcaacatgaaaattggtttcacgacaatatgcctgataaaacagcacatgaaagaaccattggtcggcctctctcccctgggtccccccacaatccccgcccttaccctttctttcagaactgtcaccataatggaaaaggaagttatctcaatggaaaaacatgctggaacacattttacctctggagtaatgggccaggactgcccacacattcaatgaaaaacaaaatatttggtcattctgctccttctacccgaacgcattcgaaagcttgcaatgccatcatctagcgttcaatctcaaaaattcatccttgactccttcccttcttgttgatggtacctccagcatccagagtggtgtgtcaaagacatcacgtctaatcacgctttgcttcagcttcaaatttctcactggctcccattcactcatatattcaacaagcaggttgctattccacaccaggccagagcccatgggcatccggcaaggtcacatccatcccctctttgatgtcccaggcgcttccagaactgggccatgtacaccttcttctaagcacctcagccccatgcctaccatcttctaagcacctcggccacacccaccctcttctacccacctcagccacgcccaacctcttctgcccacctccaccatgcccaccctgggtcttctactcatctcagccacgcccaccctcttctaagcacctcagccacgcccaccctcttctacccacctcagccacgcccaccctcttctaccaacttcagccacacccacccctcttctacccacctcagccatgcccaccctcttctaagcaccttggccatgtccaccccctcagccatgcccaccctcctctacccacatcggccacacccctttctaagcacctcagtcaagtctaccctcttctaagcctctcatccatgcccaccttcttctaagcacctcggccatgtccaccctcttctaagctcctcagccatgtccatcctcttctaagctcctcggtcacctccaccctctaggaacctcagtgctctgcccctccttaacccaccctacagagctgatggctgtatttggagcaggccttcactttcaggactatatactatgttgctacttcccttatctctctttgcaaatgacaaacacctatttattctttcagatttactgagtcaggtctcctactaagccctctttaggaagagggagaagaggcccctctcctctgtaatctcgttggaatatttcaccactgttgggggaggttaggaaagcatgctcagaagtgtcctgtaatctcagcaattcgggagactgaggtgggaggattgcttcaggccaggagtttgaaaccagcctgggcaacaaagtaacaccctgtctctgcaataaatttaaaaattagctgggagtggtgctgaacacttacagtcccagctactagggagactgaggcaagaggatcacttgagcccaggagttcaaggctgcagtgagtcatgattgcacaacttcactccagcctgggtgacagagtgagaccttgtctcaaaataagagagagagagagagagagagagagagaagaaagagaggaacagagaaagggagaaggaaggaagggagggagggagggagggagggagggagggagggagggaggatggaagaagcgaatgaaggaagcaagcagccagaaccagagtcccacctccttctgctgctcctgtggacctgcccagacaattttagcacacgcagctctacagtgagacccactcagaggaaatcttgctgaaagtatttccctctccctcctatcaaaggaagacaagggcagaagccccctcagggattacaccccaaccttggcaggcagggtgtggccagtctgggcctatgtggcctatgtctgttgaatggtaggataaatgaatgaacagaggcaaccctggttggctcttgagtggtgtgagctggtcctgtacccagatactggggtggccttggcagggccctggaaccaaatgagtgttcaagacaacctcctatcggagctcatcaacttccaggacaggagagaatgtgtcactgcctctctcatgcacagtcctgggggaaagctggcaagtacatcagggctgcctgcctgtccagcccagggcgctggggccttgctctgcagtcctgtggcagctggttccccacctgggaggaggaagacagccccattgtgaatgtctctaaaacaaaaggtagaagatactagcctcctagtgtggaccatggcagactcaagctatagcaactccatgggctaagcatgaactggtgctgtgctgtccctcaacccaaggccaaggtcactggctccagcctctctgcgtcctgagaaaagtagcaacaattatccaatagaaaaattaatctcactggatgcggtagctcatacctgtaattccagaaatttgggaggctgaggtgggagcatcacttgagcccaggaggttgcagtgagccatgattgcaccactgtactccagcctaagtgacagggcatgatcctgtcttaaaaaaagaaaagaaaaagaaaaaaaggccaggtgcagtggctcacacctgcaatcctagcactttgggaggctgaagcaagtggatcacctgaggtcaagagttcgagaccagccctggcaacatggtgaaacccagtctgtactaaaaatacaaaaattacctgggtgtgatggcactttgagaccaccgacccttcggctaggcctatgcacgtgtcccaaaacaaccttttgtgtccgagggctcaaaactccaccctcagatgatgctaacatcaccattttttttttcaagacggagtttccatcttgtcaatcaggtaggaatgcaatggtgtgatctcagatcactgcaacctccgtctcctgggttcaagcgattctcctgcttcagcctcctgaggagctaggattacaggcatgcatcaccatgcctggctaatttttgtatttttagtagagacagggtttcaccatgttggtcaggctggtctccaactcctgacctcaggtgatcctcccatcttggcctcccaaagtgctgggattacaggtgtgagtcactgtgccgggccaacatcaccactttctacagatgggccctatgtcaaaacatgaggcttgattacacctgcacagtgatctgttttggatgcttgtcccctccacatttcaggttgaaatatgatctgcaggggtggttccaagatggccgaataggaacagctccagtctacagctcccagcgtgagcgacgcagaagacaggtgatttctgcatttccaactgaggtaccgggttcatctcactggggattgtcagacagtgggtgcaggacagtgggtgcagtgcaccaagcatgagccgaagcagggtgaggcatcgcctgacctgggaagcacaaggggtcagggaattccccttcctagccaagggaagaagggacaaatggcacctggaaaatcgggtcactcccaccctaatactgtgcttttctgacggtcttagcaaacggcacaccaggagattatattccgtgcctggctcagaggatcctacacccatggagcctcactcattgctagcacagcagtctgagatcgaactacaacgcggcagcgagctgggggaggggcacctgccattgctgaggcttgagtaggtaaaaaaagtggccaggaagctcgaactgggtggatcccactgcagctcaaggaggcctgcctgcctgcctctggagactccacctctgggggcagggcatagccgaacaaaacgcagcagaaacttctgcagacttaaatgttccagtctgacatcttggaagagagtagtggttctcccagcacggagcttgagatctgagaatgaacagactgcctcctcaagtgggtccttgacccccgagtagcctaactgggaagcaccccccagtaggggcagactgacacctcacacggctgggtacccctctgagatgaaacttccagaggaacgatcaggcagcaacatttgctgttcaccaatattcgctgttctgcagcctccgctactgatacccaggcaaacaaggtctggagtggacctccagcaaactccaactgacctgcagctgagggtcctgactctcagaaggaaaactaacaaacagaaaggacatccacaccaaaaccctatctgtacgtcaccatcatcaaagaccaaaggtagataaaaccacaaagatggggaaaaaacagagcagaaaaactgaaaattctaaaaatcaaagtgcctctcctcctccaaaggaatgcagctcctcaccagcaacagaacaaagctggacagagaatgactttgacgagttgagagaagaaggctacagacgatcaaacttctccgagctaaaggaggaagtttgaacccaacgcaaagaagttaaaaaccttgaaaaaagatgagacgaatggcttactagaataaccaatgcagagaagtccttaaaggacctgatggagctgaaaaccatggcacgagaactacgtgaagaatgcacaagcttcagtagccgattcgatcaacgggaagaaagggtatcagtgaaggaagatcaaatgaatgaaatgaagctagaagagaactttagagaaaaaagaataaaaagaaatgaacaaagcctccaaaaaatatgggactatgtgaaaagaccaaatctacgactgattggtgtacctgaaagtgacggggagaatggaaccaagttggaaaacactctgcaggatattatccaggagaacttccccaatctagcaaggcaggccaacattcaaattcaggaaatacagagaacgctacaaagatactcctcgagaagagcaactccaagacacataattgtcagattcaccaaagttgaaatgaagaaaaaaatgttaagggcagccagagagaaaggtcgggttacccacaaagggaagcccatcagactaacagctgatctctcggcagaaactctacaagccagaagagagtggggaccaatattcaacattcttaaagaaaagaattttcaacccagaatttcatatccagccaaactaagcttcataagtgaaggagaaataaaatactttacagacaagcaaatgctgagagattttatcaccaccaggcctgccctacaagagctcctgaatgaagcactaaacatggaaaggaacaactggtactagccactgcaaaaacatgccaaactgtaaagaccatcgaggctaggaagaaactgcatcaactaacgagcaaaataaccagctaacatcataatgacaggatcagattcacacataacaatattaactttaaatgtaaatggactaaatgctccaattaaaagacacagactggcaaattggataaagagtcaagacccatcagtgtgctgtattcaggaaacccatctcatgtgcagagacacacataggctcaaaataaagggatggaggaagatctaccaagcaaatggaaaacaaaaaaaggcaggggttgcaatcctagtctctgataaaagactttaaaccaacaaagattaaaagagacaaagaaggccattacataatggtaaagggatcaattcaacaagaagagctaactatcttaaatatatatgcacccaatacaggagcacccagattcataaagcaagtccttagagacctacaaagagattagactcccacataataataatgggagaatttaacactccactgtcaacatcagacagatcaacaagacagaaagttaacaaggatatccaggaattgaactcagctctgcaccaaacagacctaatagatatctacagaactctccacccaaaatcaacagactatacattcttctcagcaccacactgcacttactccaaaattgaccacatagttggaagtaaagcactcctcagcaaatgtaaaagaacagaaattataacaaactgtctctcagaccacagtgcaatcaaattagaacttaggattaagaaactcactcaaaaccgctcaactacacggaaacaacaacctgctcctgaatgactactgggttcataacggaatgaaggcagaaataaagatgttctttgaaaccaacgagaacaaagacacaacataccagaatctctgggacacatttaaagcagtgtgtagagggaaatttatagcactaaatgcccacaagagaaagcagggaagttctaaaaatgacaccctaacatcacaattaaaagaactagagaagcaagagcaaacacattcaaaagctagcagaaggcaagaaataactaagatcagagcagaactgaaggagacagagacaagaaaacccttcaaaaaatcaatgaatccaggagctggttttttgaaaagatcaacaaaattgatagattgctagcaagactaataaagaagcaaagagagaagaatcaaatagacacaataaaaaaagataaaggggatatcaccaccgatcccacagaaatacaaactaccatcagagaatactataaacacctctacacaaataaactagaaaatctagaagaaatcgataaattccttgacacatacactctcccaagactaaaccaggaagaagttgaatctctgaatagaccaataacaggctctgaagttgaggcaataattaatagcctaccaaccaaaaaaagtccaggaccagacagattcacagccgaattctaccagaggtacaaggaggagctggtaccattccttctgaaactattccaatcaatagaaaaagagggaatcctccctaactcattttatgaagccagcatcatcctgataccaaagcctggcagagacacaacaaaaaaagagaattttagaccaatatcccggatgaacatcgatgcaaaaatcctcaataaaatactggcaaaccgaatccagcagcacatcaaaaagcttatccaccatgatcaagtgggcttcatccctgggatgcaaggctggttcaacatatgcaaatcaataaatgtaatccagcatataaacagaatcaaggacaaaaaccacatgattatctcaatagatgcagaaaaggcctttgacaaaattcaacagcccttcgtgctaaaaactctcaataaattaggtattgatgggacgtatctcaaaataataagagctatctatgacaaacccacagccagtatcatactgaatgggcaaaaactggaagcattccctttgaaaactggcacaagacagggatgccctctctcaccactcctattcaacatagcgttggaagttctggccagggcaatcaggcaggagaaagaaataaagggtattcaattaggaaaagaggaagtcaaattgtccctctttgcagatgacatgattgtatatctagaaaaccccattgtctcagcccaaaatctccttaagctgataagcaactgcagcaaagtcccaggataaaaaatcaatgtgcaaaaatcacaagcatgcttatacaccaataacagacagagagccaaatcatgagtgaactcccattcacaattgcttcaaagagaataaaatacctaggaatccaacttacaagggatgtgaagacctcttcaaggagaactacaaaccactactcaacgaaataaaagaggatacaaataaatggaagaacattccatgctcatggataggaagaatcaatatcgtgaaaatggccatacagcctaaggtaatttatagattcaatgccatccccatcaagctactaatgactttcttcacagaattggaaaaaaactactttaaagttcatatggaaccaaaaaagagcccacattgccaagtcaatcctaactcaaaagaacaaagatggaggcatcacactacctgacttcaaactatactacaaggctacagtaaccaaaacagcatggtactggtaccaaaacaaagctatagaccaatggaacagaacagagccctcagaaataatccacacatctacaactatctgatctttgacaaacctgacaaaaacaagaaacggggaaaggattccctatttaacaaatggtgctgggaaaactggctagccatatgtagaaagctgaaactggatcccttccttacaccttatacaaaaattaattgaagatggattaaagacttacatgttagacctaaaaccataaaaaccctagaagaaaacctaggcaataccattcaggacataggcataggcaaggacttcatgtctaaaacaccaaaagcaatggcaacaaaagacaaaattgacaaatgggatctaattaaactcaagagcttctgcacagcaaaagaaactaccatcagagtgaacaggcaacctacagcacgggagaaaatttttgcaatctactcatctgacaaagggctaatatccagaatctacaaagaactcaaacaaatttacaagaaaaacacaaccccatcaacaagtgggcaaaggatatgaacagacacttctcaaaagaagacatttatgcagccaacagacacatgaaaaaaatgctcatcatcactggccatcagagaaatgcaaatcaaaaccacaatgagataccatctcacaccagttagaatggtgatcattaaaaagtcaggaaacaacaggtgttggagaggactgttacactgttggtgggactgtaaactggttcaaccattgtggaagacagtgttgcgattcctcagggatctacaactagaaataccatttgacccagctatcccattactgggtatatacccaaaggattataaatcatgctactataaagacacatgcacacatatgtttattgtggcactattcacaatagcaaagacctggaaccaacccaaatgtccaacaatgatagactggattaagaaaatgtggcacatatacaccatggaatactatgcagccataaaaaataatgagttcatgtcctttgtagggacatggatgaagctggaaaccatcattctcagtaaactatcgcaaggacaaaaaaccaaacatcgcatgttctcactcacaggtgggaattgaacattgacaacacttggacacaggaagggggacatcacacaccagggcctgttgtggggggaggggggagggatagcattaggagatatactaatgtaaatgacgagttaataggtgcagcacaccaacatggcacatgtatacatatgtaacaaacctgcatgttgtgcacacgtaccctagaacttaaagtataataaaaaaaaataaaaaaaaaaaacaaccaaccaaccaaccaaacaaacaaacagaaaaaaaaaaaagaaatatgatccacagtgttagagatggggcttggtagatgatgtttggatcgtgaatggattggtgcccatcccacagtaatgagttcacatcaaatgtggttgtttaaaaaaaaaaaaaaaaaagtctgggccaggtgcagtggctcacttgtaatcccagcactttgggaggccgaggtgggaggatcacttgagcccaggaattcgaggccagcctaggcaacatagcaagaccccatctctacaaaaaagtaaaaaaaagaaaaaaaagaaaaaagaaaaaaagaaaaaaaaatagccagctctggtgcctgtagtcccagctactacttgcaaggttgaggcaggaagattgcttgagcccaggagtttgggtctacagtgagccatcattgtgccactgcactccaccttgcagcctgggtgacaatgtgaggacctgtctcaaagaaaagaaaaaagaggctgggcatggtggctcacgcctgtaatcccagcactttgggaggctgaggcaggcggatcacctgaggtcaggtgttcgagactagccaggccaacatggcaaaaccccatctctattaaaaatacaaaaattagccagcaatggtgacaggcacctgtaatcccagttactcaggaggctgaggcaggagaatcattggaaccctgagatggaggttgcagtgagccaagatcataccactgcactccaggctgggtgacagagtaagacaccaccaaaaacaaaaaaaagaaagaaagaaagaaaaaaaagaaggaaggaaggaaggaaagaaggaagggagggagggagggagggaggaaggaaggaaataataattaaaatgagcctagcatctcctgctctttctcttgttccctctctcgctctgtgttatgctggtttcccttcaccttctgccataagtataagctccctgagtcctctccagaagcagatgctgacactatgcttcctgtacagcctgcagaaccatgagccaaataaacctctattcttggccaggcacagcggctcgcatctgtaatcccagcactttgggagaccgaggcgggtggatcacttgagaggtcaggaataccaaaccagcctggccaacgtggtaaaaccccgtctctactaaaaatacaaaaattagctgggcgtggtggcagtcgcctataatcccacctactagagaagctgaggcaggagtatcatttgaacccagaggtggaggatgcagtgagctgagatcacgccactgcactccaggctgggtgacagagtgagactgtgtctccaaaataaataaaattaaaattaaaaaacccctctattctctataaattacccagcctcagatatttctttatagcaacacaaaaacagattaacacacacagaaaccctgattagctcacctttcccaccctcccctcaccgttccccacactttagaccatgctgccttctatcccataatactcccattccctattttcagggaggcagatttgagatttgttctcctatctcctcacacagcactgcattgtgaaatcttttctcttttgcaaaaactcattaccacagtgattggcttcttgcacatgggcagaaaggacctggtcactaacaggcactgctataggagttaccaggacaggccaggcaccgtggctcatgcctgtaatcccagcactttgagacatggaggcgggcagatcacctgaggtcaggaattcgagaccagcctggccaacatggtgaaattcttgtctctactaaaaatacagaaaaaaaaaaattagccaggcatggtggcagatgcctataatccaagctactcaggaggctgagggcaggagaatcagttgaacccaggaggcaagaggttgcaatgagccgagatcgtgccacactacactccagcctaggcaacaagagtaaaactccatctcaaaaaaaaaaaaaaaaacagatagaagttaccaggacagacagtagctgccttctgttgagcagaagatcttcacgaatcttttgcatatgcaagatggagcccaagttccaatttgcttgagggggcctaaattatttgaatcaataaataaaaaggaaactgagttataaaatactttgtatgttttaggaatggatccagtgcctgggatagaggattgaagaagccaggcaaggtccctgttctcccaaaacttatgttctagggggtttactcacaagtaaacaagaagaatgtttcagatggcagcaagtgctattaaaaaaaacactgataaagcaggcagtgtgctgagatgaccgggagggtaagaggctctcccttgagataaacatcagggctgagactcatatagaaaagggagccagccatgtggaatggagtggcagagctgcctaggcagggaacaaccaatgcaaagatcttgagagggtgagcttgatattggcagagcagagagaacgtgagaggggctgagaaaggctacattgggcctctccacctaccagccatatatactcttgggcaagtttcttccttctgtgtgtctcagttttttcatttgtaaaatgggaatgttactaacatcaatcgtgtaagtttaaggactcagtaatgtaaaacatgcaaagtatacttgtccagcatagagtagatgctcaataactatttgctgtgatgatatgatgatgatgatgatgatgatgatgatgatggtgacgatgacactgttgtcatgagcctgcatcatgaggctgttcacaatgacaaaagccttaggcactatctaccagctggccatattatcacccttggccctcacactgccttcccgtccttgctatctccctggttagattctcacaagctcatcattgcctgtaagacgatcctgtatccatttgttagggctgccataacaaaggaccacaggccaggtggcttcaacaacagaagtctattgtctcactgttctgggggctagaatttgccatcaaggttatatgtagggttggtgccctccaagggccttgggcaagaatctgttccatgcctccctctgctcgcttcttggagtctgctggcaatctttagcgttccttggcttgtagatctctgccttcatcttcacgcaatcttctaatgttcttcctgtgtgtgtctctgtcccaatttccccttttataaggacactagtattagactagagccatcctaatagtctcattttacctcgattatctcagtaaagatcctatctctaaatgaggccacattctgatgtacttgagggttggggcgccaacatattattttttgggaggacacaattcaaccccgtaatagacccacacgtcacattcaggagtctatcatcagtgctgcctcccacttgggggaccctttccaatgcgctaccttctcccacatcctgctctcagccagggaacgttctgaatgtgcctgcaagactaaccagctaccttccacccatgtgcctgcccagcagatatcgtttttgttgttgttgttgttgttagagacagggtctcactccatggtgtaggctggagttcagtagcacagtcatagctcactgcagccttgaactcctgagctcaagagatcctttgatctcagcctcccgagtagctgggactacaggtgcatatcaccacacctggctatttttattttttatttttatttttattcttttctttttttttttttttcaagacagaatctcgctctgtcgcccaggctggagtgcagtggcgtgatttcggctcactgtaacctccatctcctgagttcaagtgattctcctgcctcagcctcccaggtagcttggattacaggcacccactactgcccagctaagttttgtattttagtagagatggggtttcaccatgttggccaggctggtcttgaatgcctgacctcaagtgagacgcctgccttggcctcccaaagtgctgggattacaggtgtgagccgccatccctggtctatacattctttccaaacccaaagctatgaagagatttcataggtctctgcctcccctatggggagaccagggttctctgtgaaaacaaaacaaaacaggatgttctgtttatgccaagatgactgtggcttcaaggccttccctctcacatctgcacccatttctgttggtgtctgatttcctgtgagagccctagagagctacgatcttcacatagctggagtttgcatggtgcgagagagcaacacatgaaagagatctttctagggcttcttcagtccattagcatctgatgactagtgaccagtttgatacaacctatctacctgccaggaaccacaggtctcagcagtccacaagcccagcaataggaacaacactgaggaatccatggttatggtcctagaagcagaaacttgagatgtttcccggccaaagctggtgcacattgccctccaggaaaattcaggtcctcagacttcaattcccagctaccagccgagagagaggcaccagagaggattagagtttttcctagtttttcttaggttctaaacgtgacaggaagcattccccaggctacagacttgttcctctaggctgtacaaaatctgattcaggtctttccaagctgggaaaggttatctgaggtcactccatgggggagaagaataaacaactccaaataaggcactgtttgtccccagactgttccttgccagttggacaaacacactcaaatacaaagctgttttgtcagtatctgagctatgtccctttcatggctgagtatcaatcaaagcaaccactagaacaggctagaacctcagtgttcacactgggctcccccggctaccagaatcaagccacttttcctataaatcagtcacaaacagtgaatgttaagactggcacttcttgcttagagacccaaattctgttccaagaagagtatttaaggatcttcctctaacaccccttggctgcagcaatcttacctgccaggggacattattacagcaagatcacacctacgcgtgggctgctccaccaaaaaatatgcccactgttccagtaggagagatcctgcctctctctgcccttggggaacctctagggcagacgtggtggcaggatcttggtcagaaattgtctacctgctgccagtactggatttctggaaagttgtcagccaggtgcattggctcactcctgtaatcccagcactttgggaggtcgaggtgggaggactgcttgaggcaaggagttcaagtccagcctgggtaatataacgagaccttgtctctacaaaattaaaaaaaaaaaaaatagccaaggatggtggtatgtgcctacagtcccagctactcgggaggctgaagcagaaggatcacttgagccggagttcaaggctgcagtgagccatgattcgtcactgcaccctagtctggccaacagagtgagaacctgtctctaaaaaaataaaaagaaaaaagaaaaagaaagttgttagaaaaaggccctctctgagtaaggggaggtctgtatggtgccctggcctttcatcgcaggacatccactgggtagtttctgccactgggcacttgaaggatgctttgaagcactctgcctagtatcagcctgggagctggtcctggctaacctgggctttggtggttagaatgatttttaaatgtgcccagtgctcttgacatgagactttcatttttccaaggcagcctgaaccactaacaattcgcatttcggggcagtggagtggacactggcccagagtaacttctctgtgaattggacactaggagggaggtctccaagactggatctcatgatgagatgtccctgcaatggtgttggaagcatcccttttaccaggaaagcctcaggctagatcacagaaggctgggattgggaaaatagaaatggcttcaactcctagaaagataaaataatgacctagggccagacaaactgcttcttttaactaaggagggaagtaaaattaaaaaaaaaaaaataggggcatactacgggattatggacaccttgtccagcgtcatgcaaaatgccttggccaagccaaacttgaacttgaacttaactctcaaagctcgccatctacatgtctgacgactggcccagaagaattcatttgccgtcagtgaaagactggccaaagatgcttgatgaaaagtcctcaaatatcccgaattagcctctgaagctctggattataaaagcagaaggtaaactcacatgggtaccatcttgaggataccaatgtgtcagcaatgtctctacacaacactcttatttgcaaagggcactgaacacccgagatgtaaatggcctgagaaacctttaccctttttgccctgatataaccacagagggcctctgtgtctccctctactaaaactcagatgttgaagtcctaacctccagcagggcttttaaggaggttatggggttaactaaggtcatagggtaaggcttaatccgataaggctggtgtccttaataagaagaggaagagagccaggcccagtgtctcatgcctgtaatcccaatgctttgggaggctgaagagaaaggaggattacttgagcctaggagttggagaccaactcaacataatgagagcaacataatgagatcctgtctctacaatttttttttttaattagctgggcatggtggtgtgtgcttttagtcccagctactcaggaggctgaggtgggaggattgcttgagcccaggagtcggaggctgcagtgagctatgatcacaccactgcactccagtttggacaacagggcatgatcatgtctctaaaaaaataatgataattaattaatttttaaaaagaaaaggaagaaacaccagggatctcactttctctccctgcatgcccagagggaaggacatttgagggcacagtgagaaatgaccatctgcaaggcagaaagagaggcttcaccagaaaccaatcttgccaacaccttgggcttccagcctccagaacagttagaaaatatgtgttgtttaacaaggtcaggagatcgagaccttcctggctaacacggtgaaatcctatctctactaaaaatacaaaaaattagccgggcgtggtggcaggtgcctgtagtcccagctactcgggaggctgaggcaggagaatggcttgaacctgggaggcggagcttgcaatgagccgagatcacgccactgcactccagcctgggcgacagagcaagactctgtctcaaaaaaaaaaaaaagagagagagaaaaagaaaaagaaaatgtgtgttgtttaagccacccattctgtgacacttggttatggcagcctgagcagacgcatagagcttcatttggagttccaaaagtgagtgatcctattggccagagaccctttgtactagggagggctataatgccaaccaaggggcaatatattagtttcccatttctgctgtaacaaattaccctaactctatggcttaaaaccacacaaatttgttatcctatagctctggatgtcagaggtccaaagtgagtcttatggggctcaaagcaaggtggtagctgggatggttccctctggaagctcagcaaataatccattccttgcctcttccagctcccagacaccaaccatggctccctcctccaccttcaatgccagctgaatagcattttttcctctctctaatctcctgcctcactcttataaggacccttgtggttacattaaacccactcagatactccaggagaatctcttaatcacatctgcaaagtcccttttgccatagaaggtaacatattcagaggttccaaggttaggacatgaacatctttgcaggggccatcattcagctaacataggcaactagtggtccaaaatcacccaatgagattctctagaagaggacaaaccaaggagaacctggaaggccatcagggtccagcaatggacttccatgtttaagcaaaaaaatggcatgggcttaccaaataatggaagattgttttcctaaggaaaccaagcaatagaaggattataggcaaaactgcttggataggacaggaccagctgctcagaaaggacccctgaatacagaatgctgtgaagagccccctgtatcttcagaccatggtgcaaagaggcactctccggcagcatctgcccaaatgtgggcacctgatggagagtaggcagtcgggcccacaacactaggacccaagccacaaagcctgactaatgctcacactgactggcctggaggcaagactccatcactgcctctgtgcctggaagccagcacagagccatcccttggggaagggccccatgagtccccatgtcaccaccgtagcgacctacaggcagagcttggtgcagctcaagctgggcatcccaacacattgggccatgctcaccaccatccagacataagcgccctactggggcaaagtgttctgtttgtatcataatctcctcactctgagggatgcacctcccgtggtgggagtgctctgggggacagagacacagaagccaccagttccttctaaagctgcttcaggatgatggggctgaatatcacaaccccacctgcaaaaacctcagaggcagagacttcaaatcacaaagcacttcatgcacttgtaagtctctgtgagtggtgatgctgagtgttgagaggatgccaggattactaccaagacataacctctgcctacagagagctgtgattgccatggttgagacagatgctcatgaaatgacataaacgccagtcaaattgatggaagtataaaacaatgtactaatttattaacaaataccagcagaatgtacaaaccaatcggttgagcccatctgtcctagtgggagatcttgatcgatgacatgggaactactggtcagagctcattcattcattcattcacttacccatttggcaaatatttgttgaatgcgttgcatgccaagtactgcacacaacaacgatatgcaaagatgaataagacatggtccatgtcctcaaaaattcctgatctaggaagatagacaagtaccttaaaatacgctggctgggtgcagtggctcacacctgtaatcccagcactttaagaggccaagacaggaggagcacttgaacccaggagtttgagaccaacctgtgctacgggaggactcaggggcttccaacaatgcctagtgagagaaaggtccggaaagtttcccagagaaggtgacatttccactgaaatgtgcttccagagaaggatttaatcatgtaaagtgagaaacaaaaagacttttaggaagacaggggaaaaaaaaaacagggtatttttgaaaaactgaagaaagttccagaaaactggaggagaggaggaaggagaagtggaaatggagggacagacctttccaatttccagaagatatgaattcacctcaggggcaaaggaaaaccatttgaaagttagtcagttagtttgtttgtttgtttgtttgtttttgaaagagttttgctcttgttgcccaggcaggagtgcagtggcacaatctcggctcactgcaacctgtgcctcccccattcaagcgattctcttgcctcagcctccagagtagctgggattacaggcacccgccaccatgcctggctaatattttttatgtttaatagagacagggtttcacaatgttggccaggctggtcttgaactcctgacctcagctgatccacccatctcggcctcccaaagtgctgtgattacaggtgtgagccactgcgcccagcccatttgaaggttttaagagaagattcacagaatcagatttatatttcactcattcagccagccaagacatatttagtaagtacctttgatgtgagaggctctgctctaggggataaaagcaggaacaaaacagacaaggtctcttccgtcatgtagtttacattatcatgagagatgctgacaataaataactaagcacataaattaatacaataattaaacactttggaaacatccccctggcagcagcaatgtggggagaatggattgaaaggaagcaagaccagaaacaaagagaaagagtaggaggccctggccgtagtccaggcaggagatgagtttgcatgaggcagatcatattgaatgcctcccccaaaatattccttccccactccacctctccaatccaaccttcgtcctggccagcagaacctgcttcccacaccaacagctgaaaatgccagaaactcactttcacagccttgtttagctacagtgtggagaagtgacccaatcatggccactgagacctgagagtaaggctacagagggccctcatgggtaggctttccttccccgtaaagagtgacatgacacagcaagacacatccctcttctttgcttgatgtgtatctgcaagtcgtgctgagaactgttgctggcatcttgtgatgctgaggactgaggcattaagggtagtggagcgagtagtttgaaagtacccgagtcttgatgccatttttgactcactaaatcagccctgtagctgccctatctcttacctcttattatgtgagatttatttatttatttgtttgtttgtttgtttttgagatggagtctcgctctgtcgcccagatccgagtacagtggtctcgactcactgcaacctctgcctcccaggttcaagcaattctcctgcctcagcctcctgagtagctgggattacaggcataagccactatgcctggctaatttttatatttttagtagagatggggtttctccatgttggccaggctggtctcaaactcctgacctcagatttccacccacctcaacctctcaaagtgctgggattacaggcatgagccactgagcctggctgttattatgtgagatttttaaagaaacaaacaaaaagcctctcactgatgaaggcacttttggttgggtattctgtttattgcaatcaataatggcttcagtgatatgctgtgcaatgctaggacacttgtggtagagatttaaagaactagagcctgggcaatatagcaagaccccatctcaaaatcattttttaaaaattagccaggcatgtggtgtgtgcctgtaatccagctacttcagaggctgaggcagggaggatcacttgaacccagaaggctgaggctgcagagaactatgaccacgccactgtactccagcctgggcaacagagcgagaccctgtctctaaaataaaataacacagccaggcatagtggcttatgcctgtaatcccagcactttgggaggccaaggcaggtggatcacctgaggtcaggagtttgagacccgcctggccaacatggtgaaaccccacctccactaaaaatacaaaaattagctacgcatggtggtgggcgcctgtgatcccagttactagggaggctgaggcaggaggatggcttgaacctgggaggcaaaggttgcagtgaaccaagatcacgccactgcactccagcctgggtggcagagtgagacttcatttaaaaaataataataaaataaaaagtgggtaggtgcaaaaaatatttagaaagaagaattgacagagctgagtgatttccactgaaggtgaaagaaacagatatctctgaagtctgtgaccagcagcccaacagacagaccattaatcactgtgtcagggaacacaaaaagaagagcagatgtggacaacttggaggttcccttgcgacttccaaagtgaaggcaggtgagaacagacagaaaggcaagggcttgtctgggcaaccaacccaaacaagtccatctggtattcccctatcctgtgggtctgcacactaagttacgtagtaacacagagaataacatggttattctactgagatgctagggagagattagattgccataaaatatgactccctgatgagttctcatgatggccacaggaaggaagagacatccgtcataatcatcagcattaaagaacactatttattttctttttagttttttttttttttttaaacagagtctcgttctgccacccaggctggagtgcagtagtgcaatctagtgccactgcaacctccagctcccaggttcaagcgatgcccctgcctcagccacccgagtagctgggattacaggcatgcgccaccatgcccagctaacttttgtagttttagtagagatggggtttcaccatgttggccaggctggtctcaaactcttgacctcaagtgatctgcccacctcgacccctcaaagtgctgggattacaggcatgagctaccatgcccagccagaacactttatttttatgcaacactaaagtaagcctctaacacttagtatttgcacaacatggatatttgtggatccattgcaaccctgataaataacagtgggttcatgaattcaaagctctgctatagtaaggagctacttattatctcagcttatcttagaatctcagctccctccagcctgatattctgaggactgggaggggcacgccgctgatggcaagcccctgcatggagaaaggttaccagcaccatggctgctgcagcactgtccccaagctagccctgcaaccattcccaaaatcttccttccataccggatagaaagctaggagaagtcaaatactcacttcccagcctcctttgtttgaagggatgaccacggaactcaatcttggtcaatgaaacctaaccaagttaaacagaagctggcagggagcttctgggatatcttgtgcttttctgatgaaaagggcagacagagctgggtccctccatgtcccttctacagagtcaggtcaccatggcaggagcttcaacagccattttttgaccatgaggagaaacgtaaactaactaactcaataaataagaggatgacataaggaggattccctgccttcacttgggaaatctcaagggaacctccaaattgtccacatctttctttctttctgtattccctgacatggtgattaatcatctacctgttgagctggtggtcatggacttcagaaatatctacctctttcaccttcagtgataatcacccagccctgtcaattctcctttctaaagaagaataaggtggagaaggatggaaagaggcctaaataatgtcataaatcagttgaatccaaggtagtggctttctaccccagatttctcatataaaacaatggcaaaaaaattctatttgcttaaggcactcaatttgtttacttacagctaaatatatcctaaattatctagaatttggtacctaaaatggtggctggaggaaacagaccctaaaatgtggaactctctgcctgaaggaggtagaatgctgggcaaagaagactcaactattttgagctagaaagttggcgattcttgtaccgcatgttctcacttgtaagtgggagctgaatgatgagaagacagggacacagggaggggagcaacacacacgggggcctgtagggggcagtggcgggtgggaagagggagagcatccggaagaatagctgatggatgctgggcttaatatctaggtgcagcaaaccaccataacacatgctcacctacgtaacaaacctgcatatcctgcacatgtagccctgagcttaaaacaaaacttgaacaaaaaaagaaaaaaagttggtgattcttgtaatgtcatggaggcaaatctaggaactgaatgatataatactttatatatatattatatatatatattaggattttggtatatgtcagttccttctagaagttttcaacaacattctataagacagagacaaacttagaatagaggtaactgatattatagcacagaaagaataaattacatctttgctactagaggctctctctgccttctacttggaaacaaaattcactgagagtcacataatctattaccttgagtcttaagagccaatttctgtgccctaaattaaatatataacaattgttggcagaaagtattggtttcagtaatggcagagtagctcttatcagactaaccctcctacagataacagcaataaattctaaacaaaatatggaaaataaatatttgaaggcataggatggtggccaaaagcagatagaaagtgaaggggatcagaatcttgggggttaaaaaacaaagaggatatatgggccaggcatggtggctcatagctgtggtcctggcactttgggagaccaaggtgggcagatcacttgaggacaggagttcgagatcagcctgggcaacatggtgaaacccagtttctactaaaaatacaaaaaaaaaattagccaggcatggtggtgcatgcctgtaatcctagctactcaggaggccgaggcaagagaatcacttgagcctgggaggcagagattgcagtgagccaagatcatgccactatactccaccttgggcaacagaacaagactctgtctcaaaacaaaaaaacaaaaacaaagaggacacatacatgtttatatggcttttcttctgaagatactcctctgtcagtatgagccatgaggtggttagaacttaaggataacttaaagtcttaatggatcaaggtgtcagatacaaagtttggggctgccagaagagttacaaatagaaaggaaatattccagaaaggagagagctgcacagggcaaagcctttcaaatccacagctgacctctgaactgctcaggcacaggagcacaaggggacagaattgccagaatgctgaaagtgctgagcagagatttcagctgccgccctccatagaggctggagagacagagtttggggttcaaatcttgtcaaattacagagattggcaaaacgtttggaatttcaattgaaactagaagggctagtcccttgaaataaaaactaagtcccaaaactgaggggttcatcctagaatcaaggacaaaatagaaaaatgccgtaaaagagcataagaacaaatttctataaagtcaaggtgtttggacaataactgcttttgagaataaaaacaacattattcaagaaaaagagcataattaagattctttacaaggcattatccacaatgtactacaagaaaaaaacttattggagattaaaaaaaaaaaaaaaaaacagaaaaacatgtcacatagtggaaaacacagtcaatagaaacagaccccaagatgactcgatattgaaattggcagataaggactttaaaagaggaattaaaatgaagttcaaagactcagaggaaaatatgtcctaataggtgactagatggagaacctctgcagagaaacaaaaactattacaatgaaccgaataaaaattctagaactaaacagtatgatatcagtaataaaaagttcactggatgggcttaacagaagattagagatggcagaagaatcaacgaatttgaagacagatcaatagaaatcatccaatctgaagaacagaaagaaaaagatacagaaacatattgatggagattcagtgacctgtgagacaatgagagatttaacatacatgtaatgaaaatccaaaagggaagacaacataaaagaagaaatatttgaatatataacaagtgaagatttcccaggcttcctgatgaatccatgatcagactaccacaaacaagataaaggcaaaaagaaagaagaaagaaagaaaaaatgtaaagaaaggagataaaagatcaagaaagaagaaacctatacacattaaagagagagaaaaaacggagtaggatggactctaatccaacaactggtatccttttaagaagatggccatatggaccaggtgcagtggctcacgcctgtaatcccagcactcagggaggccaaggtgggcaggccatctgaggtgaggagttcaagaccagcttggccaacatggctaaacctcatctctactaaaaatacaaaaattagccgggcatggtggcacatgcctataatcctagccactctggaggctgaagcagcagaatcacttgaacctgggagccaagatcacgccattgcactccagcctgggtgacaagagcaacactccgtcaaaaaaaaaaaaaaaaaaagaagaagaagaagacagagacacataggaagaacgccatgtgataataagggcagaaaatggaattatactcttatatgccaatgaatggcaaagattgctgaaaaccactagaagacagaaagaggcaagaaagtagaacgttctccctgcaggtgttagaggaaccacagcccagctgacaccttcatttcgaacatccatcctttagaactgtgagaaaataaactgacactgttttaagccactcagttcatagtacactttgtgatggcagcccagaaacatggttacatgagtatatacattttttgtgtatttgtttcagagacagggtttccctctgtcacccaggctggagggcagtggcatgatcatggttcattgtaaccttgaatttctcctcccacctcagcctcctgagcagctaggaatacaggtgcgtaccaccatgcctggctaatttgttaatttgggtggtattttttagggtttttgtttgttttttgtagagacagggtctcgctatgttgcccaaactgacctcagactcccggcctcaagggatcctcctgcctcagtcttccaaagtcctgggattacaggcataagccactgcacccagccaagtatatacttttaagtggttacataggcatatacatttaccaaattcatcaaattgtgcaccaaagccctatgcatttcactgtttctaaattgtaaattttaaagtgtaaacaaggaagcagatgttttaccaagatataagattaaagaccctggtagcaaagaacaagttcaccatggtatctgcccaccagaacccagaacctaccgtttcaaatttcttcaaggcaactgcccatacatttaggtgtaagaaggatggtagaaactagaagtggcggccaggcatggtgactggcttctgtaatctcagcactttgagaagccgaggcgggcagatcaagttgaggtcatgagtttgagaccagcctggccaacagggtgagactgcgttcctactaaaaatacaataaattagccaggcatggtggtgcatgcctctaatcccagcaccccagctactcaggaggctgagacaggagaatcgcttaaacccaggaggatcgcttaaacccaggacgcagagtatgcagcaagttgagatcacaccactgcactccagcctggccaacagggccaaaaactctgtctccaacaacaacaaacaaacaaacaagcaaacaaagaaaagcgaaaatgggaagggaaaagaattatcaaattttaaaaatggagcctaaataatctctttatccatggtactaacatttaaaattgcccagaaataaataaaacttaagccatgagggctgtctccttgaggaaggttgagtgtatactagataaaatgcagggaagaaggaaatgaattgtgtttgtaatgccaggtagccaggttaaacaatttatatgcattgcactgcattttatcaattcagatggaaacccttgaaccgtgatgttgccaagaaactgcaccagtaggcatgttaggatcaaccaactatgtggggctgctacccaaattgtgtaatagacctttttaggtggctgacccagcaattttccgaacctccttctcctttctcatgctttgctacagaggctagagaactaaacatttactgttccagcctcacttgcagtgagcactagccatgtattacagtcctggctaataaaaacattagaagaaagcttatattttcaaacaaaggtgtctcaggaggtgaaggtgttttgccctggttcaggtttctgttttttgtttgtttgtttgtttttgagacaggttctcgctgttacccaagctggagtacagtggcatgatcatagctcactgcagcctctaactcctaggctcaagcaatcctcctacttcagcctctggagtatctgggactacaagtatgagccatcatgcctatcacggtcttgctgtgtcttgcaacggtgttgcccaggctggtcttgaactcctggtctcaagtgatccttccacctcagccccctcaaagtgctgggatcacaggcatgagccaacacaccaaggtgaaatttcttattaagtgagcagtgattgtctttgtgacaagccactgttcatcaatatttctattacttgctacaaaatgcattcctaattgataaaactaacaactacctccctcctacctaacagtcctaacaaacaagagcaaaatatgggaaacagagtggagtggcaaacggattatgtaaatataccaagcattcttcaaaggctatgaatagatcagagtttacttgttggctacctctagcataaaaataccaaggtagtccaggcgcggtggtggctcacgccagtaatcccagcactttgggaggccaaggtgggtggatcatttgaggccaggagttcaagaccagcttgggcaacatggtgaaaccccatctctactacaaatacacaaattagcctggcatggtggtggcatgcacctatagtctcagctgaggaattagaattgcttaaactgggaaggtgaaggttgtagtgagccgagatcatgccactgcactccagcctgggcgacagagcaagaccctgtctcaaggaaaaaaaaagaaaaagaaaaagaaaataccaaggcaaaaataaagcagttaataataaaagaaggagaagaagtaaaataagaattgttaacattcattgatggctttctaggttctaagtaatttacatgcattgtgttattaattcagatggaaacccttgcaccatgatgctgctgagaaacaataccagtaggcatgttgggtcaaccaagtacgtggggctgctacccaaattgtgtaatgagaaaacaatagtagattgagaatcagtagactaacattctagtttcttttttgttgttggttttgtttttgtttttttgagacagcgtctttctctgttgcccagcttggaatacagtgatgcgatctaggctcactacaacctctgcctcccagattcaagcaattctcctgcgtcagccttcccagtagctgggactacaggagcccgccaccatgctcagctaattttcgtaattttagtagagatgaggtttcaccatgttggccaggctggtcttgagctcctgacctcaagtgatccaccctcctcagcctcccaaagtgctgggattacaggcataagccaccgtgcgcagctacattctacttttcacactgctagtcacatgctctgtgaatttgaagaatcatttaatatctctgagatggtttttcttcccttaaagacagacgttggagaaaattatttgtaggatgcacttgacatcaaacatcctaatttccaacctatttagtttggctgaagtaatttggctggatttgtaacaattcatggaatatttatgaaacatcacagtcatgtcaagagagcaacagcaattgattatcccaagctccaaagacttggcagaaatagtcaaagcaggatacggaagatagaattctgctaataaagataacttcctaagcactctcaacaagcttatacagtagctgtgaacttaataaaggaattattgcctgggcaagatgtgaatttgttgccaaatttatgcaatctatgttaatggccagaaactatgtttaactgactcagggatacagtgatggcttattttgggttttctccaaaagcaaaatttcccttcaaaattatttctcccctgaagctagcattaaaattcatttacattttctcaacacatacttaatttttgcaaacaagcaaaaaaaaaaaaaaagaaataacttgggaagaggatctgagtttgaaatattcacatagacagtccaacgatctataatctgtagggtggagaatcaaaggttgattatttgtgaactagactgtgaataaattttttaaaaagttattcaagatgcagaaaattgcatgcatacgtatttatgtttggcatcagtagtaaaattacattttctaatgaatctacagctcagggctttaaaatgtggatcttttaaaatgcaccaagcaaaattccaagcattacaagaaatgttttatttataatgtttgtgtgaagctagacgtggcacccatctgtctcttccaatatattttcacaactggatttatagactgtaactaaaaaagtaaaagagacagtgttctgactcctgtgtagtctaattcagtctattatcataattttatttgttataagctgtcaatacaatatgccatactacccttcctctgccagtttcatggcagtaagttttgtgtcccctttctgagaaacacttcaaggatgcctgcttattattattattattatttttttttttttttttgagatggagtttcactcttctcaaccaggctggagtgcagtgatgacactgcggctcattgcaacctccgcctcccaggttcaagcgattctcctgcctcagcctcccgagtagctgggattacaggtgccccccaacacgctcagctaatttttgtatttttagtagagacgggattttaccatgttgaccaggctggtctcgaactcctgacctcaggtgatccacccgccttggcctcccaaagtgctgggacttcaggcatgagccaccacatctagccctatttatttctttatcgccttcttccctacatttacacatacttgatgtggcaggagataagtaagtattgaatgaaggaccagaactctcactgcaccacataaaaagaacttaagacaaaaaaaaagctccaaaaaagtaaaatttttcatgcactctccttggccctcacttgcctcttgtttttatctttttgctttgttagtttttatggttttgtttttggtttggagacagagtctcactctgtcatccaagctggagtacagtggtgtgatcatacctcactgcagcctcgagctcctggggtcaagtgattctcctgtctcagcttcccaagtagctaggactacaggtgcatgccaccacacccagctgattatttttttttttttttcagatacagaatctttctatgttgcccaggctggtcctgaactcctagcctcaggtgatttttttgcctcagcctctcaaagtgctgaggttacaggcttgagccaccacgcagccttgcttcttgcttataccctcattctccctctaaggctttaattttttttgttattttctttttcttttttccttttcttttcccccaagacaaagtctcactgtgtcacccaggctggagtacaatcgcgcgatctcggctcactgcaacttccacctcctgggttcaagcaattctccctgcctcagcctccccagtagctaggattacaggtgcccagcaccacacccggctagtttttgtatctttttagtagagacagggtgttgccatattggccaggctggtcttgaactcctgacctcaggtgatccacctgccttggcctcccgaagtgctgggattacgggcgtgagacaccgcacctggccaatttttattgttattttcttagggacaggatcacactctgtcacccaggctggagtgcaatggtgcataatcacagctcactgcagcctggaacacctaggctcaagcaatcctccctcccaagtaactaggacatgcctcagctaattatttttttctttttacattttgtagagacaggatcttactatgttgtccaggctgatctcaagctcctagcctcatgtgatcctgctcaacccttcaagtggctgggactacaggtgtgtgccatcgtgcctggctacctctctaactctttattttgctggcatttagttctactctcttgtctatttatggccttaataactctgatgctactttagaaagcatttcctattcatttttagcaatcaccattcagtcttcgatcgtgacaaggtcctatataagtcaaccagatgagcagcagctgcaaccacttgcaaaacaatcttcaaaaagacaaaaaagaagtgaatgaccatttttacataacttggttaaagtcgcaggaatttcaacctggacgttagggccagtggcattgccccaccttcctccagagaacagagaacatcaggcacgcacataaagagagtcctacatcctaagctccaagatggggttcctgagtcattctctgcctaatttaggtcatctgtcattgtcatgtctttatcaaagtttcaaaacaactaagaaaccagattttttgagcaaagtcattcagagagagagaccagttatttggtatattctaccatagatttgagatgaattgaattaagcactagaaactcatacttgtggatacttttaaacaggatgctgaacaatgaatatgatttcacagagtcagccaggcatggtggctcatgcctgtaattccaacaatttgggaggccaaggcgggtggatcacattgagtccaggagtttaagaccagcgtgggcaacatggcaagactctgtgttacaaaatatacaaaaattagctgggcatggcggtgtatgcctatagtcccaaccactcggggggctgaggtgggaggatagcttgagcccttgagagttcgaggttgcagtgagccagactgcaccactgcactccagcctgggtgacagagtgagagtcagtctcaaaacaaaacaaaaaaaagatttcacagagtcaaaattaggtattggctggtttaaacttttcacgcctaaaagataagctgacttccaatcaaatccaacttgaaagccaaggacttgggtattaactagagctctacacctccaaataatcaaagtcttttaaaatacattcctaaaatgtgtagccaggtgtggtggtacacacctataaatccagtgtcttgacaggctcagagaggaggactgcttgaggcaggagtttgagaccagcctggccaacatagtgagaccccatttttcttaaaaaaataaaaattaaaaattcctaaaatgcatggtgactgatataatttgtaacaaatggctgacaaatgaacaaataaatcaatgaaggaaaaacatctgaaaacctgtattatttagcctcgtatgttctcagtacaaacttgttcacctgcaaaaaagaggcccacatccaggactaacatgtgaagtaggagaggggagaaaaaaagagatttttgaagatctttgtaccaggtcctgttcatttatttttagcttgaaaataatactgtgggatcctcattttacgtattattatatttattttagagatcagtaaactaaggatcagagcatttaaattttgaaatagtaataatgtttaccatttaaacacacacacaggtccacacacacacccatctttgattcttacaacctttcaagtaatgtgtcgccatcccattttaaaggcaaagaaactggggtccagaaagatcacaggtcatgtagcgatcaagtagcacagccagaaccataatgagaattgatgaaagcaggaaacctcccagcagcatctctatctgctggtcgttttgcaattatctgtctttgccattgtcacaaacaggctcatcaacaaaagagtaatccaccagggaacagacccatggggtccagcctgattgtgactaagcaagagccatggaacctgtggaaaagttgaaccaaagagtctgagtttttaacagccattgttcagactccctgtccacctcttagtttttcaaggcttttcgagagtaaaaatgaagtcatccttgcctgagaagatgccataaagatgcatgagatgtctaccagggagtgctttgataccttctcagtcacattcagaccatttgtacctccttcacagcaaccagtgatggagaagacttagagccagaaggctcactagtcagtcttgcatagccctggtgctttgtgttcaagagtgaaatggaccaaaaagcagacaaaacaatgataagaaaagaaaactccagaccaataactctagtgaacaaagatgccgaaatccttattacagtattagcaaattaaaccagtcatctacagaaatatatcaaaaggtacataacacatcatgactaagtagggtttattccaggaatgcaagcctggttcaacatttctttaaaaagagataattcactacttcaactgaataagttgaaaattcttacgaccatttcaatgactgtagaaaaaaatacttgacaaaatttaacaactattcatggtataatctctcagcaaattagaaatagtgggtaatttcctcagtctgataaaatctgttatatatgaaagacctgtatctcacatcatccttgccagtgaaagactgaagacttcccccctaaaattggggacaaagcacaaagcaaatatgtccactgttaccacttctatttaccactgtattgtatcctaggtcttagccattgcaataaggcaagaaaaaaaagagataaatatcttttttttttgaagatcttaaaataagtaaaatgatctcttatttgcagatgaatgtttgtatagaaatgtacaagatatctacaaaacaatttctaaaaagaataaataaatttaacaaggtcataggatacaaggtttatatgaaaacaattgctgtacttctatataggagcagaacaaaaatgaagctataaaaatcaattccatctgcagtagtattaaaaaaagaaaaataaagtacatatgaataaaactaatcaaaagttatacaaaatctcgaagttgaaggttataatttaacgttatttgggccttaaggaagacctaaatgaatatatatatatatcatgtttatgggttaaaatattccatattgttaagagattaatttccccaattgattacagagttaatgcaattactatcaaaatttaaccagacttatgcagacattgacaatttggattctaaaatttacatataaaggctaaatgctataaaaagccaaagaaatggtttaaaagaacaaagtgaaaaggacttaactgcagctgatctcaagacttattctgaaggcccagtcaaaaggacagacttctagataactgaacagaatacagagtcaagaaatagagatacatataaatggatattttacaaaggtgctaaggtaattcagtggcaaaagaaaggtggttttgtttgtttgtttttaataaatgatgctagaatgcctaaatatccacatgagaaagaaataaacaaccattttttcatcttgtatgtaaaaatgaactcaaaattgataatagatctaaatagaaaaacaaaaactataaaacattgggaacaaaagacaagagaaatctctgtgagcatgaaataaagattatctagatagcacacaaaaagtatgaatcataacacaaaatactgatacatctaattttataaaaaataaaaatgtctggtctttaaaggccactgttgagaaaataaaaaggcaaaccacagactgggagaatatatttgcaacatgcatgcaaacaaagaacttatatctagtatatataaagaatttatatagctaaaaaataaaagaggcttcaaaaatgaagaaatacaaatagccaataaacacaggaaaaggtacacatcattagtcattaggaaaaggcaaatagaaacaacagttatataccaccacacttcagcagaatggttaaaattagacatagtatcaggattggcaaggatgtagagcaactggaactctcatacaccaatggtgggagtgcaaaagagtacaactactttgaaacacagtttggcaatgtcttaaaaagtcaaatatccatctatcatgcaacccacccactccactcttagctatttacccaagagaaatggaaacatatgtccacaggaagatttgtataaaaacattcaaagaagctttattacatttttgactattacttataatagtcaaaaactagctaaacaaaaaacacaaacgtccatcaacaggtggatggataaattgtggaatatccacaccatagaatatcacccaacaataaaaaacaaactacagatacataacaacacagatgaatctcaaaataatatgctaagagaaagaagccagacacaagagtatatatattgtatgatcacatttctataaaatttcagaaaacaaaaactgaactgtagtgatagaatgcagatcagtttgggacagggaggtgacaacatggaggaaggaaggaattgcaaggaccatcatggaattttggggtgtgatggaaatctttggtctctttattgggtggtagtattataggtatatgcttagtcaaaattcaacaaattgcacactttaaatatgtgcagtgtactgtatgtaaactatacctcaatataatcaattttttttttttttgagacggagtctcgctctgtctttggtctctttattgggtggtagtattataggtatatacttagtcaaaactcaacaaattgcacaatttaaatatgtgcagtgtactgtatgtaaactatacctcaatataatcaatttttttttttttgagacagagtctcactctgtcacccaggctggagtgcagtggcgcaatctcggctcactgcaagctccgcctcccaggttcacgccattctcctgcctcagcctcccgagtagctgagactacaggcgcccgccaccacacccagctaattttttgtatttttagtagagacagggtttcaccgtgttagccaggatggtctcgatctcctgacctcatgatctgcccgcctcggcctcccaaagtgttgggattatgggagtgagccaaatcattttttaaataagaataaaccagagcaaattcagaatacagtaagtggggtaagaaagcatgcaatctgagacacgagtgaagattcttgaggagcatcatgactgtcctcagatgtccatcagaaacaagagtcagcttctggacaacctcactgcaaggaccaggatatactggtggcatttggagatggcaaacttcatctggggatagagaacaatttcctaaccaggaagaataatccactgctaaaactggctgccacgctggagagggtattccttggtactggaggtattcatggagaagtaggcagaccagggctttggaggaactttgtgagaacaaacgccgccactttaagttccagctccctttctaacctcatgcatttcaaggaaattacttctcttctaacaacaagcagcctgaaagaacagacagtaaatcacaaataaaacagctcaggcacagaggaagagggaaagtctcttaggtaaccaccaaacttcacattcatacaatgggccccagtaaaacagtgggccctaataagcatattcctttccctttaagtgcactaaaataaaaaaaaaactaaatgcaaactcagagggtatgcctgcaactgcaaaaaaaatgtatgggaacagacacaaaactctccctcccagataagcaagacaaagacacacagaaacattctgagtctgtgataagctcttccaccctgaacccttaaaaactcttaatctgtaagagagagcacctgacctagcttggccagacgctcctctcaggtttattctccaaaataaacctgtctttgactgttaagctacttttcgtgtttccttcctctttctttaattcttacaggcagaccagggctttggaagaactttgtgggaaaggtaaggcctcttccagcctgaagatgctagaattctgcaagactaggcattccctgctgtttgctgttggcatatgatagagtttggatgtttgtccccttcaaatctcttgttgaaatatgattcccagtgttggaggtgacgcctgcttggaggtgtttgggtcatgggggcggatccctcatgaatgtcttagtgctggccttgataatgagatctggttattaaaaagtctgtggcacctcctccttctctttctcccactctcgccatgtaacatgctggctcctcatcaccttccctccatgactggaagcttcctgaggcctcaccagaagcagatgcaggcatcacacttcatgtacagcctgtagaaccataagccaattaaacttctttataaattaccaaacttcaggcctttcttcctagtgatgcaggaacagcctactacagcataggaaagcccaaagttcaatagagtctccctttcccagacaattttctctaaagaaaattcaaatgtcaggatggaaatgaagaggaattttccaccctgtcttatttggtgccagatccccttctttctgttggcccaagaacacttacactgaagatggatgatttttaggcttgctcccttccaaaacctcatcctgtaatgactaattagtctgaagttagcacaaacagtagcggctgagtggaaacacctattgtaatttctggtgtgctggctcccaaagccatcctcatattacatctaactcatagccttcgtctcctgctgaaacagtgaggaggcgggatgcgtgggtgtaatccttaaaagtgatgacaaaccagttgagctacaagagctcattcactcattcatctgtgcattcattcaatgagcacgagcattctgatgcaccagaacactgtctcccctgctgcaactgtgtagccccttcttattgttatttcaagtgcttaccctgacttagagaggaggacacttggaggaggagacagatttaaggaaggtaaacagaaataagacatcccgggctatgtcatgactcttaagcaggcctggccagagggtctatgtaagactgatcagcagctcagggtttttgttaattaatttttgattattctcaaagagctcagggttcttattttctacaccaagctttatattacaataggacatttgggcggggcaatgtggttcatgcctgtaatcccagcacttggggaggctgagaagggcggatcacttgaagtcaggagttcgagaccagcctggccaacatggtgaaacctcatctctaccaaaaatacaaaaattagctgggcgtggtggtgcatgactgtaatcccaactacttggaaggctgaggcaggaggatcacttgaacctgagaggcagaagctgcagtgagctgaaattgcaccacttcactccagcctgggcgacagagggaaaaaaaaaaaaaaaaaaggacatttggtggcgatttggcacttctgaagagtcattccacaggctccagggaccatggcaaccaggctatttgctccttatttcccttctagcattctcctttgtaacatgttcgcgtcccttagcacctccacccggtgctgatccagggcaacaataaaagaactcactctggtccaaccaccttgccaagtgctcttgctcaaagagccaaggcagaagctcatttggtagaagttgaatctgaggccttttattaccattaatctaacctgtcccaatttgaaaggatgaggaaggtgtgtttgcattcaactcaaatcacatcccgaaaaatgggggaaaaaatttgtaagcaattcagaaggagaataaggcccaatgtgtattgcataaaggaataaaactctgaacaatagtgctgtcagaaacaggaaggaagacctctttccacaaatccagatgagactaattcagcatggagaattatttcagcttgacattaaagggaaattctgagaaagaaaaggcaatgggaagtataactgttggaaaaggctgcacttgtgcaagaggtcgaatggagtagcattcgatacataatcactgtaactgctaactaaaaaagggttccttgggccaggagcggtggctcatgtctgtaatcccagcactttgggaggctgaggtaggtgaatcacgaggtcaggagttcgagaccagcctgaccaacatggtgaaaccctctttactgaaaagacaaaaattagccaggcgtggtggcacgcacctgtaatcccagctactcaggagactgaggcaggagaatcatttgaactcgggaggcggaggttgcagtgagccgagatcgcactaatgcactccagcccagacgacagagagagactccatgtcaaaaaaaaaaaagaaagaaagaaaaggttatttgacaaactcccgctttatttttcacttgggtaatatttttacgcatattgtagatgtctatttcaattaggaactacaaatgtcattttgtcagatttagaccccattgaaaaataaacagcaaattttgaaatgctttgttcttgtattttatatcaagtttatttgataaagtctgaagtctgggttttccgtgttttcaatatttgtggtctttaggcatcatggcttactttaaaaggctaacccccaataatatttggtttcctttgtaacatgcgagatattaaatgaaaactggtgatttttttggactaaaattagcaaaggtaaaacttagatattttctcacatgcaagcaagttttcagttgaactcatatctcacactaattgggtgaaaagttgatctaaattagagatgctttaaattcagtattatgactttcaagggcattcagtaacaaaacgaagtagataagaaaaacattctatttatacgtctaaccaggacagctctgagaggctaaataagtttcacgggtaattaacatcatttgcatgaggactaatatgcttgagattaaaagttcttttttaaatgtcatacaatttttttgactgttcccatcttgacttagagtaatggctagcgctggcaaatacatctgcccccaaagaccaaacaggttaaggcaagtgtcactaaacacttatgtctgcatcggagtttccatcagccaaaaccagcaagttttctctaatggagaatcttgtctcattatacattggtagactatgtaacttatcatcatgaaaattaaaactgaagaagaaaataataaatatatatatatgaatataagcacatgtgtgtacatatatatgtgtaacttcatatatccacctaattgtcaaacttgctcaaaatgacagataactaaatgaatcgccatataaccataactcagcttcaacaattagcaatattttgccacatttgcttcatctttttccccctttcttgctaaaatattttaaagcacttctcagacatcatgtcatttcacccctacgcactgcaatgcacatctattaaaaaaattacattttcttatgtaaaaaagttatatactgactcatattaacaaaggacatatactgtttgcttattaacaaaagacataataattctcaggattaaaaatatctcatctgatagtcatccatgatcccacctccctaattgtctcacaaaggtcattttacatgatccgtccgcatcaggatacaaacaaggcacacatgttgcttatctctaatgtgccccaccctccccagctgctcattcttttcaagtcattgacttgtcgcagaaaccgtgtcagctgtcctgaagactgtcctacattccagaagcccacggggtatcatttagtttgttcctctgtccctcatatttcctgcaaatggaagttggccctagagctttgaatagattcatattcagcttttcatgaagacaacttcatatgggatgctgtgagcttcaggttgtactacattgggaccccaccctacctagatatgccaactatagtgacaactagcaggttcagggggtgacagcccaaaatgtgcattgtcaagttctccataaacctttcatctcatggtttctttcatcacagagccttgcttgatgcaaacaccgtatttcattcttggtggcaaactggtgatttccaagtgcaattaatttcttccacaattattcattgacatcttcatacagaaggtgtcctttttttttttttttttaatcaacttgggctatttggttactgttacttgggctatttgaaatactgtttatgcttttttttctttttttttttttttttagagacaggatctcacagtgtgggtcatgctggagtgcagtggcaccatcatagctcactgcaatatcaaactcccaggctcaagtgatcctccagcctcagcctcccacgtagctgaaggctaccacctaccacgccgggcttgtttatgctttttaagtgccaatctttggagtaaagatttggtacctggccaagcacggtggctcacacctataatccaagcactttgggaggccaagaagggcggatcacctgagatcaggcactcaagaccagcctggccaacacagtgaaaccccatctcttctaaaaatacaaaaaattatccagacatggtgcaggtgcctgtaatcccagctacttgggaggctggggcaggagaatcacttgaatctgggaggcggaagttgcagtgagccacgatcacgccactgcactccagcctgggcaacagagcgaaactgcataaccccccccccccccaaaaaaaaaaaaaatttttggtaccctataagcttttacccctaccatgttaaagtaccatggaagtaagtctatatatgtatgtattgttagaaacttattggaatatatataatatataaaatatatattataaacatatagtttttagtatatattacaaatatacaatatataaaatatgtaaaatgtttatatatgttatatgaatatatttttaatgtgttgctaccaattgcatttattatttttttactgcttaaatcattccattttgggcagtggaaatcctttcagtggcctccagttcttagataacctgttagtctttggacttagcacacactgcctagctcatagtaaggatttccataacttttttttttttttgagagtcttgctctgtcacccaggctggagtgctatggcatggtctcggctcattgcaaccttcacccccaggttcaagcgattctcctccctcagcctcctgagtagctgggattacaggtgtgagccaccatgctggctaatttttgtatttttagtagagtcatggtttcgccatgttggccaggctggtctcgaactcctgacctcgtgatccgtccatcttggcctcccaaagtgctgggattacgggcatgagccaccacacccagccgacttcggtaacttttatctattactatatgaaagtgaaacttacttccacataacaatgaccataagaacacaagtattcagcctatccaacatatctctatcacgagcatttactgggtccatactatgtaccagcactatccaaagtaactggactacaaagacaggtatagcatgttcagtgattatgggattacagactcgagcagctgtttataaacacagcattctagtgcacctgcacttcagggttaggtgagaagttagtcatgaatcatttatagcttgccttagagaagactagggataattgcaaatgacaggcttcttaaagaaataaatgagaagagattcaaggtgagccctagaatgccgctggtctcagtgtatctcaatattcagaaaaccagggagcagacgcagctggatcgctcagccttgcacaacgcagtgtgtcctgtatctgtgcatcattgatcaagtgtgtcatgctctgaaaaaaaaagctggtctaggaagagcaatgtgttaccagacaactataacacagtgggatgtgttctcacaatgccatcagaatagagatgagcatgtggttgaaaaaaaatctgtaggaagggaaatatcagttgggcttttaaaagatgactgaaattcatttttccagatgcagtagttcaaacctataatccaaccactttaggaggccgagaagagcagattacttgaggccaggagttcgagaccaacctgggcaacatggtgaaaccctgtctctacaaaaaatacaaaaattagttagacgtggtggcacacacctgtagtcccagctacttgggaggctgaggcgggagaatggcttgaacctgggaggtggaggttgcagtgagccgagatcgtgccactgcactccagcctgaattacagagtgagactctgtctccaacaaaacaaaaaatgaaaaaaaaatgacaaaaattctaccaatgttgtaaaaaaaaaaacaaacaaaaatagaaaagacgttctagataggaacactagcttctgtaaaggcacaaagttgtgacaattatatggacaactgtgacaggttttgtgtggccggaagacagaatatgcttgagaggtagcagaggaaggtcgaacgggaccaggtggtaaaggcattgaatgctatgaaaaggagtctacgtgtggtcaacaccagaagaaaccatccagttgtcaagcaaaagtaatatggtcagctctatggggcttttttgtttgtttttggggtgtttgttgtttgtctgtttgtttcagacagagcctcactctgtcacccaggctggaatgcagtggtgtgatctcggctcactgcaacctctgcctccctggttcaagcgattttcatgcctcagtctcccaagtagctgggattacaggcatgcgccaccacgcccagctaattttttgtatttttagtagagacggggtttcaccacgttggccaggctggaaatctatgttttttaaaagataacagaagaaggcaaggagggggagagggtagatggaccaaaagagagaaaaagtcaaaacaaaaagacgaattagaaatctacagtggcggagatgaaaaattatgagagtctagaagtataccttaaatctgccaggtagaaaaaaaggaggcagaaattcattcacaaagcttttcacaggtgaaatttacaggacttggtgactgctaaaatgcgagaagttatgaagaagaggaatgaaggatgactctcaggtttctgagtgtaaacaggaagtcgctgaaatgcaattccatttgctaactagccaaatcacagtgcaaattgattaagaattaatacatgacagagtgtattagcaaaacaggcaagttgcaaaagacatcttggagaaataaactcatcaggatttccattttaaaaacacatgcagggcaactcacatttatagcctctccatttttgaatgttaatgttctctggaaagtaaattatgaatgtccagtatgccaggatgccgtccttagcatcaaagatgagtcccaaatttgaggtataggttgcctagcaactaaagtcccctcgaacaaagaaaaactgacttttttttttctagtaaagtcgcttcatggatccaaagcaggagtagggggaaatgatcattaaaaattgaccttatgacgacagttcagttaagaaaattgaatttactcaaccagcagggggcatcccaccttctccaagaacctttgctaaagttctccgtacaggttatttcccatccttgaccaatctcagcaaatgataatctctccttcctctaaactcttacttcactgggatgaccctggaggcacagcgtggcatgatggttaatttttcaatcgtcgtcttcgaatacgttgacatatctggagccattatcttttacgtcatttattgactgtggacccggacagcctaagtttgaatcgtgactctagcccttactacctctgtggccttgagcaattgtgtaatgcctccatgcctcagtttccccatctttaaatgcaggcagtaatactaccctctctcatgttgtaagcattctatgtgtgatacacgaatttgtattttcatatttatgagttcatatttttatgtgtataatttatgacatgtgagcaatataggagttaacatagttaaggtgcttgacacagttctggcacataggaagcactcagtagtggttggctctgattagtattacatcatgttaccttgcatcctctgtcgtagctggaaaggtaaacatatagcatttattgtaaaagtgatgagtgattttctggttctttttccactgcttcctactttaatgttccattttgcaggaaaacactcgaatttatttcagagctccaaaggggcctcaggaattacctgagtattctgcaggtacttagggaggaatcagcccaaccaagacatcttttttttttctttttcttatttttttttagagacagccttactctgtcacccaggctggaatgcagtggtgcaatcatagctcgctgcagccttgaactcctggactcaagtgatcccccatctcagcctcttgagtagctgggactacaggtgcacatcaacaagcccggctaatttttattttattttaatttttttttgtagagatgaaggtctcactgtgttgtccaggctggtctcaaattcctgggctcaagcgatcatcccaccttggcctcccaaagtgctgggattacaggcttgagccaccacacccagcttaggcatctctgttgaattagtgtgagaaatttgcaatttgtgtgcagttgacttgaaggtccttcctctgggccaatcagctcacccaaagagtccaagcgtagaaaatgtacatgggaaaaatgtacatgggaaagagatccaatctctttcccatgtgcatccccatgaaaggaaggagcatttgctgggagatgctgaagtcagtctcaagaagaaaggaaaagaaaaagatgaatgagcttataacaaacaggtaggtggagaaaaaccagagatagacctgaaaacacagattgcgcaggaagctttcatggacaaggccctgggattcgcagaggaaggcacagaacttcccttttcaaggccagccaactaggttgtggtaagtagagtaatggccctccaaagatgtccatgtctataaatatgtcaccttacatgacaaatgggactttgcaggtgtgatcaagttaaggattttgatatagagagtgatatagtttagctctgtgtccccacccaaatctcatcttgaattgtactcccataattcccacgtgttgtgggagggacacagtgggagataattgaatcatgggggcggttttccccatgctgttcttgtggtagtgaataagtctcacaagatctgatggttttatcaaggggttctgctttcccgtcttcctcattctctctttgcctgctgccaagcatggaagacatgatttgctcctctttgccttcccccatgattgcgaggctttcacagccatgtggaactgtaatttcaattaaatctctttctcttttaaattgcccagtctcaggtgtgtctttatcagcagcatgaaaacaaactaatgcagagggattatcctgaattatctgggtgggtgcaatgtcattacaagagtccctaactaagaggaaggccggagggtgagagaaggagaggtaagggcagaggcatagccacagtgatgcatggccatgaaccatggagtgctggtcacctccaaaagcaggaaaaggcaaggaaaggattctccactagagcttccagaaggaatgcagccctgctgccccacccatcacttctgactttcagaactaaaagataatgaattcctgttattttaagccgctcaaatggtgactgtagttacagcagcaataggaaccgaatggacaggtgggaaaagggaggagtctgggagaaaatccacgtgccctccctcagataggcaaggagaagacagcaagagtggaagtggcaaagcaaacaaattagtgcctgtatcagcattttcctttgaatttttttaaactgtacattcgggggtacatgtgcaggtttgttacctgacgacatcgcatgatgctgagatttggtgaactgaaccccttacacaagcagtgaacacagggcccaacaggtagcttttcagcccttgcctccttcctccttccccactctggtagtctccagtgtccccatctttatgtccatgagtacccaatggttagctctcacttacaagtgagaacatccactatttggttttctgtttctgtgttacttaggataatggcctccaggtgcatttgtgtggctgcgaaggacatgattttgtccttttttacagttgtgtagtattctatggcgcacatgtaccaccttttctttatgcagtccaccactgatggacacctgtgttaattctctgactttgctattgtgaatagtgctgcaataaacatatgagtgcagagcttttttttttttttttttttttttgatagaatgatttcttttcctttgggttatatcagcattttctaaactgttctgtaagatgatattatgagtccccagaaagggacagggcaagtaggggagttcagaagatgatgaaagtggaaccaatttgacaatctgagactgatggaaatttggtaaaagaatatgattgctttagccagttaaaagttgcaagaaaggtattatcattattattattgtaaccattactattattatgactcttctgttttttgtgggaaaaacaggatgaatggatgaaatggatgaaaaagattcctgggtgtcttgtctgacacatttttccaggttatctcagcctttcatcctattacataatctgtaagtggtagaaaactactaagaatgcaaggaattcttgtccatagagatgcagattagtagcatctggtggaatgcaatcattgtctaggacagatgatctaagatgggtacaggtccacagcctgttaggaaccgggccacacagcaggaggtgagggaacattacctcctgagctctgcctcctgtaagatcagtggtggcattagattctcataggagcataagcccttttgtgaactgcacgtgcgagggatctaggttgcgtgttccttatgagaatctaatgcctaatgatccaaggtggaatagttttatcccaaaaccatccccgcctcaagtccatggaaaaattgtcttccatgaaactggtccctgctgccaaaagggttggagactgctggtctaggtgatagacccattttgcacccacttgtaaatccatgtcagcattcgctcttttcgtgtatacgtgtgattcttagtcttttccttggaacaagtcatatcaccttactggctctctcagtgaatgccttatataaaatttgtgatatatgttcatcctgtatctgtatgggagtcacaatttctcattttcaaaaacttatcctgcaggaaatgcaaatcaaaaccacaatgtaataccaccttactcccacaagaatggccattatcaaaaaaatcaaaaaacaatagatgttggtgtggatgcggtgaaaaggaaacacttctacactgctggtgggaatgtaaactaggacggccactatggaaaacagtgtggagatttcttaaagaactgaacgtaaaactaccatttgatccagcaatcccactactgcacatctgctcggaggaaaagaaatcatcatgcacaaaggatactggcacacgcatgtttacagcagcacgatttgcaattacaaaaatgtggaaccagcccaaatgtccatcaatcaacaggtggataaagaaactgagatatatatacatgtacataaatacacacatatgtacatgtatatatatctcagtttacgtatacatattctttatatacacatatatatatgatggaatactactcagccataaaaaggaatgaattaatagcatttgcagcaacatggatggaattggagactactagtctaagtgaagtaactcaggaatggaaaaccaaacatcgtatgttctcactcataagtgggagctaagctatgaggattgaaaggcataagaatgatacaatgaactctgggaacttgggggaaagggtgggaggggggtgaggaataaaaaattacaaattgggttcagtgtacactgctcaggtgatgggtgcaccaaaatcccacagatcaccactaaagaacttactcacgtaaccaaataccatccattccccaaaaatgtatggaaatagaaaatttaaaaataatcatcatataaattaaaaagcaaaaaagaaaacccatcctgcaatattttattaggatagagccgttgtgtagctaatatagtctgaaagcgtgtgtgtccgtctttctcccaccttctcaggagctgactcaggtaccacagtgatgcagcaaggccaggtacccgagaggtatccccaggccccaactccctacaccgcacacacacaaagctctccccatcttggtctaagagggactaagccttcctcctacgaggactctccctgccttcagaacggtggctcctccagtgaggaaaaagagagaagcagaaggaactgcaaagtggacccttggatgctgctatccaaaatcagagccaaaattaagagactcttaacccccgcaaaattatccaggttaaaaacatacgtgagcttcagaaagggtgaacatagccatggctgagaatcgttgtggattatcatgataggaaattgacatgcttatgggtgttctgtcctttggggttgatgtcagggagccaagtggttgcactatttctgctgtgtgtccgaatttctaaagtaatatccgtgtattgtttggagagcggacttttttgctttactcctacttttacagaaaagaattttgtttctcaagcaacaaaacatttggtctctggtgtcaaagaggactttattatattagaattataaagctttagttaggaataagtgttggacattattaaatcaagttactgcaggctgggcatggtggctcacgcctgtaatcccagccctttgggaggccaagactagtagtctccaattccattccatcacttgaggccatgagttcaagaccagtctggccattgtggtgaaactccgtctctactaaagacataaaaattagcatggtggcctgcacctataatcccagctactccggaggctgaggcaggagaatcacttgaatccaggaggcagaggctgcaatgagccaagatcctgccactgcactctagcctaggcgacagcgccagactttgtctcaaaaaaaaaaaaaaaaaaaatttactatgtatggagatgatttttcatcttttccttaaactagtcatacgatgtaccatgctaatgaattccttcctagcttctttactggggcataggatacaatactttgaatgcatatagccgaattctgtctgctagtagattattttagacttttgtgcctgtatcagcgttttttactgtccaggaagatgttagcatgtaccaatgtttaaaaaagggtttattctccaacttgagaagtaaaatggtgggtaaacaaacaaacaaaacaaaacaaactgccaggtgcagtggttcatgcctgtaatcccagcattttgggaggccgaggtgggcagatcacctaaggtcaggagttcgagatcagcctggccaacatggcaaaaccccgtctctactaaaaacatacaaattagctgggcacggtggcacatccagctacttaggaggctgagccaggagaatcgcctgaacccaggagggagaggttgcagtgagccgagccgagattgcaccgctgcactccagcctgggtgacagagcaagactccgtctcaaataacaagaaaaagcttcagcaggtctctgctgcatgaacactgagaagctgtaaccagctgatgtgcattgtaaatttcaagatgagggaagtgacagcagcatttcccagacttatttgactgtggacctttcccctggcacatctattcacatttcccagcacaccattctgcaaatcaccagtttccaaatgctagttaatacaaaagtgagtcttatttctgaaatacctttattgaggtttgagttcaagatcatgattgcctaaaacaaatttaatacattaatgtgtgcatgtttcagaaaaattattttttaatacaagagtcctttgagtcctttgtaccttgaatatttgaaagacttagctggcattttatcagatgcctcctgggagaggttagcatcagatacattttgtaaattctttctcagtcccaacttgctctgccctattcaagtgcctacatctgtacatcgatttattattattttttttcagttaaaaaatgtgtgtctttatttaaagctcaaaacctgattggcattcaatggtatgttttcatgtttacatttccttcatagctattgtcaaatacacattcccatttctaattctgttatatctttggcattcattcattgaccaagaaactcaaagcgactattgtacggcaagaaccaggcatgaaaaatggccaagacgtagttactgcttttgtgcaagtcatggtctagtgtgagagacagatgcgccaacgaataattacaacccgctgtaatgaaggatagaataaagtcatgcgagcaggctgggaagacaagaagaatgcgactgacagcctagaggaattggcaacttcaaagcctttggatcctacaagatgaacagagaacaacgtagcaatttaggcggaagctacagactgtgtaagaggaaggagaaatgaaggatggcagaggaggccagccatggtggctcacgactgtaatttccacactttgggagggcgacgcaggtggatcactttaggtcaggagttcgagaccagcctggccaacacagtgaaaccccgtctgtagtaaaaatacaaaaattagctgggtgtggtggcacatgcctataatctcaactacatgggaggctgaagcaggagaatcgcgggtacccaggaggcagaggtgagactccgtctcaaaaaaaaaaaaaaaaaaaaaaaaaagaatggcagaggaagaaaggaggaagagagtgcagagagaacatggaatggaggaaagcaggacatgaggctggtcaaatcaggttgaaccacaggtttgagtatgtgttaggttcccagggctgccatcacaaattcccacagacctagtggcttaaaaccacacaagttcattatctgactgttctagaagtcaaagtctgaaatgggtttcattatctggcttttctagaagttgaagtctgaagtgggtttcgctggatgaaatcaaggtgtcagcagagccgcacgctccccgctaggctagcacccgtttccttgccttttctattaggctggtgcaaaagtaactgcattttttgccattacctttaatggcaaaaaacttcgatggcgattacctttaacggcaaaaaccacagttacttttgcaccaatctgagagcttccagagtgcacctgaatttcttggcgtacggccccttcctccgcattcaaagccagtcatgttgcatcttctctttcctctgacctctgcagaaggtcggacatcatacagcattatttacataaacctagatagtctagcccactacacgtctaggctagatagtatatgctattgctcctagggtacaaacctgtacaacgtgttactggactgaatactgtaggcaactgtaacacaacagtaagcatctgtgtccctctgcttccatcatcacgtttccttctctgactctgctcctcctgcctcggtcttagaagacttgtcaaaacacagtaatatattcacaggttctgttctgagaattaggacgtgggaatctgtggatggggcgggcattgttctgtcaatctgcctagaggctggattttatacagcaggcaataaagagcagtgaaagatgtttatgcaggaaagttatcacgatggattgtgatagggaactctgacaggaatgcaaagaacagcctggagcaggggcagactggttttaggacccgctaaaataccctaggcaacattgggagatcccatttcttttattattattattattattattattattattattattattattattatactttaagttttagggtacatgtgcacattgtgcaggttacatatgtatacatgtgccatgctggtgcgctgcacccactaactcgtcatctagcattaggtatatctcccgatgctatccctcccccctccccccaccccacaacagtccccagagtgtgatattccccttcctgtgtccatgttagggaaatcccatttctaccaaaaactttaaaaaaattttgccagggccaggaacagtggctcacgcctgtaatcccagcactctgggatgctgaaacaggcggatcacttgaggtcaggagttcgagaccagtctggccaacatggcaaaatcccatctctgctaaaattacaaaaattagccgggagtggtaccacatgcctctagtcccagctacttgggaggctgaagcaggagaaccgcttgaacacaggaagcagaggttgcagtgaatcaagattgtgccactacactctagcctgggtgacagagtgagactccatctcaaaaaaaaagaaaagagaaaaaaaaaaattagccatgtgtggtggtgcacaactgtggtcccagctacttgggaagctgaggtgggaggattgtttaagcctgggagatcgagcctgcagtgagccatgattgtaccactgtactccagcctgggcaacagagaagggtagaagactcagacatttctgtagaagattaagccattatccaagcttgaaaataataaagaattcactagggaacccatcaggtccagatgccattgtaggaagacacagacatgcatcacttaacattggggacacatcctgagaaatgtgtcattaggggattttgtggtcatgcaaatatcatagtctacttacagaaacctagatggcctagcccactacacatgtgggctagacggtatatgttattgctcctaggttacaaacctgttcaacatgctactggattgaatactgtaggcaattgtagcacagtggtaagcatctatgtatctcaatatatctaaacatataaaaggttcagtaaaaatattctatcagtcaatgagtggataaagaaattgtctatactattcagccataaaaaggaacaaaatagtggcattcgcagcaacctggatggaattggagaccattattctaagtgaagcgactcagggatggaaaatgatacattgtatcttctcactcgtaagtgaaagctaagctatgaggatgcaaaggcataagaataatacaataaactgaggacttgggggaaagggtgggagggggtgagagataagactacacattgggtacagtgtacactgctcaggtgatgggtgcaccaaaatctcagaaatcaccactcaagaacttagtcatctaaccaaaacccacctgttccccaaaaaatctattgaaataaataaatacaaagtattataatcttgcagaatcaccattgtttatgcagtccatccctaactaaaatgtcattccgcagtgtacaatggcatctctttgactgggtagatggctatgccattaaccaaggctaaaactcagtgcagtgtggtagctcatgcctgtaatcccagcacttcgggaggccgaggcaggtggatcatctgagttcaggagttgggaggtcagcctggccaacacggtgaaaccctgtgtctactaaaaatacaaaattagccaggtgtggtggtacatgcgtgtaatcccagctactcgggaggctgaggcaggagaatcactttagcctgggagagggaggttgcagtgagccaggatttcaccactgcacttcagcctgggcgacagagtaagaccctgtctcaaacaaaaacaaaaacagaaacagaaacaggtttgggcagaaggggatctcctaactggcctcttttttttttttttttttttgacagagtcttgctctgtcgccaggctggagtgcagtggcacgatcttggctcactgaaacctctgccccctgggttcaagcgattctcctgcctcggcctcccaagtagctgggattacaggtgccagccaccacggccagctgatttttgtatttttagtagagatggggtttcaccatgttggccaggatggtctcaatctcttgacctcatgatccatctgtctcggcctcccaaagtactgggattacaggtgtgagcctcttgccttttattcctcccctctattctgtcctccacaattctccctcactcttccacggtcccatatggtttaggttaagatcaactcctcattctaatatacaagacactttatggcctgacccctccccttgtctccagctgtattccttgcctctcgtcccatcctcaatcctcaacatgagcaagttcaagtcactttacagttcgtcatgtgaagcagcacattgccaagtgccttcatgcatcagctcagactcacaccactgcctgaagcgtctgtcttacagacactccactcacctaatatctgtgcagacacactcatcttttgagcccttgctcctctgtgcattctttgatgtccctgccagatagaataaccactgtcttctcctaccagtggacaggtatgggcttccattatttaaattcaggcacatatttaagtgcataactttcccacagctggaaaataagtattctgatgtcaattacaatctctctctttttttaagagactagatcttgctctgccaccccggctggagtgcggtgatgcaagtagctcactgcagccttgacttcctttgctcaagctatcctcctgcttcagcctcctgagtagctgggactataggcaggtactaacattcctggctaatttttaaaaaaatttttttaaggatggggtctcactatgttgtccaggctgctctctaactcctgggcctcaggcgatcctccctacttagcctcccaaagcactgggattacaggcatgagccactgtgcccagccaagaacaataccttattcatcaacccattcttggtggctaacacagcacttaacattttctagcttctaaataaatgtttggtgaaggaattaatcagtggagaaagatgaaaaataaaatgaagtcattagaagttacaaggtgtcattatttagtccacgaattgaaaaatggataaacaaaatattggtatatctatccaatggaatatgattcagccataaaaagaaatgaggtactgatacatgctacaacatgaaggaaacttgaaaacattacactcaatgaaagaatatttgatattattccatttatatgaaatgtccaaaataagcaaacagagagagacagaaagtagattagtggctgcctagggttgggagatatggcgagattggaggagtgaatgctaaggggtattaagtttctttttcttttcttttttttttttagacagggtctcgctttgtcacccaggctccagtggagcgcagtggcgagatctcggctcactgtgacctctgcctcgtggactcaagcagttctcctgcctcagcctcccaggtagctggggctacaggcgcataccgccatgcctgggtaactttttgtatttttgctagaaatgcggtttcgccatgttgcccaggctagtctcaaactcctgagctcaagcaacccaccctctctggcctcccaaagtgctagaattacaggcatgagccaccgctcctggccttcagtttctttatggagcaacaaaaatgttctaaaagtgattaccctgatggacacacagctacgggattgtacaaaaagtcatggaatttcatacattaagtgggtgaattgtatagtatgtgaacagctcaatcaagctgttaccaaaaaagaaaaagatgtcatatgtagattcaaatataattctttaacgaagaaaaagaaagatctagagaagcacactgggagataggcccaactgatggtggacatttatccaaggcagcagggagaaatcggaatgcaaatacgtgttcacatatattaagttctttttatgtgcttgccactatatcaaacaccttacctatgtaattatttcatcctcatgagttagatatttttattcctgatgagaaaactgggtcatttgcccagcagcccacagttagtatcatgaaaccagcacttgaacccaagacaactagctccaaaatccacactcttgaccttggctttgcttatgaacttggagggtacattaagattttccttttttgtttctttaaatgagggatagtctgaaaaactctctagagaaatgagtttattttctttaagaatggatgcacttaaaactatgaaattttacctctgggtaattttgagtgagtttggccagaagtcatttggattgccctaatttcttattgcttaatttgttttcctatatttaatttcctgttgtttgattttcattgtcaaatggaaggtttgcttttttttttttttttttttttttgagacagagtctcactctgtcacccagactggagtgcagtggcacgatctcagctcactgcaatctctggctcactgcaacctccgcctcccaggttcaagtgattcttctgcctcagccttctgagtagctgggattacaggcgcacaccaccacgcatggctaatttttgtatttttagtagagacggggttttgccatgttggtcgggctggtctcgaactcctgacctcgtgatccatctgccttggcctcccaaagcgctgggattacaggcgtgagccaccacacctggctggtttgcttctttaggctggtgttacattatggccgaagaatgtggcctggctggacatagtggctcatgcctgtaattgagcactttgggaggctgaggtggaaggatggcttgaagccaggagttcaagaccagcctagacaacaatgtgagttcttgtccctacaaaaaaataaataaataaataaacaaataaagatggaaaattagccaggcaagatggtgcacacctgtagtttttgctacctgggaggctgaggctggaggatcacttgagcccaggagttcagcactgcagtgaggtatgatcatgccactgcactctagcctggacaatacagaaagatcctgtctctgaaaaacagaaaaatacaaattaaaaatacataaaaataaatgtaaaaaagaacgtggcctgcagagtttctgcattgaggaatttaagacacctttcttcgtggtctaatctagaatcaggttttgtaaaactgcagaactcctgaaaaaaaaaggttcattccctctttggaggggaagtgcctagcgctccctgatatattaaatataagactttcataaaaggaaattccaatttcttcttaaattattttaaaaacagaatggccttctcaatagttaaatgtttaatgcaagcaacatgcttagaaggaagaggaggaagaatttgtctgagtaattcaaaaggccagaaagagctcagtcatttgtaatcagatatttcaatacttgcaaggctttttactttggcatgatgaatggccataaaaaactatacaccttcatgtaaaagacgttggcttcctctgctctttacataatcaatttgacatttgaattttggcaaaggatcgcaggtaccttgctttatttattacctgagattagataaaaacatcactgttatcaagccataccaggcttcttcctaaaatcatgtgcaatttttcaagtaaggatcactttgtcctgacatcgaactctcccaaacaggatttccaagtatattatacatagaagccacattctcctccctccctcccttctctttcccgtctgctataaccaccccccaccctttaaaataacccactcccagcaattctaccttctaccaactgtgacatttatagcatgggacccacctaaaaaagaaaaagggattactaaaggattcatcatcaaaactgggccagaaaagagaagcactctcaggcaccaactgtgtcactttgcacactatatgatcaatactgaaaggcagatgggtgccctaggaccacaggcttgctttcatttgggatgggaagatttttaacactgggaaagggctacagccagagaaaagcactgaggaggtcatcaagctctcactaatccctgtacttacctctgtgctctcaaaggcacccttaagaaaggatctgtccagaaccatctgaagaatgagtagaggtttaaaatggtaaattctggctgggcgcagtggctcatgcctgtaatcccagcacgttgggaggcagaggcaggtagatcacttgaggtcagcagttcgagatcagcttggccaacatggtgaaagcccatctctactaaaaatacaaaaactagctgggcgtggtggtgggcgcctgtaatccaagttacttgggaggtggaggcaggagaattgtttgaacctgagaggtgaaggttgcagtgagctgagattgcaccactgcactccagcctggatgacagagcgagaccctgtctcaaacaacacatcaatcaatcaatcaatcaataagttctaatgcccactctcccagtttcccatgaaaggctacaatccaaaaatacagaacctcagctctctctccaaaactaagccaatggtcaaacagcctaaatctagaaggaactggccaagcacagtggctcacaactgtaatcccagtgcttggcaggctgagccggggggcattgctcgagaccaggagttcgagacaaggagttcaagaccagcttgggcaacatagtgagaccacatctctacaaacaattaaaaagttagccacagtggtgcccgtctgtaatcccagctattcagaaggctgaagcaaaagaatcacttgagcccaggagttcgagcctgggcaacatagcaagaagctatctctacaaaatatttaaaaaattagccaggcgtagtggtgcaaacctgtagtcctagctacttgggaggatcgctggagcccaggaggtcaagatcacagctgcagtgagctgtgattgcaccactatactccagcctgggagacagagtcccaacaaacaaaacaacaacaacaaaatccacaactgagccaacggtcaaactatagcctaactctagatggaatccctatactgcagcccaaactataaggcttgtcctggttctacctcatgaaacaatgacgggcagcctgcaaggttagcagaattctcaagcgacctctactatgcccccttcaatcttcaaagaagaaatggactttgcagcttctatggcagtctgcaattccccttatcctaccgcctctccactatatctcacctttcttcataaatgttgatgccccgacaaatcaactcaaaaaaagccaaattaatatgaaattggggggagtggaggggagtggcaatgacacatttttgagacagcatgtatggtgacatgatggtgaagagcccagtctctctagtcagtcagccaggggtgaatcccagcgttaccacctactagctgtgcaacgatgggcaaataccttaacctctccaagcctccttcctctctgtgaactagaaatgttaatagtgcctacctcatattttaaaacatgtgaagtccttggaagaatgcttaaccatagtgagcactcagtttattatttctaggtttcaagcaccttacaaatagtgtctcgtattatttcatttaatcatcccaaagatgctttgagctccactgtgtggatgaacaaactgagacttagagtagctccataactagctcaaggtaatggagctggtggggtggagctggggcttgagctgagatctgccatcaaagcccaggttctaccagtgcaccatgctatgcccctgggggatgcggtctccatgaaaaaaaaacacacatggagacaaagaaaacaccaaccctggcagcagcaaacaatgatgatggctgtttttcaagtgctctgttggtttaaagcaaggaagaaccagacagtgggaaaagaacaggatgtcacatgtcaaagctgtagctatattatacactgggcttgtgaatttgtttctccctgaggaaagcaacttggagatttctcaaagagctaaaattagaattatcattccatccagcaatctcattactgggatatacccaaaggaaaataaatcattctaccaaaaagacacctgttactcacatgtttattgcagcactattcacaatagcaaagacatggaatcaacctaggtgcccatcaacagtggattggataatgtagtatatacacaccatgacatactatgcagctgtaaaaaagaatgaaatcatgtcctttgcaggcaacatgagtgcagctggaggccattatcctaagtgaattaactcaggaacagaaaaccaaatgctgcatattctcacttataagtaagaactaaatattaggtactcacagacacaaagatgggaacaagagatactggagactactggaggggttgggggaagggttgaaaaactattgtgcagggcacggtggctcacgtctgtaatctcagcactttgggaggccgaggtgggtggatcacttgaggtcagacattcaagaccagcctggtcaaaatagtgaaaccccatctctatttaaaatatgcaaaacttagccaggcatggtggtgcgcacctataatcccagctactcgggaggctgaggcaggaggatcgcttgaacctggtaggcaaaggctgcagtgagctgagattgtgccactccagccgggatgacagagtgagactccatttcggaaaaaaaaagaaagaaaaaaaagaaaaagaaaaactatttattgggtactatgctcactacctgggtgacagatcaattgtatcccaaacctcagcatcatgaatacatccatgtaacaaacatacccatgtacaaccttgaatctgattaaaaaaaaaaaaaaaaaaagcagtaactgtagtaagcaaaagccagctagaacctggaacctaaatttggaacatcatacatcaaactcccctctagccttagaagtggaactcaccatacatcacccaagaggacagaagacgcagcctggagcaacccacactccctatctgttggcaagaactacgtccggacagaccttgctttgaaataaagcgggaaactgacatggagatgcgtaaaaccctttcaaaaccatatcacaaagtctcagtgggaggagcaagcctcaaaacaattcaaggacacgtggacttcatgaaatgtgagtaaacatctatagtgagagagcctcctaaaggaaaaatgaaatggaaggagataaaaagggatacaagtaacataagatttgcaagaaaccaaaaagcatttaaatatccacatggagatatttatcagcaagactgataccgcaggaaaatcaaatcagtgatattaagaatacacttgagaagttctccaagaatgtagaggaaaaggataaaagaatgaaagtaatgagaatgacagctctgtgaaatccaattttaaaactccaatataaatataataaatttttcagaatagagtagaacaaaaacaacaaactaatgaaaaaaagaaatagaaaacatcttttcttgacctttagaaaaatcatgttctataaaaagagatcctcacatagacatatcctggcagaatatgtattgaaatgctggaaaactttaaaccattgctggatctgagaaaagtacttagaactgaatgaaaatcagactgaccctggcttttcctctgtgatagaaagttcaggaaaacaccagaataccatctacacagttgaggggaagggttagaaacccaaggagtaaaccagagactttgaaaacacacttgtgtagtctgacatctgtgaaaataacatgcttggctgtttttgctttgagagtacatatcaccaataagcagcttaagaaaaatatcaccttagttccaccattatagaagacagtgtggcgattcctcaaggatctagaaccagaaatactattttacccagcatacccaaagggttataaatcattctactataaagacacatgcacacatgtttattgcagcactatttacaatagcaaagacttggaaccaacccaaatgcccatcgatgataaactggataaagaaaatgtggcacatatacaccatggaatactatgcagccataaaaaagaatgagttcgtgtcttttgcagggacatggataaaactggaaaccatccttctcagccaactaacacaggaacagaaaaccaaataccacatgttctcactcataagtgggagctgaacaatgagaacacatggacacagggaggggaacaccacacaccagggcctgtcggggggtgagggcaaggggagggagagcattaggacaaatacctaatgcatgcggggcttaaaatctagatcatgggttgatgagtgcagcaaaccaccatggcatatgtatacctatgtaacaaacctgcacattctgcacatgtatcccagaacttaaagtaaaataaaaaattaaaaaatcaccttaaatttacgcgaaacaatgagtaggtcataggtcatgctatttgtgggttttccttgaaaaatttagttcccaaactccggcaggtttggggtgggctaaggactgccaggatgtttctggggacctgcaatacttcccttgataactccccttctccctggtttctgccaacttccagaaaccagaaaccatgctccctggatcacatcctgactactacagtccacaccaagttttccaaccagttaaaacaatccctggtgcttctctatttcactctaattagcaagggctaaattatgtacactgctggatgctgtacgaaaattaatacaaagagctttattcctccttcccaaacagggcaacatcatttaaaaggtgtctttgttgccaagtaatttgaggtctgaattttctgtttattgtttaataacatttttttttctaagtgcaaaagtcatactagcccaatgcagaagatatacaaaagccagggggtaaaatatacccattatcccaattactaaagaaaaacattgttacctttcataatgttcttgcagcatttcccatgcatagccttcatataagaggcctctctcttttttttttttttttttttttttttttttgagacagagtctcactctgtcgcccaggctggagtgcagtggcgcaatctcagctcactgcaagctccacctcccgggtctacgccgttctgccttagcctccccagtagctgggactacaggcacctgtcaccacacctggctaatttttttttttttgtatttttattagagacggggtttcaccgtgttagccaggatggtctccatctcctgacctcgtgattctcccgcctcagcctcccaaagtgctgggattacaggtgtgagccaccgcacccagccaaagccaagaggactcttttttaatgttaattgtattcaactatacacagttcgttgttgcctttgttcataatgtatcaaatttccatgtgaaaaaaaatctccaacaatattattttcaatgaccatattgcattccagtccatgaataattgactcatgattaacacaaccaacccgatcattgaattttttaacattataaaaactatactacacattatacaatatactatgtaatgtggcaattaaaaacttagttcacgaggtaaaatttcctgagatcaaatcacttttccaccatttattagtcatgcaatgttgggcaaattaaacaatctgtgcctgtttcctcatgagcataatgggaatcacaacagtacttaactcacagagctgtgtggattaaatgaattatacatgtaaagactttagaacaatccctgcaacatggtaaacagcatatatttagcttgtttccagttctttgctacagtgtagaatgagcatccttctacatgtagttttttaaactaatacagttattttaaatataaaattcttaaaaatgaaattgctgggtcccaaggcaattcacgtttttaaactgctgtacacatattgtctaaattccataccaaaaaattctacaattttataatcccaacaataaagaatgaaaatgtccattttcacacagcattgccaacaatggatatctactttttctgtccaaccctgctaaaatagtggatagaaattgacattttgttgctttattttcaatttctattactaaaagttggggattcttctctgtaggcttattgatcaatttgatttttttttcattttgtgcaaaacctgttcacattctttcctcagtttttttgtttttatttttgcttttcttttgttttgtttttgagatagagtcttgctctgtcacccaggttggagtgcagtagtgtgatctcagctcaccgcaacctccgcctcccaggctcaagcatcttctgcctcagcctccctagtagctgggattacaggcatgtaccaccacacctggctaattttttgtatttttagtagagacagggtttcaccatgttaaccaggctggtctctaactcctgacctcaagttgatccacccaccttggcctttcaaactgctgggattacaggcatgagccaccacacccagcctttccccaatttttgtcagaagtatttttctcctgattgcaaaaaaaaaatatatatatatatatgtatatatatatatatatattcaggagaaacatttataatatatattggaaatatcttatctcaatttgtcaggctggtttataacgttttccttttttaatgctttaagttttgtaacatcaaatttatcaatttttcctttataccttatgactttggggttaaacttgaaaaagcattcccaaattcaagtttatatgtatttaacctacagtgcaatctctaacagctgtgatttcatattttatatttaactctttaatccaaattcaattaattgtatgctttagcataaggaaagaacccaacaattatcttcccaaatattaatacacttccccaatcatgtttactgaatccttttctcgctgattttggacttttgccatatactagccaaataaactcaaatatatcaccagcttctccactgtgctttactggtctccctgctttcatagcagcaccacttttcattattagagtttttaaagtgaatcctcaatatctggaagatcaagggctcactcaccattttgtttttgttttttgaataacgtaatgggctcttcacagccatttattcttcagacgaattttagaaacattttgtcacattccccaaaaaatgttcagtaggaattttgttattgttatatttgaaatgcagcatctgtcattggatttgttttggcctcttcttcgaaaatataaatggtccctctgttggatctttgctgtctgttctctgtacttatgacgtctcaaataacttttagtttcttgtcctcatcctatacattctagagcttctctcaaactcctcttcttttgactgcatagattcgctgtaatattacttctgcctcttactgcttctaatactatatgtgacttgcaattgcatgatttgcttctactctttgaaattttgccaaattaattttcatcttagtcagtgccttatcctacaagcttatctttttttgtattttgctcttgttttagagtctgtttccctttattgtgtttattcttttatttatttcttttcttgtttcattgcctaaaatcccttaagactagaacagatgcaggctaaaatttgtttttgttttcaaagaaaaaaaaatctgtttttaactatgccctttctttacttcttgaagaatatgtttatctcctttcacattgcagatttgtttatatatcccatattgaagatatggtttttcctgcttattcagcctttaataagaatggatttatcctttgatgagattcatcccacctggccacctggaagctgggacagctgcaacatgggaatctcattgaatgaggtaggtccctgtatttttataagaaccaaagactagtaatcttcccaaatatagacattatctgtcactgagctcctctatctttgctgtaaagctgttgaaacagtctctatatcatctctaacatcaatatcaatgataaaatatcaactattacaatttgccagaaagaaaaagatgctaatgaactactcaaaatgttggtaaaatctgcatttcatgacatgactagcaagggctcatttgagctggtctttctacatttacgcatcctcccactctctccccgattcactaggctccaaccactccggccctctgtctctttgtcggcgggagggaagaacttattcttatcttgagttttgggttgaagggagtgctctgcccctggatcttcccatggcaaatgacttcttgtttttcaagtctcccttcaaatgtccctcccttgaacaccctcattggccaactcctatgcggttcccaacctgccagcctgttttattttcttgagagcacttacaagtagctaaattcagccagtttgtttatttagtagtagtagtagtagtagtagtaatatttgagacagagtctcgctctgtcaccgaggctggagtgcagtggtgcaatctcggctcactgcaagatccgcctcctggtagtgctgggattacaggcatgagccactgcacccatcccgcttactttcttatatgtctcccctgccaaaaatataagccttgtaagaaggacattctctgtctttacattgctataaccccataattgagaacagtttcatataattaacagacacacaatgcatgtttgttaagtggataatggttatatatgacaggtggaactctgggcgacttttatttttctcttattattctttattcttcatactttgcaatgcatatatattacttttatagtaaaaaagtgcattttaagacaaaaaatctatacaaatttatctatggtattggttttcaaagtttttaacagcaaaacttttttacaaaatctctgtgaaactccagtataacagacataaaggcagtattttcttatcaatgtattgttaaactcagaagatcatgacagttgcctcttatacaatcaaccaataaaacagagaggctttttaaatgaaaaattcacattttaaattgagaaatagggaggaaagtttttatttaataaaagcctcagatggcattcacttattttaatttagctatttaatattgaggaaaatcctgattcacatagatgggtagctgcaaatgtagttttaataagtcacctggttttatgatattcttacgttgaataggacttacaagagaaaagttatttttaagtttacacaatcacaagttaaccaagatacacaaattttcacactggtggtttctaataagtttggtttctaatacatttgggtatcatttttatcacagctctaaatagagcagaatgtatttaaaatgctaaatatgaataaaacacttgcacagccactcaggcatgtccatggaagactgcagttgcatggatgatattttgaaaaccacatggatatgcctgctacaacaacagtttaacacttcataggcagagaaaaaaagagtaaaaaaatacatcaatatgtcaacagtggttccacctgggtggcagaatgcctggagacttttattccttcttcttgcttttccgtattttccagggacttttttttaatggatgtatattaatttgtaatgggaaaacaactatttttaaaaaagccagaagccatgctcgatacacaggaatgtcacaaatgtaatgttgagctaagaggccagacacaatagaccattttgttccttttacctaaaatgcaaaagcaggagaagtgaatacacagtgttagaagtaaaggtagtggctgctctccaggaaggctggggatttgaaaggcatcacacatcaccatttccaggactcagaaattccagtcatgttctgtttctttctttcttcctccctccctccctttccttccttttcctacttccttccttccttccctccttccctctttccttccttccctccttccttctctctctcctttttctccttccctccatcctgtcctctctccttcccttccctcctttcttgtgtcatttctctcttttttactccttccttctctccctctttcattccttccccccttctcccttgacttcttccttccctccttccctctttccttccctccttccctccttccttccctccttccctctttccttccctctttccttccctccttccctctttccttccctccttccctctttccttccctccttccctctttccttccctccttccctccttccctctttccttccctctttccttccctccttccctctttccttccctccttccctccttccctctttccttccctctttccttccctccttccctctttccttccctccttccctccttccttccttacatcctttcttcctcccttcccttctcccttccttccctgcttccttgcttttttcccttccctttcttccttccctccctctctccgccctccgttcctccctctctccctctctttctctttgcaaacaatcaatggtttttagtatattcacagacatgtgtatcactgcagtcaatattagaacattttcatcacctcagaaaaaaagaaaacaaaaaaccctctctacactttggctatcgggctctttattccccagccctaagcatccattactctaccagctgtctctatagacttgtctattcggggcatttcagagaaatggaatcctacatggccctttgtctctggattctctctcaagcaagcatgttttcaaggcttaggttctgtttcttgacctaggggctggttatcccacttggtgaaaattgtctgagctgtacaatatccttggtacacttttctgtacctatgggatacttcaatcaaaagttctagataataaaaattaaaacaaagtcataagagggtgttccagcagcatcccccgaagccctcgtttctgacggtggtctcccttctccacccttccaggcccttcccaggcttcccatcacctatccccttttgtcctatgaagaaggacaactgcagggacacagtttgcttttctcatcttcttccgtctcccccttccagccatccacctcctgcctcctaccaggctgctggggcttctccagaacggcctccccttgaggcatgcctgcagttccatttttcctgttcttccccaccccaccctaatcaagcttctctatggtgtactccatccctcgggagtgttggtgaatgtgaagaataaattattttgtgctaagattttgtgctgtcagagtaatctttctaaagtgaacatttaggctgggtgtggtggctcaaacctgtaaccccagcactttgggaggctgcattgtttcgttttcatactgctacaaagaactgcccaagactggtaatttataaaggaaagaggtttcattgcctcacggttcagcatggctggggaggcctcaggaaacttacaatcatgggggaaggcgaagggggagcaggcaccttattcacaaggaggtaggaaaaagactgaactcaggaggaactaccaaacacttaaaaaaacagcagatctcataagaactcactatcacaagaaaagtatggaggaaaccacccccatgtttcaattatttaatacctccacctggtctctcccttgacacgtcatgattatggggattacaatgcaagatgagatttgggatagggacagagccaaaccatatcagatgctgaggtgggaggatcccttgagcccaggagttcaagaccagcctgggaaagatgatgagccccggtctccagaaaaaaattaaaaaaaaaattagctgggatggtggtacaagcttgtggtcccagctacttgggaggctgaggcagggggatcctttaacccaggagttcaaggctgtagtgagctatgattgtaccactgcactctagcctggatgacagagcaagaccctatctctaaaaaaataagtaaaatgaactgaaatgaaaatttgattgtgacactcctaatgaaatcattcaaagggttcgtattgccaacaaaactaacttaggctccctatagcctaattctccaggctggccccaacctgaccctttcccacctctccagacctcagtctctgcacctcttttcccttcctttccaggctccagagaagctgggccaggtagagttcctcaaacccattactctgttgcacacaccactgcttttgctgtaactcttccttctgcctaaaacacttttcccgcccattcccttcctattaacaatgtgtgactcagctaaaatacatactgctgactctcagatggagctccattttgccttttatttcagcaagaaaggagagatcacatgcaaagcatctctcctgtgtctcctgactttgggcaaatgaacttactcctatcatagttcagggtacccatctgcaaaatgatgatgatccaagaaacgactcgataggtctgtagcaagaattaaattagataacacacctagagcacgaaaaacaaggcctggtacatcacgaatgttctatgaatgttagctatcgctgcaaaatatcattgcatgtgcttgttcctattgacggtccctgctgctaaaataggagtccttgagttatggcttattcatctaacttgccggcagatgaggtgacagccggtgatggggtcaggcctgggtttgaattaactttcttccacgtattagctgagccagtttctacatctctcaaatggaaatatgatagtgttgtgcagagaattaaagaagatgatgatagagagctcttggcacgttttctggcccacattaaaagcacaataaactgtttcatgtaagacttaagacccgactcgtaatagatgcttgatgaataaccgttttttatggctcctagatatctgattattttccaattcaaatccatgtttcctttgctgttaaataccagagaggggccgggcacggtgactcatgcctgtaatcccagcactttgggaggccaaggcgggcagataaggaggtcaggagatggagaccatcctggctaacagtgaaacccatcgctactaaaaatacaaaaaattaaccaggcgtggtggcaggcacctgtaatcccagctactcgggaggctgaggcaggggaattgcctgaacccacgaggtggaggactgcagtgagcggagactgtggcactgcactccagcctgggcaacagagcaacacaccgtctcaaaaaaaaaaaaaaaaaataccagaggggggaagaatctacccaatagatatgacatggaagaactgaaggactatgactaaggagagtcccagcccccattgaaactattccaaaatatcttcatcttcaatcaatgcattgggggtaccatagaagacgacctatcttaatattcagatatttctaggcctggcatagtagctcacgcctgcaatcccagtgctttaggaggctgacaggattgcttgaggccaggaactcaagaccagcaggggcagcaaagcgagactccatcactacaaagaataaaaaatgagccaggcctggtggcacacacctatagtcccagctactcaggaagctgaggctggaggatcacttgaacccaagagttggaggcctcaatgagttatgattataccactgcactccagcctgggcaacacagcaagactctgactcctaagaaaacataaaaataaagaaaaggtatttctaaataaccagtctatcaaccagtcagtagtgatgatgcaaaataccttaacacaaaactgcttgtgggccaccttccacatggagaaaatccttgagagaaacttttgattgtggagtccacaaaacagaaacgctcaagaaagcctcactctcaggaccctccttgctgtgggctctgccctcatttcacagggcttgtgatcaacctgctgacgaatttctgctcagaatgaaaatcactctgaagacgtgggtccgttctggcagtaaccctgctaccactaagacacattccatcctgcctcttataattgctaatgcattgcgtgtcctaattaaaaacaactaaacatttgttcagacgttatctttgttctccgctctagcaagttgtccgggacagtccactctggcctcaaagctggagacaggaagtggcagttcttggacatcaaggaattttctgaattatttgctgtgtgtcttaacctgggttccctaaacaaagaagcctcaggcaaaactttatgggtcagagaaggcacatctacagaagcagaaaatagattagtggttgcctggggctgggagtgagaacgggaaatgactgcaaatgggcttgaggatgtgtttttggggtgatggaaatctactcaaattggatttcggtgagggatgcgcattgctgtagattttatggtatgtaaatgatacttaataaattacacttcaataaagctgttgggggaaaaaaagaaaagtgtatgagctaatgtttatttggggaatagcattgcagaaaggcaagagtgatggtatagggttgagttggggacagaggggatggcagctctgagaagtgttgccacaaggctctgtgaccagctgtgtctactcagcaatgcactccactccagtgctgtgtgctccaaacagggagggagaaggatgcacccaccacgctcaggtccccctgcattattgggttatgcatgagcccagagagagctccgtagcttcttgcatttcaggggcaaccttaaagtgagagaccagggctacgaggcaaaggcgctgttgtggcatttgctcagcaagctgagggtggagtagagacccctgcagtgagcccttggtctaggcagggggtacccaacaagacagccacaggaggagcacaggcctcgctagctccaccccagcaagtgcaccaatctgggcagattccccagctcaaccctgtctactatgcaatgaatgatgcacaaacagtttggtgacaaggtgtttaccaccataactattgactagttaatgtgctaccttctttataaatatttgtatattaggctgggtgcagtggctcacgcctgtaatcccagcactttgggaggcctaggcagacggattgcctgaggtcaggagtttgacaccagcctggccaacatgatgaaaccctgtctctactaaaaatataagaattagctgggtgtggtggcacacgcctgtagtcctagctactcaggaggctgaggcaggagaatcacttcaaccaggaggtggaggctgcagtgagccaagatcgctccactgcactccagcctgggagacagagcaggactccatctcagaaaaaaaaagaaaaagaagagaaagaaaaaagaaatatctgcatattaagataggtcttttgaggactttgaggctgcagtgagctatgattgcaccactgcactccagcctgggtgacagagcgagatcttgtctcaagaaaagaaaaaaaaataggtcttctacaatcaggggtccccaaccaccaggcagtgacctattaggagccgagccgcacagcaggaggtgagtgaggggtgcagaagtgaagcttcatatctgtatttacagccactccccgccgctcgcattcccgcctgagctccacctcctgtcaaatcactgcagcattagattctcataggagcacaaaacctactgtgaactgtgcatgcaagggatctaggttgcacactccttatgaggatctaatgcctaatgatctgtcaccgtctcccatcactcccagataggactatctagttgcaggaaaacaagctcagggctcccactgattctacatgatgatgagttgtatgattatttcattatattaacaatgtaatcataatagaaataaagtgcacaataaatggaatgcacatgaatcatcccaaaaccatccgacatcccccactgctccatgggaaaaagcatcttccatgaaaccagtccctggtggcaaaagggctgcggaccactggtctacatgctaacatcaatgcatgactgaagatgaggattgcagatgtggctacatcaccacaccatgtcacctctccagaagcctgacccaggcagaaatgcaaacttgcctcaccacctctgttgaacattaaagacaaaggagaggccagaggcagtggctcacgcctgtaatcccagcactttgggaggccgaggtgggcagatcacctgaggtcaggagttcgagaccagcctggtcaacatggtgaaaccccgtctctaccaaaaatacaaaaattagccaggtatggtggcgcatgcctgtaatcccagctactctggaggctaaggcaggagaatcacttgaacccaagaagcagaggttgcagtgagctgagatcacgccactgcactctagctgggtgacaagagcgaaactcctgctcaaaaaaaaaaaaaaaaaaggcaaaggagaaaaaaggcagtgaagtcccaattttaatcatttcaatcccgtaatactgcaaaagacttgaaataaagacagctccacacggagctactgccttcgtacagcagctgtggatggacccagctaggatctccctgcaaaaaagaattccctgctgcacgaggcctttgggattcactcagtgttgagccacagccacgtcctccccaggcagcccccagccagtgactgggctggccatgggacttggtcccggccacttctacccaacacaggattcctctaatgggcaatctttgctgcagaggtaagcatgggtcggaccaaggctttgtcagatctgcatgggaatctgagactcctcctgttcagttctacttccaggccattcaatttcacagccattattataatacttcctccctccccaccaataaaccttgcacacttgatctcaacatctgcctccagaaagacccaactaacaaacttgttgaccttaaatatcactggggctgggcggggtagctcacatctataatcttaatgcattaggaggctgatgggggaggactgcttgaggccaggagttcgagaccagcttgggcaatacagtgagactctgactctacaaaaaataataataataaatttaacataactgagcgtggtggtgtgcacctgtagtcccagatactcgggaggcctaagcaggaggatcactggagcccagaagtctgagctatgattgtaccactgcactccagcctggatgacacaagaccctatgtctttaaaaaaaaacattaaagataaataaatacatatatctttcataggtctggggattaggaggtggcatctttggagaagccataattctgtgtatcatagggtgcatcccaagcgtaaggtaccctgaccctagggaggtggagaagagtcagcgtggggccagtggctctctaagctcttgtcaccttctgtccccttcacctgccttctcactcctgagttctagacatagagaacagttattgaaccagatacacctctgatcccaaaataaagcaggggacagtgaagctgagtggtcccctgagctctttctccaaaagagacaacttcacagcattgttttttggtgggggagacagggtcttgctctgtcacccaggctggagttcagtagcacaatcacggcttacagcagactcaacttctccacctgaagtgatcctcctgcctcagcctcctgagtagctgggagtacaggcacatgccaccacacccactgattttttttaagagatggggtcttgctatgttgcccagactggtctcaaactcctgggctcaagtgatcctctcacctcccaaagtgctgggattacaggtgtgagccatcacatccggccttcagcatttttaaacccatgtgtgaatgtgacaagatgttaagaggcaatagagaaaatacaagaaaggattaagaaaagtacctttttgggggtctgcttccccacggaccaaggtgcaggcattgtcccacacccaaactccccctaagggctctagtctctgctgtaggacgtggctaaatggacaagagggttcctggagaccaagcacaccccagccactcccctgtcctaggtagcacagcactgtaccccagtgagtaacaggactcaggagcctcggggtggaggcaggtctgggcctgggcatcttgcctcttggagtatgactaacaccagccccaaacatgattatagaaaacaactctataaagccctggtccatgccaataaagcgctctccctggccctgacatcaccgcttctatagcaaccagttactcttcaaagagcaaagtgtgggagagtgcaaaacagagtcaaaactgaagacactaagtcgtgccagatgaagaaatgggccagaaagctacatcagagttcagagattgtcatcagagaaggtctaggggaagaaggacgatttcacaggcatctctagggtccaaaccagaaagacccaactgacaaacttggtgaccttaaatatcactggggctgggtgtggtggctcacacctataatcctaatgctatgggaggcttaggtgggaggattgcttgaggccagaagttcgagatcagcttgggcaatatagcgagatcccccaactctacaaaaaaattaaataaattttttttttttttttttttttttttttgagatggagtcccgctgtttcatgcgggctggactgcagtggcactatctcggctcactgcaagctccacctcccagcttcacgccattctcctgcctcagcctcccgagtagctgggactacaggtgcctgccactgcgcccagatagttttttgtacttttagtagagacggggtttcaacatgttagccaggatggtcttgatctcctgacctcgtgatccgccctcctcggcctcccaaagtgctgggattacaggcgtgagccaccccgctccgccaaaattttttttaaataactgtgcaggccaggcgcagtggctcatgcttgcaatgccagcactttgagaggacgaggcaggcggatcaccaggtcaggagatcgaacccatcctggctaacatggtgaaaccccatctctactaaaaatacaaaaaattatccgggcatggtggcatgcacctgtagtcctagctactcaggaagctaaggcaggagaatcacttgaacccagcaggaggaggttgcagtgaactgagatcgtgccactgcactccagcctgggcaacagagcgagactccatctcaaaaaataaaataaaataaaataactgtgctttgggtaaccaaagcaacaatgaagtgcccagctcagtagcctgttattgtgatttgttgctttttctgttgtgtggggtgaggaattgagtgagaatctctaacctgaccatgtagaggacgccatgcttgaagaagtttccaaaaccgaaacatcactttgctttagtatacaatgtctaagtaaacataattgtccttcaaagaagagaaaaccattaatccactcaatgggaaccctgggagagtagggactaggtggtcattaagaccttcttatggacgttaatgaatgtgaccctataaaacaatgactggtaaagcactatgtccaaagcacggttttcctctgaaggagaagtgcctcattatccattctgtagcacctaggctatcttcatctaatctgatctggccggcaggtaaaaagtcatggagttcaggaaggggctgggtaggagagatgcaaattgtgtactcccaagagcgacagagtgcagggaactgcagatgccatgagaagcacacccctgaaacaggaaactgcaccctacctgaattaccccactcttgactctgacaactaacaacatgcattttttgggaatatgtattcattaaataagcactcagccattctatttctcaattacctctagtgaccctaagatctgaccacgggcatagaagaggaaaaattcttccctagtgacagccagctgtaactgagtcaaatgcccgtcattttttcttcattttcttaagagacaaggtcttgctctgttgcccaaggctggagtgcagtggcatgatcatatctcactgtaaccttaaaatcctgggctaaagtgatcctccaacttcagcctaatgagcagctaggactacaggtgcattccaccacaactggctaatttttctttttattttttgtagagatggggtcttgctgtgttgcccaggctgatctcaaactcctggcctcaagtgatcctcctgccccagcctctcaaagtgctggcattacaggcatgagccactgtacctgttaagatgctcttcatttaagagtcaactgaatttcagaatcaatcagaggtgcaacatgtagtactccttgatacaatttcccattaaaatccatgaagatacacatgcgcgcacacacacacacgcacacacacccttgcacacacatgcatacacatgcacacatgcaatgcacacacacgcacgtgcacacatacacacaagcatgcacgcacacacacacacagaggcagcagaataggaaactgcatataatagaatttcctatgcaaataggagacatttcaatggctgaactgtcaatagggtcagttcaagagacaaaatcctggaatgaacaagagctaccttctaaaccagaactgcatcgatgatatcaaaggatgcagaaaaacacattgattagcctcctataaaaaaaaattcaacctcactagtagtcaaagtaaaacaaaactccagtcttatttgaagcaaccaaattggcaacaattttttttttataattttttttgttttattattattatactttaagttttagggtacacgtgcacaatgtgcaggtttgttacatatgtatacatgtgccatgctggtgtgctgcacccattaactcgtcatttagcattaggtatatctccaaatgctatccctcccccctccccccaccccacaacagtccctggagtgtgatgttccccttcctgtgtccatgtgttctcattgttcaattcccacctatgagtgagaacatgtggtgtttggttttttgtccttgcgatagtttgctgagaatgatggtttccagtttcacccatgtccctacaaaggacacgaactcatcatttttttatggctgcatagtattccatggtgtatatgtgccacattttcttaatccagtctattgttgttggacatttgggttggttccaagtctttgctattgtgaatagtgctgcaataaacatacgtgtgcatgtgtctttatagcagcatgatttataatcctttgggtatatacccagtaatgggatggctgggtcaaatgggatttctagttctagatccctgaggaattgccacactgacttccacaatggttgaaccagtttacagtcccaccaacagtgtaaaagtgttcctatttctccacatcctctccagcacctgttgtttcctgactttttaatgattgccattctaactggtgtgagatggcatctcattgtggttttgatttgcatttctctgatggccagtgatgatgagcattttttcatgtgttttttggctgcataaatgtcttcttctgagaagtgtctgttcatgtccttcgcccactttttgatggggttgtttgtttttttcttgtaaatttgtttgagttcattgtagattctgggtattagccctttgtcagatgagtaggttgcaaaaattttctcccattttgtaggttgcctgttcactctgatggtagtttcttttgctgtgcagaagctctttagttcaattagatcccatttgtcaattttggcttttgttgccattgcttttggtgttttagacatgaaatccttgcaaatttgcaacaatttctaaaaccataaacatgatgttggcgaaagggtggtgaaaggggagtatttttcacacggttagtaggagtggaaacagaactgacctatcagggaagcaactggacaatctgttataagagccccgaaaacgtggagacgcgatgccccagtgttttcacttacacaagtcttggcttctttttttttttttttttttttttgagacggggtatctatctgttgcccaggctggagtgcagtggcgtgattttggctcactgcaagctccgcctcctggattcaagcaactctcctgcctcagcctcccgagtagttgggattacaggcacccgccatcgtgcctggctaatttttttgtgttaggtcacagctttaaaaaacaatcacaaagacaagcaaagatttgtttttccatagttcactacataactacttaggaccaggaaaaactggaaataaagctgagtggctgaggctggacgcagtggctcatgcctgtaatcgcagtactctggaaggcgaggagagcggatcacctgaggtcaggagttcgagaccagcctggccaacatggtgaaacccagtctctactaaaactacaaaaattagctgggcatggtggcatgtgcctgtaatcccagcaactcaggaggttgaggcagagaattgcttaaacccgggaggcggaggttgcagtgagctgagatcgtgccactgcactccagcctgggtgacagagagagactccatctcaaaaaaaaaagaagaaatacctgagactgggtaacctataaagaaaagagttttaggccaggtgcagtggctcacgcctgtaatcccagcactttgggaggccaaggcgggcggatcatttgggctcaggtgtttgagaccagcctggccaacatggtgaaaccctgtctctactaaaagtgcaaaaattagccaagtatgggggcacaagcctgtagtcccagctacttgggaggctgaggcaggagcatcgcttaaacctgagaggcagagattgcagtgagcttagactgtgcccctgcgctccagtctgggtaacagagcgagactccgtctcaaaaaaagaaaaaaaaaaagaaagaaagaaaaaaggaaagaaggtttaattggctggcaattctggagcctatactggaagtgtgatgctggcatctgcttggcttctggccaggcctcaggaaacttgcaatcatggcagaaggcaagggggaaagctggtatgtcacatggcaaaagcaggagcaagagagaggggagataccacacacttttaaactatcagatctcacgagaactcactcactgtcataaggacagtaccaaggaggatggtgctaaaccattcacaagaagtttgcccccatgatccaatcacatcctaccaggcccccctccaacactggggattacaattgaacatgagatttgggtgggggacacagatccaaaccatatcaggtgcctcatttggaggagtcagtgctggtttttcacccacctctcaggatcttgcttgacacaatcagagacccccgtggccagaaatcacaagctaaaaagaaagggagaaggccaggcgtggtggctcatacctgtaatcccagtgctttaggagaccaaagggcaaggactgcttaagcccaggagttcaagacaagcctgagcaacatagtgagatcctatcttgatcaaaaccatacaaattattcaggcacggtggtgtgcacctgtagtcccagctactcgggaggttgaggcaggaggatcgcttcagcccaggagttagaggctgcagtgagctatgattgcaccactgcaatccagtctgggtgacaaagcaagaccttgtctctaaaaatcaatgaaaaaagaaaaggagagggtagcccctgcttagggtgagctacaggctcctgttaaagcagttggcactgggacacaggcaagggagtggtggcaacaaaacataatcagaatgatgggctttccttgctatttatttaacgggccgcggtcaggcagaggagaagaggggttcccattcttctgacaacagagctgagcttaatctgaaattgaggtggagctgggcacatgggagaaataaaatctcccaggagaattaaagtctgaaggaatgacttccaagtcactggaggagggaaaatacaaaggaaacatcatttctaaaccaaaaacagggcccaaccagcatgaggaaatcgtgctccttcagcttctaactagtatggaaggtgattcattttttgatggatatggcttacagggtaaaaaaggaaccaagtggcttctctcaatgctagtgaactggaggatgacccagcagccactgcttaaaaagagcaggacattccctgcactttccctgaacttggtctctcataggcctgatgtggtccctcacaggcccccacaaaaggaagtcattaccaaaagcagaactaccatttgacccagcaaaaaaataaattgttctacccaattgttctattgaaaagccacccgcactagcatgtttattgcagcattattcacagtagcaaagacatgaaatccagacagatgaaatcaacagtggattgggtaaagaaaatgtggtgcatagacaccatggaatactatgcagccataaaaaagaaggaaatcgtgtcctcggcagcaacatggaagcagctggaggctatcatcctaagcaagttgatgcataaacagaaaaccaaatactgcatgttctgatgtatacatggagctcaagtattgggtacacgcagacatgaagatgggaacaacagacagtggggactactagagggaggatgtagggaggaaggcaagggttaaaaagctacctattgggtgctatgctcattacctgggtgacaggatcaatcgtaccccaatatcacacaatatacccttgtaatatatactcattatcacacaatatacccttgtaacaaactggcatatgtacccccttgaatctaaaataaaagttgaaattattttttaaattaaaaaataaaatcttctaggagaattaaaattggaagaaatgactttttcattcactagaggaggtaaaatgcaaaggaaacatcatctatataccaaagacagggcaacgccagcacaaggaaatagcattccttcagttcctaagtcatatggaaggcaaaattttttttggatggatatcacagggtcaaaaaggaaacaagtgacttcttttaatgctgttactcatgttcagaattaaaacccgtgaactaaaggaagacccagccgtgctgtttaaaaagagcaggatatggccagacatggtggctcacgtctgtaatctcagcactttgggaggccaaggcaggtgaattactttagatcaggagtttgagaccagccttgcaacatggtgtaacctgtctttactaaaaatacaaaattagctgggagtggtggccagtgcctgtaatcccagctactcgggaggctgagacacgagaatcgcttgaaccccggaggcagaggttgcaataagccaagattgcgccactgcactccagcctaggcaacaccgtgagaccctgtcaaaaaattaaaaaaaaagagcaggataaggccgggcacggtggctcacgcctgtaatcccagcactttgggaagtcgaggcaggtgaatcacgaggtcaggagattgaggccatcctggctaacatggtgaaacccggtctctactaaatacacacacacaaaaaaaaaattagctgggtgtggtggcgggcacctgtagtcccagctacttgggaggctgaggcaggagaacggcatgcatgaacccaggaggtggagcttgcagtgagcagagatcacgccactgcactctagcctgggtgacacagcgagactccatctcaaaaaaaaaaaagcacgatattccagcattttccctgcacttggtctctcataggcccaatgtggtgcttcacaggcccacaggaaggaagtcattttaccaaaagaggccgggctcggctttcacgtctcttcctcagggaagcttccttcactgagcaccaggttcctgtctgagacagcaggacacaccttagcagggtgtcctcctgtgtgtccccaattctgtaagcaccctgcttcggttctttttccaactgactcgatacttaagtgccaattaccattccctggcacgggggaggggcaacgataccccaaaaagggccacttacaaagaagtgagcagggctttccgccgtgttggtcaagcttcaaaaggagtggccaatggggaaaagaggtcattttcagttttctgtgccaaagacaagcagctagacggaaagatcacacacagctcggtctctgaagactgataattccacgtgtattctattttaaagcgaagccctcggcgctaccttgatgattttgtagaatttacactgaaagggcataaaatgtcacgccatcttgtgtgttcctcacttccatgtgctctttgcgagaaaatcaaactcagctgtttctgagctcctagcgagtacccacaatgtctaaggcttacaatttcaactgtgcatatcttctgcaaggcaaaagggtgcagggaaagaaatagcagtggatcaggcctgtaatcccagcactttgggaggccgaggcaggcagatcatgaggtcaagagatcaaaaccatcctggccaacatggtgaaactccgtctctactaaaaatacaaaaattagccgggtgtggtggcacacacctgtagtcccagctactcgggaggctgaggcaggagaatcacttgaacccgggaggcaggggttgcagtgagccgagattgcgccactgcactccagcctggtgacagagcgagactccacccaaaaaaaaaaaaaaaaaattagccgggcatggtggtgcacgctaagaaggctgaggcaggagaatcgcttgaatccgggagatggaggttgcagtgagctaagatcacagcattgcactccaacctgggtgacaagagtgaaaatctgtctcaaaataataattaaaaaaagaaagaaagaattagcaatggaaaactgttcatgccaccgagatgcttctctgaaccatgatttccccaactgcaaaatgaggctaactctgcctacctggcaggggtgacataatgacccaatgcatagtctagcccataggagtccttgctcttcccctctttgggcctcagtttcctcacctagaaagcagcagggaagggtcaagaaagtaggcaacttcataagatgacccagcttcaacaccccacattgttaggacttcctctaagacatatcactgaaggtcagctttcgctatcccagtgctttcaagggttacatggacaggataaaagttatgatccccaaacacatcttcctacactgtagagataagaaagagggctgacattatcctaggcaaactgatgcagaaacaaaatcaaataccgcacgttctcatttacagatgggagcattgggttcacatggacaggaaaatgggaaccataagtctggccacagtggctcacacctgtaattccagcactttgggaggccaaggtgagcagatgccttgaggtcaggagttcgagaccagcctggccaacatggtgacacccatctctacaaaaaacaattagccacgcatgatggcgcatgtctatagttccagctacctgggaggtaaggcaggagaatcacttgaacccggaagacagagactgcagtgagctgagattacaccactgcactccagcctgggccacagagcaagactccatctcaaaaacaagacagaaaagtaaagatgggaacaatagacattggggaaacagggatggacggcaagggttgaaagactacttattgggtactgtgctcgctacctgggcgacagtttcaatcgtatctcaaacttcagcatcatgcaatatacctttgtaacaaatctgcacagtaccctctgaatctaaaattaaaagcttaaaaaaaaaaaaaaagagggcagccgggagtggtggcctacgtctgtaatctcagaactttgagaggccaaggtaagcagataactaaaggtcaggagttcaagaccggcctggccaacatggcaaaaccctgtctctattaaaaatacaaaaattagctgggagtggtgacgggcgcctgtaatcccagctacttgggaggctgaggcaggagaactgcttgaacctgggaggtaaagattgcagtgagccgagatggcaccaccgcactccagcctgggtgacagagaaagactccgtctcaaaaaaaaaagaaaaaaaagaaaaaagaaaaaaggtggtaacaatagacattgggttgtggggggtgggcaaaggttaaaaaactatctgttgggtactatgctcactacctgagtgagaggtccaatcacatcccaagcttcagcatcatgcaatatacccttgcaacaaatctgcacaagtaccctctgaatctaaaataaaaagttacaaaaaaggagaatcactcgaacctgggaggcgggggttgcagtgagccgagactgcaccactgcactctgaatcattatgaagatgagaagtagaggcaccagaaacccaggagagcgttccccaagctacactgtagacaccatcccgaaggtcttccaccagctagcaagtactctgtcccaggacctatgccttctccaagcaacttccagctccacaatccctactctcatttctgctaagctcctccaatgtcggatttcaggttcacggcaaagcagaacggttctgaacaggtttgggaatactgaaccaagtgctgctgtctgtgcctatcaatgtagctcttctttctttgtcgtgggaacttccatccacacacagctgcttaacggggactgggcttgtcaatgagatgcctgtgatcccaatgtgtttctctcatctaattagtttggtcaaagagagaatgtagtgtttccagggactagaagacttaccttaatcttcccttcactcaacattctgtcctctgcttgcctagaatgcatgtaactccactcctgagcttagcatatcacataacaattagtttaaatgtctggcttccccactgggttgagagctcctcaccgggtttctctggggtgataaaatgtgttctaaaactgaatcacagtgatgtgtgcacagctccgtaagattatgaaaaatcattgaactgtacacttaatgcaggtaatttgatggtatataaactattcctcaataaagttatttttaaaaatactccagcattcattggtgcatggctgtgggcaaattactctctgagcctcagtttccttatctgtaaactggaacaacaataactgatgttgtacaatagtcgcaaggtttaagtaaaggtgacgatggaaagaaggtgcttaatgcagggcctggaatacagcaagcactccacaagtgttggctaccttatttatatatttatttatttatttatttatttatttatttatttattgagacaaggtcttgctctatagtccaggctggagtgcactgatgcaatcatagctcactgcaacctcaacctcctgggtttacatgatcctcccacctcagcctcctgagtagctgggactacaggcacatgccaccatgcctggcaattttttttttttttgtagagatgttggtggtggggggcggggatctcactatgttgtccaggctggtcttgaactcctgggctcaagtgatcctcctgaagtgctagaattacaggtatgggccaccacacccagcccatttttaattattattatttgtccagcactaaagatacaatcagggaaaagggaaaaacgaacatggaagaaaagctgggtgctgtgggaggcagaaaaaagcctctccaaagatgaccatgtcctggtccccagaacctgtgaatctgttacctcagataacaaagagactttgcagatgtaaaaagagatcttgagatgggggtattatcctgttttatctgggtgagcccaatgtaatcacaaaggctcttaaaaagatggaagaggaaagcagagcatggtggctcatgcctgtaatcccagcacttgggaggctgaggcaagaggatcgcttaccatttgacccaacaatcctattactgggtgtgtacccaaatgattataaatcattctactataaagacacatgcacacgtatgtttactgcagcactatttacaatgggaaagacttggaaccaatccaaatgcccatcaatgataaactggaaacagaaaatatggcatatatacaccatggaatactatgcagccataaagaagaatgagttcatgtcctttgcagggacacagatgaagctggaaaccatcattctcagccaactaacacaggaacagaaaaccaaacaccgcatgttctcactcataagtggaagttgaacaatgagaacacatggacacagggaggggaacatcacacaccggggcctgtcggagggtggggagcaaggggaaggagagcattaggacaaatacataatgcatttgcagggcttaaaacctagatgacaggggccgggcacagtggctcatacctgtaatctcagcactttgggaggctgagccgcgcggatcatgaggtcaggagatcgagaccatcctggctaacagggtgaaaccccgtctctacaaaaatacaaaaaattagctgggcgtggtggtgggcgcctgtagttccagctactcaggaggctgaggcaggggaatggcgtgaacccaggaggcagagcttgcagtgagccgagactgcaccactgcactccagcctgggcaacagagcaagactccgtctcaaaaaacaaaaacaaaaacaaaaaacaaaacctagatgacaggttgataggtgcagcaaaccaccatggcacatgtatacctaggtaacaaacctgcacgttctgcacatgtatcccagaacttaaagtaaaattttaaaaatattttaaaaacagatcagcctgggcaatgtggcgaaactctgtctctacaatagatactaaaaaaaaaaaaaaattagctgggtgtggtagcatacacctgcagttccacctacttgggaggctgaagtgggaggatcacctgagcccaggtaggtcaaggctgcagtgagtcatgatcacgccgctgcaccccagcctgggcaaaagagtgaggccctgtcttgagaaaaaaaaaaaaagatggaagaggacagtaggagagtcagagagagagatctgaagatgctccactgctgcctttgaagatggaagaggagatatgagctaaggaatgcaggcagactctatagaagttcgacaaagcaaggaaacagattctgccccagcatctccaaaggaatgtagccctgataatatccctattttatcccagtaagatgcattccaaactccgacctccagaattgaaagataataaattcgtattctgttaagccgctaagttagtgataattggttacagcaaccacagaaaactaatataggcacagtcgtttccccatcacccacagcgtcactttctgcagtttcagttacctgagttcaaccacattccaaaaatatcagatggaaaattccagaaataaaaaattcatcagttttcatgtgcatgccattccaaggagcgtgatgaaatcttataccatcccaaactgccccacctgggggcatgaatcgtgcctttgtgtagcctagccacactgtctacactaccagtctgtcagtcactcagtagctgactgagctatcagatcaactgttgcagtacacgctttttttttttaatttttattttaagttctggtgtacatgcacaggatgtgcaggtttgttacataggtaaacatgcaccatggtggtttgctgcatctatcaacccaccacttaggtattaagcccagcaggcattagctatttttcctaatgctctccctcccccaacgcccctgtccaacaggccccagtgtgtgttgttccctttcctgtgtccatgtgttctcattgttcagcttccacttacaagtgagaacatgcagtgtttggttttctgttactgcattagactgctgaggataacggcttccagctccatccatgtctctgcaaaggacaggatctcattcttttttatggcttcatagtattccatggtatatgtaccacattttctttatctagtctatcactgatgggcatttgggttgattccatgtctttgctgttgtgaatagtgctgcaatgaacatacatgtgcatgtatctttgtaacagaatgatattttattgctattgttgttagtctctcactgtgcctaatttataaatgaaactttctcatacgtaggtacctataggaaaagatgtactaggtacagagctcagtgctatccgtgatttcaggcatccactgggggtcttggaactcctcccttgctgataaccccacccttactgtaccatgctgtggaatgcctgggctgtcagggtaagagtagactaaggaaaagagtgatcaactagagctatattttttgtaaaatcaatttgtttagcagcatgtaagttgcactggggggcaggagagaggcagcaagtgtcagaaaagacgctgttgtcttggacaagacagtgcattgagaaggagcctgacaggtgtgaaatgtgtgttgggatattggatgcataaaacatatgcaacttggagatcccctacaggctggggccaaaggagaagggtcaaagaagacaaaaggctggctcatgggaatcacagtgacaccattctaggggtcagaagaaactgcctcagcagggggagcagagaggatgtaggagcatgcatcagctccggcaaggggtttagatttgggccaagagcttagaactgcagtcagaactaaagatcccattgtagaaccgtcatcgcagaggtgaaagccaaaagtaatccaggtccgggaagaagacaactaattgaacaactgcattgtacgtgataatactatttacaatagccaagcattggagagaaacaaaaatccaacaaataagagatggttaaataagttattgtcacttcatgcaatggactcgtagaaagctttcaaaaaaatttttttttaatttattttttgagacggagtctcactctgttgcccaggctgtagtgcagtggcaccatcttggctcactacaacctccgcttcccaggtacaagcgattctcctgcctcagcctcccaaacagctgggattacaagcacctgccaccatgctggctaattattatatttttagtacagacagggtttcgccatgttggccaggctggtcttgaactcctggcctcaggtgatctgcccatcttggcctcccaaagtgctgtgattacaggcatgagccaccacacctggcttaaaaagtattttttaaagaatagttaatggtttaggaaacatatgatatattgaaatttttttaatacaacataaaaagccaaattcctttaaaagactggaaggaaacaacagactttaacactatctatattgggtatagtgatgacagtgacaccttcttcttcataatttgctatatttttaatttagcataaattagcatgtttagcatgtaacatgtttagcatgtttccataacatggaaacacagttttcaataatatgcatataattttattgcacctgtttaaaagctttggctttattaagttctttctctgattgttgatgaaaaagtttagttcctttattttggtcacaagggactgtttttcgtcactatttttactgtttgacttcttgatacaataaagatcattctgtaaaaaggaaaaaaaaaaaaaaagaaggcactgtggagaaaggcatggaggagatcatttgagtaaaggacccactgcagggttggaaggaggaaaaaaagcaaccccaaggacagaataagagccaaaggagaagacggtctcggggagttgcctgtgaccctcagtgggatggagagttaaggggctaaggggagaagagaaggcagtgttcacaaagagatgtttcctttcaagagagagaaaaaggctgggtacaatggctcatgcctggaatcccaacaactcaggaggccaaggcaggaggatcacttgagaccaggagtttgagaccagcatcggcaacatagtgagaccccatttctacaaaaaaaaacagaaacattagccaggagtggtggtgagcacttatagtgtcagctacttggagggctgaggcaggaggattgtttgagcccaggagttggagggtgtggtgagctatggtcacaccactgggcaacagagcaaggccctttcttttaaaaactaaattaggccaggcatgctggctcacatctgtaatcccaacactttgaaaggtcgaggcaggcggataatctgaggtcaggagttcaagaccagcctgggcaacacagcaaaaccacatttctactaaaaatacaaaaatcagccaggcacagtggtgcacacctgtagtcccagctactcaggaggctgagacaggagaatcgcttgagcctgggagacagaggttgcagtgagtcaagatcacaccattgtactccagcctgggcaacagagcaagatgttgtctcaaaataaataaataaacaaacaaacaaacaaactaaattaagctagaaaaagagaaacaaagaggaaacataacaatagaaagacacactgatgtttacaaggaaacagtaaggttgagaagagtttgccatggacagtttcaatcttttaccacaaagatagaggcagtttgcaggtaattacaaggtaaagcaggattagaaccctacagagcacagagaaaagctgcgatctctgctttggatgtcaacaagagaagacaagaaacttccccgggagcccagccaagattagactctgcctagattcctccagccagcaaagtacctcccacagtctagcacatatgaggccattagttagggtggcctctgacatctcctgaatattgttggctttgttatttgttatctgaagtccacttgtctttttttgttttgttttgtttttttgtttttttgagatggagtctcgctctgtcaccgaggctggaatgccatggcgcgatctcggctcactgcaacctctgcctcccaggttcaagtgattcttctgcctcagcctcccaagtagctgggattacaggtgtgcaccaccacacgcagctaatttttgtattttagtagagatggggttttactatgttggccaggctggtctcgaactcctgactgcaagtgatccgcccgccttggtctcctaaagtggtgggactacaggcgtgagccaccgtgtccggacatgaagtccacttgtcttatcttcctaacttgtggagaacagaggccatctctaatttaatttggtatgttctccagatgctggatctcggtagatatcccctaagtacttaattatgggtggaaagcaatggaagagaagcaataatagcaaatgcttctagttgctattgctataatttcccaacatattgattaaaacttgctttaaagaaacacaacagataaaaacttataaaacagacctggtgtggtggctcatgcctgtaatcctaccactttgggaggccaaggtgagagaatcacttctggaagttcagaagtttgagaccaccctgagcaatatagcgagactctgtctctgccaaaaaaactaaaaattagccagtcatggtagcatgctcctgtagtcccagctactagggaggctgaggtgggaggatcacatgagcccaggagttggaggccacagtgagctatgatcacaccaccgcactccagcctggatgacacagtgagactctgtctcaaaaataaataaataaataaataaataagaaaaataaataattttccaaaaagttcaagcagatcaattagagtgtgtccacgccttatagaattcctttaaatactgcattagtattgtcctgggtgcattttaaaaagaatttgctacagggaaatctacattgaaggcaactcctaaagaaatagctccatagtgtaaaaatcatttaacgctagcacagacaggcttgcaaatgaaatccttcacagccccagcagaaagagtcccacacactctgctgtgcagcagagaaggatgtcaaagcagcccgtgttgattagactgtaaagggctcagaattccactccggggacctggcacatttctaaacatgtgggaaaactctccagcatcccccacccccgcccccctaaccttggactccatgacatctctccctctgctgtcttatgttgttattaagcctgtcaatcaaatctctgccccatcaccccttggccatgtagccctggaaggccaagttacaaccactgtccctttggttcttgcccacccggtaccccatccttatatacttgtacttgcaccctctgcaaagaaaataccccaagctccaaggtagcacagaactgctacctgaccaagaaccagccctggggtccaaataacctgatttcacattctgggccaggcacagtggctcatacctgtaatcccagctcttagggaggcagaggagggaggatagtttgagcccaggagttcgagacctgcctgggcaatataatgagcccattctccacaaaaaaaaaaaaaaaagaaagaaagaaaaaagaaaaagaacctgatttcacattccagtccaatttcttacaagctgaaaaccctcagaaaaatcacctaattattgggatagtgaccatcccaaccttgttattcacgcaacgtctctcacttacgtaaaggctcattaaggttgggtattatcattaagtgtttaaggaagagttgacttggcttgtaaggctgaaagagaacatataaaatactcaaagtcgaaattctcagtgttcagagccactcatcaagcccacccgccctccgaatcaactgcagaagaaaccaataaaatgggatggtctctcatcgagcaagttctactgacaacagtcaatatggaggctcatatatgttcgttaaaccaggaaatcagtgagaaaaacctgcccatagagatagcagcaaagacccaaggagaacctcaagtcctgccattcattggcatgcctgaaaaagttcagggttgcagaatttttttcctcttgcatcgtggtggaaaacgccaggctcatcgcaaaaatcaaattatccctacaatatgtgataattaatggttggattatctgaaccaaatgacatcccagagcaaactgtgctaactgttgggaggaggaaataaatgtgtcattgattttcagctttaatgatatagtacaggtatttgtgactatctgtcacatggaaaagactcaagacatgttggttattattatttcataagcaatgttcatggtctttggccaagggatagatttgtgtcctaggacacctccccatactgggagtctgcagaatttaattgatgtgttgaaggagcctgcagtgggaggtgaagtctgacctagttgggaacttttttttttctatttttatttttttttttttgagatggagtttccctcttgttgcccaagttggaatgcaatggtgcaatctcagctcactgcaacctctgcctcctgggttcaagcaattgtcctgcctcagcctcccgagtagctgagattacaggcatgtgccaccacacctggctaattttctatttttagtagagacggcgtttcaccaagttagccaggctggtctcaaactcctgacctcaggtgatccgcccggctcagcctcccaaagtgctaggattacaggcatgagccactacacctggccctggggaattcttattataccggtaagggaagatcaaatggatttgaggcatcactaaactgcaacatcacaaacatctgctgctctgaatcccacccccatggccagaagctgaaattgggaggtccttattccagataagggagacagggagagacgacagggccaaagaagtagactgcacctgtcactgagcagaggactagagagagcagcagaccaggagaggcagagacaggcacagaagccacagcgagggccaggagacagaagcagaaaaatgcattaaaccaaggagagtcttcactgcctgttagagcatttcaggttggctttttaaggttcttggggctgagttctgggagggctggtttcactcaagaaccatcagcccttactgagtcctccctctcttaggagttccccaaaatgaccaacacaaaagcaagacagagagaaacccttccttcttctagccccttcacaaatccagagtttctctggctactcaagaggaaatctataaggtgagattgcagacatcaagggaatgaggcatgtttaacaaggagtgccccagaaatgttaccatggaaaatggaagtgcctgcaacatcatggctctttctgcctggcactgttgacagcaaatgcataaaggacaagggttttggcaagttgatgaatgtataaatctagcatcttgaaggactccaaaaacagaggtggcattcagaagcttgtgaaggtaatgacccacaaaacaaggaagccctacagaagacagccgggttcaccaaagctccaggtgacagctaattgtttagggtctgcaggtgttcaccttgggaaacattgcaattgttgctcaggaataatactcttaaatgaaaaattcacaaaaggaaatcagtattctatgatagttacaagagcacatcaaaattaagttttaatatttccatttttttctttgatttttaaattttaactggagtcttctccatccagagaaacaaatgtctatgagaatgagttgcaaagagactgagctgctggctttattccctagaaattcatggtataatgaatttatttcctagaaatttattgaatgaattatttaatgagtataatttattatttaatgatttttttatttaatgaatttattccctagcaacactttattccctagaaattcatggaataatgagtgtctgatatggtttgactgtgtccccacccaaatctcatcttgaactgtagttcttgtaatccctacatgtcatgggagggacccagtgggaggtaattgaatcacagggagggttagctccatgttgttctcatgatagtgagtgagttctcacaagttctgatggttttttaaggggcttttcccctctttgctctgcacctctatttgctgccgccacgtgaagaagggcatgtttgcttccccttccaccatgattgtaagtttcctgagacctcctcagccctgtagaactgtaagtcaattaaacctctttcctttgtaaattacccagtctcaggtatgtctttattagcagcatgagaacaggctaatacagtgtcatagaaaaagaaaagattgtgacaagacagagacccagacctctcatgatcagacatcccccactaatgtggacaaagctaggaagcaggagagagggccctcagactcttgccccaccttaaacagcctgactcttcacactaatctgtgcctttacagccagtaagatgttgtactccgtgacttctaaaatacctcctggtgctttctattcaaatattctgtgatggctgggaaaagtggctcatgcctgtaatcccaacaatttgggaggccaagacaggaggatcactagaggccaggagcttgagaccagcctgggaagcacaccaagaccccacctttccaaaaaaataaataaattagccaggagtggtggcacgtccttgtattctcagctacgcaggaggctgaagcaggaggatcacttgagctcaggagtgaggctataataagctatgattgcaccaccgcactccagcctggacaacagaacaagaccttgtccctaaaaataaataaataaataaataaataaaccaaagattctgtgacgctctgctgtcttagcttctaaaccctcttgatgtgcagagatttttatttctattgtattctgcacatctgacacagcataaatatcaacatataataaaagtttagtatattcctgtatttaaatgtaaacagcaaaatcttcctaaattatctgggtataacttttctaaggtgttaatttcttaaatccccaaggtgcatgggtttgtagatcaagttaactcaacagaataacgtgggatgctacagaaaaaaaaaatgtggattttctaatgacacagaatgcccagcctctgccaggtagctcctacatgtgccctcgatcccaacagggttcagaagagagaatgtgcaccacttagtacacaatgcacagcttcgactgtgcattcccttactaaaaccaacagaaccactgtcaaagtgcctcccctcctgaaagcaggatagtcttgtacattgcatgccagcagagacaacacaagccaagggtggaagggcttaaggatttctattcgaccatgctgaaaccaagctttaagtttaaatatgagtgacattcttacaaccagctcattttgctgggtaaacaactcaacaatcctggagagaatcctagcctcaagttctagctgtaatgacttgagactaatgttttgaagagagactccaggagtgtgggggctactttgggaagtctcataggatccaccagtcctatagttctcgaaacacttggggaaatttctttttttttttttttaaataaagatggggtcttgctttgtagcccaagctggagcgcagtagagtgatcatagctcactgcacccttgaattcctgggctcaagctatcctcccacctcagccttctgagtatctgggactataaggacgtgccaccgtgccaggctagttttttaactttttgtagagttcgagtcttgctctgttgtacaggctgatcttgaactcctgacctcaagcaattctccagccttggcctcccaaagcgctggtgttacaggtatgagctgctgcgactgggggagatttgctgaatagcttccaaagccagtgtctaacaaacacagatcaacttgttactgcatgttcatacaaacattactgctagtttgatcaatcaactgctccacatgatttgactctaaactgccattctctgttgctaaaactaccctcatcttcagaagagaaggattcgttgctgttaagtttattcctgaggatgtctcaaggccctatagtcagctggcaaagaaatccagtcattcactgagtgtgggcagtgttcttggagaaagaatcactaatgtgtagggtccatcacttccactggtctgaattatgtttccaagtgacctatacaaatcagagtgtatcatgcttttctgctgttctctctacctggaaggccagtcccatgcctgtttacactggacaaatatttggtttttaaaagcattatttggccttctggaaccttccttgagtgctcccagccacctcctctaaaagcattacttactccccgcattatcagagtctatatctgcccctctcaatagactggagtggaatcaaactatctttgaaccatttcaattccaatctagcctttactacattctctggcacacagtagattcttagttaatatttgctgaatttgaatagttttagttcaagtaagttggcttgagaatcattcatgttagagtctgttttgcacaatgaaagtattcaccattcaacaggcatttattggtcactaaacttacaccagccatggactaggggaagggagagtcgtttcttagtgtcttttctcagacttgtgcactgcatttttggggtgtctttattttgttctgtttttaataatttttaaaagtcaagaatggtacgagcacattctgttttcccccccacacatttacttaaacaaaaaaggttcagaccgggtgcaggggctcacacctgtaatcccagcacttttggaggccaaggcgggcagatcacctgaggtcaggagttcgagagcagcctgaccaacatagagaaaccctgtctctactaaaaatacaaaattagccaggcgtggtggcgcatgcctgtaatcccagctacttgggaggctgaggcaggaaaatcgcttgaatccaggaggcagaggttgcagtgagccaagatcacgccattgcactccagcctgggcaataagagtgaaactccatctcaaaacaaaaaaaaaaaggttcaaatatatctgatgcaacacactcatgtctaaaacaacagataccataactcagccatgcctctttagtttgtctccaaacaaaagcagcccatgccatctaaaaagtaaaggccactaggatgaaagtttacgcatttaaaatccctctctctctctttttagtcatttaagcttttgagtatacagttcagtggcattaagtatattttcattattgggcaaccaccaccatccatcctcaggactttttcattatcccaaagtgaaattctacctattaaataactctgcacttgttaaacaaccctattcctcctcttctgagcccctggcaaccacccttctacttcctatgaatttagctattctagggacctcatagaaatggaatcatacagtatttgtccttttgtgtctggcttatttcacttaccatgctatcttcaaggtgcacccatgctgtagtgtgtgtcagaatgtccttcctttttaaggctgaataatattccattcaatggctataccacattctttccaccttttggctattgtgaataatgctgctatgaacatagatgtgcacatatctgtttgagtccctgctttccatcctttggggtataggcataaattgatggataatatggtaactttatgtttgggtttaaaaatcttaaattatttttaacctttgggagtaagagagaacaactcattattttttgtacacggttgggaaaataaaatccactctagtggaggatctggaaatgtcaggtttttacctactcataaacaattcaaaaaaagtaaatgatcataccttcagggactcctaaaagcattggctaaatatggttgaaatattaaaattaaggccaggcgcagtggctcaaacatgtaatcctaacactttaggaggctgaggtgggcagatcacttgaggtcaggagtttgagaccagcctgtccaacatggtgaaaccccatttctgctaaaaataaaaaaattatacaggcgtggtggcatgtgcctgtaatcccagctactcaggaggctgaggcaggagaattgcttcaacctgggaggcagagattgcagtaagccaatattacaacactgcacttcagcctgggtgacagagcaagaatccaactcaaaaataaaattaaaattaaaaaataaaaattaactggcttttaattattgccagaaaaataatactaaagttagcaaagacatttgatattatagatatggatgtagatattcccaaaacccaatttcactcaatgatctgaacctaaccagtaatccagataaagggaagtgatgcggagtgaatgcttgaagccttaattcccaatgtgatgatatttggaagtgggacctctgagaggtaattaggtttagatgaggtcatgagggaggagcccccgtgatggtatcagtgcccttatgaggaaaagaaaggactgagctctctctctctccatgtgaggacacagcaagaaggcagccatctgcaaaccaggaagagagccctcaagaactgaatcagctgccgtctttaatctagacttcctagccctttagaactatgagaaacaaacttttgttatttaagccacccaactgatggcatttctatagcagcccaaactgaccatgataagaagtaattttgattattttcctactcccaactgtctaacgtttgtttgttttttaaatcagtgagcttctttcggtgctaagtgctgacctagcaaaccttagctgcatccggggatgcagtgttggggactaagagaaacagccccaggcacaagaaggcgggaagagcacatgaaccagcgctccccactcctccgcccctgcccccagtactcactgtcaggacttagtggtttctcctgtctggagtgagtgaccttagacaaaacccctggcccttctgagccaatcaagctgctaggctgatctaatgagattctgtatgtggacagcaaagtgggccatagaactaactgtgagtcctcactggcccgaaggaaagaactcattctacctaagtgaatttctctacctaactaaagtccagagacaaagtccacttagtaagtttgaatggaaatactgctgaaacatatgacatacttctattccttctttttagtttttatttgctagctcaaggtcaccatgaatgccgactgttctacctctatctaccgtacaatggtctttccaggagctactgtcaagtctgtatattgaattctcccatcctgctgaatggaatgaggacttttctgaaggctgaatctccttgctgaaagctaaatctccttgctcaagaccatacacatagaaggtacaatgcatgggctgaccctgcaaggaactccagaaaagaacctaaagttacgtttttgaagaaatctctgattttaggcacagagacttcaactttttcatcactgcattcccagtgcctggcatatagcagatgttcaggaaacctttactagattccgataaaacgatagggtaaagatccctcaaactctgattatttcagaattctgggtatttggtttcaattatttcaatgcaaagctattcaagaagtccacaaataccatattaagttcctacaacgtacaagactgctgtaaacaggattgaaaaataagcgtgttcctgctctctaggatgtaatccagtagaggaactaaaatatataaacaagaaaacagaaaagttccacaatttattattgggatataaatgaggaataaaccaagttaaagcacagagaatgaattcctttttttttttttaaatcagctttctcaggttgaagagaatgaatttcatctagctgtagggtgattttagaaggttccataaaggatgtggcaattaaaatgggggttgagtaggaactcagcaggtgaagaacaagcagaaagggcttcccagacagagaaaatatagttataagtagcttgcaggcagaaaaatgtggttttatggcactaccaatggatagaaagaatgactattccctttctcaactccacagttagcaataacttacataacttggtgctcaacttcagagagagaggaaaagcaaattccaatttcctaaattgtaccaaatactaagacggccctaccctctgactccctctgacttttattccaactcctctaaatcgtggtgtggagagatggatgacatcatcaggcatcctacatctcacatgaggaaaacagaacaggaccattattcagcatcctcatcaccttgctccatcccaaaacatcgtaggtgatgagttctcttggaggaaaatattcaaatgaggtgacgtagacagaacaatccccgctggaggtgctatgtagggttttccctcctccctctgaactgttcaagttttcatgaatcatctgtgcaggcagcccagccccgccctggtaaggacaacatcatctgagccaccaattcctaggcaccagtaacgtgctgacttttcctgcaaccctacgtgcagtactgtgatgtgactcattttaaagctgtgtaaagtgggcctgggcacagtggctcacgcctataatcccagcactttgggaggctgaggcgggtggagcacctgaggtcaggagttcgagaccagcctgaccaacatggtgaaacccccatctctactaaaaatgcaaaattagccgggcatggtggtgggcacctgtaatcccagctactcaggaggctgaagcatgagaatcacttgacctgggaggcagaggttgcagtgagccgagattgcaccactgcactccagcctgggcaacaagaatgaaactccatctctaaataaataaataaataaataaataaataaataaataaataaagttgagtaaaacaagatcagagatagaattcacttcccagacatcacaccattggctagaggcaatgctgggattttcatccaggtatctgcgactccaaagcccatggtctttctttgctaggctgatgcctcagcaaaactcaaaagaccagttcttctttcaatagcgactgtgcaccagtgttctggtgccaccatttctagatgtgtttccattccaccagcaaagaaatgtagctggccacaaggtctcactgccctggcagcaatgcttacactgcaaggcgtcctccacatttttgaattgaaaaaaggtcactatgaaacaaaactcagacctaagatgtacccagcctcctttcttttctccctatgggattccctctctcttctctagttccagagtgccctcttatccgacaaaagtaatttccagacactttattatgataacatctttccagttccacttcctgtctgggtcttgggatgaaggaatcaactccttatgcaatgggacctctggatcatcaaacccttacctcagaaacaccccctttttcctctctcagatagaactgaggtttctttctttggcagaggataaaagctctcatttcaaaattagggactggccttaaaatgctgacaccattgtgaggggtgagggctcctgcagacacctctggactgactccaactcagaagactcgggctctgcggtctaagggacacacggtggcttggtgatgtcccttggagagtggtgtcctccctgggaagccccaggagctgccctgtcctgcccccagtgtcacctgccaggctaactttcagtaactctataattccgtgatcaaaactcatccaaggtataaatcagtattaccagattctctttcgagagaatgttttgctaagaaagtgatgaaaaaaaggagaatactactaaatgcctcaaagtggacaggagaaaaaaagacatagaaataaggacacggtcctttgaccatcttcttgttttgtccaggactatccgataccccatcctcacagttaggccaatgatcctcattcctaccagaacaattttttttttttttttttgagatggagtttcactcttcttgcccagactggggtgctgtggcgcaatctcagctcactgcaacctccgcctcccaggttcaagcagttctcatgcctcagcctcccaagtcgctggaattacaggcatgcgccaccatgcccggctaatttcatatttttagtagagacagggtttctccatgttggtcaggctagtctcgaactcccgacctcaggtgatctgcccgcctcggcctcccgaagtgctgggattacaggcaagagccactgtgcccggccagccctaccagaacaatttttatataatcacagacagcccagtgtatgccctgtggccaccttcctctactcaccctatccccacccagatagttacggagaaagctacaaggtatttcatgaacttcgtgggtccttggtctggcaagggttttcaacagaccattttctttctttttttttttttttttttttttttttttttttttttttgagatggagtctcactctgtcacccaggctggagtgcagtggcgcgacgttggctcactgcaagttccgcctcccggttcacgccattctcctgcctcaccctccagaatagctgggactacaggtgcccgccaccacgcccaactaattttttgtatttttagtagagacgggtttcaccatgttagccaggatggtctcaatctcctgaccttgtggaccttgtgatctgcccgcctcagcctcccaaagtgctgggattacaggcatgagccaccgtgcccgccctcaacaggccattttcttattaaagataaattatgattatcatgcccactttacagaagtggtaacatagtcccctggtagacatctgtatttgtttcctgtggttgctgcgaccagtgatcacaaagttagtggcttagaactatacaaatgtggccaggcatggaggctcatgcctgcaatcccaacactttgggaagccaaggcaacaggattgcttgaggcctggagttggagatgaccagcctgggcaatacagcaagaccccatctctacaaaaaatttaaaaattagccaggcatggtaggtaatgcatgcctgtagtcccagctacttggaaggctgagacaggaggatggcttgagccgggagttccaggttgcagtgagctacaatcacactactgcactccagcctgagcaacacagtgaggctctgtctttaaacaacaacaaagaaaaacacaaatgtatcatcttattgttctggaagtcagaagtcctgaagtcaagatattgggagggctgtattccttctggaggctctagtggataatctatttgccttttttcttttttagatggagttttgcttttgtcacccaggctggagtgcaatggcacgatcttggctcactgcaacttccacctcacaggttcaagcaattctcctgcctcagccttccaagtagctgggattacaagtgctcgccaccacacccagctaatttttgtatttttagtagcaatgggatttcaccatataggcccggctggtctagaactccacccaccttggcctcccaaagggctgggattacagtcatgaaccaccacgcccggcctctttgccttttctcacttccagaggtggcctgcattccttggctcatggccccttccaccatcttcaaagtcagcaatgcagcaacttccagccaatctctctctctctttctccttctttctctcttccattctctcttcttccatcatcatatggctttctgactctgaccctccagcctccctcttataaggacacttatcattacattattattcccacccagataacctcaaataatctctccatctcaacatcctaatgtagtcacatctgcaatgtactttttgccatataaagtaacatgttcacaagtgtcaggaattaggacacgcacatctttagggggatatctttgggggtacatctttcgggggacattgttcagccaaccacaacatctattaaatttcgatctagattttttttttcaaaaatataatctcaatcccattttgagaatcaggatagtctataatcgatcatgttttgttgctatgggaaacatttcaaaaggacattttaagttttagaatgttccaagatataagagaaaggcttaaaagaagtatttttaatcaagaagacaaaaggaaagcgaggcaaattaatttaaaaaatcacataagcagtgatggatcacgaatttcttcattaaagaaacactgaaaaaccacatgggttgtgctaaaaggcaactagacatcgcagagttctgactgacctgattagacacagacatgcagattcatcattctgccctgagtgaggacaagctcaggccacccctgcctggctcagtatcactgatgaaaaaaatcagacagattcaccagaccctccactccagtcgtgagcaacagaggtgtcatcttcctgtacaaagcaccagacacctgcccatacacagctcatgaaaccatcatcgcaacaccaccaggaagccaggcaagcatttccactctcctgtgtgaggtcaagaagtcagggctcaaggaagtcaagaaacttgcccaagatcacatgtttaatggctggtggaggcaggactagcccaggcaagaaggcacacttttcccccagatctatccacaggatcttcaacaagaaacagaccttcagcagggcatggtgggtcatgcctgtaatcacagcctttgggaggctgaggcagacagatcacttgagttcaggagtttgagaccagccctgccaacatggcaaaaccctgtctctacaaaaaatacaaaaattagctgggtgtggtggcaggtgactgtaatcccagctactcaggaggctgaagcaggcagatcacttgaggtcaggagttcgagaccagccttgtcaacatggctaaagcctgtctctacaaaaaatacaaaaattagctgggtgtggtggtgggcacctgtaatcacagctacttgggaggctgaggcaggagaatcacttgaacccaggaggtggaggttgcagtgagccaagatcacaccactgcactccagcctgggtgacagagtgagaccctatctcaaaacaaaccaaaaaaaaaaaaaagagagagagagagagagagaaatagaccctcagtgaaccatgctgatcctgctaagaccgctcctttaactcagatgggctctttcacaattccataattccctgcagtcttcattccaaatctttactatccttcacccaacaccactctttctcaaagtccctccccaaaattatctgaaaaattctatcttaatgcagtgttcatcttttctagccactggctcctccccttaaaaataagcctgggatctaaataagatgattaggagaggctgaactgtgagaggttcaaacaaggagcctggaagtcagacagcctgggtctgccacctggctttgccttgctagctgtgtgaccttgaggcagtcacttaacctctccatgccttagcattctcatctggaaatcagaatgacagcataggacctggcagagcagttgtgaatactgaatgagagtgatgtcaggcacatggatagcctggctcctgcacccgtactcttaaccattcacatgtggtacagactcattttgggggccatctgacatatagttcagatgtctgtcccctccaaaactcatattgaaatgtgatccctggtgttggaggtggggtctggtgggaagtgtttgggtcatggggcggatccctcatgaatggtttggtgccctccctgcagtaatgagtgagttcttgctctattagttcatgtgggagctggttgtttaaaagaggctggcatctcgcttactccccctcttgcgacgtgatgcccactccccttcctcttcccaccatgagtaaaagctccctgaggcctcaccagaagtccagcagatgcaggcaccacgctcgtatagcctgcagaaccatgagccaaataaacctcttttcttcataaattacccagtctcaggtatccctatatagcaatgcaaaatgatctcatacaccatccttttccaacctctgtgaggttaagagcctggctttcctttatccttggctgttgggcagggtctctctggtcaccccaatgttccccctgctccattccattaaagacatagagaccagaccaatcatcttggagctgaggctgcaccctttcaagctcagaaaacttccaagatcccccagctacctccctactacagtcccatcttttgacctggtaccctaagccctcagacctaatcagcccttcaattctgcttctgatgtgcccacctctcaccttccactctggtcaaagcccaacagcctccaaggtccaacacacactgaacttccacatcacaggatttttttcattctgccctttattatactatctatcccaattgttttcatccttcagggcccatctcaagtgccttcctctgtctgagcagttacaccgggacattctttctctttcctctgaactactttttttttccttttttcttgaaacagagtgttgctctgttgcccaggccagactgcagtggtgtgatcatagctcactgcagcctcaacctccctgggcttaagcagtcctcccacatcagccttccaagcagctaagactatgggtacacatcaccatgcccggctcattttgtttattttttgtacagacaaggcctcactctgttgtccaggctagtctcaaacttctgggctcaagtaatcctcctacctcagcctcccaaagtgctaggattacaggcataagccaccatgccgtagcttattttctgtagtgtttatggcatctaatagattacgtgaatatgagtgagttgtggtgatggaaaggttctatatattaactgtatcaatgtcaatatcctggttgtaatacagtaccatagatttgcaagacattaccactgggggacactggacaaagggtagaggcaccttcctgcattatttcttacaattgcatgtgactctacacacatctcacaataggaagtttaattttaaaaatatagattaagaattataattaattgatcaatcattaaggttattcagcacccaattctgcagcacaccacacaagatattttacttatgtaaatcttaatgcgtccccaaagtccagactcagttttgtaatggcctattcagaatctccacctggacagctaataagtattggactcaacacgttcaatactgagctcctggactttctttctcccctctcagttaatctcacctctattcttctagttgattgagccaactatcttgctagtcctccctcacttctttcttcctcttgcactctacacctaccccgcaccccaatcagcaaatcttggtaagtccacctttgaaatagatccagaatctgtccaggcacagtgactcacatctatattcctagcacttagggagaccaaggcaggcagatcacttgagctcaggagcttgaggccaacctgggcaacatggtgagacctcttctctactaaaaatacaataaaaaattagccatgtgtggtggtgcttgcctgtggtcccagctactactcaggaggctgaggtgggaggactgcttgagcccagggtgggtggaggttgcagtgggctgtgatcacaccactgcactccagcctgaatgacagagcaagaccctgtctcaaaaaaaaaaaaagaaagacagaggaaggaagggagggagggacggagatccagaatcccactgctccttccaacctccagggccaccacccttgtcctagccaccaccgtatctcgtctggattattacaaagcctccatgctactcctactcctgttcctgcttattttattttctgtaatttttataatataatatactatgcctgctgccacaagagcagaagctctgtgggaattctactttgcttactgctgcatcctggaccttaaaactgtgcttcaaacattgtaggcactcaatcaacatttgtgaatgaatgagcaaatcaatgaatattatgccttcggtatttaaaaaacttcacaaagttacttattattgtctcatttttacaagtggggaaactgagggtcagagaaggtcaaggctctggaagggatgagagctgaagttctcctattctgagactgacattccatccaccctgttctacctggacttagtctcttggctgggtcctcagaggctggacctctgtctgattgatcattttggttttcagcatctgggaatactgcttagatattgcagaaatgcaataaaaacttgaagaactaatgcaaatttttgatcattttatgaaaatgtaccaaattcagttatgagtttatttctcatttatttattacctctatggaactgatgccttcatccttacaactttcttctgtgagtcaaggtgtgattctgagataacaattcccatttgtgttagtttgttttaaggactgctataaagacatacctgagactgggtaatttataaaggaaagcagtttacttgactcacagttctgcatggctaagggggcctcagaaaacttacaatcatggctgaagttgaaagggaaacaagcacatcttaccatggcgaagcaagagaaacagagaacgtgcaggagaaactgtcatttataaaaccatcagatctcatgaaaactcactgtcataagaacagcacgggggaactacccccatgatccaatcatctcccaccaggtctctccctggacatgtggggattacaattcaagaagagatttgggtggggacacaaagccaaaccatatccccattctttttttatagacaaagtctcactctgttgcccaggctggagtgcagtagcgtgatcccagctcactgcaacctccgcctcccaggttcaagcaattctcctgcctccgcctccagaggagctgggactacaggggtctgccaccacacctggttaatttttatatttttaatagagatggggtttcaccatgttggctaggctggcctcaaactcctggcctcaagtgatctgcccacctcagcctaccaaagtgctgagattacaggcatgagcaactgtgcccagcctcatatccccattttaccagaaggcaaactgaggctccatttctgctcttcttggtggctctgactattgggtagcactgcctgtcagcaaactagaccaactactgcacagaatacacaggaacctttctcggtgctgcgctgtctctcttgtgtagtgcactatagaatcttgtgatgaagtctttcctgttggatttccttaggctggcaatgaacaattttatagctgccttctctacagatgccctggttttgttgcacataatttgctcaggactgcatcaaatttggggagaatgcagagaacatgattgtttgagtgtacttgatttgtctctgcctggtaatttgttaaggccatgaaagaacaacgtgatgcatgagtcccctgcctggatccatcgtctgctgtccccactcatcagcctcccaagtgacttgtagctatctcgagcacacacacagagccactgtctctatgaagacaaatgtgttttactgtgagagggcaatgctttagggcaaaaaacacattataatcaaaaacagtgatcagaggctcagagggcacttcctcactccgttgtttttttatttttatttttttttgctgaggggacagaatctgttatgagctcttagtcataacatgcagcacaagtcaacctgaagccattagcacttaccttcacatcttagctcacttacataaatattctttttctttcccccccgctgagacagagtcttgcttgccctgttgcccagactggagtgcagtggtgccatctcggctcactgcaacctctgcctcccaggttcaagcaattctcctgcctcagcctcccaagaagctgggattacaggcttgcaccaccacgcccagctaattatgttttatttatttattatttattgtttgtatttttagtagagatggggtttctccatgttggtcaggctggtctttaactcttgacctcatgatccacccaccttggcctctcaaagtgctggaattacaggcatgagccaccatgcccggcctttcttttcttttgagacggaatctctctctgtcacccagcctggagtgcagtggcacgatctcagttcactgcaacctctgcctcctgggctcaagcgattctcatgcttcagcttccccagtagcagggattacaggtgcccgccaccacacccggctaattctgtttgtttatatttttagtagagacagggtttcaccacgttagccaagctggtctcaaactcctgatctcatgatccaccctcagcctcccaaagtgctgggattataggggtgagccaccacacccagccttttttcttttcttttctttttttattattattgttattttttttgagatggaatctcgctttgtcacccaggctggagtgcagtggcatgatctcggctcactgcaacctctgcttcctgggttcaagtgattctcatgcttcagcttcccgagtagctaggactacaggtgcccctaccaagcttggctagtatttttatatttttagtagaaacagggttttgccacataggccaggctggtcttgaactcctgacctcaagtgacccactggcctcagcctcccaaagtgctgggattacagctgtgagccaccacacccagcatagctcacttaaataatttttttttttttttttgagacaaagtctcaccctgtcgcccaggctggagtgcagtggcgcaatctcggctcactgcaacctccgtctcccgggttcaagccactctcctgcctcagcctcctgagtagctgcgattacagatgcgcaccagcacgctggctaatttttgtatttttagtagaaatgaggtttcaccatgttggtcaggctggtctcaaactcctgacctcgtgatccacccgcctcggcctcccaaggtgctgggattacaggcgtgagccaccgcgccctgcctaaataaatattctttaaggagagatatacggaagcgatgggcacttttcaagatttcacaacttgtggggacattattagtgtcctattagatgggggcttttttgcccctacacttcaagaaattccatctcgaagaattcttgcctggcctgacacagtggctcacacctatgatcccagctgtttaggaggcctacgtgggagggtcgctggaggtcagaagtctgagacaagcctgagcaatagagttagacctcatcgctacaaaaagttttaaaaattagccgggtgttgtgacatgggcctgtggtcccagctacttgggaggctgaggtaggaagatcacttgagcccaggagttcaaggctgctgtgaactatgatcatgccactgcactccagcctgggtgaagagcaagaccccatctctaaaaaagaaaaaagaagcacatgcacacacacatacacatacttctaaaaaagatgaccaaaattctggattcacagataagacttggtttttccctttcacattaaaatatccttcacactttccagttttgttcaatcaattatttttttttctttcaaatttgagaccaggttttggtctgtcacccacgctggaacacaatggcaccatcatagctcactgcagcctcaaactcctgggctcaagcaatcctcctgcctcagccttccaaagtgctgggattacaggcatgcatgaccatgcctgacctagttaactcatttttaattggacagactgggaaaagataaaagaaattcattattgccctattcccttactccttccctctgacatgccaagcaatagtactaaatactcagctattgccaagtaccctgccatgtgccaggcaccttgccacatcctcctcccaggaggtgggtgattatattccccactgtattagttcattttcacactgctataaagacactacccaagacttggtaatttataaagaaaataggtttaattgactcacacttccatatggctggggaggcctcaagaaacttacaatcatggcagaaagagaagcaaggcacatcttacatggcggcaagagagagagcgtgcacaggggaaactgccacttacaaaaccatcaaatctcgtgagaactcactaccatgagaacagcatgggggaatccgcccccattatccaatcaccttccaccaggtccctcactagacacgtgcatattgcaatttggattacaattgttgatgaggtttgggtggggatacagccaaaccatatcaccccatttgacagatgaggacactgagatgtgtgactgtttaaaacttgcccaagggaaatgaaaattaaaaccacaatgagatgccaccttactcttgtaagaatggccacaattttaaaaataaaaaaaaatagatgttggcatggttgtggtgaaaagggaacacttccaacgctgctggtgagaatgtaaactagtacaaccactatggaaaacagtgtggagattccttaaagaactaaaagtagatctaccacttgatccagcaatcccactacggggttcctacccaaagggaaagaagtcattctatgaaaaagacacaagcacacacgtttatagcagcacagttcgcaactgcaaaaatgtggaaccgacctcaatgcccatcaaccaacgagtggataaagaaaatgtagtatatgttatgtgcaccacggaatactactcagccataaaaaggaatgaaacaatggcctttgcagcaacttagatggagttggaggccattattctaagtgaagtaactcaggaagggaaagcaaatactgtgttttctcacttctaagtgggagctaagctacgaggatgcaaatgcttaagaatgatataatgaactctggggactcgagggggaagagtgggaggggagtgagggataaaagactacatattgagtatggtgcactctgcttgggtgatgggtgcaacaaaatctcagatatcaccactgaagaacttacccatgtaaccaaaacccacctgtacctcaaaaactactgaaatgaattttttaaaaaaaaacttgcctaagagcacagagatataaaacatccaggatttgacccaagttcagtgtgatttcacaatccctggaatttgctccttcaccggcaagaagtcaagctccttatccatggggcagccctaattataggcaggcaatctttgatttcctgcagtctctttatggttccatttagcagaggaaactacagcatatttctgataccctgaaaaagagatttgtgtggccaggagccagagtgaacttcctttaaaatcggagacagctactgggtttagaccggtttctgattcaaacaagcagtttgaaagagaagaactccatcaatcaataacccaagggcactgtcaatcaataaaccagattaattgagcacaaataggtgactttttgaactcaacatgttcatctttctgatacgggattttggctttcagaatactatgggaaactaggggactaagcatggcatgttaaacacagccaaaagatatgaagaagccaggggtggtggctcacgcctgtaatctcagcactctgaggctgaggtgggcagatcacccaaggtcaggagttcaagaccagcctggccaacatggtgaaaccctgtctctactaaaaatacaaaaattagctgggtgtggtggtgggtgcctgtaatcccagcactttgggaggctgagacgggcagatcacccaaggtcaggagttcgagagcagcctggccaacatggtgaaaccctgtctctactaaaaagtaaaaaaaaaaaaagaaagaaagaaagaaagaaaattagccaggcatggtggcacacacctataattccagttactaggaaggctgaggcaggagaattgcttgaacctgggaggcggaggttgcagtgagccaagatcacatcactgcactccagcctgggcgacagagcgagactccatttcaatttaaaatatattatttatatatatatatatgtatgcatcaaaaaaagatatgaagaaacttagctggagaagcagtgactcccagttctccagccaccattgaccaccttgtgatcaagcatgattaagactactgggccttggggatgggtctttggctgtcttctcattatcatcacttaagtataatgaagactccaaaatctgtatatctgggataaacactttgagtcccagaaatcaatatgcaagaacccactggacatctccagtaagatgaccttcagttctcatcaccattccaccctatccagactccctgtccctggtctcagcggttgtcaccacctgtacctcattacctagttaagcggccacacacctcactcctcacccccacatccatatctcatcaagatgaattacagtagagacaatttaacatggtagttaattaagagtatgggctttggagtctgattaagctaagcgggaatcccactcccaccaattatgagttgtgtgacttggccaagtgacttttaatccctttcacattaatttccctcatctgtataatggggacaccaatgcctcccagttattgcaaacatcaaatagaataacataaacacagcaagggtctgtatttttaaattcccatgccaacttctccccaactcattgctccttcctcagtctaagccctttcctttcttttcctttctcccctaactatgcaaaagggcttctggttgttgccccagcctcaaggcccacttctctcaaatccattctgcaaaccacaaccaatgcaaccttttaaaatgcaaaaaggatctcatcagcaagcatcaatataccttgtccagtcttcccaccaaaagcaaaacactccagtgctttgggaggccaaagtgggaggacagcttgaagccttggatttgagaccaacctggacaacatagtgagataccatctctacaaaaaatgtaaaaattagctgagtgtgatggcacacacctgtagttctagaggccaggagtgtgaggctgcaatgagctatgattgcaccactgcacttcagcctgggagacagagcaagactctgtttctggaaaaaataaaatataaaataaagcaaaagccctgtgcagtgataagaataagagaagtccagttcatgaagcatggattagcaactgatgttaccctttttgttgaactcctttgacaaactccgtttgttgaactccatatgacaaaacttacagatctgtcttctctccagaaaaaacatcactactcataaacacacacaatattgttaagctccacgggtgcacagaccccaggttaaaaacttcagagttgggctgctaggctgatcaaccacagtcgtggagattcaaaatctaaaacatttttcttaacttgcatactgaggatcttcaaaatctggcaagaggcttcggcagcagctcagggcacttttcccagaaagagtggcacctctgaagggatcttaaagggagtagcacaaaaccatgatcaatcatgcacctgaaaccctcaagttttacacccccagtgggtgctggctaagccattgcacttggctatctgaggagccccccacacagatgtaagaaacactaagttctcagatttgtctccatgacaccccttttcccacttccccccaccacagcaccagatggcagagaagcaagctctccaaagtgccctacaaattgcacaggggtaccagaccaaattttatgatctatcatccctacggtgcttctaggttcagagatgttaaattcccacccagatggttgaggtctgcaacataccctgaggctcatttcactggatacgagcagagtaacagcagcaaagcacacaccaactggcaccagcttaaaaactatcagtaggctgggcacggtggctctcgcctgtaatcccagcactttgagaggccgaggagggtagatcacctgaggtcaggagttcgagaccagctgggccaacatagtgaaacccatctctacaaaaaattacaaaaattcgccaggtgtggtggcacgcacctgtgatctcagctactcgggaggctgaggcaggagaattgcttgaacctgggaggcagaggttgcagtaagcggagatcacgccactgcattccagcctgggtgacagagcgagactctgtctcaaaaaaacaaaaacaagaacaaaaacacaaaaaatctatccgtacacatgagcatgtaaatggtggcacactcctgaggccagcatcacctgcagtcctgaaaccatttatttcagaagctttttttttttcttagagtatcactctgttgccaaggctggagtgcagtggctggagtgcgatcatagctcactgcagcctcaaagtcctgggcttaagcaatcctcctgcctcagcatcacaaatagctgggactacaggtgtgcacatcacgcttggataactttttcaacgattttctgtagagatgggatcttcctatgttgcccaggcaagtctcaaattcctgggctcaagtaatcctcctgcctcggcctccagaagtgctgggattataggcatgaatcaccacacccagcttattttagcagctttacaggaaaaaaacaccaccaccacatacttttttcaccatcaccataaaactttagtggaacaaacaaactcttaatattgaagttgatgagtagagtttggaagcaccactgaaacaaaaatggccttgaatgttaaccagatgacgttagggaaaccgcaagaggagtgagaataatcagggaaaaggaacactcctgaaaataggcatgctaacatccaccaccagcaacacggatggttgggctcttcccattttcagaaagcttcgctcttcaaacaccacctcccgctttagagaggaaggcagagaaatatttccagtgtgctcaactcaaagagaggccagtgtcaccctccataggggagtgagttctggtcaaccggccttgctttcagcctccccatgtcccatcaccaccgcagctcctacccaaggaataagtattataggacacatctactaactttaaaaggagatctatggacacgttccctcctgatccttgagagcatcacacggaggacttggaaggcctgcatatgcagccatctgcagatgtttcccacatcgaaacccaggtcttagaggatcctggatcttttttgtttcttttttctttttagattcgggggtaacctgtacaggttagttacatggatatattgcatgatgctgaggtttgggctttgatggaaccatcacccaaacagttaacacagtactactcaaataggtagttcttcaacgtgcccttttcctctctcctctgttttgaagtcctcagtgtctattgtttccattattatgttcccgtgtacccaatgtttatgtctcacttataagtgaaaagatggagtatttggttttctgtttctgcattaattcacttaggataatggcctccagctgcatccatgctgctgcaaaggacatgatttcactttttatggctgcacagtattccatgttgtatatgtactacgttttctttaagaggatcctggttctatccctcaggacaattcaaggtttggaaactattattggttcctcttccctctcctctctctggcaatttaagtctgttacctccaaaccaatgaggacagccactgcgatacaaagtgctgaggttgaagtgggggagtaggaaaggtatccttatgcgcttagagctaagacacaaagactcacaatgggttgtccagattcttccatttactgacaggcctctccagttagaggcatttacattgtgaagtgggcctgtcctggcagaacaattgcattggaccctgtccagtgttttgcttctcctctaaagagctactatttgccccagtgttggggtggtggtcctttgtctgggtttgttccatcataataagcatcatcatcataacaataacaataattactattcctgctattgttcccatactgtgtgtatttggcatgcagtaagtgcccaacagataggaacaataataggaatagtaattcctcactttgcatgtattatctcttattatccctataaagtatatattattatccacatggtacaggtgagaaaatcaaaacttgtggggtggtgaagtaggtcaaatgccatgcatcttcaaccatgcatttttattttattttattttttattttattttttttaaccagggactcactctgtcatccaagctggagttcaatgacatgatcgtggctctctggagcctcaaattcctgggctcacacaatccttctccctcagcttgctgggcaacttggactataggtacccaccaccatgcctggctaactttttaattttttgtacaggctggttgcccagcctgtgccatgttgcccactatgttgcccaggctggtcttgaacccctggcctcaagcaatcctccctcctccgcctcccacagtgttgggattacaggcacgagccaccatgcccagcctaatgagctcattttttgacaaagttctcttatcagaggaactagtgttcatttattcaacaagtatttttgagcagtcactatgtgcctatcatttcactgtgtttgttcccagggataagcatgatatatttaggcactgcctcaaggatgaaacaaattccccccaaattaatgtcctcctgcaggcttcaagggtctaggccatccagccttccctgttgactcccctccttttaccttgctgaactgctttgcataaatattaagtgaaattgatgagggccactggtttggactgagctcctgcacgcggcccaataaaccaaaccaaaatggagtccctcatgctaaaagttccacacgaccgagccaaaactaattggtttatatgaccttctgagaagtcaggagacggagagctggcagccaaaccctaagcaagcccattttagccagcatgtgaaggaagtccctctgctctaacctttacaaggaaaagtcgctctgaaacaatcaatctgctttttttgttttctgtttctgctttcctcagcccttttctgtctataaaaccaaacttctctgctcagctcataagaacactcactttatagaatgaggtgttgcccaactccagaactgcatataaaagccagttaagatctttgaacaaaatatatcttcaaaaaaggacaaatctccaacactttaaaattatagatctgtctgtagatcctaatctgctacaacacttcctgctcaaaaataataagcaggatttttttttttttttgagacagggtctcgctctgttgccctggctggagtgcagtggtgcgatcatagctcattgcatcctggaacctggaactcttaggctcaagcaattctccagcctcagcctcctgagtatccaagaccacaggtgtgcaagcaccacacccagctgattttttgtggttgttgttaacaacttttaagtttaggggtacacgtgcagatttgttccataggtaaacttgtgtcataggggtttgctgtacagggttatttcgtcacccaggtattaatcctagtacccattagttattttttcctgatcctctccctcctcctacctgcctccaccatctgataggccccagtgtgtattgttcccctctatgtgaccatgtgttctcatcatttagctccagattacaagtgggaacatgcagtatttggtttcctgttcttgcgttagtttgctaaggataatggccttcagctccatccatgtacctgctaatttttgtagtatttgtagagacagggttttgtctcgaacttctggcctccagttatcctcctgcctcacctcccaaagtgctgggatgacaggcatgagccaccacgcccaagctaaaccaggaagtttttgagtcatttgttacacagtaatatggcaatacaggtctggatgtaaattcaacactcttccttcttgagaagtaaatattaatgaccatgttgatagagcaaatttgtattttaaatgggtgtgtcctaactcatcacctgcgatgagtggagcaacgtttagatgccctggatgccactgtgaagagagaagaccagtgagtcattgctgctagaacatgttgctaatatcaaattcttgagtagtcccagggaacagttgaacctgctgctggccaattactgcaaggagaaacaatagtgtcagtgaagccaacatcggaatgatgggttttggcaaactcccttcagcatccagatggataatgttcaacaactctactcaacaggttaactcatttagttatctgggggagcacgatggggcttaattagcttactagatctgttacaatgcatttctgttgaaaatgaaaggttccccaggaacaagatacaggtgattttatgactgagataaacacgtggttactcctgttcctcaaatagctcaagtcaaagtcatgctttaagatgcagcaggttcttttgcataacaagataccaccctctgcttgctatctcatgcagggttcttagaaataagaacctaggacacatttttctaaagccagtatttagatcacctgttgggaaggctttctaaactacaaaggctgggcgcagtggctcatacctgtaatcccagcattttgggaggccaaggagggaggatcatttgagcctaggagttccagaccagcctgggaaacacagtgaggccctatctctccaaaaataaaaaacaaaacaaaattagccaggtgtaatggcacgcacctgtgccattgggaggctgaggtgggagggtcgcttgaacctgagaggttaaagctacagtgagcagtgaaggcaccaccacattccagcctggacaacagaccaagatcctatctcaggaagaaaaaaaaaaactaaactacaatgtacccccatctccttgcatctagaaagtctagtatgagcacctctttcctcattgaaaatcaccatcatgatagcttactattactagaagaagtatgttttgaaaaagtccacagaaatttgatagtgaggtaaggttgaaagccaccaatgtgtctgaaataatacaaaatacttgtatattagataatttgaatatggggcaaagagttcctgcttaaaatatagttgagaaaaccattcttccaatagacactttaaggccatcactggaatcaggtaactggtgtttaactttttgcctcaaccaattggaaatttgcagctaatgtcatgcacattccgagccaatgtgttcctttaaggggctgtcatatttttttccttcctccctgtgtgtggatttctattttctatttctattctgacagcctttgcagttgtgttttttcttttatcttatgatgccttgatcgcttttggaaacaggcagaatataaattacaaattaatagcatgaagctggcagggaaggtaggtactcgggtttctttcttggccacagctatcaaaatgcattttcagaacaacatgcgggaaactactagaagacttagcaagtgcctctttaaggaatgggcccttggaagcagctaccatcagagaaatccctgctctgccctgctaacaaagcctcacaactctccacaaaagatatctttctcaaggctcaaagggcaggtcaagcctccaggaggaaggtacccaggcagataaaagacgtatgttgtaaagctaattcccagctcagggcagagctgtatatctgacactccccctcttattgggatgatgatgtggctcattcattgcgtaggttttaggcttcctctggaggagagaactttgagccatcagataagagttgtgagcttgtcttcttgtaacaggaatgtttctgcctccttcaaacctcctcttagaaagcctgtagagagaagtgtctccaaaaaaggcaagttgagtttgcctctgggatcctgaaatcaaccggcaaaaacgggataaaacagtaggggacgggggaccttcattacaagaaaacgtaggatggaccacatgggtggcaggtggagagggccctccagagcttactgcacagaaaccagcccccctcctggcataaagtcatgctcatggccagcctttcctgggctgcagggcacctctcctctcagtaaggagcactctgggctcacacagagctttaaaaatatctctccacccactgaaatttgattaatcagccaagtgctcacccatgtgtcacagtggtggcagagatatatgtgatggtgacatgacgggtacaagggaagcacacaggatctcatctcacagggagcaggattcagtacatgaaagtgaatggcatgggctgtgcagccaggtggcagcttgaatcccaggtccagcagatgctggttatgtaaccttggacaaggttatttaacttctggatttttcacgtttgcaaaaatgtagttagtaacagtacctgggccgggtgtgttgactcacatctgtaatcccagcactttggcaggctgaggaaggaggattgcttgaggccaggagtttgagatcagcctgggcaacacagcaagacctcgtctttgctaaaaatttaaaaattagctaggtgtggtgttgtgcacttgtagcctcagctactcgggaggctgagatggcaggattgcttgagcccagaagtgtgaggctgcagtgagctatgatcgtgccactgcactccagccggggcaacagaatgacagtctgtctttaaaattttttaaataaataaataaaaattaatagtatatgcataataggatgattgaaaaggttaaatgagttaatccacataaaacactttgaacagtgcctagcacatagtaagcactcaataagctttagctgtgatgatgattatgatgatgacaacagtgacaatattgaaactaaaaagttgaatgaataggtagggatttcccaggcagacaaagaatatgtctggcccaagaagcttaaacaaaagcggagaaggaggaaggagctcaaggcagcaggggatcgtgtggagggtaagcagggagttgaagcagacaaaaaaaaagaagggattcagccacacaggacttcatacactttgtcaccaagtctagataccagtaacatggctgtaggctgtagagagctatttaagaatgataagcagaagcaaaatgttaaaagtgctataatggttgacaattttaactaattcagggaaacaaaataaaattaaattaattgtaacaggatgagcatggtggctcatgcctataatcccaacactttgggaggatgaggcaggcagatcccttgagcccaggcgttcaagaccagcatgggcaacatggcaaaccctgtctctacaaaaaattatccaggcatggtgacatgcacctgtagtcctagctactcgggaggccgaggcaggagaatcacttcagcccagaaggtggaggataaagtaagctgagatcacaccactgcactccagcctgggcaacagagcaagaccctgccacacacacacacacacacacacacacacacacagaactaattgtaacatacttctgggtatgacaaagaaacttatgcaagaataaccctcccaccatgtgccataagccaggcacaataaaactgaaccaaatatatgaggcaactgttttcaggcaaatgacaacaggcagcacaagattacaattgcaaggagaagggaaattcacatgacaagccccatgctcgccctggctctctgcctggggacaatttcccaaccacaattcacgtagtagctgcacgaactagaatctgcagggtaggacaggagagagaagaacactatgcagagagggaacatcagaagcccatgtgtgggttccccatgaacatctggttgaagcctatgttatccagatgcaaggtgagattttattttattttattatactttaagttttagggtacatgtgcacaatgcgcaggtttgttacatatgtatacatgtgccatgttggtgtgctgcacccattaactcgtcatttaacattaggtatatctcctaatgctatccctcccccctgcccccactccacaacaggccccagtgtgtgatgttcctcttcctgtatccatgtgttctcattgttcaattcccacctatgagtgagaacatgcaaggtgagattttaaataagacttaaccaggaagcagctgctatgaggttgagaacagaaaacaaatactataactgaagcagcagatagtggaaaaacctcattagtactccaggcatccagctaagacactagaaagaccacctcttaagagatggtcagtttccactgatttgccccccaacagagcgtaaaaacgaacctacacaaatttaaggtggtcagccagtaattgaattacctactagaacaaaaatcagcactcttcagagaaagataacacataatcactctaacataggattcacaatgttcagtctatagtcaaatattcacaggcatgcaaagaaaaaagaaaatctgaccacagtctttttaaaaagtccataaaaaccaatcccaggatggcctagagccttgatgttggatttagcacatacaactttaaagagctattataaacatagaaaagtatattcagagaattaaagaaaactattgtcttaatgattaatcagagaattaaagaaaactattgtcttaatgattaaacagatagggtatctcaccaaagaaatgggaactataaaaaagaaccaaatgaaaattctagatctgaaaaaaatttgggtgtttccgtgtgtgtgtgtgtgtatgtatgtgtgtgtgtgtgttgagagagagaaaaaaaccctaaatgctgaaaaatgttaaaaagtaagccaggcacaatggatcatgcctataatcccaactacttaggaggctgaggcagggggatcacttgagcccaggagatcaagactacagtgaattctgatggcaccactgcactcaccagggtgacaatgcaagaccctgcctcaaaaaactaaataaataaattctaaataaatgaaggatatacagatattcacttttactttccaaaaacctctgtggatttgaattttttaagactaaagaaatattttttaaaatgtatttttatttgtatatacacaaaaaaagaagataaaagttttaataagccaaggctgggtgtggtggctcatgcctgtaatcccagtactttgggagactgaggtgggaggattacatgagccctggagttcaagacaagcctgggcaacatagtgacaccccatctctaaaaaaaatttttttttaatttagcaggtgtggtgacacacacctgtagtcccagctccttgggaggctgaggcaggagcatcgcttgagatcaggaggtcaatgctacagtgagccatgtttgtgccactgcactccagcctgggcaacagagcaagacactgtcttaaaaataaacaaaaaaagaagttataagccaaggaataacctaactaagtgtgcatttgagtagcatccctccaatggtatcgaactgaactgacatgtgggtggatcatagatgaaacccaataagatcagctccagtgaatgctgttgtctaggaagtggaaacttgacccaaggcaataccaatgtggtcagagaggaaggaagacttacagaatacgaagagaggtcaagatatatgggactaaagattgtatgtaaggaccaagagataacaaggatgattcccagatgactgctgtggctgactggcaatataatttcctgggaaaaatcccagaggagaggcagttttcaagaataaagaaaatccattttggctttagatatttggagtttaagggacttgtgagacacctgcacaggactacaggtactaggtctaaaatccaagagggaggcaggactggagatacgtatcttgaggtcatcagcacgtagatgctcgggcagaaggcaacaaaaaccaaccccaggagacaaagagtgtgcctcatacttctttaatcttttttaaaaatttcacatctatagaggtttaggaatgcatggtgaatatctatcttccattctttcttataatatttctttttgttttcttttttctgagggagtgccatggcacaatcatagctcactgcagccttgacttcccgggctcaagcaatcctccctcctcggcctcatgagtagttaggattataagcatgaaccactgtgcctgccttttaaaaaaaaaaaatatatatatatatatatagttttcagcaggcaggagatgaggggtacacaatgaatgcagagatgacaaatatgtagaaaagaggaaggaggagatctaggtaacgacatgggtaccaaggcagtgatggactgcaaaaactaaggtgtgaacaacagtgccagatgctgcagaaagtcctgaataaacattaaaagtcatctaggccagtcatggtggttcatgcctataatcccagcactttggaggctgaggcaggcagatcacctgaggtcaggaattcaagactagcctggccaacatggtgaaaccccatttctactaaaaatacaaaatgtaggcgggcgtgatggtgggcacctgtaatcccagctactcaggaggctgaggcagaagaatcgcttgaacccaggaggcagaggttgcagtgagctgagatcgtgccaccgcactccaccctgggtgacacagcaagattctgtcaaaaaaaaaaaaaaaaagtcatctagaggaggcaaataggggctcctagagaaaactgagctgcaggagagcagtgactctggaatagtcaaagtgacactggtcaactactaaaatggaaccccaggttcaaaggatggcagtctggtattctattcccatactcaaaataccccctatgatatacagaagagtatatcagtataaatattaattttgaggccaggtgtgttcgctcatgcctataatttcagcactttgggaggtcgaggcaggtggaccacctgaggtcagaagttcgagaccaacctggccaacatggcaaaaacccatctctaccaaaaatacaaaaattagctgggtgtggtggtgcacgcctgtagtcccagctacttgggaggctaaagccggagaatcacttgaacccaggaggtggaggctgcagtgagccgaaatcgcaccactgcactccagcctaggcgacagagccagactctgtctccacgaaaaaaaagaaagaaagaaaaagaaatattaattttgagacatgcacacatgtgagaggctgggaatttttgctaattgccccgccaatgaaattggagagacacaatttccacccacacttggaactacagtggcacataaggaagactgactcaccacaatacattgacagtaaatcatgcagtcactccctacttcacagccactgttttccatgggaatctattcctcaacccaaacccacttcagcagcacccttttttaagctcatttggggaacacaacttaaccgcagccatgggttggtatgtcccatcctgggttatctatacagcacaggtgaaagccaaaatgttcctaggatgaccaaacgtacaagagtagcttgggaatgggaaggagagaaggagagaggaagaacaaacaacatagatggagaattctgtggcatagggcgcaaagacagcaggaacaaccaccgagacccccacctctgcccagagccatgggctacatgaatgtcttctggaaactggagacggcatgcatatcaatctctcaccagtctaaggataaaaaggcttaggccaggcacggtggctcacacttgtaatcccaacactttgggaggccaaggtgggcagatcacaaggtcaggagttcgagaccagcctcgactaccctgtctctactaaaattacaaaaattcgccaggcgtggtggtgcatgcccataatcccagctactcaggaggctgaggcaggagaatcacttgaacccaggaggcagacgttgcagtgagccaagattgcaccactgcactccagcctgggcaacagagcaagactccatctcaaaaaaaaaaaaaaagcggcgggcgggggcggtggggaatattatctcaggtttgggataaagtgaagaaggcaagattctttttttttttttttttttcttccccctagagacagggtctttctttctcaccaaggctcaagtgcaagtgcagtagtacaatcatagcttacagtagcctcaaactcctgggctcaggcgatcctcccacctcagcctcacaagtggtggggactacaggcatgcaccaacacatccagctaattttttgtagagacagggtctccctatgttgcccaggctggtctccaactcctaggctcaagtgatcttcctgcctcagcctcccaaagtgctgggattacataggcatgagccactgtgcctggccaaagttagactccttacaaaccttgtttactgacaaatactgagcctacaaaaaaacttcataatgttgagttacaaagcataatagaaaaaagcaatataaattatacaaaaaaaaagtttcatgcaaaagaaagttaccatcatctggaagacgtagagaaaaagacttttattatgaatatatatacaaataatttatgaccagaaacagaagagattttcacaaactggaaaatagctaatagctatttcctaatagctccaaactgaaaacaacccaaatatccactgagaataaaataggaaaataaattaagatatatttatatacagtggaacattatatattaaagaaaagaggtaaacttcagatggaggtgaatttagtttaagattaagatagcattacaaggccaagcacagggtctcacgactgtaattccagcactttgggaggccaaggtgggtagatcacttaaggtcaggagttcaataccagcctggccaacatggtgaaaccctgtctctactgaaaacacaaaaattagtcaggcgtggtggcacatgcctgtaatcctagctacttgggaggctgaggcaggagaatagcttgaacctgggaggtggaggttgcagtgagcaaagatcgcgccactgcactccagcctcggtgagagtgagactgtctcaaaaaaaaaaaaaaaaagatagtatcacgagattattcaataaatagcattaagaaaactattcttcaacaatcatactgcatatatctaatagaattccatataatgcactctaaaagtataagatattgctaataaatctggtatatgcataaacttcctggatagacgtaagctccttggaaagaggcaatgaatattatgcttatttgattttcctctactacctagaaggcatttcctcctccacctagtaaatatccgtttaatgaatgaataaaaatggatgaatgaatgaatgactgtctccatcaatccaccttcactgagtttggctgggtgattcccaactttaatctgatcattttgaagcagctttgcatgtttccctcctgagctttgtgtaaagagaagaaatagggacttcccagaagggaattgcagctgaaaatgacctgcgtggcaagtggtccttttcatgcctgttttcagaggataaccattcacgaagtgcacacctttggcccttacactggaggaaagggattttccatcattggtgataaacacgaacaggtggggaaacctgtagccattcacaagcagaaggctgcagtggctgcagggtggggagcttgacagcagataaggatagcacccaactaatgcctatgctcaaggcagccagaccacaaaggatgctgcgatgtccatcagtgtccaacacatcaactcccagtgcagcaccacctgtcctctgagggtaaatgagtgcccccaaccagcagaactttagggtcaccttgccatgcagcagcccaagagaacagcaagcaaactatgccctggaaactggcttccccaacaccaatccatagtcatctgaattgattcaagccagttggtttccagaccctgcgtgcctgctctaaaatcagaacacatccgcactgtcctgcccagagccccgagatgcttgtaataaaccaggaacagtcataactcagtgttcgccttggcaaaaactaaataaataagtagaacgaatcttctgtcagaaaataaatggcccttccccaggctgagagcctggattaccctcctgaaggacaaacacagcatcttcaccagccaatctcgggactttataaagcccccacttcactcaataaactaccccaaggctgccaatgctcaggctgccagcctgggcttggagggctcttagaattactctcgctaatctacatactgaaaaagtgcatttcagtgcttctcaagctgcctttgcctgattaaaatagcaagtttatatgcttttctgtttgtccaggaaagtggagggcatttcaccagggcacccaagtagggagaggagggttgaaatccagccagcagccctcttgaaaagccatgcacccccacagtagccctgaacagttgccttagcagagcttgaatttaacagtgaaaaaagccattgcactgaaaagtcacagagaaatcatctcttgatcattcatggcaaagttgggaaggaggaaggggggagaatatggaaagccacagatgattccaaactccatttggttagtgatttttaacctcttaaataattgcccaaaacatatagatagtgttgcccagttctcagccagggccactcagtgggtcctgcacgcatgggggactcccagtccctcctgctgatgactgagcctggaggatctactcaaataaacacaagcaaacatccaccccacattaatgtaccacctgccctaatgtctattcacagtgaagactcccataggtaggaaaagcctgggcctcacttcacctcccaaacacacctgctatgagctgaatgtttgggtccccccaaaatgcctatgtggaaacctaaccaccaacgtgatgtcattaagaagtgaggtctttcaggaggtgattaggagggagcagccctcatgaatgggattagtgcctgctatggtttgaatgtcccttccaaacctcacattgacatttgattagcattatgacagtgctaagaggtgggatggttaagacgtgatttgactatgaaagatctgccctcatgaatggattaatgtcattatctcggggggagttcattatccagagcgtggactattataaaagtgagtttagccctctcttgctcttaccctctctcgcctttccaccttctgtcatgggatgaaacagcatgaaggccctcaccagataccagtgctatgcacttggacttcccagtcttcagaaccatcagccaaatatagttcttttctatatcaattacccagaaggtactatgttgttatagcaacacaaagcagactaagacagtgcccttacatactcaaggcacaaaagaacttattcactctctccaccatatgaggacacagcaagaaaagtgacatctatgaatcagaaagtggccctccccagacatcaaatctgctggcaccttgatcttagacttccaagcctcctgaactgtgcgaaataaatttctgttctttatgagccacctagtctatggtgttttgttatagcagcctgaacagaccaagacgccacccaagtgacatctatgaatcagaaagtggccctccccagacatcaaatctgctggcatctttatcttagacttccaagcctcccaaactgtgagaaataaatttctgttttttatgagccacctagtctatggtgttttgttacagcagcctgaacagaccaagacaccacccaagggcagccttagcctgaatttgtggtcgcctgtatgggctcactttggaggaggtcagagctcaatttcctgcttctgtgtcctgcaccagcacaccttttgctcaactgaagaccagaagatgtaagggttcctgctctcctctcaggccaccagtctttgtccagaccacagtgagcagccgctatccctaggaatcttgattctgccccaatcactccacttcttcaaacatcccccagactctctttggacccagcccaccggggccacatcctctgctgcctccctgctcattcatgtaaataagcaagcatttaaataagcacacaagcaaaatggatgagagaaggagaagctattcaatggcctctcctcttcacctccctcacttcctgcctgttgtgaagcaagtttggcttcactgtctcagagccaaatgtcctccatcttccttctgggagaaatgaggctccctaatgtgcacatacaaagcacactgatttgaaccattacacttaaaagcaaatatgtgggccaactggggtaattttgacttctctacttgagaaagtaaatttaaactttgtgccttaaaatgatattattacaaacaacaaagtattcaaaaacacgagggaaaactgattctggtttgacctcagccgatgtagtacctaggtaaaaacatcaggccaaatcaacctaatcctctattccgggggggggggacttgtttttcctatttttaattagaggattggtttatccaagatacaatgagacacagtcctaggatgaatttagtcatcacgttcccaggtttatgtccatccctaacccctgccttgagcacccagggctgtactgtgttacaaagaaacagaggcaattaaaataattgctatccactgtcacctagacaaagcttccagatgattctgatctgaacaggattcaaagcaccatggccagaagtcaagagacagccattaacagggcttaaacctcccctgcagatggactccattgtcagtgacaacacagaaacaagacaattccattggtgataaagactccggaaaatggaaaacacattttaagagaggtgaaggctatccccccagtcactatccaaggaaaccgaaatatccaccatagattgctcaggctatcaggtctgtacacacacacacacacacacacacacacacacacacacacacgtcacttgggcaaaactttgtctctgaactctttcccattatgccatggctacacttggccacaactgccaaggagtggccaaagtccagggctttcaattgagcttcacaatagccagaaacacctccctgggaggggggccatccccccaaacagggtaggctccttaccatcgagctcctccacggagatattagccagctgttcgctgtcactgccagcagagagcgatcggttgaggtaattccccttgtacaacaagccggcggtcacatggtggaacggcatcttttccctgcccaagagagaacaggggaggggaaaagaaagacatcatcattcattcttcctttcctttcttaaaggaccatctgattttcagatggccagtgtcattttaaaaatagcagtaatatttctagtgggaaagtcaagatatttccagggtcccaatgacctgagcaatttccaaaggaattcaggtttttcccattccttcactgtacatcttacttcattttccccatttaattatgaatttgaacgatgttgtccttgttaatcatggcacaccacatcaccatcgaactatctctttgcaaacggcaatatccttgactcctttccttggcccgataaattctcacttgatgcttgtaaggaaggactgagaatcccagaagtgtagggatgcccagggactagatgtcttgtctgtgatcaagcagagatccaaatgtctcatttctcccagataatataggcattgcactcacacagcactcaaaacaggtaggaaatgcccaagctctaagtaagtacatgcaatgctctgcatctcaagcagcagctgccaaacctggttgagatgcagatgctgcttacatgagtggtgtgtgagcacacacattctgaaatgctaatcacacctgccctgctggaaacaggagtgacgccttcaggtgtcccacaacgaagctacttccagcactctcacacaaagttaaagcatccttctacgccaatagaaaaaagctcctgaacccagatggtcatcaatggggcttagaagtttccactaatgcaaggctgactggaggctccaggctacggaaaaaagagatgtgagataaaaggacagcaaagacaatggaagagaatggaagaatgagcaacgacaagaaagaggaaaggcagatgggaagattatcttctccaaagcagaaagagcatagctcctggcccaacttgtctaatgatgctctccgtgactttgaacaagacgccgaatgcttcacattctggttccccatctagcaaaggggactaagaggatggataaacctctgagcagaattagggccaacaggcaggaagcacaggagtcaatcacaaggagtgggtagagaacatctttgtatcggagcttctggaaagtgaactgggcagcactcaacctgtgaaacccctgaaaattaaaaggtttaaccaggagcacaaagccagttagtgacagaagttgttctagaactccagcatcctacatgctatttccattaagcagacccagctaagtgccagacatttccacccggatgtcaaaccctcatttcaaactcaaaatgtctaaaaatgaattaattatcttcctacaaagtaggctacactttctggtttctctatttctatcaaaggtgcttttcgctcatcacaacaactgggacaactctcccaaatgctcggggccccaaaaagtaaaacagacacatggctgaggcaagagccaactgtcagcttgcaacccatcccctcgcccttaactctttccatagctaacagcatgtacatccacagaacaattgcaaatggcaggatgctgattacaaagggtatatgcatttgccaattataagaggtacatcttcagctagttacaagtgagatgtttccaaatctatccttatatttaaacagaatacaagaatctttctctagaagaacacttcaatgaccacctccttttttctccaagttaattttcagaccaaaaagctttaaaaggaagaatcgcatgtgtgaattaggactactctatcttttccttaaggccaatcctgatttcttgggactgtgtgtcatggtcatttgagtacggactgatacccactgccataatgtgaatgtctccccaaaattttgtgtgtcagaaacttaatccccaatgcaacagtgttgagaggtgggacctttaagaggtgattaggtcatgaggacagaattaatgctgttattgcaggcataggttacctatcacaagagtgagttccttataaaaggatgagttcagttgggtgcggtggctcacacctgtaatcccagcactttgggagacctaggcaggtggatcacctgaggtcaggagttcgagaccagcctggccaacatggtgaaaccccatttctactaaaaatacaaaaaattagctggacatggtagtgcacacctgtaatctcagctactcgggatactgaggcagaagaattgcttgaacccaggaggcagaggttgcagtgagctgaaaccatgccattgctctccagcctgggcaacaagagcgtctaaaaaaaaaaaaagatgaattcagcccctttcccttctctgcctctttcattctctctctaacactcatgctctcttcctcttctgctacaggacgacacagcaagaaggcccctgaaagatgtaggacccttgcccttggacttcccagcctgcagagatataagaaacaaatcttggctctttgtaaacaacccagtctcaggtattctgttacagcagcacaaaacagactgagacatccatggtccagaaaatgagatgtcaaccctggctaacacttcttatgtgatttcaacttcaccctcagtaccagtcccacacacagtgagcctcaccagctgttatcttaacatgtttaagtcttcataaacatgggaagacacctgctctgatattatctaatttgttagctaagcctcactagatgagcctcaccagctgctaccttaaccaacgtttaagtcttcacaagcatggaaagacacctgctctgttcttatctaattcacttcctggaacaagacccactaaggtcggtacaaaaagcattccttccattccaccatgcatcactctagtttctcagcattttataaatatcttcctattgtcaccttttacctggttgtctgcagctttggattcactacacaaatttttacagtcataataaggatgttatactcaagcaagcatctccaacccacgccccagttcagccacagaataaatgttgagtactttgcagagaaaactggtcacaactgaatcccacttgatataccaacataatttgcttctgaaaaaaaaaggcagcttacaaaattaggtacacattcagttcatttagtctctgcattcaaaaagctcaaagtctagtggggaagaaaccatgagcaatggaacgatccatatagatatataaagtcatgttcaagaaagggaagaacattatcctaagtaagctaaaaacagctgctgcaattaaggactaaatttcactccaagctgcctagggaaacccaagctttaagattctctccttggctaagggaagagaaatacacaagttcaagcaaagataaaccttgtcctgaaactaaaacttgaagatggatccttctatagagagcaacaaacaaaaataaataaatattttcaacagcagtttcactcactgtgaaatatttaagcgactgtcatgaaaacaatctttctgtgttttatgtaaaccagtgatatggtctgaatgaatgtgtcccccagtaattcatacactggaatctaagactctaatgtggtagtattaagagatggagcctttagaagctgattaggtccatgagggctcctccctcactgatgggattaatacccttataaaagggttggaaggaactagcaaggctcttttgtctttctgccttccaccatgtgaaaatgcagcaacaaggcagcatcctggaagcagagagcagctctcaccagacacaaaatctataggtgtctcgatcttggacttcccaacccatagaactgtaggcaatgaatgtctgttgtttataaattagctagtctaaggtatttgttacagcagtagaaactaaagcagagtggtttcatggttaagaattggctgggtgtggtggctcatgcctgtaaacccagaactttgagaggttaaggcaggcagatcacccaaggtcaggagttggacaccagcctggacaacatggtgaaaccccgtctctactaaaaatacaaatattagccaggcatggtggtgggtgcctgtaatcccagctctacttgggaggctgaggcacaaggatcacttgaacccgggagtggacgttgcaatgagccgagatcgtgccactgcactccagcctgggtgatcgagggagactccatctcaaaaaaaaaaaaaaaaagaatcagcactttctagtcaaaaacagtgttagatttgaatcctacctctgcccttattagccaggtaaataagtagtttgacctctgtaagcctgtctcctcttctgtaaaatgggttttaatatatactgaagagaatagtactgttgtaaatattaaataagataaacggccaggcatggtggctcacatctataatcccagcactttgggaggccaaggagggaggatcacttgatgtcaggatttccagaccagcctgggcaacagagcaagaccctgtctcttcacacagaccaaaaaataaaaaaatttagctgggcatggtggcacacacatgtagtcatagctactccggaggctgaagtgagaggatcatgtgagcacagtaatttgagacttcagagagctatgatcccaccactgtactccagcctgagtgacagagcaagactcttgactctaaaaagataagatatggaaagcactgtacttagcaccaggcatctgctcagtgagtaacaccagtaattatttgctaaggatcatatgaagcaggatgcaggggcaacaagaagtcatggatgaattagattgatgcctggattacatgctggattacaaaggagggtcagtgagacctgacaaagggcaagcttcagggagaggctggcatgtaaaccactgtgctgagggatcaggtgtgagcagcaaagcaccagcgggttccagtgctgaatggtgtcagtatgcagaaggggctacttgaatggaaagtgccagagccaaagaagagtccacttcctgggtgccagggaggctggctgaattgtcatatcaaagaaaagatcttgtgaggttaaaaccaaaagggatggttcctgttaatggggtcaaggaactggtacatttcttgacagagtaatatactgaagaggccatgtatggtgcctaacacctgtaatctcagcattttgggaggctgatgctggaagattacttgaggctaggagttcaagaccagtctgggcaacatggtgagactgtgtctctacagaaaaattttaaaaattttagtcaggcatggtggtgcatgactgtagtccctgctactcaggaggctgaggtaggaagatcacttgagcccaggagtttgaggctgcagtgaactgtgatcttgccactgccctccagcctgggcaacagagggagaccttgtctctaaaaagttaattaaataaataaactaaagagcctcattcacattaacttgaaatgatgcccttttgtgatggtcagttttatgtgtcaacttgactgggccatgggttgcccagatatttggttgaacattattctctgtgatgtgtctgtgagggtgttgctggattaggttaacttttgaattggtagtctgagtaaagcagattctcctccccagtgtgggtgggtctcatccaacagtgaatagaatgataggcctacatggaatgaacacactaagaaagaatttgctcttcaaactgtcttcaagctggtacatcagtcttaattctgccactgaactcagacttggactggagcttttcactatctgattctcaggtcttcaaaccagactggaactataccattatttctcttgggtcttcagcttgctgacagcagactgtggaattttcagagtctgtaactgcatgagctaattccttatgataaatctctttaaagttatacagatagattaaggatagatagatagatagatagagatatatgatagatgatggatggataggtaggtaggtagatagatagatagattctgtttctttggagaacccacattaatgcaccttccttttttttcctctacagtaccaaggacccaggcacattgcagtagggtattattattattctgagcaaagccctgtgtgttctgcagggcttctaaagcagtgctactcaaagtgtggtctatagaccactgcaaattgcatagcatttgttgctggtctgcagtgagataagtaaaagaactgagagaaagcattgaaatagcaatttagagcattgccccaacttctaagcacttgaccagtggacttgatttttgtatatttttgcttcttttatttttcctggtaattctttcttactggtttttgttttgttttgtttgtttttgagatggagtcttgctctgttgcccaggctggagtgcagtggcacgatctcagccactgcaagctccgcctcccgggttcatgccattctcctgcctcagcctcccaagtagctgggattacaggcgcctgccaccacgtctgcctaattttttgtatttttagtagagatggggtttcaccgtgttggccaggatagtctcgatctcctgaccttgtgatctgcccgcctcggcctcccaaagtgctgggattacaggcgtgaaccacagcgcccagctcttactgtacttttttaaagtatcagtctacaaatgaccgaaactaaaaaaaattaaaactggtccttcctcacaaatagtttgagaagcacagctctaaagtatttaatttatgttgtatagatttctggtaatgaaccacagagaaagcaagaaaaacatttggagaaatgcatcttaacttgtccctgaaactttttcaaagagcttaagatttcttaaaagtcttagatggacttctgaaagaagctgaaagacttcaattgattcctgagctctctatagagtgctagagaagtacaaggcatctcttgcagacttgacagcaatccgtgtcctccaattaccagacatacaaggggcaatattgatcttgcatgctaaaggttaaagagcctaaccagtcctgacacagcctttgccaaattcctgtaaaaacaaccacgaaagcacaccaaaataatgatattctcaacaccaccaatgccagagtatggaagaagctttcataaaatcagtgcagttaggattagaatgatgaataatcagtggtgcagccttgaagtcagagacggaataacagagtcagatagtacagggataagaagagattgttatctacccaaattctcttctgtttcagggacttagggatgaccaaccataacagcaggcaatcacccttctgactggaattgctttattaaagcagccaaggtcaaatcccaccaccatctcttccaccactgtgaagcaacaactttttttcctctagctactcatggatcataactcccagtatgcaaggtggctaggaatggaaggtctgagacgtggaccctgcacatgaagatgagaaattagctgcaaggcacaggtgttggtgagaaggatcccaggagtaatgacctatggggattatgatttttcatgcattgcttctgattaagaaaaaactgcagaaggcctcaaataacccagaaatatatatgtcttcctctctgttcaacagctacatggtgggcacaagaagatctcatcttactccagcaaagatgctctcaacaaaggccagctagaccctggacatttggctaagcacttatgaaacagttttgttcccctgttaaaatcctgcaggggcatgccagttggcaaacacttggtttggacagatctcaaatcagacaagaatgagtaagcaaaaacactaacgtagtggtctgtgtaaaagttctgcatcattagagaaggaagaactttcaagaagaagtacagcaaaagcctattgccaataatgatataatacaagaaaggacaattttacaaactttaacaaggtgtctatgacacaggaatgcaaattcataaagaaatatcagagtgagaagaagagatatcaagacaaaaagaaaaggcaataagctgagaggtaagccggtttggaaaaggtgcatgcatttgcaaacaaaggagaaatgcaaaaacagtagcagaatgaaaatctgcattaaaggcaatgaagagtatttcaaagaaacagaaattttaccacataatgcacccatgtacccaccacccagatttaatgatattttgccttctttgcttattttttaaagaaataacatattacactgaaacccttaccacctactctattctttcacttccctccctccacagtgacaactctattatccttcctgtccatgcttttaaatttgtccagattttgatgtaactacatagaatatattgtatcattgctgtgccgatctttaaatttacataaatgatattacaccatccatatgcttttgcaacctgcatggttcactctatattggatttctgagatctatctaaatccatacacatacaccaaattaattttttttttttttttttttttttttttgagacagagtctcggctctgtcacccaggctggagtgcagtggcgcaatcttggctcactgcaagctccgcctcctgggttcatgccattctcctgcctcagcctcccgagtagctgggactactggcgcccgccacgacgcacggctaattttttgtatttttagtagagatggggtttcaccgtgttagccaggatggtcttgatctcctgacctcgtgatccacctgcctcagcctcccaaagtgctgggattacaggcgtgagccactacgcccagcctagttaatttttaactgctcaacagttttccattgtatataaattacacaatcgatggaaaagtgtgctgcaatgaatacccccatgtgtgtctcttcatatatatttgcaggaatttctctgaactgcatatctagataaaatactacctggttattgagtatgcgaatctttacctttattggatttagtgaaattgcactccaaagtgattgggttatttattggtatataatagttatttattggtatataataaattacccctgaactttgtggcttaaaataaatatttattatctcaggttctgtgggtcagaatcaggagctgcttaagctgggtggttctggctcaaggagtctcctctgattgcggtcaagacactgactggggccaccatcatcagaaggcctgaccggggctggaggatccatttccaagatggtgcactcacatagctttgttcacgtgagttgggagcactcacatggctcccaacatgatgccattaaacatggatttggaaagagatgttcataaaaggtctcactttcttgtgggtctctccatagggcttctgaagtgtccttatgacatgggagctggatcaccccaagcaagtgatcaaagacatgggggtaggggctcttatgacttggtcttggaaatcacacatcatcacttctgccacattgttttcattagaactgtgtcactgaatacagccaacacttagggggaaaggaattagactccaccttttgaaaaatggagtatcagataatttttagatgtattttaaaaacaccttaatgattgtgacaatttacagatccaccattagtctaggagtgtgtcaatttccccgatagccttgccaaaacttggtattagcagactgtttcatttttaattggatttccttcactgctagcttaagcatctttttatatggcttttactcattcaatttcttctgctacaagtatgcttttcatctttatgtattggattgtttatgatttttgcactgctttgtccttctatgttattgtccagtgtccaatttcaatcttatttttaaccccttttccccaaaaattagtcagaattattgtttcttacaatcgatacttatgtaaacttttccacaagtttgccaattttctgctcatcattggttcttgcaggctactcctttgttccagattcaatttctttttcaatgaagtgtaaatgtaaataaggggctataaatggcaagctttctaagtctttgtcttaaaaagtctttatttcaacttcatttgaattatgaaggttaacctagtagagaattataaattaatgatttccttagcacttaaaaaatgttttgttgctgatgagaaatctataggtatacttgctgttcacctattcatactcattctggacaattctaagtcattatgttttcagatataggtgctctccaaatctctttattctctttttggtaagctcttattagatgtacgttggacctctttgttcaagctggattctcttgactggttcacccaaaagctattcacagttcatctgactgaggaagctgggaggccaataactattttccagactttcttgctactaaggttctggatgaaagttagttctaatattcaaaagctcttacacaaaatttgcaatatagacatgaggtgaaggcagtgatatactggtaaatgtttagcacttggtctcaaaaagaaacactcttgatgtgtagcattttccattttcatggtgaaaatattcccaacaaggaccaattccaagctcccaacatggtaccactaaacatggatttggaaagagatgtgcagcagtataccagcataccaccatgaagtatctccaccacacacacacaataggctaaattaaccacaaaatcacaaataatagtaaaatgtagcaaaatgattaggaagtgatgaattttaaatatttattaccttgatttttcacttatttcattgtaagttcatattccatttttaagaatgaatgcataggctgagtgtggtggctcacacctgtaatcccagcactttgggatgccaaggtgggagcccggagttcaagaccagctgggcaacatagcaagacctcatttctacaaaaaataaaacaattagccgggcatagtggtatgtgcctgtagtcttagctactcaggaggctgaggttggagaatcgcttaagcccagaagttcaaggctgcagtgagctatgattaaacccctgtactccagcctgggtaacagagaacgagaccctgtcttaaaaaaaaaaaaaaaaaaaaaaaaaaaaaaaaaaaaaaaaaaaaaaaggatgcatttaatagtcacctcacaaaatcccttaaaatttaaaagtgggctctcacaagccagtatgagcttatgagctagctccagcatgtcactggctgtttccttgccatgttttgactttctacagaaaagaagacatgaaaacatgacattttcctgcagcaacattccattgttcactctccagtttcctggctgtgacaaagcagctatggtggtggcagcaacagcttctgaatccccagatcacagctctaggggaccattctctaaatgctgggaagtcaagagaatgttgcagggacaatatacagcagtggcagcctcagtggtagcaactctcctggagagttgactttgagttattctggaattcattctggacaaccacctaaaatccactccttcaacccttgaacagttatgcaagcatcaaatcccttatactaaatcccctcctgcttaaaatacccagagtggttactggttcttgaactaagtcttcactgatacatcatagtgttgtccatattctttaaactctttttaattgttcacatttttacctctctgtgtatcttagaagtaatctcctcaaattatttgcaaatttgtactttctcttttcagtttttactgaatggtggttgaacctgtctactgaatttttcatttacatgactgtattttccatttccagaagtttactttggttcttttataaacacacctcttatttttcactgagtatcaatctttcattatgattcctatactttctttcaccttttaaccattttttttttttttgagacagagatctcactctgtcatccaggctggagtgtagtggtgcaatttgggctcactgcaacctctgcctcccgggttcaagcaattctcctgcctcagcattccaagtagctgggattacagttatgcaccaccatgcctggctaatttttgtattttcagtagagacaggatttcaccatgttggccaggctggtttcgaactcctgcctcaagtgatctgcccaccttagcatcccaaagtgctgggattacagatgtgagccactgcgcctagcccttttaaccatttctgacttatttcatatttttcttcagaatgtcattttataatttccatttctgaaggcactaatcctctttttgtactactctgactttcccagtgacaaactgtttcccagtattgcctgtcatttgttgaggggaggaaccccagcagcctttgcaacaggtgacgcttttcccactggagttccaagttcacagagatccccgtccatcacacagggcatctcaccagttcagaaccagtcattacattaattccttaacttagaagcctgcaccacacaggcagtgtacatttggactgcacatcccctggaacactggcttagagttttgatttgtcactgtagcctttctcttttgtagccattgatctgggaagaaaataagcatcactgctactttgctgggccagtgtggagactgagtctagctcccacctgtaagtgaaaactgtaacctccacctcccgggttcaagtgattctcctgcctcagcctcccaagtagctgggatgacaggcatgtaccacaatgcccggctaatttttgtatttttggtagagacaggattcttcatgttggccaggctggtctcgaactcccaacctcaagtgatgcacctgccttggcctcccaaagtactgggattacagacatgagccaccgagcctgaccatatgttgaaattcttattgccaatgtgatggtattagcagataggggccaccgcacttcagcctgggtgacagaacaatactccatctcaaaaaaaaaaaaaagaatttcaacatatgacttttggggaaacacaaacatttagtccatgaatagtaagttgctactaggttgtacaagaataattgcagttattgccattactcttgcaccaaccattactttcaatggcaaaaatcgcaattactcttgcaccaacccaatataacagaatatgtggcttaaacaacaaacatttatttctcatggttctcaagcctggaaggccaaaatcagggtgccagcttgatcaaattcttgatgaagaccctcttcctggtctacagggggccctcttctcattgtgtccccatgaggtggacagcagagagcgctctggtctctttgtccccttataagaggacattcgtgaggattccacctcattagtgaatgaggcctccacctcccactcattagcagatagggcctttgagaggtgattgggtcactatatcatgacccaatcacctctcaaaggccatatctgctaataccatcacattggcaataagaatttcaacatatagtcaggtgcagtggcttatgcctgtaatcccagcactttgggaggccaaggcaggtggatcacttgaggtcaggaattcgagaccagcctggccaacatggtgaaatcctgtctctactaaaaatataaaaattagccaggcatggtggcgcatgcttgtaatcccagctactcgggaggctgaggcaggagaatcacttgaacctgggaggtgaaggttacagtgagccgagatcgcgccactgcactccagcttgggcaacagaacaatactctgtctcaaaaaaaaaaaaaagaatttcaacatatgacttttggagaaacacatttagtccatgaattacagggggctgggaaaccggagtctcatttcctatttcctgcctgtgccagtccaagaccacatcttttgtctctgcatgaacattaaaaccccatcaccagagctttctggggggcagggaggttcctgttgttcagtagcgcccactcctatgcttatctccctgggctctgagtttccccttccttcctttctttctaactgattttattcgtcagagcttagccaggaaaacagagcctgtatcaggcagttcaacaagaggatttaaaacagctatctactaagttgttggaagggtggaaaagccaaacagagatacttagcagagattagagatggcagcaacgtattcccacccctagtctggaaggacgtagggagagggtggtactatcagaacctcaaagttgagtttcccaaaaggatctagcaccgtggtaggggctgcccaataggaactaaaaggagagatggaaaggctttgctctgccaagattcaaagcaagaaccactaaaaagagacagccactgctggagacaattatcaaaagcagatcgagatggggaaaaataccccagcctctctctttttcccgccttttcatttcctgctggtgtctccttttggccaaatcagtcagcagcctattgccagggaatctggaaatgtagtttgcaaacatcaagccctaccatgcagggtagcaggagaaaaaggcagataaatccgtaagaaagcaggcagatgaccagcaaagtgacacgtttggtattttttttctattttattctgcatttctatgttgatagcagaaaaagcacccatgttagcttaggacactgacagaggtagatctccaggtaacatttttgaacttcaaggataagaaaaaatgctctgagcattcaggtagaaaatacagtttaccggccaggcacggtggctcacacctgtaatcccagcactttgggaggccaaggcaggcagatcacttgagatcaggagtttgagaccagcctggccaacatggtgaaaccccgcctctccttaaaaatacaaaaattagccaggcatcatggtgcacacctgtaatcccagctactcgggaggctgaggcaggaggatcacttgaacctgggaggtggaggctgtggtgagccgagaccacaccactgcactccagcctgggcgacagagcatatccacaaaaaaacaaaatgagattcagtttccttcagaataataatggcttctgaagattcctccagaagcaaccacaaaaacaacactatctccacctcccgccgccttgaatgggtcacttaaattaaaataagtagagaagtttatgaagtaaatcatgaggaaatattgtaagtcaaatgtaatagaaaataaagttctcacttcaaacaattcaaactaaaaaacattgaagtacagtgaagtccaagtgaaagatgatgaaggtcattctatgtttgagggtaaaattcaaaatgatagcatattagtcataaacttctatgtaccatatcatagcactgtaaagtaaaaataatttaaatataaagaaaaactgcctgggcacagtggctcatactcacaatccccacactttgggaggttgagacaggaggataacttgaggccaggagtttgagaccagcctgggcaacacagcgaaacctcatctctatgaaaaatttagaaatagcctagcgtggtggtgcgcacctgtagtctcagctacttcggagactgaggtgggaggatcgtttgagcccaagaagtcaaggctgcagtgagcataatgttgccactgcactccagctgggacgacaaagactgtctctaaaaaagtaataaataaataaataaataaataaataaatacagatttttaaaaatggttgaagtctttaaagacaccctataagcctctgataaattacctggacaaaaaataaaaacaaaaaggatatgaagaaaagtgggtattaggctatgaaggctaatttaatgtgtgcatttctgagtgtgtgtgtcccccagagatccgtcaaattatcaaatataagaccacagagcaaacttcagcatacgtatttaaaaagttggtctaccacagttgaatttaagtagagacaataatgaaagtcaatactttcagtgtatactgggcagatgatgggtgcacccaaatctcacaaatcactactaaagaatttatgtaaccaaacaccacctctttcctaaaaacctatggaaataaaatttttttaaaataaaatagaagccaaaattgaaaattttattatattcccctaaatatttcctaggtcaatgtttaaattaaagttataattacgggctatctttaaagtaatgaaaatggaaacaatacttatttttaaaaataacaaaaacaatacttattttttttaaatcacagagtgtagcaaaggagcattcatatgaactttaaagtagttttttccaattctgtgaagaaaggcattggtagcttgatggggatggcattgaatctgtaaattgccttgggcagtatggccattttcacgatattgattcttcctacccatgagcatggagtgttcttccatttgtttgtatcctcttttatttccttgagcagtggtttgtagttctccttgaagaggtccttcacatcccttgtaagttggattcccaggtattttattctctttgaagcaattgtgaatgggagttcactcatgatttggctctctgtttgtctgttgttggtgtataagaatgcttgtgatttttgtacattgattttgtatcctgagactttgctgcagttgcttatcagcttaaggagattttgggctgagacaatggggttttctagatatacaatcatgtcgtctgcaaagagggacaatttgacttcctcttttcctaattgaataccctttatttccttctcctgcctaactgccctggccagaacttccaacactatgttgaataggagtggtgagagagggcatccctgtcttgtgccagttttcaaacggaatgcttccagtttttgcccattcagtatgatattggctgtgggtttgtcatagatagctgttattattttgaaatacatcccatcaatacctaatttactgagagtttttagcatgaaggttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctgtagaattcggccgtgaatccatctggtcctggactccttttggttggtaaactattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttattagtcttgctagcggtctatcaattttgttgatcctttcaaaaaaccagctcctggattcattgattttttgaagggttttttgtgtctctatttccttcagttctactctgattttagttatttcttgccttctgctagcttttgaatgtgtttgctcttgcttttctagttcttttaattgtgatgttagggtgtcaattttggatcttttgaatgtgtttgctcttgcttttctagttcttttaattgtgatgttagggtgtcaattttggatctttcctgctttctcttgtgggcatttagtgctataaatttccctctacacactgctttgaatgcgtcccagagactctggtatgttgtgtctttgttcccgttggtttcaaagaacatctttatttctgccttcatttcattatgtacccaaggagcattcagaaaaaaagttttgttatttaaatgttctcttttatcttaaagaggaaaaaacactaagtcctcaatgctaacttcttagttaaaaaataacaacaaaataaattaagaaaataggaaaaaaaggaaataatgaaagtgaattagaaaacagataatttgaaaaagctagttctccagaacaaaaccaataaacaacaaatctctgacaggtttattaaaacaaatatagaaagcataaatagataacatcctgaaatatgggaattctacatgcaactccagactaataaattttaaaacactggttaaatgaataactttgcactcaagataaagaaagtggatttttttagcgaaaacaagatgatttaatattattcacacttattgaaaaccttgacataacactttgttatacagtaatttgaagatttggttttgggttgagtttatttccagactttattttcatgtctgccataaccaaaaatacacctccgtaagagacacagatccaaatggaagaaaaatgtcattggcagtatttacgaagtcataatattcattcttcaattccatctgacaagcatgccaaggtttttgctgacatttggctggtgaagtttcatcttccctaacgtcaacagatgattttgcaaactgaaagcagttgcattttcatatttttaacaaatgagtctgaaactcccttgatctcttcatttggaagtttctcacacagttgacaaagttctgtttccagatttttgaactttacagagtagagtttgtagatagtgcactcaccatcttattattttttttagctacaaaatcacataatagttgagacatttccaaaaacatctattttcaaaaatgttctttccacagcataaggttcctttgagaagcggtgatttcctcaatctttgttaaaatgtcatctttacctgtgtatggccaacaacatcccaccatctcagaaaagaccagaaagtgtagatcatttgactgtttatgacagaaagcgtgcgactcttatttgtgtttgacaattcacttaagaactttgccctgaaataagacgcacactttgttgtggcacaaaagccacctgcagccatcttccatctcatctcaaagatgtaggccagtgagagtcaatagagatctacattttaaattgtcttttggaagtctgttaatcgttttggccaacttctgtccaatctgatgaactcctcagtgctctaactcatagagtaactaatgaagggctccttttgggagcaaaggaaatgtcagcttggtcactgtcttggggtctacttgggcctgttagatcagcatgatcaaaagctgaggtttcttggtagacgttctgtaaagcctcttgcccattatctattagtctagttgaagcaaattaatataatctgtaaatccctgatatggtttggcttcatcccaagccaaatctcatcttgaattcccaaatgttgtgggaggggcctggtgggaggtgactgaattatgggggcgggtctttcctgcactgttcttgtgatagtgactgagtctcaagagatctgatggttttaaaaaaaaaaaaaaagaggggaggggtgcggagtttccctgcacaaactctgcttttgcctgccgccatccacgtcaagtcgtgacttgctcctccttgctttcctccgtgattgtgaggcctccccagccatgtagaactgtaagcccaattaaacctctttcttttgtaaattgtccagtctctggtatgtctttatcagcagcttgaaaatgaactaatacaatccccctaaccaggcacttgtgtcacaagtcactggaaggtaccacagtacctcccagtgtgagatgctctccttttcctaaacacttcacaccagaccagacagcatatgggcaactgaaggcggcagtgtcattctctactgtagataatcagtaaagtataatttcctccttttattcttatactccaaaaaaacccttacatgccctcccctttgaaaatcaggcagagaaattaccatgaaacaaggaaaaagacaagaagcccattatgtccactattaaataacactatcctagaaattctacttaatgcagtaaagcatgaacacaataagagactatttaagaggagaaaaactaaaaaataaaaatgaaaagcctagagtgaaatacatgtaaatatttaactcatctttcatagttaagaggcagaaattacaaaggaaaagatgaatagccttgccagtataaaaatacaaacttctaaacattataaacgatataaataaaggtaataggcaaacagggaatgcaaagactgtatgatcagacaattcacaaaactggaaagacaaagaattaataaagtatgcaaaaacaacagttgatctcacaagtaaccaaagaaatacaattttttaaaagatgctcttatctttttttttttttttttttttaaaaagagagactgaggtcctgctgtgttgcccagactggtttcaaactcctgggttcaagggatcctcctgcctcgacctcccaaagtgctagcattacaggcctgagccagcatgcctgaccatgttatctgctttttcaatgggggagagtttttgtttcaatttttgttttgttttgtttttttgtttgttgtttttttctgagacggagtcttgctctgtcacccaggctggagagcagtggcacgatctctgcctccccggtttaagcattctcctgcctcagcctctgaagtagctgggattacaggcgcatgccaccatgcccagctaattttttgtatttttaacagagatagggtttcaccatgttggccaggctggtctcgaactcctgacctcatgatccgcccacctcgtcctcccaaagtgctgggattacaggcatgagccaccatgcccagccctttttcaagttgtttttaacatactggtgagaatgtaatgggactgatacttcatagcaattgaaacaacagttcagagaaagtaatttggccattctgcatcacaagtctgaaaaaaatagttctggccctttgaccctgtaactctattttttttttcagtctgtcctgagatgtagccaaagatttgtgtatcaagaaaaggcactgcgttgtatttttaatgaacaacaacaacaaaaaagataaaaacaagaaaaaaaaacagttaaaaatacagaaatcaataagcaaagtgcattcatatcagagtatgttgtggatcaaagacgctcactaaaattttaatgacatccaaacatctttataatgtaccactaactctaatacgtgtttcaactgagaaaaacgaacacacttctctcctaaaattctattacaatcatgatatagggaacaaaatagaataagtgcataaacacagatgtatgtatttaagtataaactgtatttgtctaattatatttatagccagtcacggtggctaatgcctgtaatcccagcactttgggaggccaagagggggcagatcacttgaggtcaggagttcgagaccagcctggccaacatggcgaaaccccgtctctaccaaaaatacaaaaattagctgggcatggtggcacgtgcctgtaatcccagctactctggaggctgaggcaggagaatcgtttgaacccccgaggttggaggttgcagtgagctgagatcatgccaccacactccagcctgggtgacagagtgagactctgtctcaaataaataaataaaaatgtaaataagcacagaatatcagggaaagaccatcattggcccaaaaactttggcagatccctggagggcaggatgaattcatccatctttacagacgtaattgggcagacagaagccaggctgaaagcatgcaaactggaaagaaagtggaggagggagaagcgctgagagcacacagagtatagtcccagtcagcagttgctaagatctggactggagacagggtggacagggggtgactgatttaagtccttcacttagatcagcttgctgggtttcccacccctagaaaaagatcctcttaaaagcaagcaggccgggctgggtggctcacacctgtaatcccaccactttgggaggccgaggcaggtgtatcacttgaggtcaggagttcgagaccagcctagccaacatggtgaaaccctgtctctactaaaaatacaaaaattagcctggcttggtggcgcatgcctgtagtcccagctactcgggaggctgagagaggagaatcgctgtaacccaggaggcagaggttgcagtgtgctgagatcacgccactgtactccagcctgggcgacagagcaaagactttgtctctcaaaaaaaaaaaaaaaaaaagcaagcagtgatctgcctgaggagtagatctgacgttgatctcccagagtaaggccttcatctcctggcatttacatggggcatcctgttcaccccttcccagtcttgaaccctacaatgaagcctactggtcaacatgccccactgctataaaagagtttgcagccattggtctcattcagagagaaaggctgctactaaaacctgcctcttatcacagcccatcacattcagaaacgccaggaatggcaatgaccaaacaaggattgccagacacttcaagaaaaccagtgtcaccgacaagcaggacagaaaaggtgaccccagacacagcaaggatgatcctggaaaaaagaagagaccttggaagaattttaatgtaatgcttcagggagagctgagaggctgctaaaaaaaaaacagtctgagatgaggaattgaagaaagtttaaagaactgatgaaataggagagaaaattcaaattgtatacacagtgaattactgcagatgcgtttcagaacaagagaacagagaccacggagaggaaataatacaagagaaattcccagagcggatgagatgaagcttgagactgaaaatgcctgtcagctgctatatgggataaatgaaaagacccacaaagagccaaacctcataaaatttcagaacatcagaattaaagaaagcacctaaagccctagaggaaggaacggacaacgttttaatgaatggcgatcatgctgacattaaactgcacatcagcatcatcagacacgagataacagtggagcaagtggtctggacatcacaggaaaaactaatttacacccagtcaaaatccaatcaagacagaggcttagaaagtttacaatttggctgggcgtggtggctcaggcccatcatcccagtactttcggaggtgcaggcattccagattagccagcataccaagcccccatctctacaaaaaatacgaaaacaggatgagcgcagtggctcacacctgtaatcccagcactttgggaggccaaggcacgtggatcacttgaggtcaggagttcatgaccagcctggccaacatggtgaaaccccgtctctactaaaaatacaaaaaattagtcaggtgtgatggtgggcacctgtagtcccagctactagggagactgaggcacgagaattgcttgagcccaggaggcggcggatgttgcagtgagccgagatcgcgccactgcactccaggcttggagagagagtgagggtctcaaaaaaaaaaaaaaaaaaaaaaaacgaaaagaatccgggcctggtggcatccatctgtagtcccagttaccacagagactgaggcagaaggatcccttgagcccaggagttcaggagttcaaggatacagtgagctatgatggtgccattgcactctaacctggtgacagagacagaccctgtctcaaaaaaaaaagaaaaggaattttacaattcatagacatcatctaaaaagaaatcactcagtgaattatttcagcaacatgcaaaaggagtccaagaaatgagagaaaatgagatctaattcatgagatggattctaacaatgaggtgagagcccagaagaccacagtgggggcaggtgttgtaaatcagtgccaaggaggacaggaagaagtgaacttccagcatcagtgcattaaagaaactgcataccaggtggccagatcatctgaggtcgggagttcaagaccagcctgaccaacatggagaaaccctgtctctactaaaaatacaagccaggcgtggtggggcatgcctgtaatcccagctacttgggaggctgagacaggacaatcccttaaacctgggaggcagaggctgcggtgagccaagatcgcgccattgcactccagcctgggcaacaagagcgaaactccatctcaaaaaaaagaaaaagaaaaaaaaaaaagaaactgcatatgcttagtgagaaggagaatccagcatcaatattaaatatcaaataaatacaatgagagtgggctcgccctccctccttcactctcttttccaatttatttatcctttcctcctataaatgttacagcactaggtggggtgtgctggctcacatctgtaaacccaacactttgggaggccgaggcaggaggatcccttgagcccaggagatcaaggcttagtgagctctgatcatgccactgtactctcatctgggtgacagagcaagactctgtctcgagaaaataaaaagtaaatgttatgggattgcttgtatcatatttgtttctgcagtgagtaattatttacataatcatagtaatcatattcacaaaatctttggttttgaatttgaaataggagaatcatggaaatttcagatagagaacaaatgtaaatgcctgccactctaagagtcagtaatacagaagacaagctgcaaaaaagaagaaagaaatgaagaggtgctaagccctcccccgaaaccaccgtctttcagactgggaggtccaaaggtatggtttcaagttaataaagaaagacttaagtttataagctaaagcaataaagctattcaattcagattggaaaaataaaaatgtgactggcagagactgggatgggaaaggggaaagactccacgttcttcctgtctttcaaaggagaggatggagagatcccatttcaagtggatgctcaaaaccacataaggttgggcacagtggctcatgcctgtaatcccagcactttgggaggccaaggtgttcgggggccaggaaggggggattgcctgagcccaggagttccaggccagcctgggcaacaacaggaaggccccatctctacaaaattaaaatgaattttaaaaaaaatcaagtaagcactttacttggagtgatttcatccaccagaatcactgagatgaaaaatggcttacaatgcttgcctctgacatggggggggtatagctgccagcgtctcttttacgtctatctacttatattttgtttttttattatcctattcttatattactttcattaggtcaggccataaaatcctatgtagggcataatcacaactatataaatataattacctggcctacctagccacatacatatatatttatagagatatataaagttcttcaaaggatataaaccaaaatgtaaatactagttattgctgagtgatgaacttactgttgttgtatatttagttgtttaacctctccacacttagtgacatgggtctatttcatttttacagctagagagaaattaaaatgattttacaaatgaaagagcctggctggaatttcctccacgtgggagtaaggccccaggaagccctcagacaggaccaaggctgcctgatggccacggctacagtgacctgcagcctcgcatgtgacctgctgtctgcagcccaggcctccaaagagagcctgggttggaaccctttaagggcccgtgttaacagctggctgtgtcagccaggacagacatgtgcctcccatcccaattttgattttgattgggactggcccccagagaactgcggaggattgcaaaccttcaggtaattagatgaacgctcctgctggaagaaatcctgcaccagcttcacaaggatgccggcgctggcctgccgacaggaatgcttttggcaggtgattttgagttgttctttctgaaagtaattacacaaaaagttccactgcttgttaaggctccttcttaaggctgttttgatctcttttaattaataagttgaatatggaaggatttaattgtgatgaatttctatgtaacttccttcaagatccccacgtaaagtggtcctgctaagtccaccatacacttctagctgctcagacacctgtatcaaaccgagagccttagatagctttctgcaaagtttgagagaatcctgctggctgaggcctctcccaagacagtgagaggtcagggattatttgatctacgggaaataactgcacactgtacccaacattgattgttgagagttctctagaacagcacttttaagactttagtagcttagtttgctcaggttaccgtaacaaaagactacagaccgggtggcttaaacaacagaaattaattttcttatagcctgaaggctggatgtctaagatcaagaggtcaacatggtcaggttctgatgaggactctcttcctggcttacaaatggccaccttcttgctctgtcctcacatggtcggggagagacagaaagagggagagagggcaagctctctggtatctctacttataagggcactaaattccattatgagggacccaccctcaagacatcatctaaacttaattacctcctgaagactaaagttaccttgcccaaattcctatctaaggggtctagggagtcatgccctacaaaccataaacactcatcagatgggttttatctaaccttgtatatcatgacttactttccaaactgacactggtataacatgacaagacaaggaagaaaatcaaaaaattttaccccaaaacatgtttctttgccatattttgaaatggtcctgcaaagctgtcctttgtgggggaaaatgtacatctgtaaagaatctctattcacatagctagatctttttcttccaggccctcccaatcctgaagagattaagtaagagtctagcaattttttaaaggtctgaatagaaaacatttgtcatctatctatctgtctctaacggcagccactataagccttcagaagaaggtctccacagtcttttatcttaacctaaacatttcctttctatggaacccaggtctttagacaaactcaaccaattgtcaatcagaagatgtttaaatttatggtgtacttggtttctccagtcgcccacctggccttccaatctgtactttccttcttttcttttcctactgttctaaagcttttaaataaactctcattcctgctctaaaaaaaaaaagaagaaaaaaaaagaaaagaaaaataaaaaagaaaatgtttaaatttacctatagcctagaagcccccattttgagttatcccctctttctggaccaaactattatgtttcttaaatgtatttgattgatgtctcatccctccctaatatgtataaaactaagctgtgccctgaccaccgtgggcacctggttctcaggacctcttgagggctttgtctcgggccatggtcactcctatttggctcagaataaatcttttcaggtattttacagagtctgactcttcgttgacactcccaaaaccccatctccagatagcatcacacggaagagaggaagagcctcaacatgtgaatttggggttgggggacacagttcagtccacagcactaactaggtcgacagcaaatatgattgaagacagacaaagtcaggcaggggccctagccagacttctgtttttggtttttgctttttgtaattttttttaaactcaaattagccctatctcagcagaagaggcttttaagagattcaagcagaaaggtacaggacctctggagattggcttcattttggccaattaacataaaatgaatagtatgtaaattagattcattcaatccatcattcagatggaaagccatttgaaacttacatgttatttttgagttgacagcatgagaatgtttggaaataagactacagcacagaggacaaagattgcattattttttcctgaggtttcttctcattctgccataaaactgagggcacaccctacgaaggctgaagcccgtctggccgcaagagaggtcagttcattcactcggtcgctcgtgcagtgcagtgggcatttaacgcatctaatgggctgtgatcctcggatggtatcagagcagaagtcacagcctgtggcctcgcaaagcttgcagaatagctatgatatgatattatctgggcaatgcgactgcctgagagctacgcatattcaaagacagcagagtagggactagaagcaacctcctggctgagcctctggtgcagatgccgtggggaggtgacgctggtcacagacttcccaatgcagacacagacactagtgccctgcagagagcagccggcaacagggatgtcaccagcaggacacaagatcatcccaacagccgggcagaggacaatgactgaaagacggctgttgcctcaggacatctgctggcaagaggagggtcccagacgacaagagaagcaaaaggcagagacaaaaaaaaaaaaatgaacacaacctaacccaagagggtgagttcaccagaaggacatttcgtgagtcctctcactcactaaccttcacaaagacacggtgatggacagaaatctgctacaagaaatcagaacttttctttgctcaagatgtgtaataaacaaaacgacagaaatccacaaactagggctgggtgcagtggctcacacctgtaatcccaggactttggggggccgaggcaggtggattgcttgaggtcaggggtttgaggccatccccgccaacatggcaaaacctcacctctactaaaaatacaaaaattagccaggcatggtggtatacacctgtaatttcagctacttgggaggccaaggcacaaagatcatttgaaccagggagaaggaggttgcagtgagctgagattgcaccactgcactccagcctgggccacagagtgagatgctgtctgtgggggggggagagagagagagagagagagagagagagagaggaaagaaaggaaagaaagaagaaatccacaaagtaccaccaaagcttgagctgcttggatgcaatgccctcccagtgtcaagcccaatgtcagatatacaaggaatatttgaaaatgtttgctgaatgcacgaatgaatgaatgaatgaacgatatgagggatcctgtccccctgggaactgcaatgaaaacattgcagatgacataaaatgatgagtcccccagagctaccatcctcccatgtccttctgatgaactcacactcttgggttaggttgtgttcattttttttggtctctgcctttttgcttctcctgtcagctgggaccctcctcttagttccttcccggaacaaaacacaacctcaaggtcggtgggggcagaacaataaaaacttgggtgaagaactttcatggagtgataatgattctagaagcttccctggggatcattcccatctggcatgtatgcaagtaccaaaggaaaattttgcatgaaattccatgcaactaactcatgcaggaaaatagtaaacatttttagagggctcactatgtgctaggcaattctaggcaatgttaagtaatgtctcagttataccttatccccattttatagatggggaaatggagcacaggccaattaaataactggttcaaaactgcagagttagtaagtggtagaccaggcagtttagctccagaggcaacagcttgcacaagctctatagcctgcctttttcattttctcacctaagccaggaacctggagggaggctctacgggagggagactattcagaactcatcctgagccagatggagaagacacaactaaaggcattcatttatcctagaaatccatgccggtcctgttcatctttctgaagtcacattctgagccagggcctccactctttgaaacatacacatcagtctgtgtgcaaataaatccactggcacccaagaagggactcaaaagggtcccaaggaactcaggaatggacccctctcttctgatggagcacatgtcccgtgcaaggtcctgtggcctggaaacacagccctggcaggtgtcaaaggtgctacagaaaagaataggggaggggggctcacaagggttacacgggactcaaggaacggcaacatgcgtgaccaagggagggaagccaccttcaagagcccttggcggagggcatgggagggaagctgatgaatcagaagtggcaagcagggaagggcagggagaggcaaaacaagcacaagtgcaaggtcccccgctgtgcactgtcgtctcctgtcccacagccggccaagaaagacagcgctggaccacttcccacattctgctccaagccaaagaggtccaaaagccaacctcatttagtcatctctctactctctcctgaaacgaccttccttcatcaccaggtccagggagatttgctgactttgaatcagaaacttaacctgcgcttcccgcttcaaggctatccagggccaggggcaagcctggacaaactccgatgccctccaaggggccctgccagcattctcttccctgagcactgcaccctgttcacatcggtccgccagcatcccccagggatgcccccacactgccctccatgtcttcattctctgactactcatggctactagctgactgttataacgtcctgatcaaggacttgctcaggaaggaggagttctgcaacccttaagtctctagatatacaaagagaggcagcctagtagattggtctggttttcaagccaaaaagccccctgacctagtcctggctctgaaaaaccctagacagcacaatgctactccatcttagttttgccatggatcaaatgggagttgtaaggtatctacctcattgagccattgtgagggttaattgatatgatccagaagatacttatcacagaggctgatatgtggtcagaagataatgcatccagctcttggcattcgagatactacctaataacaatggcaatggcctagatgcagcagtgctaatatcagtagacaaggaacagagggcagaacaaaaggaatcttggcttctgtggttataatattgacatcaccctagtgccatttagataataccttgggtagtgccagctctcagccatgtgctggcatggtgtggcggtggacacttgatgcatctggtgacatctacatcaaaacgtaagagcaggccaggcatggtggctcatgcctataatcccagcactttgggaggccaagatgagtggatcacctgaggccgggagttcgagaccagcctggtcaacatgatgaaaccctatctctacaaaaaatacaaaattagccgggcatggtggtgggcacctgtaatcccagcaactcaggaggctgaggcaggagaatcacttgaacccgggaggtggaggttgcagtgagccgagatcacgccactgcactctgtcgccagcctggcgacagagcaagactccgtcttaaaaaaaaaaaaaaaaaaaaacaaaaataaagaagaagaaaatatatatatacggtggatccttaaacaatatgacattgaaaggcacgggtgtacttatgcatggaatttttccagttatgccaagtgtgcctttctctcctgcatcccttcccacctcctccacctcttccgactctgccaccccttggggaacaagaccagcccctcctcctcctcttcagtctactcaacgcaaagatgatgaggatgaagacctctatgatgacctacttccatttaacgaatagtaataaatagattttctcttctatatggtttccttaataacattttcttttactaataacattttattttactttactgtaagaacacaatatataatatatcaaatacacaaaatatgtgttaattacctgtttacattattggtaaggcttccagtcaacaataggctattagtagttaagttttggggggagtcaaaagttatgtgaattttttactgtgcagagggtcaacaccccaaccttgcattgtggaaggatcaactgtatttcttttttcttttttgtgtgtgtgtgtgtaagacaaggtctcactctgttgcccaggctagagtccagtggcttgatctcggctcactgcagcctcaacctccccggctcgagcaatcctcccacctcagcctcccaagtagctgggactacaggcacatgccaccacaacgcctggctgagattttttttttttttttttttttttttgtagagatggggttttgccatgttgcccaggctggtctcgaactcctgagctcaagcgatccacctgcctcagcctcccaaactgctgagattacaggcgtgagccaccaccgcgcctggccatcacctgtatttcaagcaaagtaaggtgatctgtgaagggtttgaatgccacaacaaggctcagactttgaagaaaaataggaatgatccaaagaaacatgaaagatccaagaaatgagcataggagagtgatgggaaagaaggaagaggaaaacaacagtggcttccaagacccagtggcagaagcaacctgccacaggcgccacttccagctgagtaagatccatgtccccaaaggatactgttgacatttctggacattgctaaaagccacctgccctagactacaagaagcattctggtttcaacaagtcactcccaggctgggcgcagtggctcacacctgtaatcccagcactttgagaggctgaggccagagtatcacttgatgtcaggagttcgagaccagcctagccaacatggtgaaaccctgtctctactaaaaatacaagaattagcagggtgtggtggtgcatatctgtaatcccagctactcgggaggctgaggcaggagaatcacttgaacccagcaggcagaggttgcagtgagccattgcaatccagcctagacaacagagtgagacttcatctcagaaaaaaaaaaaaaaaaaaaaagtaagtcacttccctataatattttggattttgttgttcaccccatgttatacctataagccatgtgccccaggacagacagcgctgggccactttgcagttgagggggcagaaaattgggttgcaggtgagccatgtatacctagagatcctcgtgctaggagatattttttcttttgcaaattcaaaatgtaactttggaaaagatgcctcaggttcagaaaattcagaaaggacaagtaagtcaaagaaagaaggacaatggcatcattgaaaaggaaaacaaacagttatgacaagttgaaagatttgggacaactagaaaaatagtgaccacaaagatcatgcttattttcctattgaaaaaaatatggataattttaaaatagaagagagaataagggaacatttgccctatcataattttttttttttgagatacacagtctcattctgtcgcccagactggagtacagtggtgcaatctcggctcactgcaacctccacctcccgggttcaaatgattctcctgcctcagcctcccaagtagctgggactacaggcatatgccaccatacccggctaatttttgtgtttttagtagagacagggtttcaccatgttggccaggctggtctcgaactcctgacctcaggtgatccgcccacctcggcctcccaaagtgctgggattacaggtatgagccactgcaccttgccaatcataaagttactaaaattaaaccagggtggcactggaaaaagaatggatgggagaatggagaagaaacaaaagatttagaggtcaacccagatgagtatggtaattcggtacataacaaaaacgacatttctaaatcagtgaatggattatttagtaagcattattgggaaaatcgaaaaaacatttggaaaaaaataacaataaagttacatccctatatcctaccatagccaaattaatactagttgtattaagaaaaaaaaaattctttgagacagagtatcactgtgtcacccaggctgaagtggagtgatacaatctcagctcaccgcaacctatggctccagggctcaagcgacagctcccaactcagcctccagagtagctgggactatcggtgcgtaccaccatgcctggctcattgttttgtactttttgtagagatggggtctcactgtgttgcccaggctggtggtctcaaactcctggctcaagcaatcctcccaccttggcctcctaaagtgctgggattacaggcatgaggcaccgtgcccagcctggattaaaaaatttaatgatgggactatatatgagacttctggctaataattggcaaactgaactcattttcccctctctttacctaaacactgctaaaataagaacaaagaacagagaggcaagggagatactcccctgtaaactacaaggaaacagaggaagggaagggagagatttcaaaggagatgtggaaggcacaaagaagagggaatggtaaccacagggtggacaaattctgtgcctattgtgggtctacaccacaaatgagccagacaacagggcagacagacagagccccgtccctcacccatggagtcagcacattgcccctatgcctgtgttcctggaagcctgcaggccagccttggcagcaatgaataagaggacacaccaggcccagcacagggctggagtgaggtgtcggtcgactgagggcaaggagggggagccagtctatgcacagaatcaaggggccctctgccaccatccccctccctgacggcagaattccagcagctgagcctacgcctgattcctgctttccagcactttcccagggcagcaagggacagccactttgtgtaaaaagccatttaatactatttgatttctaagctatgtgcaatacactatgttaacatatatatatacatatatatacatatacatatatacacatatatacacatatatatacacatatatacacatatatatacacacatacatagattttttttttttgagagagtctcattctgtcacccaggctgtagtgcagtggcacaattttggctcactgcaatctctgcctcccgagttcaagtgatactcctacctcagcctcccgagtagctggaatacaagtgcccaccaccacacctggctaatttttgtattagtagagacagggtttcaccatattggccaggctcaaactcctgacctccggtgatctgcccgccttgtctgcccaaagtgctgggattacaggcgtgagccaccgtgcccggccatattttttaatttttaaaagaacgcagaggtaagtatttgtgtaatctcagggatggggaggaattttctaaacatgattccaaaacttaaatatttaaaaagaaataataaaacattttgttaaaaaaaaaaaaacaaaaaaaactataggctgggcacagtggctcacacctgtaaacccagcactttgggaggccaaggctagaggatcacttgaggccagagttcaagaccagcctcagcacacagtgagacccatctctacaaaaaaaaaaaaaaaattaattagctggacatgacggcacacacctgtggtcccagctacttggcaggctgaggcaggaggatcacttaagctaggggttcaaggtggcagtgagctatgatcgcaccactgcaccccagcctaggtgacagagtgagaccctgtaactataaaaataatttttaataataaacacaaagttaaaaagtaatactaaagaaataaagggataaagagcaaacatagaaaattttgcaacatgtaataaaggctactattctttccactacaattctttaaaaaacattttttaaaaaaccgtgaccaatgaacagacataaaacatcaatgtgcaattcacaaaaggaaaaatcaagcagccaataagtatatgaaaacaaaacgtatgtgctcacttataatctcagaaatccaagctaaaacaccaacacaaaaccactttagctgtcaaattttgaaaaacagaggccgaggcgggaagatcacttgaacccgggagttcgggaccagcctggaaaacacagcaagatcctgtctctacaaaaataaaaaaattagatggtgtggtggtggatgcctgtagtcccagctactcgggaggctgagaagggaggattgcttcagcccaggagttcgaggctgcagtgagccatgaccataccactgtattccagcctgtgtgacacagtgagaccctgtctctaaaaaaaaaaaaaatttcaaaaaacaacgccaatagcagacattggtaaggatggatagaaataaagcctcttttcattgctgctggaaattaaaataggaaaaagcttgaagaaagtctgcaaattgtggacctgataattcctcttctaagaatttctccggccgggcgcgaatcatgcctgtaatcccagcactttgggaggctgaggcaggaggatcacttgaggtcaagagctcaagaccagcctggccaacatggtgaaaccccgtctctactaaaaaaaaatacaaaaactagccaggcatggtggcaggcacctgtaattccagctcctcaggaagctgaggcaggagaatcgcttgaacccaggaggtggagtttgcagtgagctgagattgcaccactgcactccagcccagatgacagattatgtctttaaaaaaaaagaaagaaagaaaaaaaagaatttgtccttaaaaaaatacttacagatgtgcaatatttttcattagtgaaatcgaaaacaacacgtggcacacccatttgtggactatgatgaattcgttgaaaatgttgaagtgggagaatatgtaatattagggtggtgcaaaagtaattacggtttttgccattgaaagtaacggcaaaaaccgcaattacttttgcaccaacttaacacagaaacattcacaggatattaagtgaaaaaacagttcatttaggaatggatgctgcaaccccttcagataataaagaggggaatacagagtaaagacacacaacatccacacaaatgcagactctgggacattttagcctgaaactgtcatcaatgattacctctggggtcagtgggattacgagtgaatttaattttcttctatttgcttatctttaaaagtttaaccacaaaccttttacttatgcacttaaaagaatattttaggccgggggcagtgtctcatgcctgaaaccccagcattttgggaggccgaggtgggaggatgagaggattgcttgagtccaggagttcaagaccaacctgtaacagcatagtgagaccctgtttctacaaaaaacttagaaatcagctgtgcatggtgtcacatgcgtgtagtcccagctattctggaggctgaggcaggaggatcacttgagctcaggagttcaaggctacagtcaactatgatggcaccactgcactccagcctgggcgacagagcaagactgcctctcaaaagaaaaataaacaaataaacgaaaggaaaggaaaggaaaaaaaaaggaaaggaaaggaaaggaagaaggaaggaaaggagaggaggagggaagagagagagagaaagagagagagagaaagagagacacagaaagagagagagagagggagggaggaagggagggagggagaaaaagaaagaaagggaaggagaaggcagggaagaagggagcaggggagggagggagggaaggaggcaggaggggagggaaggagggagggaggaagagagaaagaaagagaagagaaggaaggaaggagagagaagggggggacggagggagggaggaagggaagggaaggaaggaagaaaaggagggaaggtgtttccaaatgagaaagcaaaaatgagacagcagcagttttctcctggggaaatccctgttaggttggtgagtcttacaagccatcatcccacagaggatttattcctaaacatttctacaatgaaggctgagaggatctaatgttgcagtttggtaccacaactgttcccacaactctgtttgctctgcctggctggccccaccagagaactgatgacagccagcatctggtaggatgggacagctgggctgcaaacgctggagacagaactgtgaccacagggcgaactgggctgctgccactcagagaagaacctgtgtggcacctggacagacctggcctaggaagtcccccccagactcagaaaggagtgctaggctgagaggaaagaaagggctgaggttagggatttgaggagaacattacttccagtctttctaagaaaaagaactcaatgtctccctccaagagacaccagcatgacaccggccccagaattggaggctccagccctggtaaacaccgggaatccaaagaatgtcctcgcaacagatgaaaaagtaaggacatgaatgaactggaaatacagaaaaaaagaatgtcaaaccaccccaccctttaggaaaaatatttcactctgtgcaatagatcaaattctacttcccagtgatttgcaaaacagtatgggacctgagtgttatttctgattgagcgtctatggctgctcacagggaccctttttctctggtctcacctccctctgtcaataacctgatctggaaatttcactcaaattcataaggggcatccctatttcaaaggactctacaacgtgaattatttggtttcaatgcaaatgatactcaagtcttaaacatctgttcagatattcttaaagggtcccattaagaaacaccttgattttacgttattttctcttctgctaattctctgaagaattcaagggactgaaagaagtcgctcatttgacgcactttcattcttctcctactaccaacctctccaatagtgtctcaactattatctccctcttactctggagcaaaaaaatcacagagcaagggacagaagatcaggattccttgcagaagaaccaccttgcaaacagacacaagcttattctttccacattggtgtccaggagttatgatgacagaggatcaaatgtacagctagctctccacagtatagttagtcctccaattaaacttcatttttcttttgagatggtgtcttgctctattacccaggctggagtgcagtggtgtgatcatagctcactgcagcctcgaactcctgggttcaagcaatcctcctgcctcagtctcctgagtagctagaaccacaggcatgcaccaccatgtgtagcttttttttttttttttttttttttttttgtagagacagggtctcgctatgttgcccagactagtctcaaactcttggactcaagcagtcctcccacctcagcctctggagtagctgggatttcaggcatgtgtcaggaatggctattattaaaaagtcaaaagaaaaaaaaaaagatgctggcaaggatgtggagaaaaagaatgtttatacactattagtctgttagtgtgaatacaaatgagcacaacctctatggaaaacaatatgaagatttctcaaagaactgaaaagagaactacatttgatccaacaatcccactactgggtatctacccaaaggaaaagaaatcatcttatcaaaaagagatctgcacccatatgtttatccaagcactatttgcaacagcaaagataaagaatcaacttaagtgtccatcaatcgaggactggataaagaaaatgtggtatagacatatatattctgtattatttcgttttcatgctgctgataaacacatacccgagactggacaatttacaaaagaaagaggttccacagactcacggttccacatggctggggaggcctcacaatcatggctgagggcaaggaggagcaagtcacatcttacatgaatggtggcaggcaaagacagagagcttgtgcagggaaactccctcttttaaaaccaagagacctcatgagacttattcgctatcacgagaacagcatggaaaagattcaattaccccatgattcaactacctcccactgggtccctcccacaacatgtgggaattcaaaatgagatttgggtggggacacagccaaaccatatcatatacacatacacacaatggaatactacttagccatgaaaaagaatgcagtagcaccatagatggaacaggaggccattatctgtaagtgaaataagtcagaatactatttggtttccaagctatgcacaatatactatgttaacaaatacatatattttttaatttttaaaagaacagaggtaaatctgtggtgaggctggggtgagatgtccactgaaggcaaggggggtgggccttgggagctaaataatgtgtacacacggacatagagagtggaaacatagacaatggagactcagaaaggtaggagggtgggaggggatgagagataagaaattacttaatggatacaatgtacactattcgggcgatggttacactaacagcccagacttcatcactaggcacagcttggccaacatggtgaaacccagactctactaaaaatacaaaaacaaattagccagggcgtgagacaggagaatcacttgaacccaggaggcagaggctgcagtgagctgagatcgtgccgttacactccagcctggacgacagatcgagatgacacagcgagactccatctcataaaaaaacaaagagcagactgtggtcctctaaaaatcaggctgtaataccaggcaagcaggcagagagggagggccaagatcaagccaagctgctgaccagggctaggacggcgggctaggaccccagcctacgaccttgcaaaacggtagagcaatccagtaccattcaggcaagggtaagtcccaggaaatccagtccagtgagtcgagcctgaagtgcgggaggattcagggagctctatctgttccccaggtgcacatgctcccggagtggctcttattggggaagcaagaatgaggtaacaagtttcgggatggaagcagaaaagagccacggtcctgggacctaggatgacataagcaaagaagtactctgcagacacttgtacaagttgagcaattagaattacagaggcagctggaagtgatggctcacgcctgtaatcccaacactttgggaggccgcggtggtcggatcaattgaggtcaggagttcaagaccagcccggccaacatggcaaaaccccatctctactaaaaatacaaaaattacccaggcatggtggcatgcacctgtaattccagctactcgggagcctgagacaggagaattgcttgagccagggaggcggaggttgcagtgagccgagaccacaccactgcactctagcctgggcgacagagcgagactccatctcaaaaaaaaaaaaaaaaaaaaaaagaatcacagaggcagcctaacctagcaggttaagagcatggcttttgaagtcatgagtccaaactcactagtccacagctgtgtgactttcagccaggtatttaacttctctggggttaggtgccctcatccataaaaacgttattgaaaagattaaatgaattaacctatgccaagtacttagaaagcagcacttacataaccataagctgtaagtatgctgcctcaatctttatgctcactttcagctgccccctaagacttcacctattcaatttaaacacttgatcttctaggacataatgcacacaccctgaaaaagcactgtctatttgagtccttgagtttcgcatttattgtcttcatctcaaggcagctcacaaagagccgggcaggaaaccgtccctgtcgacactgacatgctgagacaggtgacttgggttgagaaagcaagaaaaaaggatccaacgaaatacaacttattagtcatcacgcgttgagcacatcacggctgggtgataaatgccaagagcatcaattatgaactattcttacaacaagctgaacatattcaccacaacaccaagaaatctataggttacaagtgttctctatgggtttcaacgacaggagacaatattttgggcgaaaatcgtaaacgtaattgttttgcgtgaagtggggcagcctacatcagcgtcccacctggaaacaagctgttgaacatctgtcaaggtgtcaactccaactgcagaagcaaagaatttcattaagcttctgtgtagttaactaaagttggtgaggtgcctggagggaggggacggaaaatcacaggtataattaactgtgacatcgctggagtcacaggtgcctttaacgtgactatacccgcagtctttctggatagctctgtctcctgattctcccttaccaagaacagcacaaagtgtcatctctcttggcatcttcctgccacgtctgtcctcctgagcagacctcctgttctagtggtctgtgactctaaacaaatcaccctgggtcccagcttcctccaccacaaaacacagtggtttagaccagctgtccccaacatttttggcaccaaggaccagtttcgtggaagacagtttttcccatggaccgggggcaggagaggatggtttggggatgattcaagcacattccatttatcgtgcactttatttctattattattagattgtaatatacaatgaaataattctacaactcaccatcatgtagaatcagtgggagccctgagcttatttttctgcaactggatggtcccatccgggggtgctgggagatagtgacagatcatcaggcattagactctcataaggaggttgcaacctagatcccttgcatgcacagttcacaataggcttcctatgagaatctaacactgccgctgatctgacaggaggcggagctcaggtttacggtaatgtaagcaatggggagtggctgtaaatacagaagcagcaccgctcccttccccaccgctcacctccttctgggtagcctggttcctaacaggccatggaccagtcagtacccatccatggccaaggggttggggacttgtttagactagataattcctaagttcctttccatttctccaagcttccaattctgacactataaattctgaccaggagtgaaataaaccaggcacagaaagacaaactttgcatgttcccacctatttgtgggaactaaaaattaaaacaattgaactcatagagatagagagtagaaggatggtttccagaggctgggaagggtagtgggggaatgtgggggatgtggggatggttaatgggtacaaaaaaataggaagaatgaataataccctagtacttgctaggacaacagggtaactatagtcaaaaataatttaattttaaatttaaaaatttaaaatcccttgttcataacacaagggataaacgtttgaggggatggatataccccacttaccctgacatcattattacacactgcatgcctgtatcaaaatatctcatgtaccctataaatatgtacccacaaaaatcaaaaaaatttttaaataaataaatatcctgggtggagtgggaacagaaaaaggacaggggaggggaggggaggggaaggcacgcaaaaaaaccaatttgtaattcaaaccacacagaaaaaaaaaaaaaaaattcctgaccagggacaggagaatatgctaaatcttgaaggataaataagtttcatcctgacaactggttctgagagggaccctgtagagaggactcagagtgtgctgtgagcctttgcagtgagtctgtcttgttctgaggggtgggaaaggcaggaacccagtcctttgttctctaaccctgccctggatgaacccacgctaccaggcatctcatgaaaaggcagtgattctggaagcccttcgtgtgaagctacggatgtcaggaaaatgcttctcttaactagcatcttggtagtcccactgtggtccaccctatagcagtggtggctgcagcttgttggaaatgcctgctccacgggcgattgcctgaggtcaggagtttgagaccagcctggccaacatagtgaaatcccgcctctactaaaaatattttaaaaatcagctgggcatgctggcatgcacctgtaatcccagctactcaggaggccaaggcaggggaatagcttgaacctgggaggcagaggttgcagtgagctgagatcacgccacagcactccagcctggggacagagcgagactccatctcaaaaaaaaaaaaataaaaaataaagagaacaaaaagagaaagaaaaaaagggaaaaaagagttgccttccccaaactcaacgatcataatttgcagtttaggctgagcacggtggctcatgcctgtaatcccggcactttgggaggctgaggtgggtggattgcttgagtccaagattttgagactggcctgggaaacatagcgaaaccccatctgtacaaaaaacacaaaaattagccgggtgctgtggcacacgtctatagtcccagctactcgggaggctgaggcaggaggatcacttaagcccaggaggttgaggctgtgccactgcactccagcctgggtgacagagtgagactctgggttttttgttttgttttgtttttttaaatgcagttcaacaagatcccctggttggcacatcccttggagaaatggtgtccgagtgccctggttcgcaaagttggctgtacagtggaatcaccactgcctcccaggccccaggagactcctgggatgtgattagagcattggaatttttaagcctccccagagaattttaatgtgcagcaaagtttgagaaccactgaattaaaatctctgcttcagattctagcactcaaatccaagttctggagggatttcacctcctccagaaaggtctgtttcctgaaaaagcatcactgataaccatccttttccaagaccacagcagggtcatcccatctctggagttatcatttatgacggggtcactgtcccaatcatacctgcctcttgcatttaccttccctcctaatattattccccaataacctccaaaatctttccctaggagtggaaagctcattttcagctctggctctctctctctttttccctccttttaaatgatgtaatttatttatttatttatttatttatttatttatttatttagagacagagtctccctctgttggccaggctggagctcaatggggtaacttggctcactgcaacctccgcctcccgggttcaagtgattctcctgcctcagcctcccgagtagctgggactacagatgtgtaccaccacacccggctaatttttgtatttttttggtagagacagggtttcaccctgttggccaggctggtcttgaactcgtgacctcaagtgatccacccgcttcagcctcccaaagagctgggattacaggcatgagccactgctctcagtctcaaatttttccctgttgcctactaccctttgagggttccagggagttctgtgctgggtttttggaagctcgacagatgcatttatctctttgggtgtcgagaattagagaatttcagcgtttacttaaagattgctgggtgcactggctcctacctctaatcccagcacttttgagaggccaaggcaggagaattgcttaagggcaggagttcaagaccagcctgggcaacatggtgaaaccccgtctctacaaaaaaattttaaaagtagctgagcttggtggcaaactttggtcccagctactcaggaagctgaggtgggaaaatcatttgagcccaggaagttgaggctgcagtgagccatgattgtgactctgcactctagtctgggtgatagagattctgtctctgaataaataaatgaaaataatgctgtccgggtgcagtggctcatgcctgtaattccagcactttgggaggccaaggtgggtggatcacctgaggtcaagagttcgagaccagcctggccaacatagggaaaccctgtctctactaaaaatgcaaaactgagccgggcgtggtggtgagcaccagtaatcccagctacttgggaggctgaggcacaagaatcgcttgaacccaggaggcagaggttacagtgagccaagatcacaccattgcactccagcctggacaacgagattgaaactctgtctcgaaaataaataaataaaacaagagtgaaactctgtctcaaaaataaataaaataaaaataatgcaggaaccaagtcagttagttgcctaggtaaataacttgaggcttgggtcttggcaggaaaagaaaaccacccatctctgctgagggcagatgatctattggtgacctgctcccaccaagtgactcatgaagggaacggattgatggcaacccacaaaacaggcttgaaaatgcaataacctcgcagagacctctctgccgcttgacatctgggcaaaaaatgtgatttaactgttttttggtgggcttttttagaagacagggtcttgttctgtcacccaggctggaatgcagtggcacaatctcagctcactgcaacctccacctcccgggttcaagcgattctcctgcctcaagccttctgagtggccaggattaccggtgcccgccaccacgcctggctaaattttgtatttttagtagagacgcagtttcaccatgttggccaggctggtctcgaactcctggcctcccgaggtccgcctgcctgggcctcccaaagtgctgggattacaggcgtgagccatcatgcctggccttaatttaactattgaaagtggttttacaaactcagatcctgatcgtccttgcacaaaggttgcttgtcttggataggcacagaaaggatgaaggctttagctagtgggttacatacctctgggtttccaagtactaagccgtgaccctgtgcaacatctctgtgacctggctacatctctgtttcttcatctgtaaaatgggagaaataaagcagatgacacctactaagcactaagctagtttgcctgctgagatggaatatgtgtttatgtgtatgcatataaaatgaatcatcagccacagatcagattaaaaagcagagcaactggttttccgaaccagcagtaggaatgctggaggctgagacgccacatcagtgttcagtacagatgtttgaggttttcttaccaggctataaaaatgtttacacagtaattaggcctgttatcagtacacaaacagattacaatttgcagaatgaatgaacagctcaaaaaccctctcggttttcatgaggttcggagcattttcctaattcttgggtttacaaaaataaattcggtttccaataacaaggagccacagctgagtgtaggggaaagggctctggggtgtgaaatgaactctgtttgacagtgcacatgtcactcagtctctctgactgagtctccccatctgtcaaatgagctaaccaaggttcctcttctcctttaaattccatggttctattactttgcagtcaatgtcttctaaacacatattcattcttttcaccacaaaaggatatgtttagttaatgatttttaaggtagtaattctgctgaatcacatgagactccaatccaacactattcagtcatattgagactgagtttgtggcagttaattcctgacaatgaagcccccaagcccagtctgtaggatgagaccacaaggtcaacttgggctttatgtgaacatccagctcttccagaacacatcaatggttctgagtaacacttgattgaggctgggtgcagtggctcacgcctgtaatcccagcactttgggaggctgaggcgggagaatcacttgaggtcaggagtttgacaccagcctggccagtatggtgaaacccgtctctactaaaaatacgaaaattaggtgtggtgacacgtgcctttagtcccagctactcaggaggctgacgcaggggaatcccttgaatccagcaggcggaggttgcagtgagctgagatcacggcactgcactccagcctgggcaacagagcaagactctgtctcaaaaataaataaataaacgaacacttcattgaacgtttttcttttcctgttttcaaagaataatacttagttgtaacaaatatgacaccaaaataattagccaagctgtcgaatttgcacttctacattttcctattgcctaacttttgataatgaaaaagtgcacgcgatttgtaatcgtgatacaaacttttgggatccaatgatgtttgggaaagcaataatgtttaaatgttcagaaataagcttttaatgaatatttaattgctctattcttcataagtataaattatgctttcagtaacactctgaatactaaaaaggcaaggttcagttcttcctagttatgtgttcaaatttcctaataatttgtttaaaagggggaaaaaaaggtcatcttggtttcaacctctatgagaagaaacttggagagtaatttagaagcaaagtaacttcttacagcaatacctcaaattcaacaaaatttagatgtatgtatttgaaatgcatagaaaaaaatctaacaatatatgtacttgaaatgttaatggtattgagaatgagagtgaagaaaggtgccttccaagttctatgtaacatttctgtatagcttttaatttctttttttaaaaaaaaaatgtttactttcatcgctaaaaaatgtcttaagcacaaaacagagccacttattgggcaccttgtcaaaacatgtaatacagtttggctgtgtccccacccaaatctcaccttgaattgcaataatactcacgtatcaagggtggggccaggtggagataattgaatcatgggggtggtttcccccatactgttctcatggtagtgaataagtctgatgagatttcatggttttacaaatgggagctcccctacacaagctctttcctgccatcatggaagacatcctcttgctcttccttcatcttccgccatgattgtgaggcctcccaggcatgtggtactactgtgagtgcatcaagcctctttcctttataaattacccagtctcaggtatgtctttattagcagtgtgagaacagactaatacgatgagcatcctgtgttttgtcccaaccaggaccatgggtttttgagattaaaactcccaaaataagatggtaggggaaagtgttttgtagatatagtctcccaacattctattcaaggcattggtgatcatcggtgtctacatttatttacttttgttgagacagagtctcgctctgttgcccaggctggagtgcagtggcacaatctcagctcactgcaacctccgcctcctgggttcaagcaattctcctgcctcagcctcccaaggagctgggattacaggcacccaccaccatgcccagctagttttttatatttttagtagagacggggtttcgccaggttggccaggctggtcttgaactcctgacctcagctgatccaaccatctcggcctcccaaagtgctgggattacaggcgtaagccaacgtgcccagcccggtgtctacattttaaaacaaacatttttccgattgtaaatgtgtgttcatttgcaaaaccataaaatcattcataacgccaacagctttggacaagcattgttaacatttttggtccatttatttccattgttcttctgtaccacgtttttaaacaaaactgaaatcatactataattgcagttttgtttgtatccacacttaactggtacgttagaaatcaccaaattaaggtcaccaaagcattttctctccatctgttactgttaaacactacattttattttacactctgatggataaagactcactttattgtaccacagtagtgcaggcagaatggacagctggagacaggatgatctttggaaaatatagactaagtcatatcattcacctgtttaaaacccctcagtggcttctactgaactcagtatcaaacccaaactccacagggtgaccctatatgagctagcccccatctctctgaactcatctcctgccacaccagtctccttccttctcctctaatgaacccagttcattcctgctttgagacttttgcactggctgttcccacaccctggaagttcttccgcagatatttccccactttatcccttcatgtcattctggtatcagcctaaatagagctcatcagtgagacctttcttggttgggcgcggtggctcatgcctgtaatcccagcactttgggaggctgaggcaggtggatcacctgaggtcaggagttcgagaccagcgcggccaacatggtgagaccccgtcactactaaaaatccacaaattagctgggcgtggtgccacgcacctgtaattccagctattcaggagactgaggcaggagaatcgtttgaatcctggaggcagagcttgcagtgagccgagatcgcgccactgcattccagcctgggcaacagagcaagactccgtctcaaaaaataaataaatataaatacataaataaataaaaataaaaatacaaaaattaggtcgggcgcagtggcttatacctgtaatcccagcactttgggaggctgaggcaggcggatcacctgaggtgtcaggagttcaagaccagcctggccaacatggtgaaaccccgtctctactaaaaatacaaaatttatctgggcgtggtggcgggcgcctgtaatcccagctactccggatgctgaggcaggagaatttcttgaacctcagaggtggagggtgcagggagttgagatcatgccactgcactccagcctgggtgacacagtgagactccatctcaaaaaataagaataatgacacaaaaattagctgggtgtggtggtgtacgtctgtaatcccagcttcccggaaggctgaggcagaagaatcacttgaatccagtaagcagaggctgcagggagccaagatcgtgccactgcactccagcctgggcaacagagcaagactgtctccaaaaaaaaaaaaaaaaaaaagagagagagacctttgttggccatccaatctgaagcagtgcttgcatctgtctcaattatatcctccaattttatttccatattttttattgtgtcttacaccactagactataagggtaccatctctgtctgacgaattcatcattttccccagtacctgaaccagagatgctcaatacattctggttggatgaatgaaagcattttcaaagaatccagatttgtggtgcatgagataaagtaacctacttaaataggtcttattcacagcagcacagtcccttaatgaggctttttaaaatagattgtcaccctctccaatagcctggtcatggagagctgcccacagccctgccagtgggaaggcaaaccagttatttagtcttgctcggacttcgattttacttctccaccctgttacctaaaccagaaacccaacagtgacaccttccctttctcccacttccccaccaattaataatcctgccaattttccctcctatggaagacaagctcaacatcactgtcactgtcttttagcagaatccttccagtttcctttcagaaaacaatctctcctggccgggcacggtggctcatacctgtaatcccagcactttgggaggccaaggcaggtagattacctgaagtcaggagttcgagaccagcctggccaatatggtgaaaccccgtctctactaaaaatacaaaaattagccgggcatggtggcgggagcccataatcccagctactcaagaggcgggggcagaagaatcgcttgaacccaggaggcagaagttgcagtgagccgagatcacgccactgcactccagcctgggcaacagagcgagactccatcaaaaaaaagaaagaaaaaaaagaaaaagaaaaaggaggaggaaaacagtctctcccaatcccagtgacttttcagaaacctacccctagatacagggacccaaaactatgccaatcagatatgtcctctgagcatcttgaatgcagcagaatgatacagtaacaataacggaggacaggtgagcccaaaattggggcttagcctgggagggttcttggctttgcccaggaaagaattcaagggcaagccaggggtgtgagacagcaacttttttttctaatagtcacagaatatctatttatttacttattcattttattttttttccaactgttaccttgttttttttccaagttttatcttaagttcagaggtacatgtgcaggatgtgcaggtttgttacacaggtaaatgtgtaccatggtggttttctgcacagaccatcccatcacccaggtattaagcccagaatccattaggtattcttcctgatgctcttcctcctcccaccctccaccctctaacaggccccagtgtgtttgtgcatccccatgggtccatatgttctcatcacttagcttccacttataagtgagaacatgcagtatttgattttcagttcctgcgtttgccaaggataatggcctccagctccatccatgtccctgcaaaggacatgaactcatcattttttatggctgcatagtattccatggtgtatatgtaccacgttttctttatccagtctatcactgatgggcatgtaagatgattccatgtctttgctattgtcaatgggagacagcaactttcattgaagcagcagtgtacagcagcagcagagatactccttgtagagcagggctattccctaggcaatgtgtgcaaggtagcaccccagaagcagtgctgcagtcatatttacacccacttttagttacaggcaaattaaggacagtttatgcagaaatttctagaaatagggtggtaacttctgggtggttgggtcagtgccatggaaaggggtgataacgtctcggtgttgccatggcaacagtaaactgacatggcacatgtgtgggtgtgtcttatggagagctgcttccaccccagccctgttttagctggtcctcaatttggtccagctacttggaccaaattgagccccacctccaaagttgagtcccacctcctacctcaataataatagaaaaggttggtgatcatttacttccatagcatcccctgggagagaccacaagtcaattcctgccactgagatcccctggactgcctaatgcctgagtattccatgcctggttcttcagggatgttcttaatcctgtgagtttccatcagtattcttaatgcgatctttattgacgttgttagccagacttagtttctgttgcttgcaacccaaggatcctaactgacaactctcctgtttgccaaattcatcccatcttctccatcctccccaccatggcctcatcagccttgtccggctttcagagccagcttcctccctggtatccatgtttctggtcttctcagtgccaaatccattcaccacgaagtctccagccacaactgaccatgccatcctaacggagaaatgctgagtccctgggtcctgactaaaggcccccaccatctatcattctggtcacttcttttgtacctccctgtctcaacctttaagcaccaagaactccaaactaccagctgcttcctcatattctccacgtgttctaatttctcagactttcccaccctttcctctgcaccagaatacccatgaaaagctaaccacgtcctaatcatcctttaaactcagctcagacatcacctccacccttgcctagctaccatccatctctgttcacaaatgttcaaccctaacacatggtctggcctccccactaatctgtgaattttttgatgacaggcactgtgtcaacttcatctatctatccataccacataataggcactgaataaatgtttgttgaatgttaaatgattaaaaacttaattcacattgaaaaaccccaggttggatgcaacaatggtgttttccttttcctccttccgaaccacatttggaattatcctcaaattgagcgttctgagaaatctgccaatgttctgctaatcttgaaggatggtttcatagcttaagagtcagaactcacactgttttaacgagcatcagaggctgttgctggttgcactgcttaatggttctcaatcgtgaaaggacatttcagacactctgactacaccagctgaagtcccaagtgaacctataccaacatgggtacagaaagggaatatgcagaaaaaaaaaaaaaaaaagcttaccatcaatcatcaaaccagtctgggctcaaaccagtacaggcacacgtgacaaagaaagggttttgctgtgggattctccttccaccccagaccaactgcacagacacagctcctcctgtgcctcagtttcctcaccaggaatgaggaatgagctgctgacctagattcactcaacgaatatagggcacccactctgtgtctgactctaaacaagttactgcaggtcaaaggttcccaaaatacttttcctaaggaagcaatgtggaaagtgccccgcacataggatcgaaacccagcctgttagcctcaaaccgtaactctgcttctgacctgcaagcttcacagccccaggaaaagtgatttcacttccctttgcatcagtttccaaacacgaagaatgaggatgacatgagctcaaaggtgtgaaagggtctggcacacaagtagggtctcagaaatctgaattaagagggtctccgaaggctttaaacgtccaaagtctatcaattggaatttctctcgtaatgagaaccagtgcccccttctgacaaccagcaaacactgcataggtggtcaatacaagaatgtggtaaaagacaccactgcacacaccacaacagaaggaaggaccagccacagatatcccaccctggctggtgaccctcaagagaccagtttctatgaaaaagaaatttctaaatgcgaccccagccctgcccaatatttatgaacggatcagaagctacccactggagagataaatgtaaaactcaacaatgaacagttgtcatccacccctcaacctgtaccccccctccccttacagaggaaagggcatcatgtgtgtcaatcaagtcttgcccatcgtttctcaacagaagcagctgaattaaattattttcgttctaaaaagcccttatcctgcaccctagccgaaggcctgattactggcaatagttgctttcagagttcagggaaaggtgacatcttggtgaacaattctaagaggatttagctctcctccaataaaatatcgtgaggattggatttccaaagagttttgttttcattactccacttggatacacccagtaaccaacttcaccattgtagaacagcttctcagtaaacagcttcatgcagctattgccatgaaaaacccacacgtctgcagtgaactcaacaaacagagccattccactggtcttccaccagggcaggctactctggaaacacagctcagggcatccttggggctttggtagaagaccccaccaactgccgggggaactagcaaagttatgcagttcctggagccctggaatgaatcctaaactgggcgtggtgacagaaccacaaggccgagaggtctgaggtgacacctggacatgagtacaggtagcagataaaaatcaaaactccacattcttcttccaacacctcctcccaccccacaaaaaatgaaataaaaccacgaacaagccaagaaggagagctggaatggggcttctatgaaaaacacgtcctgttctagcctcaagacaatttcacaccaaatggctttaaattcctttccaaagctctgatgcccgaattgaaaaataatttccctttttgagcaaaagtcatcagttaaagaagcagaacctgaaaatgctaggagctcatgagttctatgtgcacgaatgttgcgtgtgtctcaacacacacagcgcagaaatctacccattctttctgagaaggtcatcccaactctgtcgcagaggctactgtgggtcactctagaatgtagttattatcaccactaaacagacttcccagccacacacagccggcgctaagctgctattccctgagcccaaaaaagtctccttttttgcagaaaaccggctcagggcctggggatggctggcgccccagtcttggcactcagggaactgcaggcaccgcttcacccaggagctacgggcttcgacccaaatggaagaaaggcgccttcctcacacaagcctcgtccaagaaaaaagagcagtgggaaacgatggtgggctggtggcccgggcgcacgtggcccaaggctaagacgcaagccgatcccctcggtgcacgctctgtacccccagcccgtctggatggggcgtcccccgctcgccctcgccccaagggtggcccagaactacctgctgctgcctaggcgccctcggaccaagtctcgggaagttcactccgcgctgcgctagtccggagaaactaggaacccgagtaaacccagactgtccggggaagacggatcccacccccacctgggcgccagacccatccagctgcttggagctcagagactaggtcccagccggactgcagaggcctctctggttaccccttgcaccctggcgcccccggactcggggtgggtggcggcgaggagcgtgcgcccagaaaggcaagcagtcagcgctaggggccggaggtggagagaaccctgcctcccgcctcccccgatcgccatgactccggcttcgcgaagagacctggttgccgccgggcgctcccacctgggctgcggtgcggctccgagtcccctgccctccctccccatcgcccgggcgcctgcgggcgggggcgcgcagcctggtggccactggcgcctgggggctagaagagcggctcccagcctccagcccgcacggtgccgggacagccgagtccgccgcggcccttccctagccccacgtccccaggcaggcggccaggagccagctccacggaaggcaaggtggccggcgcggcccccagcccgcggggtgggtgccccagtgtcggagccaacaggtacgggaggcgctgtctgccaaccatctgcccactctgagcaccagggcccgcgacagcccgggggtttggacaccctagagagaagcgaggaccgagggaagaagaaaagagagcgcgcgcgcgggtaagctagggagccggcggcggcactcacctcttgctgggccggggctccgcagcccggcagccgaggcgcctccgcacagcgcggggggcttcctccgaggcccgcagggagggggcggtgcggaatggatgcgccgagcgggcagcgctcagcctctcgctcacacccccagcaggcagccgcgtccccgtgccggcatcctcgctgccgccggctccctcggcgcccccgggccgctccccacgcgcgcgccgggacctgcacgagccccctcgtcgactcggagcgcgatctgggcgcgtgcctccctgtccttgtcctctgctctcgtctggggacgtgtgccccgcaccccctgcaccgcgcgctcctctacccctcccgctcccgctggccgcgcgggttcagcccatgtgcgcggctgcctcgctgcgccccggagcccagtggccgaggccccgctggagttgcgcgccctagaaactccatgcagctccggcctcctccccagctcctccccagcggatcccccagggccttgccgccgacagcaccacactcctcgctctgccggcgcccgcgttcaggagccgggcttctgggctcgccttggccgcctgcgccccagctcctccgagggtcggggagcccccaccccccaacctccgcctctccaatggctccctcggtttccaagcagcgcaacctgaggaacgcctcggcgcgcgcgcactcacactcgcgcgcacacacacacacacacacgcatgcacatgcacggcacacacaggcagacacgcggggggcgagcaggcgcttggcagacggtgctccttccttcccttcccaaagaggctgcccacgttaactccggcaaactgctgctcctcagcacaggacaactcaccctagcgcccgccgccttcactacttcatcccaggtgcccacaccctagatccacgattacacctgagcccagggggaaggcggggcgccgaagtggaggggccaatggccgaaactgcggggaccagcattccgcgtgaccgcccctggagacgtccagggaggcacggctgccgcagggcatcgcccacccaccagcgatcccactcctccagggcctgagaacatgtggtgtggcccccacttcttccaaggtcatagaatggatccgatgggaaggagagggcgcttgggcagaggtgtgagctacaaattcgcagactgtctgcaacctgcccatgcgctgacctctactgagtctacgcccagacagacccctgccccaggtctcaagggcaacgcatgtgcttggagtcagcagtcacctttcccagtccccacctgtctgcctcccaagaactgacggaatacacagtgcaaccaaggtttgtcttggcaagaaaaagaaagaaagcagcaaggtgggtctcagactgtcccgtagacagattagacgcttgccagttcctttctgctgcccccaaggttgtgccaataaagaaagagcaacaaacctggccaaagcaggctagtccttccttacagcaccctcctctcccgggtccccagtttcttgtcccctcttggtggcaaagactgctcaccagctcagatgtcttcaattcccagaaccagagaaaagatacatgtgaaaaatttcacaccaatcagaacaaaagcaggcaatgctgctctaagcctctcatgcaaacaactcagcaatcacctctccactgtttggttcaactgccagggaagtttgggcgtttttgtcagccagcagcacagtgtgtgtgtgtgtgtgtgtgtgtgtgtgtgtgtgtgtgtgtgtgtgtgtgtgtgtgtctcacctgggtgtggtttcagagtccctgaggcactcattgtgggtgccacgcctttagcatttagcatttcctaacctgtattattactatcttgtatagaccctacttccctagtaatcttttttaaatatgtttttgttatttttataggtacatggtaggtgtacatatttatggggtacatgagatgttttgttacaggcatgcaatgtgaaataagctcatcatggagaaccgggtagcattccctcaaacattcatcctttgagttacaaacagtccaattacactctaagttattgtaaaatatgagttattgactatagtcactgtgttgtgctatcaaataataggtcttattcattctaacttgtttttttttttttaacctattaaccatccctacctacccaacctcctcaccccccacccagcccccctcacccttcccaacctctggtaaccactggtagattctctatgtccatgagttcaattgttttgatttttagatcccataaataagtgaaaacatgtgatgtttgtctttctgtgccgggtttattttacttaacataatgatctccacttccatccatgtagttacaaatcactggatctcattcttttttatggctgaatagtgctccattgtgtacatgtcccacattttctttattcatttgttgatggacacatgggttgcttccaaatcttaactattataaacagtgctgcaacaaacatcagaatgcagatacctcttcgatatactaatttcttttctttggggtatatactcagcagtgggattgctggatcatatgctccctagcaatcttataactgagatgtaacaggtaccactcttaaggacttgctgagtacccctcccctaccccagcatgaaaacacagaaaaatcctgagttccttcaaagaaactccaggtacctagctagccctgagaagtaaaccagcaacttgataagcaagaaggtaattttagcttaaaacaatagccaaggaagttaagagtcaggaaatgtttttgttccctgtatcagtctgttcttatgctgctaataaagacatacctaagactgggtaatatacaaaggaaagaggtttaatggactcacagttccacatggctggggaggcctcacagtcatggcagaaggtaaaggagaagcaaaggcacatcttacatggcagcaagcaagagagcttgtgcagggggaactcccattgataaaaccatcagatctcgtgagacttattcactatcatgagagcagtatgggggagacctgtgcccatgattcaatttcctcccaacagatccctcccacaacacatgggaattatgggagctacaagtcaagatgagatttgggtggggacacagtcaaaccattccctatagtctatcattccctatagaatctaaacataacatcttagtgtccttcagttgtttttcagaaacctggacccccattaaactgatcgactagcacatagaccttggatgagagggaactgaggactaaactctaactgtggttcttgttctaaatttcttcctgaagggtctggaggaagccacacctacaggccagagtgaacattcttttctgcaaaccccgtatttttagacaaagctttacctccttaactaatcacaaatcagaaaatctttgaactcacttatgacatttgtagagatgggatctccctatgttgcccaggctggtctcaaactcctggcctcaagtaatcctcccacccccaccttccaaagtattgggattactagtcccaatgtgagcccatgtgggcctctgctcccagatgtctgcttttttaagtcaaaccaaatgtagagctttcatggattgatttatggctttgcctgtagcctctgcctcccacctttaaaaatcctttcctgtaagccaactgggtggttgggacttaagcatgagctgcctgattcctcttggttggtgccctgcaaatacatgccttcccttctcctgctgcaaaaccttgatgcggatagctggtcttactgcactgggtgagcagcccagtgacatgcttgagccactggttgagttttatgtacctagttcagagatgcgcatagaaggtgatatggtttggctgtgtcccctcccaaatcacatactgtattcccataattcccacatgttgtgggagggacctggtgggagataattgaaccatgggggcggtttctcccattccattttcatggtagtgagtaagtctcacaagatctgatggttttataaggggaaacccctttcacttggctctctctctctcatctgctgccatgtgagatgtgtctgtgcctttggccttcccccgtgattgtgaggcctccccagccatgtggaactatgagtccattaaatctttcttttgtaaattacccagtctcagctatgtctttatcagcaatgtgaaaacgaattcatacagaaggtattatatttacaggggtttccacaatgggtcgcaggcagatgaacagagttgacaggatctccataagatctttccctttgatcccttagtttggatgaatgctgcatcatctaacaatctgttgcctctgtaagcaattattctgacactttctagatgacaaccatgtcaccaaagtgccttggtagggccaagcacggtggctgaagcctgtaatcccagcactttgggaagccgaggcgggtggatcacttgaggtcaggggttcgacaccagcctggccaacatggtgaaaccacgcctctactaaaaatacaaaaattagctaggcatggtggtggatgcctgtaatcccagctactttggaggctgaggcacaagaatcgcttgaacctgggaggcagaggttgcagtgagccgagattgtgctactgcactccagtctgggcaacagagcgagactcagtctcaaaaaacaaaaaaacagacaaacaaacaaatgccttggtaagtgtagagatacacacatgaagttcctggtaaaatgtgggggcctcccacataaccagagtgggaaacatttggccaaagctctcattctgccctcccttcctgcctgcgtaaatttgggcaagttgtttactctctctgaatctcattgccctcatctataaaatggggataatcagagtgtctattccataaggctttgagaaaattaaatgtgactatgtgaaatagcagttcactcagttaacctggctccaggcatagagtaagctttcaataaatgttggctgttgttacaagtgaatagtcaacacaaacacaaatcaaagaccttactttgggaggaaaaaaaaaatcaaggatctcttgccttaggacactaagctcagcgagcctcagaagtagagaaggctaggcagtggctcacacttgtaataccgatactttggaaggtctaggtgggaggattactggaggttgggaatttgagaccagccagcctgggcaacatagggagaccccatctctacaaaaaatgatttgcaaaattagccaggtgtggtagcatgtgcctgtagtcctaactactcaggaggctaaggcagaggatggtttgagcccaggagttcgagattacagtgaactgtggtcacaccactgcactccaacttgggtgaaagaccaagactttgtctcaaaaaaaaaaaaaaaaaatcagaaacacaaagaactagagaagctggatggcagacttctgcagtttcttggtcttccccagctatgaccattttgagacctccatattaaggtggttgcaggtttacaggccctggcacttttgctccaacttttattcaatatatgtggtcaaaatgtgtcagctccttcctatgaaaataccaaagaaaatcttttaccaattaccgggatggaggctaaactcaacatggaacaaaatgaacaggaaggacttctccttatcgtgcatttgtagctggatttagcataagttctctctctaacctagaatagtacagccctccaggaaacagtgaggagtcaatttcaacttccttctaccacctgcctctagctttgggattcagagttacacaaatcagacaccaagacaagtgctaccttaccagtgataatcctccggtaaatatccccttcccttatcttttttattttaccatcagtaaatatatctacttcaagtgcccaagacacccaagggtagagggtgatgaaaagattcattgcactctgaatagaaataggtagaagtagaaaaaaaaaatcattcaaaaaatacatgttggaaggtaaaatttttcatgtcttccatcaaagtatggaatccaggattcactaaattctttacaacacacattctctcctgtgtggctaggggtttgccacaaactttgcagtggtttgctttgcagtaatcgataaccaggacaaaatttggtatctggaaggagagtgctgctgtaacaataacttaaaatactggctttgggattgagcaatgggaaaaagctataactgcctcgaaagactattaatgagagttgcaaggacctttggaaaactcttggaggaaacatgaaggggcacaggaagggcttattggaagctggagaaaagaacgcctgagtcacgtcccagcagaacagttagcaaaattgctgcctgtcaatggtcagctgggtgcggtggctcacgcctgtaatcccaggccgacgcgggtggatcacttgaggtcaggactttgagactagcctggtcaacatggtgaaactctgtttctactgtaaatacaaaaaattagccaggcatggtggcgcatgcctgtaatcccagctactcggaagactgaggcaggagaattgcctgaacccaggaggcagaggttgcaatgagctgagatcagccactgcactccagcatgggtgacagagcgagattctgtctcaaaaaaaaaaaaaatcaatataaccaatggcaaggatacctaatgacctcatggatctgactagggtgatttccaagtggaaaaacagaaaatgccagctggatttttccagatgcctatgagaaaaggtaagcagagacaggttaattgaagaagaagctattccagttttttagcagaattgagatggaatagcaaggaaccagggtttgctgagttagaaaggattactgtttctctgctgggttagaaaggactactgtttctcattgtggtgtctccaggcgaaacctttcaaatctagggcggtaaaatctggtttctgggaaagatggactcaaggatggggctgtaatatcctttgttaaggcctcagacatatttaaggggatgcccaaaagggcttctacatgtcttaaagacactgcctcactcagcagctttgcaggagactaaagataaagaaaggtctatttttttttattttttaatttcatttatttatgtatttatttagagacagagtctcactctgttatccaggcttgagtgcagtggcttgatttcagaaaggaagagagagacagggagaaaaagagaggttccgggcctgtctgcagctactcaagcccctgctgtgagcgtcttcccagagaaggctacagattctgttggagagagacaagccacccccaccatgggctatctgaattcccaatccacagaaccacaagaggcagtcataaatttttgttttaagaaacttcgtttggggatgaatttttgttatgcagcaataaataaccagaaaaattaaatttactaaattagaaaaatgtcaaaaaatatgttgtaaagtgaaaaaagttaatggcaaaataacatgtatggtgccacttttgaaaaagaaaactttgtatatgggatccgtgtacacatatgtgcacagaatataattccaatgctttctgttaactaactctggagaacaagtattgaggggataaatatatatatatatttatttatatattctatttatatgtaaatatatatttatgtattttatgtatatataaatttaaatatatatttatatttttttatttatataaatatatattttatttatgtatataattatttacatttttatttatatatgcttattatataaatggctttttataaatggaatataaatggctttttgctttttcgaaaaaattttcaaaacgtatattaaccagccaaaaaaatgaaatccaggttaaatattatacattaaaaaatataagtatatatagcatatatttatataacacataaatatataaatagcatatatttatatcatatataaatgtatatgtgaacatatatttattcatatatgaattgttttatgtggtatttatatttatatataaatatttataaaaataatgatatataatacattatatatgtacaatataatggcacatgttatatattatatcgtatgtactgttatattcatgcatgttatgtataattatacatgttatataattatgttatacgaaattacataatatatgtattagatactattatacaatgccaaaagaaaagaacatcttacagatcttaagagcatcacaggcatagaaggaaaaggaaaccttggaaagtggaggcgtcattgtgctccattgtccccttaaaggcattcattcacctgtgtttgaaactgcacatggtgaatggtttaaaaaaaaaaatagcaagagaaggaaagaaagaagaaagtggaaggaaagaaagagaaggaaggaaggaaggagaaagaaaaaaggaaaagggaaggaaggaaagaaagaagagaaaggaaagaaaggaaggagggaaagagagaaagacaaaaagacaaaagaaagagagggaagggaagggaagggagagagggagagaggaagggagggaggaaggaaatgaggaagggagggaaggaggaaggaaagaagaaagggagggagggagggaagggaaggaaaggaagaaaaagcaagggaggaaggaaccaagcagcaggaaggagaattcttgggaaattggagtctataacctccctaggaggaggggcactgataaacaccccagggtttcagttgaaccttttgaaatactacatgcattaagattaagggcaaaccaaaagcctttggagaatcaagttcggccttaaattatctcaataattgattagccaaaaatgatctttacgtaccctaaacgcctgccgcatgaaaagttaaatctctctgagagagaacaaatgtatagccactataattttttaaatataacgtggcatttaagcaaaaatcaacaggcatgtccggaaaaagaaccgaattaagaaaaaataaagagaaacagcagacaataggaaaatcaaacataggaaattcagatactggatttatataaaacagacattaaaacaattgtatagatgtttaagaaaatgaatgacaagataaattcaccggtgaatagctaaagtctatttattcttaatttctttctaattcaataatttaacttttactttttattaaagtgatccataatttttaaaggtcaaatggtaatttgttatgcagaaatagaatttaaaaataaacatcaaacagttccaaaaggtcaattgcgcaaaatggtgttctctctttcctcctcctccattcctttttcccaaagataaccactttcaactagtcagttacctctttggataattatatccatatttctaagtaagtgatttttaaaaaaatatttattttcttttctgattaaaacacctaactgaaggatgaagatgtaatactcttacttgtttctccaatccacacacatacattctgtcctgattctcccatatataatttttaatttgatctccattcagttaaaatttatttattatttatttatttgaaacgaaatttcactctgtcacccaggctggagtccagtggcacgatctcggctcactgcaacctccacctcccaggttcaagcgattctcctgcctcagcctcccgagtagttggggttacaggtgcccaccaccaagcccagctaattttgtgtatttttagtagagacggggcttcacatgttggacaggctggtctcgaactcctgacctcaagtgatccacccgccttggcctcccaaagtgtgggattacaggtgtgagctgcagcgcccggccaaaatttgtttatttttaacacagaataaagtagcaattctggaacccatcaaaaaataaagaaaatgcactcaatagatgtggttaaagcaaattggacacagtagaagagattagcgaactttaaagaggtcagtaaaaaatatcctgctaatgtgtgagaaggaaaagtgggaatagagaaaagagagtaagagaggattagagcacagcgaattgtcaaacatgtaactgaagtttgaaaaggaaaggggagaaagaatggggtggatgcaatgctggctgagaattttccaaaaccaataaagacattaagccacagattcaggaagtcctataaactccgaataggatacgtgcaatgaaatccacatgaaagcaatcatcattacatttctaaaacccaaagacaattttttttctttttttttttccttttttcttttttttgagacggagttcccctctttttgcccaggctggagtgcaatgccgtgatctcagctcactgcagcgatctcagctcactgcagcctctgcctcccgggttcaagcgattctcctgcctcagcctcctgagtagctgggattacaggcatgtgccatcatgcctggctaattttgtatttttagtagagacggggtttctctatgtcggtcaggctggtctccaactcccgacctcaggtgatgcgccagcctcggcctcccaaagtgctggggttacaggggtgagccaccaagcccggccaagacaaaataataaaagcagccaggccccctctccttcacacacacatacacctttcaaagaacaatttgccggacagacaacttgttaacaaacgtaataaaagctagtacaacttacaatcattggtatcatctttggtgcactaaaagaaaatagctatccactaaattctgaatgcagtgaacatgcccactaaaaagaaaacggaccaatttttgcttctatgttactaggttggtgcaaaagtaattgcagtttttgccattgaaagtaatggcagtagggcgaggtggctcatgcttataatcccagcactttgggaggctgaggagggtggatcacttgagaggtcaggagtttgagaccagcctggccaacatgctgagaccctgtctctactaaaaatgcaaaaattatccaggcatggtagcaggtgcccataatcccagctacttgggaggctgaggcaagaaaattgcttgaacctaggaagcgaaggttgcagtgagctgagatcactccagcctggacaacagagcgagattctgtctcaaagaaaaaaaagaaactaacggcaaaaacctcaattatgtttgcatcaacatagtaagttagtttccttcccactattaacaattagaaactaaacaaatgtacaaattaagtgttttctgtaattggacagcagatagtacagggctgtgatccacgtgagaagaggtacaaattacgtgtgtcctgcaactgcccagctttctacctggagatcgtttctgtatcgctgcagaggaaaaggaagccaaacagaacacaggggtctcactaaattgagggatcagagttcatgaaggcttaggtagctagattttgtggggcagagaactggagaggagaaggcaacacagatagaaaggtggaaattttttataacgatttaagttcctagttgacaactaagatgtgcataaagagacaaatcccatgccgctaggcagagaacagttagtggagagttgttaagtcgaacaatttctagacgtaagaaagaactggaaaataggcaagttctgatgatcctgagtgagaaaactcattgaacacccggcgggtacaatacagcccatatggattgccccttcctggtagcaggaataaactagctctagaataacagctatttaagacttgacctaacaaagcttaagagcaaacatcaaatggatcaaggtgattcccaagttactaatccaatgcctagcaaagaaacttcaaaactcttcaaaggacaaaagcaaaattcagaaactcaacaacataacacccacagtgtccatggaaacagaaggaaaaataacaatggcaatggaatctgcagaaaggggctttcgagcagctattaggatgttcaaggatttaaaggaaattgtgaacaataaaggaaggcatgcaaactaaaaaaagaagcaaataaaattgtagtgctgaaaaatgtatacttaatgtgaaaaagctatttgagggcttaacataacattaggtattgtagaaaaataagtgagtttgaaaaaatagaaactgaagcagagaaagaatgctggctaaaaaaatcttaaaatctttgatggcaggtgggacaatatcaagctacctaacatatgttcgattttaatacctaaagcgagagaaaaagagagagactgtaaacacgcgtgcttgtgtgtgtgtgtgtgtgtgtgtgtgtgtgtgtgtgtgtgttgggaaggttaaacagaaaaaagtatttgaataaatagtggctaatatttcccaatttgataaaagcctaaatatacagctccacatgacagaatttactgcaagaaagataaatacaaaaaatgcacaccaaggtaccttataatcaaattgctgaaaaccaatgatagagaaaaatcttaaagtatccagaagaaaaaaaacattatagcaggagaacaaagagaagatgtaatactaacttcttttaaggaacaatacaagccaaaagacaatggaacatttttaatgtgctgaaattgaaaacaaaaacaaaaatactgagaattgtcatgacggttttgacttgcatgtctctaacaattagtgatgctgagcttattttcaaatgcttattggtcatgtatatgtcttcttttgaaaactgcctgtttgtgtcctttgcccactttgttatggggttgtctgctttttgcttgttaatttaagcaccttatagattctggatattagccctttgatagatgcgtattttacaaatattttctcccaattctgttggttgtctgtttactttgttagtttctcttcctttgcagatgctctttagttgaattaggtcccatttgtcaatatttgtttttgttattgcttttggcatctttgtcattaaatctttgtcaggatctacgtccagaatggtatcttctaggtttccttcaagggtttttataggcccataaaccctttaggttttatgtttaagccttcaatccagctagaattgatttttgcatatgttaaaaggaaggggtccagtttcaatctactgctttggctagccagttatgccagtaatatttattgaaaagggactccttcaactgtggaaagcagtttggagattactcaaagaactcagaacagaacaagcacttcacccagcaatccactgggtatatacccaaaggaatatgaatcgttctaccataaagtcctttgcatacatgtgttcatcacagcactattcacaatagtaaagatatggaatgaacctaagtacccagcaatgctagactggataaagaaaacgtggcacatacacaccatggaatactactcagccataaaaaagaatgagatcatgtcttttgcacaacagggatagagctggaggccattatcctaagcaatttaatgcagaacagaaaaccaaatactgcatgttttcacttataagtgggagctaaacattgagtacatatggacacgaggaagagaacaacagacaccagggcctatttgagggtggagcaggaggaagttgaggatcagaaaactacctaccagatactatgcttattacctgggtaatgaaataatctgtacactaaatccttgcaagactcaatttacctatataacaaacttgcacatgtacccctgaaacaaaagtaaaagttaaaaaaaaataaataaaaaaaatactgagaatttcctaatcagcaaaaatatcctctgaatttaaaggtgatggctgggtgaggtggctcacgcctgtaatcccagcactttgggaggccaaggtgggtggatcacctgaggtcaggagttcaagaccagcctgaccaacatggtgaaaccccatctctactaaaaacacaaaaatgagctgggcgtggtggcaggcacctataaacccagctactcgggaggctgaagcaggagaatcactggaacccgggaggtggaggttgcagtgagccaagatcacgccattgcactgggtgacaaagtgagactgtctcaaaaaaataaacaaataaataaattttttaattttaaaaaataaaggtgaaataaagagtttttcagataaacagtaaaataatttataggccaggaacagtggttcatgcctgtaatcctagccctttgggaggctgaggcaggaggatcacttgagcccaggagttcaagaccagccttggcaacctagcaagaccctgtctctattcgagaatttatagccatcaggctgaagtaaatgacaacagaaacttaggaatgataagtcctgggaatggaaaatatgtgaataaaaataaaaagtttgtcattatttttaactttctttaaaaggtagtttactgtttaagacaaaaatattacccaatgcatttatgggatttataagacatgtataagtaaaacatgtacgacagctacagcacaaagggagtaaggaaatggaaatatactattaaaagatagtcaatttatccatgaagtggtatagtatcatttgatatcacactgttatatttgaaggtgcacattgttaaaccccagaacacaaagagatacagcaaataagccaatagagaataaatacaatatttgaaaaataatcaataccagaaaagtcatgaaaagggaaaaacgaacaaagaacagatgaaacaaaaaagaaatagcaagatggtacatttacacctaaatatattgtgaattgcatttaatttaaagagtgtgaaccactaccaaatttggccatattaaatttatagagcactatattaacataatcttttcaagtgccttttgaatgttcataaaagatagactctgtatcttgtgccacaaaataattctcagtactttggtattttaagccaggtgtggtggctcatgcctgtaatcccagcactttgggaagccaaggcaggcagatcacttgaggtcaggcaggagaatcatttgaacccaggaggtggaggttgcagtgagctgggattgcaccactgcactccagcctgggtgacacagcgagactccgtctcaaaacaaacaaacaaacaaaaaaaaccactttgagattttaaagttatcccaactctactaaaagtaccaaaattagccaggcgtggtggcacatgcctgtagtcccagctacttgtgaggctgaggcaggagaatcgcttgaacctgggaggcagaggttgcagtgagacactattgtgccattgcactccagcctgggtgacagagtgagactctgtctcaaaaaaaaaaaaaaaaaaaactttgagattttaaagttatcaaaatcatacagaaaacattctataaccataacggaattaaattagaaatcagtaataagaagacaccttaaaaattccccaagattttacaagtaaaaaacagttttgcataatgcgtatgtcaaagaataatcacaaaggaagtttaaaaatattttgaactaaatgaaatgaaagcacaaggtattgaaattggtgagatcagctaaaacagtgcttacaaggaaaattatagcttaaaatgtttactttacaaaaagatgaaaggtttaaagccaatgttttaagattctaacttaaaaagctaaaaagagaagaacaaattaagttgaaagaaaatagaagaaaggaaaaaggatggggaaatcaaatttaaaaatggacagaaaaatgaaataaaacatcataaaattaataaacctgtagctaactagatttgaaaatatggcaaaaacaccaagtaccaagatcaggaatcagtatagatcctaacgatataaaaaagaataacaagggaatattataaagcaatgttatgacaaaaaatggacaatttaaacaaaagagaaaaattcttttaagaaacacaaattaccaaaatagacccatggagatataaaaaatctgaatattcctatatcttttaaagaaactgaattcataattaacctcctatgccctcaaaacataaacaaattcctctgtgcccagatggtttctctggtgaattctaacatttaatgaagcgctaataccaatctcataaaatgctttcataaaatagagagcgggaacacagctcaactcattttatgaggctactgtctctctgttatcaaaatcaaatacaggcaataccaaaacagaaaatgaaaataaatgcaaaaaaagccttaacatatattagcaagccaaatccagcaatatataaaaaggataagacatcttgacaaggtggagtttttttaagtcatacaaaattagtctaaatcttaaattctaaaagatgaatcaatttaatttatcctatttatagaagaaaaaattacaatcatcctaatgcattcatgaagagtgtttggcaaaattcaacacctattctccatgaaaacttagaaagtttggaataaaagggaactttttcatcctgctaaggggtactacaaaaaaacctacagctaacatcacacaaaatggttaaaaactgaatgctttccctgtaaaatcaggaaaagggcttctattgaacatttgttggaggctccagccagtgaaataagtcaataaaaagacagaaaatgcatcccgattggtaagtaagaagtaaaattgtttttattgaaaagcaacatgattgtgtaaattaaaaaataagggtatttgaatgaaagtgaccttaacaaggtcacagaatacaaggtcaatgccaacaataaacaactgaaaaatgaaattttaaaaatagctccattcaggccgggcgtagtggctcacacctgtaatcccagcactttgggaggccaaagtgggtggatcacctgaagtcagaagttcgagaccagcctggccaacatggtgaaatcccatctctactaaaaatacaaaaattagccaggcgtggtggtgggcccctctaatcccagctactcgggaggctgaggcaagagaatcacttgaacccaagagggggaggttgcagtgaaacgaaattgtgccactgcactccagcctgggtgacagagcaagactccatctcaagaaaaagtcccattcacaataatatcaaaaccatgaaatattatggataagcttaacaaaataagtgtaagttctgtatactaaaaacctcaaaacattgctgagagagattaaagaagaccaaaaataaatggagacctataccatgttaatggattagaggtttgataattttaagatgtcaattctctccaaattgatctacaggttcagcatcatcaatatcctaataagctgttttgcaaaatttgacaagctggtttaaaaatttatatatgtatgcaaaggacatagaatagccaaaaccattttttcagagaagttggaaagactttctttccaactgatttcaagacttaactataaagctaatcaagagagtgtggttttggcacaaggatagatgtatagagcaaaggaacagaaatgattaggaatagactcacttgcgtgtgaccaattagtttttcacaaaggtgccaaattaattcaaattaattaatttaatgaggatagtcttttcatccagttctgctggaataactggatattcatgtggaaataaatgaactttgatactttatttaccctataggcaaagattaactccgaatggatcgtagacctaaaagataaagccgcaaaacttttaaagaaaacccaggagaaaatttttgagaacttgagtaagcaaaaatttctttttttttttcttttctttttttttttaatttcccttgagacagggtctcgctttgtcgccaaagctggagtgcagtggcacaatcacagctcactgcatcctccacctcccgggctcaagccatcctctcaactcagccccggaatagctgggactacaggcttgcgccaccatgcccggctaatttttgtattttttatagagacagactctcagcatttgcccaggctggtctcaaactcccatgctcaagtgatccgcccacctcggtctcccaaagtgctgcgattacaggcgtgagccaacgtgctcagccaaaaactgcttaacgaggatacaaaaggcacaaattggccggccgctgtggctaacacctataatctcagcacttggggaggccaaagcgggcggaccacttgaggccaggagttcaagaccagcctggccaacatggtgaaaacccatctctactaaaaatacaaaaattagctaggcgtggtggcgcacgcctgtaatcccagctactcaggaggctgagacaggagaattgcttgaacccaggagacagaggtggcagtgagccgggattacaccactgcactccagcctgggcaacagagtgagactgtctcaaaaacaaaatggaacaaaaacaaaacaaaacaacagaaagcccaagtcataaaagaaaaatttgatcattttgatttcatcaaattttaaatcttatgcttctgaaaaattcatttttggtaaaatgaatagacaagtcacaggcaggcaaaaattattcataatacatatccattatttcattcttatgaaattctagaacagaaaaaaacaatctgtagtgacagaaattaaatgggtggattcctggggctgagtggttgactccatcagagtacaagggcacagtttaggttgaaggaaatgtttatgtcttaattatggtgatggttacaaaggtttatacattttgtcaaactcatcaaagtgtacattttaaatgggtgcattttattatatgtaaattatcctcaataaagttgatttgaaaagaaagaagaaaatgaagccttaaaaaaaattatggttgtacaaaaggaagataaatgtttgaggtgactgatttgctagttactctgatttgatcattacacattgtatacatgtatcaaaatattacactgtatcccatagatatgcacaattattctgtgttcatttaaaatgataatttaaaagttaaagattgtggttaaaattttgtaaaaggaaagaattgctatagtgagctattcagacagaaaaagatatggtttcaaatggaggaacagagatgaaagggtaaggagcactggaaataccaaatatgtaggtaaatctgaataactattgtattttaatctaataataataaatgctaataatgtttggtagtttcttaaatccacgaagaagtaaaatacatgaaaacaattgcacaaaatgtaggaatggggtaaacagagttaaagtgttctaaggtccttgcaactttagatacaacttgtattaaagtgataaatgtactaatttaggatatataccagtgggtcaaggatacacactgcggtctctagggatatcactaaaataataataaaagaatgtaaaactaacaaggacgactaaaattgtataataagtgccaatctccctgaaagatggaacatttcaaaaattggatacacctaataatataggctcaaaatatataaagcaaaacctacaaaattaaaagcaattattattgtgtattattagctcaatctgattgacatagtaaataatcaaagaactagaagaacgcaaattacaacataagagaagaaaatcaaaatatattagctaaaaactgtaaattaggaaaatgagtatattatttagtctgggcatgttgaaacggatctgattaaacatagctgcttcagggcagtgagaaagcttagagcaatatattagtgcttgtcaacgtatgtcttgctctaaaaccaacacttctaagctttggttttgctttggttttgttttgttttgtttttaattcagggcaagaagtggagacttccaggaaacatgacggtgttaactggacattttttaaaacctcctccctgaaacctacaaaaaccaacaaaggaactaatgattaaaatgaaaaccaaactgaaacttagagacagccttaacctttccctatgaatgccaaggaatacttgccagatagaatacaacttgaaccaaaatgaaatatgatgctggagtttggccacaattcctgtgcttcggaaccaacgcagtgctgtgggcccaagagccttgctaacacaaaccccccgaccccaagctgagatctggcgatgtggttggactcggaatgagaaaggttcctcctgcaccacagatcagctccagcggagaggcctcgtgggaccaggtactgccaatgttaatgagtcccagcttttttatggtgaaacaaagggattcgattggaaataaagcaaatttcttatcaaagaagaaaattaaaggtagagaaaagtgtgtgctgataccacccccaacccatccctaatcaaatctcagggctgccttgatcttaccatgagcatcatgaatgaggtttttgaatgcttttaaatacacaaatgagactcacgtcaaatcaacggaatcagaatctacaaaagcgaggcccagacaacagtagttgaaaaaactccccattatgagataacatgtttagcctaatcaataggcaaaatttaaaagtatttataacaacccaatgttggcagaggtaaaaagaaataaacatgtttataggaattctgaagaaaatggtcatggggtaagaaacttttattttatatatttatatatatttttatatatttatatatatttatatttatatatatgtgtgtttttttttagatggagtccccagctcccaggctcaagggattctcttgcatcagcctcctgagtagctaggattactggcacacaccaccatgcctggctaatttttttgtatttttagtagagatggggttttgtatttaagaggcagaatctcactgtctcccaggcaggagtgcaatgatgcaatcataactcactgcagcctcaaactcctgagctcaagtgatcctcccacctcagcatcccaaagtgccggggttataggtgtgcaccaccatgcctaactaattttttaatctttttctggagacagtgtctcactatgttgcccaggcactggtctcaaatgcctggcctcacgtgacccttgagccttggcctcccaaagtgctaggattataggtgtgagccactaccacgcctagccttggatcacaaattttcacgtggagtgatatccactagtgtaacactctggatctctatatttcctcgctcacttctctgattagtaaatggagaaaggaaaaggactgttagatacaatcctcttgttctctctcctcagctctcccttcccgcagagagcactgactttgacattgtacttagccatcactccctgtggctggccaagtggtacatgtcctaattctgggtgcaacataccagaactggcactgtgatccccgtcaacctgaccccaacttcggagagagaagaaaagcgcaatttgtgaattcccctcaagcccatcggggcaaagtcaacaaagatagatgtaaaaataacattggcggccaggcgcggtggctcacacctgtaattccagcactttgggaggcggaggcaagcagatcacgaggttaggagttcgagacaagcgtggccaacatggtgaaactccgtctctactaaaaatacaaaaattagctgggcatggtggcgggcacctataatgcctgtaatcccagctactcggtaggctgaggcaggagaatcgtttgaacccaggaggcggaggttgcagtgaggtgaggtcgtgtcactgcactccagctccagcctggctgacaaggtgagactctacctcaaaaaaaaaaaaaaattacattgggtgctaccaacaccacaaacctgccacctcatcacagtgcatccttttttcttcttccccatgaagaggccctgcatctcttcctgccaaaggccaggccctccgctgtgcttcgtaggatactattcctccccattttctaggaaccctgcactagatctcataccctttatctgtggattttactttgctaattagcataacgctctattttagaagccagaccatgtcagagtcactcttggcaccttcctcctccccgaccgcgttctcaatccatttctgagtcccatcacacggttcaatattccaatgtgaaaaacaatattcaataacacatctccctccccgtttcgtcttccagatcctccgatctcctacagggcaagtattgtaactttcttgcgtttctttccagagatattttacatatatctgctgcttctttatacaaatgctaacacactgtacacattgttctctacctttctttttcacttgacaaggtactacttttaggtcacatgtacatatagtgaggtataggatatgcaggcaccacgtgcctcctggtatgacacagtgaagataacaacacatgtatgcactattcctgacaaaaaagaataacctgattccaatcatgagaaaacctcatacaaactcaatcaagtggaggaaccttgtgaaagttgacctggattggggccgggaaagatggctcacgcctgtaatctcagcactttgggaggctgaggcgagaggatcacaaggtcaggagttcaagaccatcctgctgaacacggtgaatccccgtctctactaaaaatacaaaaaaaattagccggacgtggtggcgggcgcctgtagtcccagctactcaggaggctgaggcaggagaacggcatgaacccaggaggcggagcttgcagtgagccaaaatcacgccactgcactccagcttgggtgacagagtgagactccatctcaaaaaaaaaaaaaaaccaaagttgacctggattctgcaaaaatgtgaatgtcccaaaatacataaaaagaagctaagaaattcttacagcttaaagacctggcagcgaaatagaatgtccaactcatggtcgaatcttggttttaaaacaaactataaaggacattattgcaacaaactgggaaatttgattttggcctccatttactttattagtgttaagcttcctggatacaataagtatattgtggtcacacaggaaaatgtaattgtctttgtgaaatatctgctaaatatttaatggtgaagtctgttgtgatgttttccatttatttctacctaatattcaaatggttcaagagagagtagagaaaaggaaaagaagaaacaaatgtgcaggatatacggctgtttttggtactatttttacaatgtctctagttttgaaatttttttatttaaaaaaatcagagaaagattgaagacatcacacatgtttatagatgcatacaaaaaaatgggtttcataaaagccaaactggcaacattggatgtcaatcaccttggaggggtggaatgaaacgatagcattagatagagaaataaatactgtaacactttttcttttctattttttttttattatactttaagttctagggtacacgtgcacaacgtgcagatttgttacatatgtatgtatacatatgtaacatgtaacaaacctgcacgttgtgcacgtgtaccctagaacttaaaagtataattttgagacagagtctcccctctgtcacccaggctgaagtgcaatggcatcatctcagctcactgcaacctccgcctcccggattcaagcaattctcatgcctcagcttcctacatagctgagattacaggtgcacactaccatgccgggttaatttctgtttttattagagacagggtttcatcctgttggccaggctggtctcgaactcctgacctcaagtgatctgcctgccttgggctccaaaagtgctgggattacaggcatgagccaccgcacacagcctaacatttcttattctatttcattctgccttgttggcatttgttgcaatgagaatgtactacttttcattttttgtaccaaaaaaataagcttacattttgtaatttaaattctccacaggttattcatgcacaaatcaagatgaagcatcaaatatctccaaatatccccaactctccagccccacgcctggagacgccctggatttccccagatccaaaggccaagcctccagagccttggtccctggggctggatgctaagtattttgaataccacctactatgaaatccattaataagtaaaattgatgtgaaataaaaacgagttcagaccaggtgtgatgatgtgcacctgtagtcccagctactcaggaggctgaggcaggagcatcgcttgaacccaggagtttgaggctacagtgagctatgatggcaccactgcactccagcctgggtgacagagcaagaccctgtctctaaaaaacaaacaaacaaaacaaagaattcatctttaactccagagattaatttgtacatgtaaatgttttataaaagtttaccataatatcatacactggaccaaatgataccacgtttacattcacttgatcgcatcacttaccagaagtttaccaggttaccacactctggactcaggaaatgccaactgagtagtggggagaacaaggagaaagaagtaaaaagaacggaaaggaataatctatttcttgatctttcagagcaaaggttcaatagaaactgcttgatttcaaatagaaactgtttgatttcaaggtaagtttaagtgaaaaacatcagcttaagcacgtaaagttataaattagtggacattatacatgtaatatccattacaaatcaccaaagagaaaaaagattttaagatcatatgacacatttttttcttacgcagttttattcataatttttttaatgcgagttctagatatactcagaacaggataaaaacaggagagaaaatttcctcattatcttggtaaatagcatatattgtgtaaccatagtgccatttcttccttggacaggtttctgtcattaacagaatacagtatatgacagtttcttaagtatgttaattttgaggtccaaatgaataaaatatccacgtccagggttagcacaattaaagatgttcacagcttcgttcgttgctaactgtggaagcattatggatcttatgtctaccaatttgatgacttttgataagtgatacgcccacatggccacctcccagtgaagatatagaagatttccaccatgtacagtcgcaagagttttgtagcttacatatttctcaagtctgttgacttctctccatggccaacagagcactctaagtctccatcctctctctaccagcttctctggtggcttactaggcatcaccctaggagggtgatcttctcaaagcctcatctggtctgggtaccacgctatctataaaatacacttccttcacttcctttgatctccaggtaaagatgcaaattctttcacagataatgattctccatggtggcctggttccagaggcctctcatctcacactcttttaccgcaagttctctctacccctccacacagctggctgtcattctgtcctgcctgtgtgcccagtccctgccacccccaggatattcctctgtggcccgttgtcctggggactctccccctcctgcagcctttcttcctttcttcaaggaagaaatcgtactcatcctcttgatcccagcccagccatcacctcctcgggccagcatccatttcctggtgtctgccccgagcagctcatatacatttaccatattccggtaaatgaagcagacttctaatgagcagaatcctggttccgtgtttgcccaggcacctgtcccgtcacaggccagcagcctggcccagatattacttcattgcaggcaattatagacaaggtagaagcacctggttttaaggatgttctttttttaatttaacttttaagttcagggggtacatgtgaagatttgttatacaggcaaacttacgtcatgggggtctgtcgtacagattatttcatcacccaggtattaaaaatattagttatttttgctgatcctctccctcctcccaccctccaccctctgataggccccagtgtgtgttgttcccttctgtgagattatgacacattattttatttttttatttttgagacgaagtctcgctctgttgcctaggctggagtgcagtggcgtgatctcggctcattgcaacctccgcctcctgggttcaatcgattctccggcctcagcctcccaagtagctgggattacaggcaggcaccaccatgtccggctaatttttgtatttttagtagagaaggggtttcgccatgttggccaggctggtctcaaacccctgacctcaggtgatctgcctgccttggctgcccatagtgttgggattacaggtgtgagccactgcacctggcctaattttaaaaagacaaatgcacataaacttactttttttacagaaaaaagtatcagtctaggttttatacttaatagacacaaaatgttgaaagtgaaagtactgacagcaggcattcattggtgggaatatgtagtagctaaatgtctgtaacaggctacttgcaacatatggttaaaaaaaacttttttttttttttttttttgagagggagtcttgctctgtcacccaggctggagtgcagtggcacaatctcgggctcactgcaacccccgcctcctgggttcaagtgatttgcaattctcttgcctcagcctcccaagtagctgcgattacaggcaggcaccaccatgcccagctaatttttgtattttcagtagagaagggttttcaccacattggccaggctggtctcaaacccctgacctcaggtgatctgcctgtctcagtctctcaaagtgttgggattacaggcgtgagccacggtgcccggcacaaaatgtgtttttaattcaaaattgcagtaaaaaaaaaaaatactttactataatggagaaaatttgaaaactcttctaagggacacgaaaagacacttgaacaaaagaaaacttcagtagagaagcatacctcattaccagataagaaaatacttttgtaaagatgtcagatctctctaaattaatttcaaaattctaggcaatcacaacagaaatcccagtgagatttagattagaatttgatcaaacaattctaaaacttgtaagattcaatatttacagagtcaaaataattaatggggaagaactagctctacctgagcttaaatacatcatatatctacaggaattacaactatagatgtatctgtaattgtcatactaattctggagaagaaataaaaatgtttatgatttagtatttgtctctatacctccctttgaaatgtaggaagcttcataaggaaaggagttttgtgtctctctctcttttaactaatatagcacaaattcttagaaaagtgcctggcaaagtatttgttgggtaaatagatgaacaaaacacagaattatattctcagtacggaaacagacaaacatagatcctcaggaattctgaatattgataaagtgtatttcaaattagaaaagaaacaacagtgatagttaagtgaggtatgggtgtgttaattagcttgatttaatcatcccacgttgtattcatatatcaaaacatcacactgtgccccataaatatataaaattgatttgttattcaaaagtagtattagtattcgagatcagccttgccaacatagtgaaacctcgtctctactaaaaacacaaaaattagccggacatggtggcacacacctgcaatcccagcactctgggaggccaaggcaggcggatcacctgaggtcaggagtttgggatcagcttggccaacatggtgaaacccagtctctactaaaaatataaaaattagccgggcgtggtggcacacacctgcaatcccagcactttgggaggccaaggcaggtggatcacctgaggtcaggagttcgagatcagcctggccagcatggtgaaacccagtctctactaaaaatacaaaaattagccaggcctggtggcatatgactgtaatcccacctactcgggaggctgaggcaggagaatcacctgaacccaggagggttcagcaagaccccatctttacaaaattacatatagatatgataaaaagttgtgccactgcactccagcctgggtgacagagcaagaccttgtctcaaaagaagaaaaaaataataattatatcttcagtatgtacagaacttataaatcagtggggaaaacaacaataaacaactagcaaagtgcataaaatgagaaatacgttttctaaaaaatgtttattttttgaatagggtctggcttttgtcacccaggctggagtgcagtggtgtagcctcaacctcctgggcccaagcgatcctcctaccttaaactcctatgtagctgggactatagatgcatgccaccactccctgcaaattttttaaatttttttgtagacacagggtcttgctatgttgcccaggctggtcccaacttctgagcccaagggatcatcccacatcagcctcccaaagtgctgggattacaggtgtgagcaactatgcctgacctaaaaggtgtgtaagatcacgaataatcaaagaaacattatctaatgcaaagatgtgaaattattctaccatattggcaaagcttaaaagtatagggaaaattcagtgtgagtgagagtatatgaaaacgtaccctctcgcccagttggttaaattctaaattatacttcatcatttcaagaaggaaattggacaagtatcaaagttttaaatgcacatgggcatacccttggattcactaaatccaattctaagtatttatcctaaaatgataatcagtcaattgcataaagacatgtttataaggatgtggaataaagcattgctcatattatgaaaaatgagaagtacaagaaatgtctattgatgagtgactaaagtatggtacattcctataatgaatactattttttatcttttttattttatttttaattttttattttattttatttatttttgagacagagtcccactctttcacccaggctggagtgcagtggcgccatctcagctcaatgcaacctccacctcccaggttcaagtgattctcctgcctcagcctcccaagtagctgggattacaggtgcacacaccaccatgcccagctaatttttatatttttagtagagatggggtttcaccatgttggccaagctggtctcgaactcctgacctcaggtgatccacctgcctcggcctcccaaagtgctggcattacaggcatgagctacagcgcctgatgtattttttttctttccaaaaatttcaatagctgttggggtacaagtagtttttgggtgcatggatgaatttttagtgctgaattctgagattttagtgcaccagtcatctgagcaatgtacattgtacctaatatgtagttttttagccctggcccccttccatcctcccacttctgagtctctaaagttcacatataatgaatattattaattgacatgaaaaaagtctcacttgtttaatgactaaagcaggtttcaaaatagtttgtccattatgataaccatttattcaaagttgcatctaaattgcatgtatatgacctggcagtttctttctcagggatataaccaacaaaaaaaaaggtgttgacatgctcacaaaagacatgcactagaatatttatagcagcactatcgagaatagccccaagctggaaaccacacaaaagcccatcaacaataaaatggataaataaattatgatatatttacacaaagggaaagaatataccacaacaatagtgaataaatgacaaccttctacaaccacatggatgaacctcacaaatataatgttgagtcaaagacgacagataaggtagaaagcatgcttcatgattatattttaataataaaaaaaaacaggcaaaagaaacctatgtcattagaagtcagaatactagttaacttgggttggtggaagcaggttgggactagaagcagatacaatgatagcatctggggtcacacctgtaatccaaacactttgggaggctgaggcaggaggactgcttgaggccaggagttcgagaataacctgggcaacacagcaaggccctgtctctacaaaaataaaaaattagctgggagtgttggcatgcacctgtactcccagctactcactcagaaggctgaggtgggaggattgcttcagcccaggaatttgagaccagcctgggcaacaaagtgagctcctgtctctgcaaaaataaattgaaaaattaacggtgtggtggtgcatgcctgtgatcccagctacttggaaggctgagacaggaggatggcttgggcacagtatttcaaggttacagaagcctatgattgcactgccacactccagcctggatggcagagcaagaccctgtctctacaaataaaaataaaaataaaaattagccaggtctctacaaataaaaataaaaataaaaattagccaggtttggtggcacacgcctgtggtcccagctattcaggaagctgaggcaaggggatcgcttgagcccacgagttccaggctggaagaagctccgattgcaccaatgcactccagcccaggtgacagagcaagaccttgtctgttaaaaatatatatataggccgggtccagtggctcacacctgtaataacaacactttgggaggccgaggcggatggatcaccaggccaggagattgagaccatcctggctagcacagtaaaaccccgtctctactaaaaacacaaaaaattatctgggcatggtggcaggcagctactcaggaggctgaggcagaagaatggcatgaacccgggaggcagagcttgcagtgagccgagactgcgccactgcactccagcatgggcgacaaagcgaagactccgtctcaaaaaatacatatctgtatctatatctatgtgtgtgtatatatatatgtgtatatatgtgtatctgtatatatatatgtgtgtgtatatatatctatgtgcgtgatatatatatctaggatgctagtaatgttctgttaactgttaactgagtgctggtaacgtagatatattcagtttgtggaaagctgtacacttgtgatttgtgcactttttacatatatacacaaagggcatacatgcacagaaagcacataagatggcaggaaggatgtcggcagaaatattaatattggtgccacatagaaatgggattctgcacgactttggcttctttttgtgtgtatcattcaaattttcccaattgagtgtgtgataaatttatatacaagaaaatacaaaggagaaatgaaaatgtctactgaacattcaactcaagaaataagaaaaatcatcaaaaatgaaaaaggagaatgaataaagtaacaaagatatgagctacaaaaccatcagatcatacggaggtcatctgaaagtgattgatacgctttctcccaaatgaccattaaagaactcatgaatttacacaagacgacaaagtgaaaaatgacacttcaaccataagccaaagccaaagtcctagtgaaatttctgctgatttcaccatcacagagaatggtttgaaaccctttttttttttttttttttttttgagacagaatctcacactgttgcccaggctggagtgcagcggcacaatctcagttcactgcaacctccacctactgggttcaagcgattctcctgcctcagcctcccaagtagctgggattacaggcacccgccaccacgcccagctaatttttgtatttttagtagaaacggggtttcaccatgttggccaggctgatctcgaactcctgacctcaagtgatctgcccacctctgcctcctaaagtgctgtgattacaggcatgagccactgcacccagcctgaaaactcattttaaaaacagatgtattgaaatcttactgacacacaataaggttcatgtaaagtgtacaatttataagttgataagttttatacctgtatacacctgtgaaaccatcgccacaatcaacatggtaaacacgtacattacgcaaagtgttatatacatataaaatatatatatttatatatttataaatatttataatatatataatttataaatattataaatatttatttttttgttgttgttgtttgtttttgagatggagtttcactcttgttgtccaggctggagtgcagtggcaatccctgctcacctcagcctctgcctcccaggttcaagcaattctcctgcctcagcctcccgagtagctgggattacaggcatgcaccaccacaactggctaattttgtatttttagtagagacggggtttctccatgttggtcaggcttgtcttcaactgctgacctcaggtgatccacccacctcggcctcccaaagtgctgggattacaagcgtaatctctcccttccatttcctcattctctcctttcactcgtaagaattaccatagtttgcatttcctagaagtttatagaagtagaactgtcctatatgtacttttgttgtctggcttcatctcagcataattattctgaaattcacccatgttgtgtctaggaatggttttctgagtcgtattccattgtatgaatacaccacaatttgttaatccactaacctattgatggacatttaacatgctttcagtttctcactatcataaataaagctgcaattagtagtcatgtttgagtctttctatgaatatatgcttttatttattttggttaaatacctagaaatgtaatgtacatcatacaaaaaatgtatgtgtgttatttttaaaaccaccaaacaccgttaatacaaaatagttgtaccattttacattcccatcagtcatgcatgagagttccaatgactctacattgtcaccagaacttggtacagtcattttaacttcagacattttaaaaagtatgtaatgacatctcattgtagttctcatttacatttccctaatgatcaatgatgttgaatatcttctcagatgcttatttgccatctgtatatcttttttgctgtatatattttacctattttttatcttgtgctcatgtcttttacccatctttaaattggtagtctgtttccttattattaaatttcaaaagctcttcatatgctttagatataagtcctttataagacatgtgattgactttgggaggctgaggcaggcggatcacgaggtcaggagatcgagaccatcctggctaacacggtaaaaccccgtctctaataaaaacacaaaaaattagccagctgtggtggcacatgcctgtagtcccagctacttgggaggcagaggcaggagaacggtgtgaacccgggaggcggagcttagaagggtgagccgagatcacgccactgcactccagcttgggtgacagagcgagactccgtctcaaaaaaaaaaaaaaaagtaaaattaatataggcaattgacaaattttttttctgagttcatggcttttcttttcattctctcaacagtgtctttcaaagagagagctcttggctgggcatgggctcatgcctataatcccagcactttgggaggccaaggcagtggattacttgaggttaggagtttgagaccagccaggccaacatggtgaagccgcatctctactaaaaatacaaaaaaattagcgggttgtggtggcatgtgcctgtaattccagccacttgagaggctgaggcatgagaatcacttgaacccgggacgtggaggttgcagtaagccaagatcaccccacagaactccaactttggtgacagagcaaaattaagtctcaaaaaaaaaaaaaaaaaaagagagggctcttaattttgataaagtctggtatattaatttgttcttattaataatgcttttggtgtcctatttttaaaaatttgcctaacctagggttgcaaaggttttcttctgtatttccttccagaatttttatgatatcatgctttacatttaagtctgtgatccattttgaattaagttttgtgagatctaaggattgaagtatgtatgtttgcatgtatgcatatgatatggtcaggctgtgtccctacccaaatctcatcttgaattgtagtgcccttaatcccctaaacatgttgtggaagagaccaggtgggaggtaattaaatcatgggagcacttaccctcatgctgttcccatgatagtgagttctcatgagatctgatggttttataaaaggattttcccccttttgcttggcacttctccttcctgccatcatgtgaagaaggacgtgtttgcttccccttccacagtgattgtttcctgaggcctccccagacatgtggaactgtgagtcagttaacctctttactttataaattacccagtcttgggcagttctttatagcagcataagaatggactaatgtagcatgtatgtatgcatgtatgtgttatgtattatgcatgcatgtattccatatggataactaatagtttcaccaggtttcactgataaaactatgctttctccactgaattgcctttgcatcttagtccaggaatcaattcagtagtcttccatttctgggtaagataaagtaagcatgttccacccttgctctccccatgaatgcagtgataaaatcagggcagaatgcatggagcagctattcgagaactctgaacatatacactaacaggtagattgggaaagatgaaaattcactaaacaaccaaactggtactgagtttaccatttcctccttctggcatttctgagattgaattcaatatcgcctgaaagttgaacgtaggtattagcaaaacagggaaggctccaggagacacctctcattctggcttgatgaaaggatacatggtttcctaatactcagaatgtgaaaatcccctatgattatttctttcttttccttttctctatcatcttgcacctcagcccccaaataattcataacagcagaagcagtcatggtggtggggacagtaggaacctcaaactctgaggaaggagagccttactctccagtaagataatatgtggtcccaaatggatgggaaaaacttctgttgctttttctgtgtttctgccctctgtctgcttggccccaacacaactgtagttgcagaaagcatgcagcagattggggttaactaaagctgcaactttctagctggagagccaacaaagggagtaccaagaaaatggaaagtactgataagatcatggatagggaaaagtttgctaaagtaactactttgagttgtttataaatatttgggctcaatttcatgagtatattgattcaatcctaatcaatctataaactttgagaactgaacaatggagtagacaatagctttggtgccaaactagtcactggcgtcacacacaggggacagatctgaatagcaatgcaaaagctttggaaattaactgaaattggaaccataaccaacataaaattggtcagaacttgaggcctggatccaaccagactgatcgcctactaaaataaaaccaaaaaaattctacattatccatgaccctgaatcacgtaacaaaatactcaaaatgtcaaggatacaactctaaattcccaaaatacaatgaaccaagaaaatccaaatatgtttgggtgaaggtaaccaacacatgggatgccaaaatgacatggatgttggaattatctggcaaattatctggcaaaaaggtagctaccataaaatgctccaaaaagcaatggagaacacttttgaaaagaacaggaaaacagaaagtctcagcaaagaagtagaagatacgaagaatgaccatgtggaaattttagaacttaaaaatacaataaccaaaatttaaaaaacacacttaaccagctttgcatgacataaccgaagaaagagccagagaatgtgaacatagacctatacaaatcacgcaatctgaacaacacaggaaaaaaaggaagtttgggaaaaaatgtgcacagagcctcaggggcctgtggaaaaattccaatactatttgtgtaattacagtcccaaaggacagaaaaaacatatgatgcagaaaaaatattttaagacataatggctgaaaacttttcaaattttgcaaaatgcagacagtctccaaattaaaatggtctgacttaggattttttgacttcaaaatggtgcaaaatcaatactcagtcaatagaaaccatactttcagtacccatacaaccattctgtttttcactttcaggacagtattcaataaactacatgagatattcaacactttattataaaataggcttgtgttaggtgatttttcccaactataggctaatataagttttctgaagatattttaggtaaactaggctaagttatgatgtttggtaggttaggtatattacatgcattttcaacctaaagatcctttcaacttaaggttggtttatcaggatgtaactccatcataagtcaagaagcgtctgtatgtaaatctatggattcagtaagctcatagaatcagaaacagagtaagtcccaagaaactcacatgaagacacatcataaactgatgagaattaagatagaaaaacatcttgaaagtaaacagaaaaatgatgcattgcttgtagaaaagcaatgattcacagaactgtggatttctcacgtggaatcatgaaggccagatggaagtggaaaaatattttgaaagtgctgaaaggaaagaatattaaaccaagaactctatatccagtggaaatatccttcaggaatgaaggtgaaataaagacattctcacatgcaaggaaacaaagagaatttcttgccagtggacctgctctaaaacaattgctaaacgaggtttttcagacagaaggtgaatgatacagaaaggaaacctgaaaccttggggaatgaagaaaaacaaaataaaaggaaatatctaggtgaatttaatagactattcttctattgaaatgtttagcaggctgggtgcagtggctcacgcctataatcccagcactttgggaggccgaggcagacagatcacctgaggtcaggagctcaatcccagcctggccaacagggcaaaaccccgtctctactaaaaatacaaaagttaaccgggtgtggtggagggcgcctgtaatctcagctattcaggaggctgaggaaggagaatagcttgaacctgggggaggcagaggttgcagtgagccaagattgtgccacagcactccagtctgggtgacagagagacactctgtctccaaaaaaaaaaaaaaaaggaaaaaaaagaaaaaaaaaacagaaaactagaaatacaaaggcactttctcaaccttataaaggacatctgcaccaaacttcaaacaaacttagagctagcatcattttaatgaaagatgaatgctttacccctaagatcaggaacaaggaaatggtatcccctttccaattatatccaaaattgttctggagatttaagccagtgcaataaatttcctcatgtatcaccttctcctaagcatgaggttatttaacgttttgtttgaaattattaccacatattttgctcaaatgaaaacctgtaaatagctcaacctctcaatttcaattttacctgaatactactgggatcatctgtaaacactgtgatttttatacattcaagcgctttttacatataaatatggatctaattttccctgtatgttaaaaaatcaataaaaattagttatttatacttacaaaaacttaaaaaatataaaaaaggcatccagattggaaaaaaagattgtctttatttacagatgacatggtagttgtattaatttgttattgctgcataaaaaattaccaccatcagtggcttaaacacgcattgtcttgtagtttgtctagggcaaaagtcttggtgtggcccagctggctcttttctcacggtctcaaaaagctgaaataaaaatgttcagtgagctctattctcatctggaggcttgaccagaaaaaagaatctgctttcaatggggtggctcacacctgtaattccagcactttgggaggccaaagcaggaagattgcttgagcccaggagtttgagaacagcctgggcaacatagtaagaccctggctctgcaaaaaaataaaacagattagtcaagtgtggtggtgcacacctgtagttccagctactcatgaggctgaggtggggagaattacttgagttctggaggtcgaggctgcagtgagctgtgactgcaccactgtactccaccctggcaaaacagcaaaaccctgcctccaggaaaaaaaaaaaaaagaaaaggaaaaaataaaagaatctgctttcaaaagcataatacaaaattaggcacatataaaaatatagactttaaacattttgagacagtgtcttgctatattgcccaggctggtcttgaactcctggcctcaagcaatcctcctgccttggcctcccaaagcactgagattacaagcatgactcactgtgcctggtctaaaatatataattttacttctttttaagtatataattgtttgttagtatatttaccatgttgtataactattacaactatctgatactagaacatttccaccaccccaaacagaaacctcattcttcccattttccccttctccccatcccaaacacttatctacatttcaccttgatgggtttgcctattctagatatatctcataattagaatcataccatatacagccttctgtgtccagtttctttgcctagcataatgtttttaaggtttagccatatttgtattttattcctttagttggctagttaatatccactttatggattatatcatcttctgtttatccattcatcagttgatggacatttgggttgtattcaatttttaactattgtcaataattctgctacaagcatttatatacaagtatttgtgtgaacatgtgttttcaattcttttgtgtatatatctaggagtggaactgctggatcctatggtaactctatgtttaccctttgaggaatgccaagttgttttccaaagtgacatcattttacagtacaatgcaaaaggtttacaatgtctccgcatcctttctgaaacttgttgctgttgttatcaccaacctagtgggttttgatattattgtggttttgatttgtatttctctaatgacagatgactgagcatctttcatgtgcttactgactacttgtgtatcttctttggagaaatatctactctaattatttgtccttttttaatttagctgtttgtctttttgttgaattgtgcaagttctttatattctctacatttgaccattataatgtactttacttgcaaatattttatcccattctgtgggttatcttttcactttcttgatggtgtcatttgattcacatacgttttagattttgatgaaatccaatttatctatttcttattttgttgcttggactttctgattcacatttaggaaattgctgcctaacccaagtcatgagatttacacctgtttccctctaacaattgtaactttagctctggcatttgaagttaatttttgtatatgttatgaagtaggtatccaactttctgtatttttgcatgtggacattcagttgtctcaacattatttgttgaaaagactgttctttcctccattgaatggccttggcacccttgtcaaaaatcaattgaccaaaatgtatataggttttctttttggactctcaattctattccatggcatatatttttatacttatgccagtgccacactgttttgactactgtagccttgtagtaagttttgaaatcagaaagtgagtcctccaacgtttttctcctttttcagattgtctagtcatggttccctgaatttccatatgaatattaagattagcttgtttatttttgcacaaaggcagttagaattttgacaggagttgcattgagtctgcaggtcaatttggggactcttgtctttagcttttttttagatatattttccttcagctttttaaacattttacacatagctgattaaagtctttgtctagtaagttcaccatctggacttcctgaagggtaatttctgttgattgcttttttactctttgggtaatatgggccacactttcgtgtgtgtgtgtgtgtgtgtgtgtgtgtgtgtgtgtgtttgcatgtattataattttttattgaatgctgaacatttttttgactattataaaggaataattatggaaattagatcgcccttgcttaggggtttgttgttgatgcttattttagttattgtttgtttgtttagcaacttctctgaactaattttgtaaagtctgtattatttgtcgtatgtgggcattgacaactttgttcagttagcttagtggtcagctaatgagtggactgaaatttccttaaacttatgaaaccccaaatttcccagtctttccagaagagctctgttaggtttctccaacactcagtcaagaagttgacaagtgtgacatagtcttcactttctacctgcgtagaagctgaaggtcagcagaggtgagcacttagggcctcctcaggtccttcctgggcatactcacagctctgggaatgagtgttaacttctaaattcccaggaatatattggagtttttcaaagcctgcccctccccctgcccccatttcccccaaagcattttatttcccagccattcgtcctgaactttttgattagtctgttgtttgcttcaactgttatccattggcttaaacagcaggaactaagtcatttgcctgcaaatgttttcaactaacaacccctggtagtggtttcagcactgggtgatttccaagttagatgagaaaaagtcaagccttttgagctatttttttcaagggagccatcagacaagctaaaacaaatacttacatttttttgtgaatgaggtttattctattaccagtactggacatgtgggctatcatttcaaggctatcacttatctggggagcagagaatagggaaaattaacattccacaaagctgcttgttctgttctcaccaaaattcagccatttttcttgaataagtgcttcctgggttgctgccagcttttgactagtttccagagttccaacaagttgattctgaccattttttcaggattttttaatggcttttatggaaacacagaattttagagttcccaatctgccactttcactgatgtcactctctagttaatcacttcaagtagaatgtaaaaatcttaccggcacgtaagtccttttattctcttcttttatactgtagtcgtcttacacattactttcatataccttagaatctccattaggtaatgttataatttttatttccatctgccaagtttttttttttttgagacggaatctcaaaatacaaatataacatctttttctgtatttttagtagagacgaagtttcaccatgttggccaggctggtcttgaactcctgacctcaagtgatctgcctgcctccgcctcccaaagtgctgcaattacaggcatgagccactgcgcccagcctgtatcctacttttctgaaagtttttctttttaagccaggaatgaatgttggattttgttaaatgctttttccgcatctaacaagatgatcatgtgggtttccttagtctgttatggtgaattatgttgtttgattttagaatgttaaaccaactttccatttctgagataaacgttcacttggttgtgttggattatcctttttatataatattttttcatttgtcaaaattttgtaaagaatatttgtggctgtgttcataagtttttgtatttttttgagacagagtcttgctctgtcacacaaactggattacagtggtgtgatcacagctcactacaacctctaactcctgcccttaagcaatcctcccaccacaccctcccaaagtgctgggattagaggtgtgaagcaccacacccggccaatttattctcattttctctgataatacagtaatttttaaaggatacattaaagggttaaaccctaaataaagtatatccaattaatggcaatggtaatagctaacagttatagggtgcataccagacaccagactaaatgctcttcatgaattatctcaattaatacaacagatataccagaaaagtcactcaacctctacaagcagcactacactattcattatgtcgtttcaaaatttcaactgactatagctggcaatttcaagcaattatcagccattccctggtcacagtgttcatgacccaggtcaaatttcaccttgaaaactcttgcaaacacgttcacaaaaatgtccaacagagacaggacactcaatgaggagttttcttcacactgcttgaaagcattccttatttattgcatgtttctcatttcagtcatgttttagcattctatctgtctaatccatccatccacccctaagcagctgtgtagctggttcatctcttaatatgactctgatgttaggacttaaagcctgcagggacctgaaaatgacatggccacctcccaggtgcatgagaatatttttggagactgctggcatcacatgcaaccttctcccactcactcaacttcactcaacttctctgttttaattcactacaactcttaccatgcaagaaaccaagtatgcctgtcggtctatgtaatagatggagaagtattataaatagggtatttgctactgaaacatagtatgtgaagagcagtgcagatagttagaaatagtgcacattgttttttattaatttgatgagttctccaacagagtcagaaaatccaatagtcagacaaagagaagattccacttaggttccacagccccatgccagctggataccagtcaagccccacaaatcagcaaacgccaagcttcaatgaaaatgaaagagtaaacatggggcctatgagaagacactgcaacacacaggaaggaaaacattgtcccaattctcaaagaaagagcctattccatcttaagaaacagaggtaggctgggtgcagtggctcatacctataataccaacactttgagaggatcatttgaagccaggagttccaggcctgcctggacaacatagcaagaccccgtctctacgaaaaatataaaaattagctgagcatggtggtgcgcatctgtagttccagctgctcaggaggctgaggcaggaggatcgcttgagcccatgacttctcatttacctgggcggtgaccgtgtctgttttcagttccctgcaagcttcatgtcctagcatcagagtcatattaagagagaaaccagctagacggctgctcagtgggttggtggatggatggatggatggatggatacatacattagattagatagatagatagatacatagatacatagatagatagtgttaaagtttgcttgagccctgagcctcacccaaggctgcagtgagctataaagccatggcactccagtctcggcaacagagcaagactctgtctcaaaaagaaaagaaacaagtaaattttagaaaccatgtcgatggggtcaccctaaaaggatgcaggaagacatggcctttgtgagactggggcagatcactgcaaagagagcacagcatagtgacagggaagccacaaacaagaaaataaggagagaggaatgaaacatccagcagctgaataaaaatgtacaacagaggcaataaagactagatgttttcctgaaaaataaaccaaagttttgatataagagaaaaactagaagagctctcccagaatgcagacggaaagcacaaagacataaacatgttgataaatgtgtattaaattatgcagagcaaagaatgaagatgcaacctaagaattataggtgttccttgcttttacactgttggtgagagtgtaaattagttcaaccattatggaagacagtgtggcgattcctcaaggatcgagaaccagaaataccatttgacccagcaatcctattactgggtatatacccaaaggattacaaatcattctactataaagatacatgcacatgtatgtttactgcagcactatttacattagcaaagagttggaaccaacccaaatgcccatgaatggtagactggataaagaaaatgtggcacatatataccacgaatactatgcagccataaaaaagaatgagttcatttgcaggggcatatgagtccttcgcaggggcatagttgagctggaagccatcattttcagcaaactaacacaggaacagaaacccgaacaccccgtgttctcactcataagcgggagctgaataatgagaacgtatggaaacagggagaggaacatcacacactggggcctgtcaggggcatgggggcaaggggagggagagcattaggacaaatacctaatgcatgcagggcttaaaacctagatgacgggttgataggtgcagcaaaccaccatggcacatgtatacttatgtaacctgcacgttctgcacatgtatcccagaacttaaagtaaaattttagaaaaagaattatagatgctccaagaaataagccaaacccatagaagagaggatatcataagaaaaatgcttaagaagttttttcctgaactgattaaagagtaagtatgaagttcaaagtggatcacaacttggcgaaatcaatgagaagagactcacaggtaatagttaacatttttgaaatttatgggtggaggggataaaatcactgcaatgtacaaacaaaacaaaaatgcaagccccttggatggaccctaagaggaatcaaagctgcaagtgttggagtcaagtccttcagctgatgggagcactgtccgtgggcatttccagctgtgacccagtaatggctatatccagggagattagcaataggaatttttctgtcagtgcaagacattcataggagagggccatcttgatgatgaacgatgagaaagggagaaaaatgacagccgtcaggcaagaaataaagagaatctgggctcacagacatgggagaaacacctctgcagagtctgggaggcttaagttcccaaagagtgagtgacagactgtcagaaaaatgcttcctggtgactgttattagaattgcatttttttatttcaatttttttagattcaaaggatacatgtgcaggttacatgggtatattgtgtaatgctgaggtttgaggtacaattttatccatcacccacgtagtgagcatagtacccaataggaagtttctcaacccttccccacctccctccctttctcctctagtagtcctcagtgtctgtttcttcggtctttatgtacacatgtacccaatgtttagctcccacttatacatgagaacatgcagtatttggatttctccttctgcattagttcaacctagcatgatagtctcccaggtgcacccatgttgctgtaaaggacaggatttcattttgttttttgagatggagtctcaccattgccaggctggagtgcaggagtgcgatcttggctcactgcaacctccacctcccgggttcaagcaattctcctgcctcagcctcccaagtagctgggactacaggtgcacgcctctacgcccagctaatttttgtatttttctagagatggggtttcaccatattggccgggatggtctccatctcttgacctcatgatccaccctcctcggcctcccaaagtgctgggattacgggcatgagccaccctgcccagccaggattttgttcttttttatggctgcatagtattccatggtgtatgtgtaccacattttctttatccaaatccaccgctgatgagcagctaggttgattccatgtctttgctattgtgaataatgctgcaatgaacgtaacggtacatgtgtcttcctggcagaacaatttattttcccttgggtctatattctgtaatgaggctgcggggtgaaaggacacttctgcttttagttctttgagaaatctccaaactgctttccacagtggttgaactaacttgcattcccaccaaaagtgtatgagcgttcccttttctctgcagcctcatcagcatgttattttttgactttttaactagtgtgaggaggtatctcattatggttttgatttgcctctctctggtggttagtgatgtggagcattttttcatgtttgttggctgcctgcatgtctaggatgtaatccccagagagcaggccctatgggatgccgtcttcacttctgtccccagcagctggcgcagatggtccttgtataactacaagtataggaccccatcttacctctaaggaagtgttctgggaagggacagagcagggagtctttacaatgacgaagagaaacgtcctgtctgaaaatttgttcctacccagtaaagagaataagcaatgatttcacagcttattttccaatccatagtgcagctaagggtggaggcatagatgagttggccctgttgtcccattagcatcacaataatccccctttttaaaatcttactttaagttctgggatatctgtgcagaacatgcaggtttgttacatagggatacatgttgacccagcaatcccattactgggtatatacccaaaggattataaatcattctactataaagacacgtgcacccatatgtttattgcagcactatttacaatagcaaagacttggaaccaacccaaatgcccatcaataataatccccatttcttatgcataaatgcattcctggatatgacttggaggaaggaggcggcaaaatgctttctccattactggcaggggacatttttgcagactgttgcctttaataaaatagtttttttccattatgtggacttacataaaactgtctctgagaagtgtagtttttccttgggaggtgagtgaatgtctgcaagtgtgtgcatattctctccaatatctactcctgggggattagaggaacacagagagaataaaaaacgtatgttgatttcaacaaatgctgctggaacaactgaatgatcgtacacaaagaaatgaacctttaaaaaggtaaagaagagaggaagaaaatgaacctaaatatagaacttatacctttttattaatttgggttaatgaaaattaattcaaaatggggcttggtgttgtgtgcctgtaatcccagctactcaagaggttgacaggggaggattgcttgagcctgggagttcaaagctgcagtatgctatgttgcatgtgtgatcagctactgcactccagcctgggcaacatagtgagaccccgtctcaagaaaaaaaaaagtaaaagcaaaatggatcataggccttaatgcaaaacacaaaactataaaacttctagaagaaaacacaggagaaagtagaggtgaccttgtgtttggtggtgagctttcagataaaacaccaaaagcattatccctgaaagaaaaaaaaattactagtttggacattattaatatttaaaaagatacttttaagagaatgaaaagatgaaccacaaattgggagaaaaatatttgagaacgcatatctgataaaggacttgtagtcaaaatatactaagaaatcttaaaactcaaaaatgaaaaaaacaaagaatctcatgggaaaagtggtcaaaaaatttgaacatactcctccgcaagaaaaaatatacggatggcaagtaaacatatgaaaagatgctcaacagcgctcgtcatagagaattgaaaattaaaacaagataccactacacacatattagaatgactagaacatgttttaaaagacaataataactgctagcaaaaatgtgaagcaacaagaactttcttgatgatgggaatataaaatggtatagtcactttgggagacaatttagaagtttcttacaaggctaaacgttaatcttatcacatgattcagcaaacagggtctcaggtatttactcaactcatttgaaaacactatgtccacacaaaaatctacatgcaaatgtttatagcagctttattcagaatcacagaaaggtggaagcaattaaggtgtcctttaataagtgaacggataacaaactgtggtacatctatgaaatggaatattattcagttataaaaagaaatgccatattgatatggtttggcttcatgtccccacccaaacctcatctcgaattctcatccccaggtaccacaggaaaatggaatactattcagttataaaaaagaaatgccatattgatatggtttggctctgtgtccccacccaatgctcatctggaattcttatcccaagctgtcaagggagtaacttggtggtgatgactggatcatgggggtggtttcccccctgctgttcttgtgatagtgactgagttctcatgagatcgaatggtttaaaagtgtgtggcagtttcctcatcacacgctctctcctgctgccatgtcaagaaagtccttgcttccccttcaccttccaccatgactgtaactttcctgaggcctccctgaccatgcaaaactgtgagtcaatttaaccttttttatttatacattacccagtcttgggtagttctttatagcagtgtaaaaacaactaatacaaattatcaaaccacaaagacacggattgatcttaaattcatatatgtaagtgagagaagccagtttgaaaaggctacctactgtatgcttccaatcacacaatattctggaaaaggcaaaactatgagggataaagggaaaggttgaagaggtggagcagaggcatttttcagggcagtgaaactattttgtatggaactgtaattgtggatacatgacaatatgtatttgtcaaaacccatcgaactttggcacaaagaatgaatcttaatgcatgcaaattttaaaaaatgatctaggaggtccatggaatcccaggatggaatacagaatgtgacaaatcaatctgtgttacaaatggtatgacacaaactcactgaaggggttcggagaaaagtgctgacttaagtaactttggaaatggctgggttctagaaaactcactgcaaaggaactatacataagcgttttagttgataaggttgtctcctatgggtaaattggttaacaattctgatattactgtacatgtaaactagacctaaacaagcaaataaatggtggatggtaggagccagattgcagtactgaagtgggggtttccagtaaacaaggggagaattctaggatgaccatataataatagcttacagttggagacatcagtgtaaacctatgtgttgttagtgttttttagagatgggttatcactctttcacccaatctggagtacagtggtgtaatcatagctcactgcaaccctgaactcctgggctcaagagatcctcctacctcagcattctgagtagctggggctacaggggcatgccaccacacctagctaatttaaaaaaataaatttaaggggtcttgtcaccttgccctggctggccttaaccccatgtttagttcagtatagatacagatggttacatctagaagtatagatatgtgtacatacatagtttagtatatatacatatatttcattattccgtcagctgaggggacctagaaataacaatgcctcagtagcaatacacaagatgagcctggaacatctttcagtgccagaaagaaagttctcaaaacacaggagctaacagttcccaatggccaagggtgcaacactttgagcaataaaagaaaaaaatttgtactggatcataacccaaagtataaaataagtatccataagtccatacttatgaaaatacatgatcaaactaaggaagggagggagggagggagggaaggaaggaagggaaggaagggaagggaggggagggagggagggaggaagggaggaagggaggaagggagggagggagggagggagggagggagggaggcaggcatctcccatatacaagaattccataatttataggtaatctgctctcatggagcaggagcataactcctgtttcttaagtgtagtctgtgcagtgactttctcccaaaggatacagtacggaaagagggaaaagttgtaacttcacggtagagaaacctgacaaacacacactccctccgccccgggtgatcaaggtcaacatcaacggtgacagtcatgttgacagtgtaagcctttgatacaatgtgatgaaaatggcccttcccctctgtgatcttcctcccctacacccatcaccccagtctaatcatgagaaaaccgtcagatgaatcccacttgagacagtctacaatatacatacccaatacttttcaaagctgtcaggatcatcgaaaataagaaaagtctgagaaactgtcacagccaaggggaactaaggagacaggacaagtaaatgcaccattgccaggcacagaaggacaaacaccacatgatctcacccacaggtgatctgaaaaggttgatcccatagaagttgaaagtagaacagtggttaccagaggttggggagaattgggggataggggtagggagaggctggttggtatagtcacagtgagatgagaggaataagttgtgttctattgcacagtaaagtgactgtaattaacaataacatgttgtatatttccaaagagttactaggttggtgcaaaagtaattgtgggttttgccattgacttttaatggtgaaacgcaaaattgcttttgcaccaacctagtagaagaaaggactttttaaaatgttcttccaacaaagaaatgataaatgtttgaagtgatgaatatgctaattaccctgatttgatcaatacacaatccacaaacgtgtaacattacactgtaacccataaatatgagttattgtatccattaaaaaataaaatacaattttttaaaaaggggcacgtcctttcatcttcccaagaggtacttcctacctcctgtcctgcctggacatggtctcaggagtcttggagagcaaggaaaaatgcaaaaaaaacaaacaaaaaaggtaccgttatatcctaaaatgagatccaagcacagaaaaaggacattaagtacaaacccgaggaaatctgcctaaatcatgagccttaataataatgtatcaaagtggttcattaaccgcagcacatgtaccatacttaagtaaaatgctaatgggcgatactgcgtgttggggatatgggcactctgtgctatctttgcaatgtttctgcaaattcaaaaccgttctaaaaaaagtttattcttaaaaaatttattctcatattgtctcccccatctgtgccctctccctaaaagatggcctaaaaatgcagagagagagagagaatcatggcttaagcatcctgcttgctgatcccacatacatgaccacagacacctgttggtctccagggggatgtgtcttgtcacccggtcgcaggtgtgcactggctggccaataatcctgaagttcagaactggtgcatttgggctccttctagttggtgcaatgctttcaggattcctggtatctgccctgagtgtttgggcttcctctcagctctgtgtggctgcagatcgctgggtctctattttgccctctctctagacctggaccagcaggccacgtccatcctctgttctggaaacaccctggcatccagcgcttccttcagttaccataaagctattgagtgagactcaggaaagctaccttgttgcgctctctactcatttaacttgcaagcagtattctgagcaggtgctctgtccggtgggctcccaaggtctccatggcggggcaacgcaggagcccctgtccctggtattcacatcaaacaccccctggggaccaatcccagagagaaggatgcaggaattcttccagttctcctgcctctttctcattttgcccttctcttctccaactttgaatcagaaagtagaagtttcctttacttctgtttcatagcctccttctttctggctccatcctcaaaattaagccttaaaagtgtccgaggcatcgtctttacattaggaaaataatttttaagccttaaaagtgtcagaggcatcttctttacactaggaaaagaattcaaaaatctgagtcttccctgttaggctttaattttgcaagctttcactgcccgtgaagcatggttttaaagtgtaacgtctccttaagaagtcaaatgactgttgttatcttgccctgggataaaaagtctcttgacttaagctcagttgcaatcaaataccaaggggctgagcttggtggcttgtgcctgtaatcccaacactttgggaggctgaggcaagtggatcacctgaggtcagcagttcgagactaacctggccaacatggtgaaaccctgtctctactaaaaatacaaaattagctaggcacagtggtgcatgcctgtaatcccagctactcgggaggctgaggcaggagaatcccttgaacccgggaggcggaggttgcagtgagccaagatcacgccattgcagccactgcactccagcctgggcaacaagagcaaaaccccatctaaaaaaaaaaaagaagaaagaaaagaaaaaaaaggggagaattaacaagcactagtttgatatttgccaaaatattattcccatggcttactgctggggtagtatgatgagttctatgggctggctgggtgggagaccaggttggctaaggaggggtaggacctttgccctgggaagacctgaaaaaagaagcactggctctaagaaataagggggattggggccgggcacggcgactcacccctgtaatcccagcactttgggaggccgaggcgggtgaatcatgaggtcaggagtcccagaccagcctggccaacgtcgtgaaacaccacctctactaaaaatacaaaaaaattagcggggcatggtggcaggcacctgtaatctcagctactcaggagggtgaggcaggagaatcacttgaacctgggaggcagaggttgtagtgagccgagatcacgccactgcactctagcctgggtgacagtgcaagactctgtctaaaaaagtaaaaattaaaaaaataaatgagagattggctgccctgagacagtgaaacgtggctgagaaactcaccagccagggggcccaagaatagaattcaagaggtccacaaatttggatgggaaagaatatacctttatttccattatcctataaatgaaatctagcattttcttcaattaggaatgcaagccacaaggcaccgtggaattagcaatgcccgactgtgccactattttactatcatgttcccactgtcccaattactttgaaatgttgtttatgcttaccctaacagcacttcaaaattatgattattatatctaccaatagcccttattatttaatacatcaacaaggaagcacatgtgttattatatcaacacatttgttctgtttagtatttttgataccatgcttatgtataatacatttccctttgttgttacctcaagtattctattttatgcatttagaaacataattcacaggcctcaccagactgccaaagggatccatgcaccaaaagtacccttaaaatatatttttttctgactctaagaagatttctttgtacattgtaatttttcctgacattgaaattctccagttactcccaagccttcggtaaaatctgatttatatacatatgctgtgtgttaatcggcttgtggagaattgagagaggatggagtaaaacaaatttcaccctccctacccacctcccaaccgcagaggctggtgacttggtagcagccacatattgaaagaagatggtagatccagagtcccagatgtagacccaaagtgaagctgcagagggctaagatggtacaaagcccagttagtttaggaaaaatgttaagagataaacactcttcaaacctaataatgatcagaggtatccacaggatcctcagattgctggaaggcatcttatcttgacttcccctagaatcctacttttccatttcacccagcaagacaccagaagatcccaaagaggtgcactgctaggaccaggcagcaaaaggacccagcatgatgaagaagaagtgtggtagttttaaaatatggcccctgatataatttggctatgtccccacccaaatctcatcttgaattgtagctcccataattcccacatgctgtgggagagacccagtgggagataattgaatcatggagggggtttccctcatactgttctcgtggtagtgagtaggtctcaaaagatctgatggtttaataaatgggagttcccctgcacaagtttttttgttttttgtttttgtttttgtttttgcctgccaccatgtaagacatgcctttcaccttctgccatgattgtgagccacacccccagccacatggaactgtgggtccatgaaccctcttttgctgtataaattacccagtctcaggtatgtctttatcagcagcatgaaaacagactaatacagtccccaaattcattcagcctccttctgttgagatgtggtgtctatgcctccactccctgaatctaagaggatttgcactgctttgacccctagagtatggcagaagcaatagcttacaaggttaagtcctaaaatgccaaccgggttccatctgtttctcttggaaggctcactgagatgctcccttttaggatgctcttcttacaacccagataccaagctgtcagaacacaagccacatggcaaaaccatatgtagatgctcccagctgagctagtccttcagccatcccatcccaggcacctgacatggaagtgatcaaataatgtcagcccccagccatctgcgtttctccaacagaggtaccagacatctcggagcagatacaagctgtctctactgaattcctgacctcgagattccacaagcgcaggatggttgttggtttatccccccgagtttggggcggtttattacaaagcaatagtaactggactcagagacaaaaagttcaggaagaggctcctgtacggccacatggttcatggatggagagctgaacggtgctgatgggagagactgaggaaggggcacatagtgaaacaggactgaaggtcaacttgtgtctctccagttccctttgcactgtgatgagtagaaatgacttgtacccagagtagtactgtctcatacggtctgctaacagcaagactatttagggcatgaactctattgactaatcctctcccttaccccactttctcaataggagcaaaatcctcaaattaaaatttggtacaggtcaatgcagtggcacatatctgtaatcccagcagtttgggaagccaaggtgggaggattgctggaggccagaagaattcaagaccagcctgggcaacatagcaagaccctgtttaaattaaaaaagaccctgtttcattaaaaaaaaaattaattagccagacatgttggcatgtacctgctgtcccagctacttcggaggctgaggtgggagaactgtttgatcccagaagttcaaggctgcaatgagctatgatctcaccactacactccacctgggcaacacagcaagactctgtcacttaaaaaaaaaattaatacaaacaccaggagtgtgttagatgaattcagtctctctcagtgattccaattttttccatgaaagggtttctaatgaaggacaattacagggtcatagcccaaagcagccccgccacaagcaagaaccatctttaaagtccaatatttttgccttaaaaactagcactccggctgggcgcagtggctcacacctgtaatcccagcacattgggaggccgaggcgtgtggatcatgaggccagatcaagaccatcctggctaacacggtgaaaccccatctctactaaaaatacaagaaattagccgggcatggtggcgggcacctgtagtcccagctactcgggaggctgaggcaggagaatggcgtgaacctgggaggcagagcttgcagtgagccgagatcgcgccactgcactccagactgggagagagagcaagactccgtctcaaaaaacaaaacaaacaaaaaaactagcattctacaccataacatatgaagtatgtttttaacagtacaatgtcttaaactacctgtcataaagcaaggaggacactgcatgaacatgtactctgttgatcatcagatgtcagatgtactctgtcccacagctgggccccccccaggcaaatgccaaaagaataggtatacagaattctgatgctccaaagcccttttgaaggaatcaggtgcctaggagtcggccatttagcttattgaccatagagcttttttttttttttttttctattttgagacagagtctcgctctgtcacccaggctgctgcacagtggcacaagctcagctcactgcaatctccacttcccaggcccaagcaatccctctgcctcagcatcctgagtagctaggattacaggcatgggccaccgtgcctggcctcggagcactcttaaatatttatcagcattgatgttaatcatcaagttgtggcatgttttattaaaagaatcacataggaagtaaatggatcctgagtgaacagatttccaagagatggggtcagcaaatctccaagaagatgaaaaagtgatcagaatttcttagctaagatcattggtaatatgtatggtggagtgcagaatttacactttgtgcatatagaatttttttcatcatgaagacacttctcttgatcctgcaccctctcacttcctcagggacatgactcaagcacttcctttctgtcacctccttcccctccactctggtgtcctcgtcctcaaaagcccttcccttaggtgaattggtatggtaattctggagagcaatttgacaaaacctagcaaaagaaaaaatgtacatgttttgacccagatgtttcacttctagaaaatgtagctttagctatgcttgcacaagtttgtaaggataaatgttgctcatacacagatgctctccaaagcattgcctgtgagaacaaaaacagagcatgacctgaacagacatcattacgggactggtccagtacattgcagtacaatagaaaaggatgctggtaatcaactgttgagtgaaaaaaaagttgcatagcaatgtgatcacattcataataataaactgcatattttgatgtatatatgcttatttaatctgagtgtatggcacaacttcaggggtaccattgactttttttttttttttttgagacacagtctcactatgttgcccaggctgaagtgcagtggcgcaatcgtagctcactgcagccttaaattcctgggatcaagcaatcctcccacctcagcctgctgagtagctgagactacaagggtaccaacatgcccgttttattttatttttttgtagagatggactctcactagattgcccgggctggtctcaaactgctggactcaagtgatcctcccacctcagcctcccaaagtgctgggattacaggcatgagccatcgtgcccagcctacattctattcttgtcttgtaagtgaatgaatggtacacatgggaactgcacatctgcgtatgtgtgtcacctgatgtgccccaggaacgccctgagcttgcatgtatcctaacacataaactctatggtaagtactaacctacctccccaagaccctgtagactgcatgaggaaaggattattcacctttttatctccaacatgcagcactgtacctggcacaccaatggcacttgaataaataagggtgtgagcattcatgggccccagaatatgtcagttatctatcatttgcattgatctaagaactaggcatgtccccgggagagaaaataaacacttaataggtggtttccaggctttagcaaacacatacacacacacgctgcgcacgcgcgcgcacacacacacacacacatatccagggttccaggctcaaactgtatttggaaaaactgagataaatgaagataaaccattttcttggctgtagggcatcactaagattttaatttgcattgatactctccaagaggcagatacagtatggagtatcatccgaattttactgaccatgaagcacctttagaggaacatttatttatattgatgttctgaggatcattcatctgtaacaggctgcattagaagaatcacaaaggaagtcaatggatcccaggtgaaagtcagattgccaagaggtggggtccaagaatctccaggagggtgaaagagtgatgaaaagtttcttaggtaagatcatttgaaactcccattggatgtcgaaaaccgagaaggaaaagatttggtcaatggaacaagagcaagcaaagcatgcttgttgagctgatagcagggtggcaaaaatcctccccctggggacttctgggaccttggcagggatgtcagggaaggagcccagtgatcagaattccaggagcttcctgaaaagcttctgatttaggaggtaggacctccaaatatatatattttaactcaccagatacattttgacgttgagctaaattttgaactggccattgcttgacatcgctccttctgctctgacactagctcttgttccctccagaatctgatcagcaaactgatgggagcagaggctacattacatgaggcgagattaagaaggaagtcaggccgggcacagtgtctcaagcctgtaatcctagcacttgggaagccaaggcaggcagatcacttaaagtcaggagttcgagaccagcctggtcagcatggtgaaactcttgtctctactaaaaaaaaaaaaaaaaaaaaaagaaagaaaaagaaaaattagctgggtttgctggcaggcacctgtaatcccagctactcggaatgctaaggcaggagaatcgcttggacctgggagacagaggttgtggtgagccaagatcatgccactgcactccagcttgggtgacaaaaggagactctgtctcaaaaaaaaaaaaaaaggaaacaaaaagtggagaaatagagcaatgtatgcaatttttcttgggggaagaaagaagacactggtgaataggacggaggaggtataattgatggaataaggtctctaaagacagtgtgtcggggaagagatatctgagcacatgtggcaagtggtccttggacttgggaaaggaccgtcctctactataatgggcagagaggggcaaagacagagctgaatgtagaaaaggtgacagttgggtgggtagggagttgaagatgtttctgcctggggtctttgttttaattgtgagggagaaggtgacaccattcttaagacaagtgagtcggggttgaaatagtcatggagacctgaccactagaaccatgactcacactgagaacttcgttgaggttgaaggttagaagtatataggatcatctatctgtgtcccatatccttgtagaatcttttagtagtagtagtaaaagtagtagtagaactagtaagacagggtctgtctgtgttgcccaggctggagtgcagtggcatgatcataattcactgcagcctccaaatcctgggctcaagcaatcctcccccctcagcctccaaagtggctaggactacaggcatccaccaccgtgcctggttaattttttttagttttgcagagatggagtctcactatgttgcccaggctggtctcaagctcctggcctcaagcaatcctcctgcctcagccatccaaagtgctgggattacaatcataagccatcatactcaacccatgtaggattttaccccggagcactccacatactgaagcagaagtaacaatagaaaacagctgtcagggaggatgccagagagaggcaggttgcagtgtaagcacccagagggtccacattctagaagatgacaagatcaaggttgaggccacaggagtcaaagtcaagaggatagaaggtcacaggagttgaagttgaggcaacaagaggtgagaatgttgcctggtcatctccatgctcattcatctccccagtatgatcaggacttgcagcagatataagaatgaataagctgctagggaattccaggagtgaaggggtgactagaagaaaagcaggtcacagcaatgaggaagagggagtcaggaaatgtgttcctcaatggggcagagatttttacacaatggttaggaacaagcacatgaaggtctaccagtagcctcttcaagtgaaggatctcactgctcctcttgggggatcttggagagcacccattctctctcacacacacacacacacacacacacacacacacacaccttgctccaaccaaagtgggtcctctaagtattagcctacccttaggacttactttagaaaagcttttatgagcaaaacaaaaaaaaattaaacaccattgatcatgcctagcccttccattataagccaaggatgagcttgatgaaggtacccactgctgcatcctgctagcatgccacgtgaggtacactctcccctaagacacagctcctggatgatgcatccttttagggccgatgagttcggcaccactgaagtccagaagagccaagcattgtggggaagtaggaccattggccagagaagggccatgatggaagcccttggacacctgttagggacagggaagagaggcaagaagaggagaaataaagatggcaagcaaagaggagtccagctgatgattccaatctagcaaggaagagcagctcagcgtccaggcaacaaaggctgagttccttcagcctctcactgtgcaggaccttccgtcacaaggaagtttacaggtcttgtttatgtgtagactttttataagctattcagagcaggggtgggagggaaaactagagagaaaagttccctttgaatttccattgctttcagagtcggcaatttaatgagtcaggcattctaaattccttgctttgtctacacgttttcatttcaaaatacgaaaaaacactttgtttggaacatgagttatttttagatcacatatcaatagtgcacatccacttctccccacatgaataaaaaagcttcctttggattgggctgaagccacaccatagtggtagggttatttagctggcatttgttgaagctacctgggcatcactctagtccctggaatctgtcttctaggtggcatcatggatgagtcagctctagacctgttccaaagagctcccaatctcatagtctggacaagaagtaaagaagtgaaggatttcactgctcctcttaggggtcctgggggacaccccattatcccaaatacatacgcacacaccttgctccaaccaaagtgggtcctctgagtattagcattccccatatgactttagaaaagtttctataaacagaaacaaaaaaattaaacaccatcgatcacacccaacccttccattataagccaaagatgagctcaagaccacacagtgaattgagggaggtacccactgcttcctcctgctagagtgtcctttcagacctccatgccaaggagtcaccttgacaggctagaaaaaaggtcagggcttccttgcttcactcccttgtgagaactttgagaaaaaggagtagaagagaaggaggtcaccatctacaggtcacctcctccagatgcattgagaagcatgctgacaccttagcaaagacaggagcggacaatctaggatcttctgcagtaacgtaggctgacaaatgggaggacaatgggctgcaaggctggctggctgtgggaagggtggtgtccctacctctacagtccccagccggttttgtctaacctattgctttttttttttttttttttgagatggagtctcactctgtcaccaggctggagtgcagtggcgcgatcttggctcactgcaacatccgcctcccaggttcaagcgattctcctgcctcagcctcccgagtagctgggactgtaagcgcacaccaccacccccagctaatttttgtatttttagtagagatagggcttcaccatgttggccaagatggtctcgatctcttgacctcgtgatccacccacctcggactcccaaagtgctgggattacaggcatgagccaccgtgcctgacctaacctattgcttttgttccgtaagtcacagttcactaatttgagtcttgtagggatcaccttcttaaaaagctccaacttaagccttaatagcaaatactttcccagcacttcatggagagtcaactaactccaagaataagacatacatctaatagctcaaggaactggagggatatagcttgggtatttgtcccctccaaatctcatgttggaatgtgattccgtgttggagatggggcctagtgggaggtgtttgggtcatgcaggcggatgcctcatgaatgcctgggcacccttcctgtgataatgagtgagttctcactctattagttcatgcaagagctagttgttaaaaagagcctggcatctctcttgttccctctctctccatatgacatgcctgctccccctttgcgttccactatgattagaaccttcctgaggtcctcagcagaagcagattaggccatccccttcttgtacagtctgcagaaccatgagccaaataaaccttttttttaatcaattacccaatctcaggtattcctttatagcagcacaaaacggactaatacatgggggtgaggaggcaccccgcttctctagtcattccccctccccatcttctgtccacccatttatagtggcagcagctacgttcatgcatctgaccctcttctcttgggcactactgatttgatctggagtggacagcaatgagcttgtttcccaggggatttggaattgagaccacactgattcctccatttaatcactgtcaaacagatagctatttgacaggaatcatcttcatatggacagagaaacccaagagacttagctttctcagattttccacatccttctaggtccttgatgatgagctaaattttgaaccggccattgcttggcattgctccttctctgacactagctcttgttccctccagaatctgatcagtaaactgatgggagcagaggctacattacatgaggcgagattaagaaggaatcaaggccaggcatcatggttcaagcctataatcccagcactttgggaggccaaggcaggtgtatcacttgaggtcaggggtttgagaccagcctggtcaacatggtgaaaccccgtctccacgaaaaatataaaattagctgggtttggtggtggccacctgtaatcccaaagctgcacctctggccttagatttcatgagacccaccctctgcccactcccatggatatctccctaacatgtttccctttttacttctgataactctcctgggcttctgtcccttgcaaccaatatggctctgggaggtgtgaaagtgatctggagatggaagatgagacacatcaaggagactcctctctgctttctaacttcgcctgccctgcccacactgtgcataaccactcaggccactgcagcgaggaaacagtggtggctctcttttgagcatgctttggggtgagaggagggccctggtgcccgtttttgctaaggtgtcaacatgcttctctcaatgtacctggaaaagatgacctatagatggggactgcattctcttctactcctttctctcaagggtctcacaatacccaggcagtgctttacctgaaggaggttcccaaccaaagaactgaagggcaggaggcaatgcactctgagagataacattactgctgaacctaaggggagaacacgttcctgatgggctgtgttctcactcccctccacatccaactccctggagccaagaccttgaccacagatctccctcctctggccccacccgatcccctgctttttggctttctctctctcagcccactgcacaaagaaaatctttaaggaatgtgtggatacatccccaaggaataacaaaaacagaaacatgttcagtgcgtgtgtgcgcgcacacaaatgtgtgactgcaacaagccagaaggtgtagagacccttagccccagggtctaaagggagttcatgttcagccccaaaggagaagcacatgccttgggagaaactgattccttgggtcatcactgtcccccagaggcaggtgacactcaactgcctaattcacgctgctcgcaactcttgccaaaaaattccaaattcccaaaattcaggaacaaatgaggaaacatttttaatgtaacagtgtgttgagcaaaaagatttgtctgtttgctgtgtgatatcctcagatctagaggtaggcaaatatccctttcctccgtcacaccagctttctgtaaggcagccctcctaggacttaccaaaatgtttctcttactcaattcttacctccttttctcaacatgccccacccccttttccaggggaagtgttcaacatcctttcatttatcctaggctggtaaaagtccaaccatgcctgcctttggtggaaggtcctctcctggaagggatgagctgggatggggagaccatcccaagatgatctctgactctagccaaccttccttgctcttccttgctctgagcctgcccttcagcatttgtcatttccagctttacattgtcctattccagatgcttcctcagaggctaagagagtggcttccccagtaggtaagcgttctcttggccaggggtctcatcagctcctgcccttgacttctcaaatgtcaagttgtgttggagaagattctgaacagagtcttgtagcatcctgttcctgggtcccacagcctagctccctgctcatgggagaaactgctgaacatcaggagctctagtcaccaaaaatacatccacttccttttcttccccacaagcctaactctaaactcactgcccccaccatatacacttacagtcgccactggaagctggtggctaaagctggagatcccattctgaacagccttagggagacaatttcaggatgtacccatttataggactcaccacagaccaattccttgatgccagcatccacaaagatcaaaattgtgttctataccaaaccacacccagagttgaaattcctcttgagtttgtatagccatgagggtctccgaggaaaagaaaaaagagcaagatcaaaaacccagggaggcctgtggcttggtagcatagaaaactcctcaccccgaactgaccgcatcaatgaccagagacagacagggtagcctagtggttaggagcataattttttggtgggggatggggtgagattcaaagacacttgggtaggaatcccaggtttgcctttggctgtgatctcagtcaagctgcctgtttgtgttactttcctcctgtcgaaacgagattaacaataccctcataaaattatttgagaattgattgaaattgtctatgcaaagctcccatttttatgctagtacatagtccacactctgtaagttgtatttgtcattgttcacctgaaaacaagcatgtccctccccaagagtcagtttgcaaacccatcccttcatcccatccacacatctcaaataggctcaagaaaggggatagaatctctgtacccagccaggacagctctcccaggtgtccatttcatagattctcctctccagcctagacacgcagcagcggcaaagcctcctggaccccgcgccaccccctacctgagggctgccaaacaatctaggtccttgggtttgggggaagaagacttgccaggtggggaagtcgggggcctggctcctcggcggctcctctccccctccgagggctcctccgtccccctttttctcattctcgggcttcccctctccgggttgctctggcagccgcatcgggggtccagggcgatgttctcagagagagttagaagctcatcaaaggaacgtcagcgaaggcactgagactctgaaaggagttgacagaaacttacagcctgcacagtgctgggcgattattcttctcaaagcctgccgcctaaataattcacaccctcccttccgtgtttacacaggacaatggtagaaacacaatcctggcacaagaaatataattacagttgagacacatgtttagttattaataaggcctcaatgtcaccagagggtattgcacaacaagccaataatgggcttttggagccaaccttaatatttacaggtatttttccattcgtacccccgtgggcattgctggagtatgtgcagtgtggagaaagctatagccgccaaagtgattgcaacttgcaaggaagcaaaacatcttgccagcatcatttgtttccttgctgctgacaccaggaaagccacagaaactaaatgggggactgagctggaaatcaccgtctaacggtgaaggactctggcccagcctcccaaacttagtcatgctgtcgcaatcccagggcaataccctcctaacttccttaaagcatacagcatccaagatggcatcccattaccagctccagggcagacctgcaacccatgcatatggaatctctaggtccacttgatgtcaccaagtggcaacatcctctttctacctctctctggtatcgttaccacctacttgtcccttacaactcagctcaggtgtcacctcttctgaaaagttgtccttgacctggccctctcccttggttgggttaaggcacccctcgtctctgcctacttctactgtcatttgtccacaatctccatcccctcctcccaacattgtgttgagaaaaaccccaggcagggaagagctcagatgcacactgtgtggcatttaggcccaggcagggacaaccttaaaataattggtgctcaataaatatgtattgaacacacagttaatcaatgtcagttctctttggtttcattgaaggtaaaaacaaacaataataaagacaaacaaagactctcttgagatgtgaagttcagagagtgtaaatggaagacgttggtgatgaaaccaacaaagccccggccaccatggatcagggccccatctgagagagttgtacccataagaacgtctacacattgcagcaggcaatggcttctcgcagaaacacacagatgagtctccatttctcactacttggcccctgaacattgtatcctgggaagagtccctctgccctctttctactctctcgattctggtgagaggtgcatgctcatgcctgggaagtggtctcctatcaaagtcagctcttagaagatcaggctcaaaaaatgactgtagaaagcaggaagaaggcttgaagagctgtatgtggatggtggacattattgttgcaggttgttgtaaatctgcacgcacagtacccactgaaagtcagcctcaatcggctcaaatgaaagaggctcagcccaaagccctgtgagtaactcatcagctactggtgtgaatgaatgacggacagacacataaaccaactagatgctttgtaatttccatctgaaccagaaacccccatggtcttagctcagagctggaccagatggtgtctgggtgccccaacctccgaggtctctggttccccaatggttgtgggatggagttaagccctccatcccacaggaatgatgagatacgacaggaagggtgttatgtcctgcgattgggccggcacttcccaagggttgggatctcaaagacaccttaaagagagtaagtgtctcaaagcaagaagtcacatctcaccaaacagcacatgtgcaacgcacccatgcaacagtacttggcctcaaacacatacatgcacacacacacaacagcactggtcttcagatgcgtgctcacagaccagccttgtaacactcatagcctagggatgatctgagacccatctagcatagcttgggaggtctcaggaaacttaacaattatggtggaaggcaaagggcaaacaggcatgtcttcacacgcctgtttcctgagacatatgcccaggagcactcacccccacacccacatggctcccacgcaacttcacacagctgcacactctgtccccagcagcacacacccgtacgccgctctcttacacatgcctatgactcatctattcacacacactacaacgcccacttccccacacacgcggcacatgccgaaactcttggagacttctctagttagctcgttaagttaaacaggagaagcaagtgtgtcattacagtagaaacgcaaaaaaaaaaaatgacattttattttcagatatgcttttagttgccatggcagtccccagcaccatggaagttgtgattggtggtaaatgcatatttcaaaaagcagtaattagctccccatatgcaaaaacttctgaatatgttgagtcccttctcttgtcaggtccccccaggcagtgtggacatcagagcaaggcacccagatgagaactgtcgggagctgatggtcgccaggcttctgagcccaatacacttaatgacctggaacctgcccacagctcaacaggcgcacggcactgaaggtggcagctccccgtaaggaacaatcgctcctgctgctcagctggctctggtgccctcactgcggcactcgcgatgtgccagagaaacacaaagccaggggacccaaaatggagctggctcccatagccagaagccgtctctccagaattcccctctcccagtcacagctgcctgctggcgtaacgagggaagccaagcagccctgcacaagccggactaaccaccgtcggccaactaatgaagcaccccatgttggcatctgcacataagacagacctccatcttcccccaatttaactggaagcttctccaagacacaggcacctcctgagtcctcacagccttatgcatcttgggacccaaggtgcatttcccaatgagcttccttgtccccaaattaaccggttatctcatttcctgatgcgattcctaagggtgattaatttccagaatttgtcctctaaagtccatttgctaattgcctttacaatcgtcatctgaaaggtcagccggaaggagctggatttttgagccccagtcttgaagttagatctctgggctaattcctagacccacatgagggtccttgtcagcttttttttttttcttttttaagacggagtcttgttctgtcacccaggctggagtgcagtagcgtgatccctgctcactgcaggctctgcctcccaggttcaagccattctcctgcctcagcctcccaaataactgggattacaggtgcacaccaccaggcctggctaatttttgtatttttagtagagacgggtttcaccatcttggccaggctggtcttgaacttctgacctcaagtgatctgcctgcctcagcctcccaaagtgctgggattacagacatgagccaccgcgccagccccttgtcagcttttcattccaataggtgacctacccacttcctttagcactgaaaatgcccctggaacactgcccagtcactctttcagggctcagaccagtaggaggcactcttatccacccaaaaagtgatgtagccctgggtctacgctttgagtactctatcacctgcatcacttttaccaacccacaatatgcagagaatggtgaagtaatattgttaagaacatcactaatcaaattagaccatccagttcaaatcctggctgtgccacttaggggctgtgtgaccttgggcaagtgacttaacctctctgggcttcactttcctgatctgcaaaatgaacctgataataacacctaccttttaaagttattgtaaagtgttaggcacagagcaggtgctacatatgctagccacctgatacggtttggatttgtgtccccacccaaatctcatgtcaaactgtaatccccaatgttggaggtggggcctggtaacaggtgactggatcacgggggtgtatttttcccactttcatgctgttcttgtgatacagttctcatgagatctggttgttgcaagtgtgtgcaaacaactttgctgcttccctcctctcttctcctcctgctctggccatgtgaagacatgcctgtttccccttggccttccaccataattgtaagtttcctgaggcctccccagccatgcttcctgtatagcctgcagaaccgtgagcccattaaaccccttttctttgtaaattacccagtctcagggatttcttcagagcagtgcagtaacagactaatacactatcattctccattttttctttttgcactaatactgactgagcttctcagctcagatgggcgctggactggacacagggccggatggaggtgggatgtgtggaaatgaatccaccacagatgtagcctcacggagctcagagagtcaagctggaaactcagacacaaacacacggaaccggggaagattgtccctactccttcagtctggaggatcagcttgttcctgagagtatccaagaagggagactttgattctccccttctgtggcactaggtatgcaaatatgcactgtatggcatttaggcgcaggcaggagcaaccttgaaataattggtgttcaataaacatatattgaacacacatttaatcaatgccagttccctttggttccatattgacgttaaaaacaaaccgtaggcctggcatggaggctcacatctgtaatcccagcactttgggaggccaaggggggtggatcacccaaggtcaggagtttgagcccagcctggccaacatggtgaaaccccatctctattaaaaaaaaaaaaaaaaaaaaattagtagtgcgtggtggctcacgcttgtagtcccagctactcaggagggtaaggcatgaaagagaatcacttgaacccgggaggtggaggttgcagtgagctgagatcacgccactacactccagcctgggcaacagactcggtctcagaaaaaaattaaacacacacacagagataataaagacaaagactctctagacgtgaaggtcagagagcgtaactggaatatgttggtgatgttggtgacaaaaccaacaaggccctggtcatcatggataattttttgtataaattcatgggatacaagtgcaattttgttacatgcaaggattgcatggtggtcatgaaaagacatacaaatgaccaccaattattatcttttcctttttttttttttttttttgagacagggttgcactctgtcacccaggttggagtgcagaggcgcaatcatagctccctgcagcctcaacctcccgggctcaagtgatcctgccacctccagtcccctcagtagctgggactacaggcgggcaccatcactcctggctaatttttgtattttttgtagagatgcagtttcaccatgttgcccaggttggtctcaaactcttgggctcaagtaatctacccacctcagcctcccaaagtgctgggattgcaggtgtgagccaccacacctggccccaagtatactttttttggggcaggggggcagcggtggaacagagtcttgctctgtggcccacactagactgcagtggcactatctcagcttactgcaacttccgcctcccggattcaagagattctcctgactcagcctccccagtagctgggattacaggcgcccgccaccgctcctggctaatttttgcatttttagtagagacagtgtttcaccatcttggccaggctggtctccaagtcctgacctcatgatctacccgcctcggcctcccaaaatgctgggattacaggcagaagccactgcacctggcccagcatactcttaaatggacctctgtgcttgtaacccatgcaccagattggttgctgaaggccacagaggctgaaatgatgaggttggccagtccactcagactgtatccacatacctcccttcctcagaggctggcgcagagtataatcttaaacggatctctgtgccagcctctgaggaaggaggcatatggatagtctgagtggactggccaacctcattatttcagcgtctgtggccttcagcaaccaatctggtgcatgggttacaagcagactcagcacaccaaagtctttcatggatttgatccctttcaaagtatctaaaattccaatcactgggagcaagattgagctgaaaatctaatgtttgggaatggagagggatgaacctgcattgtttatgggcataaataattcataagcatgggttaaatggtttttagcctctgggaccccatggaacagtggttcccaggctgttactcgaagacccaattcaaagaatcaccaaggaacgttccctcccttttaaccacgttgggcatcaagttacagtcttttcttttgcatcttgtggtctctgctagattttacaattgttgagggccacattataatcagttttttccctgtaatgcttgataatggttttccccttggtcctttcctctaaaaccctgcaaagatgcaccacatttaacccacaaaaagaatttatttttgttataactgaacataattctttcttgaagatatcttttggacaaaatgttccattgtgcgggtcatgccatatggtgtgtaatggggtacgagttgctgacaaaaaagacgacagggcagagtgtgagctccagcctgccccaaagctaagccctgcatttgctggaacatgagagcctggagctcttaaatatgtaagagaggttgtcaaatctacttaactgcttatgagcaatgaagtctcatcactgcacttgtgttactgactctgcaaaggtgattgttggccatcattttgaatatcttactactaagatgtattcaaaagcacaaaaaagaaatctaaaactgccaatctaggacgtagaaaatgtccatggaattccttgaaagatgcaaaagcgaaatccttctacatgatgtaaaatcaaagttgttttctccctatctctgcccaaaaccaattagatatcacggaaataaaatatatacacaagcaaagccaaaattttaagtccacatctgaaaactgaaatgagcttttcaaatcagctcaattcttctgcaagtgagacttctcaggagccctaatgtcccttcatgtcctggcttaaattcgcataagcaaaacaccctaaaccctggttcttcaaaatgaaaaccaagaccctatgaacggctcacaattaaattaacattgaaaatcagagtaaaatagggaactatatatatttcctgaacataaatacacacacctccgtatcagctcacgagccagcaccctaccttcttactttccaagaagcactagaaactttattgctaaaatcagaaaaaatacaaggatgtttactatctctgctactattaacactgtattgtaggcattaaccaacatgattagacaattagaggcataagatgggaaaagaaataaagttattttaaggtgatatgattatatgtatggaaaatcccaaagaattcatgaaaaaacgattacaaataataggtgaatttagtaaagcattagaataagaccaacatacagaatttaacaggacatgtgtagaaacagaagataatgtatgagcagagcctatttataagagcaaacataaaggttttacagatttgaaaaaaactatcaaaaggaaaaagcaaagcaattccttaaaatagaaaatgaactgaaacatgcaaacacaactgtatttcaagttaatggcttaactacagagaaaaccgtttttttcaagttactttagaacataatattttgactgagctttccacgtgagacctaagtctcaggacaaaaagaaccacaaagaaatcatacaaaagagattcatgtaacatcattaggaatcaagattttctatgttagagaaaagagctgtaaatataacaattttaaggttaagtaaaaactctgaaatctagtttgaataaaaatatcactgtgaactcaatttatttttgtctttaaaaaaatatggacgtatcagttgtgtcactgaaaagacgtcaaggtaataaaactcaggcaatgagcactcaaattgtagtctcaaaataccacttccggctaagtaatcagctccatgggaggaaatacgaaaagtcttgtcaggcctaaaagtggataagttctcaatgatgccaaatgacagagaaactaactggaagacacagccaatcaccaaatatggtacaactcattatcctgaaaattgacatgaatgtaattgctaaggaataaagtaattactcttttaaagtaataagaaaagaaccaaacaattgtcctgctttttccatacagattatattccaggataaccaaatagttgatgaagcaactctcttttagagaggtatcataaaccgataaagaaaaaatcatagattaaaacaccaccataatccggaacttgtctccagactatgaaagtacccagatggctcccaaacctggcccagctgggaactgcatgcagctgagcccaccatgctctttagtttctgtgcccacctgtgtgcggaatttattccttctgctgggttgttggtctcgccgactttaagaataaaaccacggacctcgcggtgagtgttacagctcttaaagatggcgcgtccggagtcgtctgctcctcccggtgggcttgcggtcttgctgacttcaagaacgaagacgcagaccgcggccgtgagctttaaaggtggcgcggacccagagtaagcagtaagctttattaagaagcaggaaagaaaaaaacacaaactcaagcggatagcaccccagcgagcttccccagcgggctcggggagccagcttttattctcttat

SEQ ID NO: 1174 - DNA, 109819 bp, Homo sapiens
cccggaaggagcgagcttgcggagcgtgaaccagtgagtgaaagcggcgccgcccgccggccgcaggtgcggcaaagccagtgtcatctgccggttctcttagggctcccggaaagaaggagggctagccgcgtgcgttcgcgccgcgcctccttgcgtttctgttccccaaatagggcctctccttctcccgccgcccaggcccctgcgtgggctggacgcgtcagccccacacattagcctcgctgcggcgcccagactctgctttgcctccccgtcccggtccctggcccctgccctgtcgcccgccgccggagcggtgaccgcccggcccgccgttcttctgctgccaccgctgtcggcaccatgggcagtgagcagagctccgaggccgagagccgacccaacgatctgaactcctcaggtcggtgtcctaacctcccaccctcctccagcccgccctgtccccttgcagagcgggctgcctcccagactagggtcagggactgcggacgggaacgcacagaaaaagccttcaccgtgctagtaggaaaaaaaaaaagtcaccatctgtcctggcctcgattcccctgatggaagtgcgtgtgactgcaagctaagccagcgtgggcgccagtgcccttatttattttcaaaacagccgtttctcccagctacagcctcctgtttaaaagacgagctaattaatttttggctctagtgctcatggctgatgtagtgagatttggctcacacagtggatggattataggacctctaagaacagtctgtttcttaaaaacgggtgttagaggttccttttctgaagggatatgtgataggtgtccacttgctttgaaccctttagtgcaaaggtctccagaaacagctttttcttctcagaaggtgtcttggtccgttttctaatcttgtagaggttggccagacagcaggcactggtgttttccattgttgttctctgtccatgatttttagacttctctaagcgtttgagacaagaatgggaggattattgtgtttgcaatacagtgagtgttcaataaatagataaagcagctgatgtttaattgaggaccatttgctgctttttttgttacccacacgctaggacagctgggagtgctttggttaagctccggggttgctaacgcaaattggttaaatctggggcctaaaaagagtcgccgattttagaagttctctgttcttgataggagctgtaattcagaaataggcaagctaatagatctaagggtgtttcactttaaggtgtgactttcaagactagttcagacctacattctggggactggattggggcagctttgaatggtgagcagcatctactagctttgctacgtttttctatttccttggaagggccagagtgtcatatctgttataagaaatataataattgccacctttgacattcttgcctctatggcagggcagaaacatattttagggggaagcggtgtggcatctttttaatttgttttcttgcccatgaaccaacagcattcgagcatttccgatgttagaatttgcctattcccctgtgcccggtactttacatacatttacatataatttttgcagtaatcccattttacagataaagtagtagaggttagctagagtgttttgaagtcccctttcctctggtatctggggaaggaggaatcacaatttatagcaggaaagatttctggcatggcttttgtaaaatgttaggtaaattaccaaaacaggtaaataaatatttcttgaaaagaaataaaagcagcagagatttttctagaagagtgaatgccaagcctccggagacgagcttctaggaggcagaacagttctatggcatccctggattaacctttgagatatgactataatgagcctgggaatattaccttctagagcataaaacactttaaagattcattcttgtcccagtctggaagatatttgggggagaggatgatttcttggtctagggagtcctttataatttgaatcacttccctccaaatggattactttctcccaaggaacctgaattgatctccctctttgtcctccaaatttctgatttttgcctcagcctagaatggacttactggctatttttgccctggactaatgctataattttaagagtgagggggctgtagtcctagctactcaggcccaggtgggaggattgctggagcccaggagtttaaatccagcctgggcgatgtagtgagacttgactctttttttttttttttttttgagacagtctcactgtcacctaggctggagtgctgtggcatgatcttggctcactgcaacctccgcctcccggattcaagcaattttcctgcctcagcctcccaagtagctgggattacagggacatgccaccacgcctggataatttttgtatttttagtagagatagggtttcaccatgttggccaggctgatctcgaactcctgacctcaagtgatccacctggcttggcctcccaaagtgctgggattacaggcgtgagccaccgtgcccagccgccttgacttaaaaaaaaaaaaaaaagagtgaggaggctgaagcctcgggaataggccagtcattcgggggttgagaacaggtttttttcctggacttactaaacatagctggcttgatgtggtagggtggatagacagctttgcaactccagtgtcgcagagatgggccttgtgtaccaataacttgtagatgtctaattcctttcctaactgtctagcactgctgactttgggcaagtcacagttaaattttgtaccctttatttctcattttagaaatagggagatatatatatatatctcaagatagcaggagaattaaagagaaagtaaaaacaatctgcctatacttttgtgtgctgaaaaagaaaatatttagttatgaaagaagttcattcatgttatataatcctgtaatgggctgggcgtgatggctcacacccgtaattctagcactttgggaggccgaggtgggtggatcacgaggtcaggagttcgagaccagcctggccaatatggtgaaaccccatctctactaaaaatacaaaaattagccagatgtggtggtgcatgcctgttgtcctagctactcaggaagctgaggcaagagaattacttgaacccaggaggcggaggttgcagtgagccgagattgcaccactgtactccaacctggcgacagagcgaggctctgcctcaaaataaaataaaatcctgtaatgtctgagggtttttgttgttgttgttgttttgttttttgagactcttgctgtcttacccatgcagtggtgtgatcatggctcactgtggtcttgacctcctgggctcaagtgatcctcccatctcagcttcctgagtagctgggactacagtgtgcaccaccacatctgactaattaaaagaaattttttttttttttttttttttttttagagatagggtctcactatgttgcccaggttggtcttgaactcctggactctggtgatcctcccactcagcctttcaaagtgctgagattacaggcatgagccaccacacccagcctgaggtggcgtttttgtttgtttgtttttgagacagagtctcactctgttgcccaggctcaagtgcagtggcacgatcttggcacaccgcaacctccgcctctcgggctcaagtgattctcctgcctcagcctcctgagtagctgggattacaggcacccgccaccatgccccgctaatttttgtgtttttagtagagacagggtttcgccatgttggccaggctggtcttgaactgctgacctcaggtgatctgcccacctcggcttcccaaagtgctaagattacatgcatgagccaccgtgcctggctccagcctgagcttttaaaaatactatagaaaacagtttctataattcatccctgccaccccaaccccaactgcaagatagctacattttataaaattattctttttaatcactacaccaaaaactgctttggtgaggcagagatgcctaatatgcatctcctaagcagtgtaactttattttcagtgactccttcaccagccaagcatagagccaagatggatgatattgtggttgtagctcagggctcccaggcctcacggaacgtcagcaacgatcccgatgtcatcaagttgcaagagattccaaccttccagccccttttgaaaggtaaaggattgcgttttgttttatctgaacttgctggagacgtttgtgtagccctactactttccctctacttatccatgtatcttgctctctcatctcctttaggtctttgcttaaatggcatcttctcagtgaagcctttcttgatttccttaattaaaactgcagcccctttgcctacctgtttttctctatagcacttaattatcattgacctattgcaaatatctttatctgtctatatttctctgctagaatgtgagctccatgatggcaggtattttctcttttgctcactgttgaattcccagcacgtgaaatataatctggtataagatagggactaagtgaatgaatgaggttggaaatggcccttccctgttatattcccatggaaagattttcattcttatttgtgatctggacagtgggtggactagttcagatccatagagaaaaatctccatcactactgatacactcgtaattaatcctggcggcagttttatatgagagtgtgtgtttgagaagagagattacccacccaattagcatatactgtggtagttaccttttgaacgaaggccacaactttattatttttgtatctctattaagtagtggagattattttatattaactggtgtttctgctgtaagagtccttcagttctctcctccctcacccccaccaaagattaggaaataatgaacataaggccctggtttacttaacttggtataatacagtgtaaaacatcttacatttacatagctatttgaattaaaatgcccctcctcatacacatatcatccctttaattcttacatcattaaatgtgtttcaatgattggggtaagataagcttcttataagccttttataaggcagctggcatacacagaggttgtacttgaaccttcttcattgatgtcaaatcctatattacactgttccacactatttagaaaacaaaaacaaatggtgctttatagatgatccatatattgtcttattcttaccagtgcttcatctgtttcataaataaggaaatacaagctttcagtttcttttttattattatttaagttttagtgtacatgtgcacaacatgcaggtttgttacatatgtatacatatgctatgttggtgtgctgcacccattaactcgtcattcacattaggtatatctcctaatcaatttcttccctacaggcctgagagttagactttggtaaacattctggctcttatgtaaaacaacacattatatcatgttactcatcttttttttttttttttttttttttttagagttttgctctgtcacccaggctggagtgcaatggcttgatcttggcttactgcaacctccacctcccaggttcaagtgattctcctgcctcagcctcctgaagtagctgtgattacagatgcctgccaccacgccaagctaaatgtttttattattattatttttagttgagatggggtttcaccatgttggccaggctggtctcgaactcctgacctcaggtgatccacccacctcggcctcccaaagtgctgggattacaggcgtgaggcaccttgcatggcctactcatcttcttagttttcatgattttgaggaataatgtgattctctaaagaagttaacaatagtagggcatggtggctcacacctgtaattccagcactttgggtggctgaggcaggaggatcacttgagtccaacagttcaagaccagcctgggcaacacaatgagactctgtctcaacagataatacaaaaaattagccaggcatggtggcacatacctgtcgtcccagctagttgggaagctgttgtagaaggatcgcttgagcccaggaggtcaagggtgcagtgagcagtagtcatgtcagtacacttcagcctaggtgacagagtgagatcctgcctcaaaagaaaaaaaaaaaaagccggccaggcgctgcggctcatgcctataatcccagcactttgggaggccgaggtgggtggatcacctgaggttaggagatcaataccagcctggccaacatggtgaaaccccatttctactaaaaatacaaaaaattaggccgggcgcagtggcttacgcctgtaaaacagcactttgggaggccaaggcgggtggatcatgaggtcaggagatcgagaccatcctggctaacacggtgaaaccctgtctctactgaaagtacaaaaaaaattagccgggtgtggtggcgggtgcctgtagtcccagctacttgggagggtgaggtaggagaatggcatgaacctgggaggcagagcttgcattgagccaagattgtgccactgcactccagcctgggtgacagagcaagactccatctcaaaaaaaaaaaattagctgggtgtggtggtgtgcacctgtaaacccagctactcaggaggctgaggcaggagaattgctagaaccaggagatggaggttgcagtgagctgagactaccacttcattccagcttgggcaacaacagtgaaactccatctcagaaaaaaaaaaaatatctgcatataactttcaacttagccaaaacttaactactaatagccttctgtttactagaggccttactgatagcataaacagttgattaacacatcttttgtgttatatgttattatatactatattattacaataaagtaaactagagaaaagaaaatgtattaagaaaattataaggaaggccaggcacagtggctcatgcctgtaatcctagtactttgggaggccgaggaggatggatcacttcaggtcaggaattcgagatcagcctggccaccatggtgacaccccatctctactaaaaatacaaaaattagttgggtgtggtggcgtgcagctgtagtcccagctacttgggaggctgaggcacaagaatcgcttgaacccgggaggcagaggttgcagtgagccaagatcatgccactgcactccagcctgggtgacagagtgagacttggtctcaaagaaaaatataaggaagagaaagtatattaactattcattaagtggaagtagatcatcagaaagatcttcatcattgtcttcacgttgagtaggccgagaaggaggaaaaggaggggttagttttgctgtcttaggggtggcagaggcagaagaaaatctacgtataagtggacccacgtggttcagacccatgttgttgttcaagggtcagctgtaattcgttttatgattaatcactagtaggggaaatatctagaagacttggtgttaagggaagctaacctcagatttgaagtcatcactgagggctggccatggtggctcacgcctgtaatcctagcactttggaaggccaaggcggttggatcacctgagcacaggagtttgagactagcctggccaacatggcaaaaccctgtctctacaaaagatacaaaacttagccgggcatggtggtgggcacctgtagttccagctactcaggaggctgaggtgggagtatcacttgagccctagaggtggaggttgcagtgagccaagattgcatcactgcactccaatctgggcaacagagcaagactctgtctcaaaataaataaatcatcactgagtgccctgaaagtgaataattaatgtgatgcagttaatgcaatgcaactggacctggttgcattgataaatgagttttaactgggactttgccaccaactattatgttgtctggctttgtttttccacctttttgagccttggttattaagaacattgagaataggtgaggaaggaggaaggctagtaaggagcagattataggaagaggttatcggggatttggttaaggaaggtagagatgagatcatggctcactccagcctccacctcctgggctcaagcgatccacccatctcagcttccagagtagctgggactacagtgtgcaccaccacacccggctaattaaaatacatttttttttttttttgtagagacagggtttcactatgttgcccatgttggtcttgagctcctggactccagtgctcctcccaccttagcctcccaaagtgctgagactacaggcatgagccaccatgcccggcccgagtttcaaaaaatactatagaaaatagtttgtataattcatcccccccaccccaacccccacttgatgagagtggcgtgaatctagaaatgacaacatgtggctgtggccagactatagcaaacaaaaagccagtgagcattgaaggtgatgctcatgtttcacttgtgaagacgaaacatcttgggccgtgattaggaaagataggcaaagggggtggaaatgataagtttaattatgataatagtatcttatcccccatgcttctacataatagctattgttctttctgtttttatagattaaaatattgaggcctagagagcttaaattaattgcctaaagtcacatggctgtaagtgatagcacattttaagattgcatcaggacatagaataagacttagtttccaattctagcaaagcccattatagaaatcactaggatatacaggaactagcgtggtgggtatgaggttgtttgggttttgaggtgcagcatttgttgcagagcctcctgctttgacgttgttctgcctgataattaaaagccctaccctctgcctgctgggctgctgcaggggccaggcatcactgtcgcctttatactctgactcttttttccccctttcctgctttcaggatgaggccattcctcaaaatagtaaaaaggccacacagtgaagcctgtaccccccaggtttgatttcagaaagcttttattcaacttaatgacagtttattctttcaaaacaatatattgaagtattacacagagttcactattgtttcataatgtcatatgatgtaatgctaatgctggtgggtgatctgcagaggcagtggctgggcgagtttggggctatttgtatgactgaggtaatgtttgcatttttaataagcaagcagattctttctttggccttaacccttttgcataaatataccagagtataatttatgctccataatccaaatatctgttcctttttttatcaaagggatttctgtttttcatagcaatgtctgaattagtaatttattttgacatgtaaagcattttataggaaatgaaagattagaaaattagaaagtagctacaaatggctgtgacagaacacaaaggcaaaatagtagatttgatgtaagttagcaagattccaagaagttaacaaaccctgtatagatttcttacttgaaattcaaccactcatattttttaatgaatcccactctattgtatgtcattctaaagaaatgaaatatttgcaagagaaaagtaatatggttggtgttttatatataaagttacaaaaataattattcactcttagtagatgaatatgtgcatatttacacacatgcatgcatgtgacattctttccaaccgatctgtcatttttgttactgaccttggatacaacgtaagagattgtattgctgcctatggaaggggctgtttttgttaataacaaggatgatcaaacatatacagtgtagatactgaagtgatactaagcagctttgttgggagtttggtgtttggttgttaagaacatgatgcatgtgaagtagattttgataattaaaaggagcctggggcttttcatagtggagcgaaatctcatggaacagcagtgaaagctttcaaatcacatggaacattgagaactggaacctgaaagtgtagctagggaagaatgaagcaatggaaaaagggcgataaggagagcatgatggagctagatttcaaatgaccagtttcttcacattcttctgtcatctggacaaataaaagtctttgcattcatcagatgtctgcctctaccagctgtcagaccttatcattgcattggaaaatggcagccaaaggaggggacaagagaatggatcttaatcagagccacagtcttctctgaatggcttaaaggtaatctctaaacccaggggtaatcctaagtatattttctcccaaataccatattggaaagattgatgacttattcctgattactttatgggtttgtatttgtaatagctcttcagttaagcttttaaacatggctattcagagaagtgtgagttgtgtgtaaaaacaaaaacaaaaataaacatagctgtttaccagcattgggttagccttactcagaagagtgggaagtaccaggtgaatggttgctttcaaccgattgagaaagtgaagctgtctcaccagaacaccctcatcttttcccttactcccataaatctctgtgtgcctgcatccattcttgtttctttccattaagtctcagatgaggtattcatgcctttctctgaaacttaatgccattctgtttcactctttccatttgctgggactttgctcctgtccttttctctttttgtctcgcaactagcttagtggacctctttcctcttgttcagatatacagctcttcccatcttaaaaacagaagacgaacactttctttcaattcagttgccctcttggctaccacgctttctctgttctcatttctgctgccaaacttactgactccatgggtgctacatgctgtccctgcttccttgatacctctgccatttgggaagttcccctggacaggctctcatatacataacttcatccatatttgctgctttggaggattactagtgttttcttttcatgcttgaagtttttttctcagtccacatcctcctcttcttttccgtatttaacataggtttctatcccacttgttaaaactcccttcctttagtttatgatacctccccacccagtggtattctgttttgtttttttttttttaatctactggttagtctctattcctctctgcacagcattttgcctagtgctcttttggaaaaacaagattctaaggcgctttaagtattctgaaatgtagccattaagatgattttaagtctctgtcatcaacttcaacttttttttcttttccttcttcttttttttgagatggggtcttgatctgtcatccaggctggagtgcagtggcacaatcatagctcactgcagccttgacctcccgggcacaaatgatcttccaacctcagcctcccaaggagctgggaccacagatgtaccacacctggctaattttttttttttttttaatttagagatggggtgtcactctgttgtccaagctggtctcaagccctgggctcaagcagacctcccatcctggcctcccagagcactgagattacaggtgtgacccactgcacctggccagcttcaactccttgttctgtttgtccatcatcttgctctgtttgtctatacagtcgctttaaattcagcgtattccatcttccacttgtgtattatgtatttattcattttatttattcaacaaacactggatcttcttaggcaagtagtgtacacttgaaaagaatgtgttctgtagttaatgggtatagtgttctataaatatcacttaggtcaagaaatggtgatgttcaaatcttgtgtgtgcatattgatttatttcattaatttgatcacttaatgaaagagaggtattcaaatatccagctatttttgttaatttgtctattctggttattccattggtttctactttgtgtgttttgaaagtctattattaggcatatatgcattaaatattattatattgatccttccgtctttatgaaaatgtgctacctatgtgttattacccctgtcttgtagtctaatttgttttctatcaatatagccactccagctttcttacacttactatttgcatagtataccttttactattctttacttatttttatcgatttatgtctttatatttaaagggcatctcttgtagacagcatatagtagggtcttgcttttgtatttaggctatcgtctgctttttaattggtgtgtaaattgatatggttggatttaggtctcccattttgctcttcattttctatttgtgctgtgtgcttttggttactttcatactcctttcctgcttccttgcattacaaaaatttttttttagtatgtattccattttagtttcttttctggctctttaagttatactcctttgcattatttttttagtggttgctctagaggttacaatatagtcttgatatttattatagttcatttagaattactattgtatcacttcatgtaaaatgtaggaaactttcaatggtgtggtttcattcaccccccacttcttttttttttttttttttttttttttttttgagaaaaagtcttgctctgtggcccaggagggagtgcactggcacaatctcagctcactacaacctctgcctctccagttcaagtgattcttgtgcctcagcctcccgagtagctgggactacaggtgtgcgtcaccatgcctgtctaatttttttatttttagtagagatggggtgtcaccatgttggtcaggctggtctcgaactcctgacctcagttgatctgcctgcctcagcctcccaaaatgctggaattacaggcatgagccaccacgcccggcccaccttcacttctttgtgctattgctttcatatatattgcatctacatacgttagaaatcccatagtggttttatacacacacacacacacacacacacacacacacacacgtttttgttttaataatatattttttgaagtgattaagagaagaaaataactatatatagaatgtgatgtttacccacatagttaacatttccagaattcctaatccctttctccagtttccatttgatgtcatttatttttagtttaaaggacttcttttagcatatcttgcagtacaggtcagctggaaaaaagtcctgtttttatctatctgaacttttttttgcccacttttgttataaagtcattttttggtgtaattactaagtttttgaagacatattgtgagactccatgaaatctcattttttaatctacctttatttcatcagttataatatctattgatgattcttgcttgaattaattatgctgtgatggctaccaaataactgttttctaaatttttcattccttctacatttattagtttatattctattggaaggaataggtttctcatctccccatttatttattcaaatcagtgcgggaacagtcagctcctattttatccaatgagttgtatgtaatctgttattatcattatttctttttcaatctcaaaatgttccaaaattggccagtgacagcatcttcaatctaacttcctgtgtccttttttttttggagatggagtctcgctctgtggcccaggctggagtgcagtggtgcgatcttggctcactgcaagctctgcctcctgggttcacgccattctcctgcctcagcctgccgagtagctgggactacaggcgcccaccatcatgcccagctaatttttctgtatttttagcagagacgggatttcactgtgttagccagggtggtctcgatctcctgaccttgtgatccgcccacctcggcctcccaaagtgctgggattacaggcgtgagccactgcgcctggcctactgtgtccttttaacatattccccttatactttgaaaatgtctttattttctggcacaatataatgttccagacttattttgttcttccatgtctccagctctagaatcgggtatttcttaaaggaaccctggttcttttagtgaagggtcttatttagaatccatttctggaccttctcagaagatttagctagggaatccatagatacacacccacacatttacacctatgtttattttttatatgttcgtgtatttggcaacacgatcttgccctttcaccctggctggagtgcagtggcacaatcacggctcactgcagctttgacctcctgggctcaaggaatcctcctacctcagcctcctgagcagctgggactactctgcgtgccaccacgcccaactaatctttttgtattttttgtagagatggggtttcccaatgttgcctaggctagtctcaaactcctgggcacaagcgatccacctgcctcagcctcccaaagtgctgggattgcaggcatgagccaccatgcctggcctatattttctatatattgaaaatgacaagttcacactaatatgttctctatgttctttgatctgcaggtttgtacttttaatcgaaaactttggtcattatgtcttccaatatttttctgctccccccacctgctttttgtgggacgccaattcgatgttagaccgcttgatattttcttacacatcactgacacacctttcaatttttatttttagtcttttcctttctgtccttactttggataatttttactgctgtgtttccatgttcagtggtctttttttctgtcatgtctgtactgcttttaatctcatccaaggtgttcttaatttcagatgctggtatttttcagctttagattctcccccttaaatgtctttgatctctctgcttatcatgcttatgttttcctctactttttgaacgtatgagtacttcaattttattttaattttatttttaagagggagtttcgcccttgtcgcccaggctggagtgcaatggcacgatgtcagctcactgcaacctctgcctctagggttcaagcaattctcatgccttagtctcctgagtagctgggatttcagccacccgccaccatgcccagctaatttctgtacttttagtagagacggggtttcgccatgttggccaggctggtcttgaactcctgacctcaggtgatccacctgcctcggcttcctaaagtgctgggagtagagtgcatttcttttaaaatttacttactaattttttttttccttttagagacaggatctcgctctgttgcccaggctagagtgcagtggcaccaccgtggctcactgcagcctcaacccccctgggctcaagcaaaccgcctgcttcagtccaccaaattgttgggattacaggcatgcaccaccacacctggcctggatttcattttattcctttaaggataccagactttattctggcatatacatatggttaagttacttgtagtcatttggacccttcccatgttttcttttaaataccgttggggctcatctagtgcagtctttgcctagtttaatttcatctcactactaaggtgaaatccttctgagtactctacctgttgccttatgtattatgaagtctctccactgtggctaatgggaacatgagctcttcagaaaatatttggcctactgcttctctctagttttctccagtctctggaatttcaccttacaaatttacagatgatgttttcagagatttaagggtaccctgtgcagatctcaaggctgcccccttctctcccatattctgttgtgtaaatcctacccactttagtttctgcaaactttgctctctctctaactcagtgaggctgctgggctttttttgatgtccattctgctatggactgaatgattatgtctccccccaattcacaggttgaaattgtaatccccaatatgctgtattaggagatggggccttgggaagtgatttgatcatgagggtggagccctcatgtcatgggagtcacgcccttacaagaagagaggggagagaggttccttcttccttctgttcttagccatgtgaggacacaaggagaagacagccatttgcaaaccaggaagagtgccctcaccaaatatccaatgtgctagcacctaaatcttgtacttcccagcctccagaactgtgagaaataaatgtatgttgtttaagccatccagtttatggtattcttgttgtagcagcctgtaccgaccaagacacctccctggtctgcctcttggaaactgcctttaggtaataagctgggaaaatggtagggcttgttttccttctttcagggatcaaagtcctgtgctgcctgttatacagtatcggaaatgagtgtttcatatatttttgtctggttttctagttgtttattattgcataatagcagttaatccttcatgtgcagaggcagaaatccttaaaaaaatgctttttaatccatatttttctgtccgataccagtttttccattttacttataagaccctcctgccaacagcctttaattggtcattcatttctgcaacatattgataagcacctgctaagtgcctgatgtggtcagacagtgcaggtacaaaaaatagaagacatagttgctgccctttaggaccttattgttttgtgagcgatttagacaggtaagtattcacaataatatcatattagtaacactggccacatgtcccaaagagtagataaacatggaggagataattattaatttggcctgggaatttggggcaggcttcctagaggaagtagaattcagctgagctttgagggatgaatagcaggtagctacatagagaaggcagggttgcagagagtattcttttttttttttttttttttttttgagacggagtctcgctctgtcgcccaggcttgagtgcagtggtgcaatctcggctcactgcaagctctgcctcccgggttcacgccattctcctgccttagcctcccgagtagctgggactacaggtgcccgccaccacgtctggctaattttttttttgtatttttagtagagatggggtttcactgtgttagccaggatggtctcgatctcctgacctcgtgatccgcccgcctcagcctcccaaagtgctgggattgcaggtgtgagccaccgcacccggccaagggtattcttagtttaaaagtcttctatatatattttaaaacatatttaaaagatgctggccagtcacagtggctcatgcttctaattccagcactttgggaggccgaggtgggaggattacttgagcccagaagtttgagaccagcctgaacaacatggtgagaccctgtctgtactacagaaaaaaaaaaaaaagtttatctaggtgtggtggtgtgcacctgtactcccagctacttgggaggctgaagtgggaggatcacttgaccctgggaggtcgagcggtgttcatagcgctgtactccagcctgggtggcagaatgagaccctgtctcaaataaaataaaataaaataaaagatgccaaaaagaattcttaaccaggtcgggcactgtagttcatgcctgtaatgccagcactttgggaggctgaggtgggtggatcacttgaggtcaggagtttgagaccaccctggccaacatggtgaaaccccatctccactaaagacaaaaaaattaaccgggcgtggtggcgcacagctgtaatcagctactggggaggctgaggtgggacaatcgtttgaatgcaggaggcagaggttgcagtgagctgagattgcgtcactgcatccagcctgggtgacagagtgagactgtctcaaaaaaaaaaaaaaaaattattaaccaagtttgtatttggaatatactgcttttcttttcttttctttttctttttcttttgagctggagtctctgttgcccaggctggagtgcaatggcgccatcttggctcactgcaacctctgcctcctgggttgaagcagttctcctgactcagcctcctgagtagctgatattacaggtgcctgccaccatgcccggctaatttttgtatttttttatagagacaatgttttaccatgttggccaagctggtctcaaattcctgacctcaggtgatccatccgcctcggcctcccaaagtgctgggattataggcgtgagccactgtgtccggcctgtagaggaatcttaaaactgtcatagttggcctggtgcagtggctgatgcctgtgatcatagcactttggaaagctgaggcaggaggattgcttgaggccaggagtttgagaccagcctgggcaacatagacctcatttctacaaaaaatttgaaaattagctggtcatggtggcatgtgctggtaatcccagctacttaggaggctgagatgggaagctctcttgattccaggagtttgaggctcagtgagctccagtcataccacggcactccagcatgggcaacagagtgagaccctgtctctgaaacaacagcaacaacacagtcataggtatttaataacgtttaaatattttttccatcaaaattcagtttcacagaaagccagtgaaatgcaaagtgacattttaaagaatgcacttggatagataatcatttgcttctaccaactggtgaaaatcatcagcaaaagttagtaatcatggttttttttgtttgttgttgttgttgtttttgagatggagtccagcccaggctggagtgcaatggtgcaatctcagctcgctgcaacctctgcctcctgggttcaagtgattctcctgcctcagcctcccgagtagctgggattctaggcgtccaccaccgcgcacagctaatttctgtatttttagtggagatggggtttcgccatgttggccaggctggtctcaaactcctgacctcatgatccgcccacctcggcctcccaaagtgttgggattacaggtgtgagccaccatgcctggtctgtaatcctgtctctaaacatttttagcagtatatgaaagtgtcagtaagtaaatatttatgaacaaaaagtctgttttgatttgcaggattttcggaacaggtgacaattgggattgctttgctcttcagtcttttttttttttttttgagacagagtctcactctgttgcccaggctggagtgcagtggcaccatctcagctcactgcaagctctgcctcctgggttcacgccattctcctgcctcagcctcctgagtagctgggactacaggcgcccgccaccacgcccggctaattttttgtatttttagtagagagggggtttcacagtgttagccaggatagtctctatctcctgacctcgtgatccacctgcctcggcctcccaaagtgctgggattacaggcgtgagccactgcacctggcctgctcttcaatcttttttaattgagggcttttctctaacttaaagaatcagtatctttttatttcagtaaatcttatgttatgtcaaaattaatttttctcagccataggagaaggaaaaaataaatccaacagagagttaacagttacataggccaaaggcaaattaataataaatgccataggtctttctcatattttgccatttttaaaataagatggccttcctttagtgtagtaattaaatttatagcagtcctgtgtttaacaacacttttaccactagatgtcactagactaaaacaattggtaagcttgttgaaactgctgcaacctggtgcagtcttttcaaaggcctttggttaataaggcttcctctgtagcacctgcatttctcataaaactaagtcacagcttgcttcaagcacaagctgattgggaaatatacatgttctgtgacacgttagtaatctagaattacttattttagtgtttatcaggacagaaaaggacaaatcttactaccggaggaaactttttagtgaccttaattttttggagagaaaacgattttcagtctatctctgtactcagagaagcatttatcgtcacacctcaggtttctcaagagttgagattttgtccttttttttttttttttctcgagacggagtcttgctctgttgcccaggctggagtgcagtggtgtgatcttggctcactgcaagccccgccccgccaggctcaagcaattcttctgcctcggcctcccgagtagttgggactacaggcgcgcaccaccatgcctggctaattttgtgtatttttagtagagatggttttcaccatgttggccaggctggtctcaaactcctgacctcaggtggtctgtctgcctcagcctcccaaagtcctgagattacaggcatgagctaccatgcccagccaagagttgggattttgtcttagacatcgtggatttcttagggcccagcacaaagcttggcacttggtaggtactcagtaaatgcaattaagcattagggtagtatactagatgtcatgggggaaaagatagctcacaggtcctctgctctcaagaagtctcatttgggagataatacatgcccacagcacagggtattgtatgtaaaccaaatgagtagtgcattcactagcttctgtagtatttcaggggatcagtagctcttgagagctagcggtagtgatcaaaggtgtccttaagagaaagcatatttagagatgcaaaagtaggacagttacaagtgaagaaagcaatgagccaaggtttaaggataggaaaatgcaggcagtaaagatttagaaagataaaaactcaagggccctgaatttaaagcatacatttaggtttaatattttttagggatattggaggggacattgaaggatattggtgtgggaaaataatatgttgcatgatagtttgtaatttacaaaacaatagcacttgaagaagaatgaattaaagatgattgctctttgattttaaaatacttctgttttaaagtctattataggccgggcacggtggctcacacctgtaattccagcattttgggaggcctaggcgggcagatcacctcaggtcaggaatttgagaccagcctggccagcagggtgaaaccccgtctctactaaaaatacaaaaagtagctaggcatggtggcgtgcgcctgtaatcccagctactcaggaggctgaggcaggacaatcgcttgaacctgggaggcagaggttgcagtgagccaagatcgtgccactgaactgcagcctgggtgacagagtgagactccgtctccaaaaaaatacataaagtctactacaaacacttttatttaaaagagagaacataggcatagggcttagtatatagtacctctcacttaataaaccctcagtacatgattcttgttgatagtaatattattaaatgaggaaaaaatattagagacatgctacaaaataactaaccggttttctttataagagtcaaagtcttgaaagacaaggaacaattgaagaattatcacagatttaaggagactaaggagacatgcagtgtgggtcctggattgggtcctagaatgagaaaggatgttagtgggaaaaaagggcacatttgaatagttgtgtagtttagttgattatattgtagcagtgttaatttcctggttttgatcattgtattgcagttacatactatgttaatattaaggggaagctgctgagggtgtagtggtgagatcatgactcactgcagcctcgacctcccaggctcaagtaatcttcctgcctcagcctcctgagtagctgagaccacaggtgtgtgccaccactcccagctaatatttttaattttttttgtagaaatagggttccgtatgttgcccaggctggtcttgaatttctgggctcaagggatcctcccacctttgcctcacaaagtgcttgggataataggcatgagccattgcacccatctggaatcctatactttatgcaacttttctatttctttctttcttctttcttctttcttttctcttttttttttttctttttggaggcaaaaatcttgctttgttgcccaggcttggagtgcaatggagcgatcttgactcactgcaacctctgcctcccgggttcaagtgattctcttgcctcagcctcctgagtagctgggactacaggcacgtgccaccatgcttggctaatttttgtatctttagtatggtttcaccatgttagccgggctggtcttgaactcctggcctcaggtgatccgcctgcctcagcctcccatagtgctgggtttacaggcatgggccaccacacctaagcctgcaacttttctttaacttcttttgctttttttaaacttcttattcaaaaatagtaagtttaaaaatacaattttgttttagaaaagatttcaattttgtatttgaactaagttatctactgagaggtcggatgtcaacagaaagaatttagaatctcctacccgacagagcttttaagatccactaaagcccattaagcaatccactagaatagcttaaggcaagagtgggttcccttgaagacccagaagtagaacctctgaggtgcttccttgattaggctttgtctcagtggaatgttggagctagtttgattgtctatccagaccattaaaactttttatgtcagcactagggctgtttttgcctttgtgtgttcactggagtagcacttttaattccctttaagaacttgtcctttgcattcacagcttggcaaactggtgcaagaggcctgacttctaccctgtcttagctttgaacataccttcctcactctagcttttgatttaaagtgagagatgtgcaattcttcctttcacttgaacacataaagaccattgtaggggaattcattggcctgatttcaatattattgtatttcagggagtaggtccaaggagagggtgatagccgggggaatgattggtccgtgaagcagtcagagcacatgcaacacttctcagtttaagtttcctgttttctatgggtgtggtttgtggtgcccaaaacaattacaatagtgacatcaaagatcactgatcacagatcaccatgacagatatcataataatggaagtttgaaatattgcaagaattaccaaaatgtgacagacatgaagtaagcaccctgccacaaatcttcaatttgtaaaaaaaaacacagtatctgtgaagcacaatttaaaaaaaatttgaagtggaatagaatgaggtgtgcctatatatggaagatggcttgatctaatcagagataaaaagagatgaatgaggaccatatcaaaattatttccagtttgcagttaattctgctcccagtctccagtcctaggcaaccacaggccagcttttctggacacttcatctaaatggaatcatacaatacatactcttttgagtctgacttccagtttttgcctgttatgaataatgctgctatgaacctttgtgaccatgtgttcatgtgaatgtgtttttatttcttttgggtggattcttaggaacggaattggtaggttgtatggtaactttgtgtttacttttacgaaactgccaaacttttttcaaaattaccattttacattccttccagcaatgtatgagaattcagtattctctttatttctgattatagccatcagagtggttgtgtagtggtatctcattatggtttacatttacatttctctaatgatgttgagattatttttgtgtgcttgaaatacctgttcaaatctcttatccatttttaaattgggtttttaacttatattgtattataacaagttctttattctggatacaatctcttaatcagatatatgatttgcagtattttctcccagactgtgactttcttttcattttttgggggattttttttttttttttttgagaccgagtctcactctgtcgcccaggctggagtgcactggcgcgatctcagctcactgcaaactccacctcctgggttcaagcagttctcctgccttagcctcccaggtagctgggattacgggtgcctggctcatttttgtgtttttagtagagacaggctttcaccatgttggccaggctggtctggaacttctgacctggctgatattttttgaagtacaacttttttaatcttgatgaagttcagtgtatcaatatttttaataaagatttctcctagaagttttatagttttagtgattgcatttaggcctgtgatcctttttggattactttgtgtgtgttgtgtaaaggtctaagttcattttgctttgtttgtttgcttgtggtatccagttgaccctgtaccatatgttgaaaagattgtgttttcccttattgaattatctcagcacctttaaaaaatgaccataaatgtaagggtttatttctggactcttaggtctgttccattgatctgtcccatttttaatttcgtggattgtactttggtgttgtatctaaaaagtcatcaccaaatccatgcttacctagattttctcttgtattactgcttaggactttcatagttttgcattttacatttaggtctgcgatccattttgacttaatttttgtgaaaggtataaaccatatgtgcttttaaagactatatagtctgcagtcattgggtagagagttttatatatgtcagttatgttggttgatagtgttttttgagttttgtatattcttactgattttgtctttagttttatcaattgagagtgaggtactgaattattaacctgttttgttgaattgtgtatttttccttttgattctgtcagtttttccttcatttgttttgaggatatgttgctggtgtggatacatttagaattattatatcttcatgatgtaacaactttcatcattatgaaacaccgttctctaatattactctctgtctttatttctattttatctaatattaatagagccatttgtgttagtccactttgagttgctataaaggaatacccgaggctgggtaatttataaagaagagaggtttatttggctcacagttctgcaagctgtataagaagtgtggcaccagcatctgcttctggtaaggacctcagaaaactttcaatcatggaggaaggtgaaggaggagcaggcatgtcacatggtaagagagggagacagaggtgggggaggtgccacactcctttaaacaaccagttctcccataaactaatagagggagacttgctcggtactacagggaggcaccaagccattcttgagggatctgctcttatgactcatacatctcccactagaccccacctccaacattaggggccacattttaacatgagatttggaggggacaagtatccaaatgatatcactattctgtctttcttatggttctatgatggtatatatcttttttttttttttttttgagacaaagtcttgctcgacaggctgctgaagtgcagtggcgcgatctcagtttcctgcaacctctgcctcctgggttcaagtgattttcctgcctcagcctcccaagtagctgggattacaggcgcgtgccagcatgcctgtctaatttttgtatttttagtagagatagggttttgccatgttggccgggctggtttcgaactcctgacctcagatgatccacctgcctcggcctcccagagtgttgggattacaggtgtgagccaccgtgcccagtgggtatgtatctttttttatctgtttgctttcaactcttttgtgtctttgaatctaaggtgtgtcttttgtaaatagcatatagttggatcttgatgtttcatccagtctgacattctctaccttttgattgaggtataaaaaccattcacttttaatatagttattgatctggttagatttgcctttttattatttcttttctatacattcttgtctattttgtttctctgttcctccttgactgcctccttttatattaaatacatatttttagtttactgttttaactgttccattgattttttttaactatgtattttttggagttgttttcttagcagttgctgtagggattacagtgtacatgttaattatcagagtctacttcagattaatactaacttaattctggtaaaatatatatgctttgctccattatagcctcattctttcacccttttttgtgctattattctcatgtataatatctgtatatatttgtaaacccaaaacacagtgtcatagttacttccttaaggatgtttgtcttttaaagaagttaagagaaggtgtgaataaaaatatatttgtagaatcttctgtgttaactcacatatttacaatttttggtgttcctcagttcttcttggacttcaggtccccaaccgttgtcacttccttttaccctgaaaagacttttgttagtatttaatgttacaaattcactagcagattttctcagtttttgtttatctaggaatgtctttgtcttttttttttttgagggataaatttgattgaaatggaatttttggttgacaatttttttcccccagcactttatatatgccattctactctcttctagcctccattgtttcagacgagttgcttttctcttgctcatttcaggatttttttttcctttagctttccatagtttgtgataagtccaagttttgatctctttgtatttatcctacttggggcctttgagcttcttgaatgtgtggattaatatttttcatcagatttggtaagtttgtctcttctttccttctgggatttccattatgcatgtgttggcatgtttgttgttgttgcacagatctctaaggcactgttttattttctttaatcttttctctttgttctttagataatttctattttcaggttcactgattctttttcctgccatccccaaattgctattgagttgccccagtgaatttttcatttccattattatacttttcaactccaagatttctgtttggtttcttatttttaaaaattttatgtatgtatgtatttgtttgtttgttttgtagagacaaagtctcattatgttgcccggctggtctcaaactcctgggctcaagcaatgtgctgaccttggcctcccaaagtgctgggattacaggtgtgagccaccgtgcctggcctgctttttaaaatatatatataatttctgtctccttatagggaatctgaatttgtagattcattgttatatttttctttcttttattatgattttctgtagttctgtgagcttataattgctttgaaatttttgtctgctgtatctagtatcttcaatactcagaggcaatttctattgactgcatttttttcttgagtacgagtcacactcctgtttctttgtaggtcttataatttttttgttaagaactgggcattttagataatatagcagctgtggattctgatcctcccaaattgctgttgttacttttttgtctgttcattgctctttgtttagtaacatgtttgtcaaacctgtgaaatctttttcctgtggtttgtggccattaatgtctctacttttccaccccacaccctcctttttaaaagacgacaatcactttattatctctcagatttctgtgggtcagggattctggaagggctcagctgggcagttctgactttgttatgcagctgcagtcagttggtggctggagctgaaataacaggggctggagcagctgggggccgtctgggcagctctctttatttgtgtagtctcaggtcctctccatgtgtctgcttgctttttaaacttgcttatatctttacatctgctttcctaggggttgtccatatgtctgcatgggttaatagtcagttattgatcagaggttgtacttaaccaccttgatcaggaaggcttctgtcatctgtaaatggctctgcgtggcagggtagcacattcaaagttcaggccattttcaaatcttatcttttgttcactgctgaaccctttcacctctccccttggaatacacacaccctcagtgtcagctaggagcacgtgactggttgcaccctttcaggtctctgctgcaaatgcatacagccttagctaggagtaagcttgccctgaccacgaccacaacctcgtgttagtatagcttttggcactttccacttgcccatctctgagatagtcaattctactgatgacaccgctggatgtggatgctacctattgttccaaataagtcagcagccgcttcctgctaaagcaggaaagcttcctgttctcattacctgtcccattctggtacaacatctgcttcaactgaggcaggaaggttgggagaagcctcacatctcaatgacacagattctcactatttttacccaagttctttttttttttttgagatggagtcacactctgtcactcaggctagagtgcggtggcacaatctcggctcactgcaacctccaactcccaggtttaagcgattcttctgcctcagcctctgaagtagctgggactgcaggagcacaccaccatgcctggctaatttttgtatttttagtagagacggggtttcaccatattggctaggctgttctcaaactcctgacctcgtgatccgcctgcctcggcctccccaagtgttgggattacaggcgtgagccgccacacttggccaagttcattcatttttaaggcataaatgcttctcaaatttttatatgccattggttgattttccaaacctcaaaatggtttgaattatgtttgaatggtatgaattatgttcagctttatagttaccttttgcagagaggatatgttgatctcctcatttggatttatcaagaagtcccacttgtctgtccatgtggtttttttttttttggagatggagtctcactctgtcgcccaggttggagtgcagtggcgcagtcttggctcactgcaacctctgcctcctgagttcaagcgattctcgtacctcagtctcttgagtagctgcaattacaggtgtgtgccaccatgcctggctaatttttgtatttttagtagagacagcatttcgccacgttggctaggctggtcatggactccttgcctcaagtgatccacctgcctcggcctcccaaagtgctgggattacaggtgtgagccactgtgcctggccccccatttgcttttaatctagcttttaaagtagccagcatatagttgtcttgctgttttatatatgttgaaaatctgtctttttaatgatatctttaacactcttagatttagtgtaatttcagtgtggtggggttaaagtccactgttgctattttttttttttttatttgttctagttcgttctctttttttgagacaaagtcttgctttttctcccaggctctagtgcagtgttatgatcttggctcactgcaacctctacctcctgggttcaagcaattctcctactcctacctcagcctcctgagtagctggactacaggcacgtgctagttttttgtatttttcatagagacagggctccactatgttggccaggctggtctcgaactcctgacctcaagtgatccacctgcctcggcctcccaaagtgctgggattacaggtgccagccaccgtgcccggcctttgctcctgttctttattccttcctccctgcccacccatacctttttctgtctgctttaggattgagtctttttatgttccaatatttatctgcactgttgggttattatttttatgtatgaatatatgtattttttttctagagtgcagtggcacaatcatagctcactgtaaccttgaactcctgggctcaagtgatcctctagcctcagcctcctgaatagctaagactacaggcatgtaccaccatgcccagctaattaaaaaaaatactttttttagaaatgtggtcttattgtgttgttaagactggtctcaaacacctggcctcaagtcatcctcttgcctcagccccctgagtagttgggattgcaggtttgagctctcatgcctagcaagattcattatgtggttgtatcaatagtttgttccttttattgtttccttcttatggatataccatagactgtctatccatttgccagctgaaggaatcggggttgtttccagtatttggtgattataagtaaagccaacataagttttgtggcagttacaatatatgacagaattgcttcccaaaggatttaataaactaattcatagtaaaaacaatactatctgagcatttccatttcataatatcctcttcaacactgggcattacttaaggatttgttttctccaaaatggaagtatcttttattctgatcatgaaagtaacacgtgctcatgattttatgtcactcagccctctgatccgaaacctaaatatactccattttgtctcttttgttagagcatgacccccagaattggcatagtgttccaggtgtggattggatccagtgtcttttctgcatgatatattccttttaatacagcccaagtttaagtagcttttttggcagccacatgcacttgagtcatatcgaatcatctaaaactctaaagtgtttttcacatgtgctgacattaagccacacctcccccatcctgtatttctgcagatagtttttggaccttcagtgaaagactcacattcatccacagttcagtgtcacatgtagcctcagtttctagcttgttgaagccttttttgaatccccacgattaacacaccatgaggggcctcactcaagtcattaaagaatgtttaacacgacagaacctaggtcagagatccagggaaaagctcatcacagtcaacagacacagaactctttctgttaagaatacttttttattttccagtttctagttggtatttttgtgggaagtaaattgctatctcatatgcgattagtgagaactaacatttgtgattattatattaattgagactctttttggtatctgattatcagtaccatgcttattatgtatatcattaatgcagtttttattgtggtattttatcaccacaaactgtatttattactagtctatacttatttaaaacattgaagtgtttttcctgagactttaaaccacatcctaagaccacacttcccaaacatatggtagcagtgaccagagacataaaaatcacaccattgatgagagagtaatgattctaagacctgccccaaacctcaaataggatagcaatgtcatggctgctcctaatttagatgggacgaaatcaacaaaaaggaactgctggccgaggatagttaatattcaaaagcaaaagaaatgtatctgtaaataaggaagataaatctcattataatatccactgcttttttttggatgtggtcttccagcagtagtagataagtatattattaatgaaacaattgtgttagtgttccataattatacaaaaagggaaaataggacaaggcatgaataattaatgaaaggaaaccagactcttaagtggggtgggggggacatataagaaaaggtaacagccatctgtgagtctggtctgaggaccagaggatggctgacatttttggggccagatagactatctttctgctgttcttctcctttcctggcaatatactggaagagattgaaacagaacatcaaggcaaccccacacatgagatggaaatttaaaaaatgttccagatatgagcataactccctaagccattcttttagcaatggttgaagccagtcctctgacttgcagtaagttctcgcaagaggctacagttccgaggcctatttattttggcctcatttttatccctacttttactttggtgacattccttgagtctcactcattccagcatagggacaggacacaggttgttgaggcaaatactatgggttcatatagaaagtaccagatattaactatctctggccagagtttttcccctaggtccttacaagtaagtactttttttttttttttttttgagacgcattttcattcttgtcgcccaggctggagggcaatggtgcgatctcggcttactgcaaactttgcctcccaggttcaagggattctcctgcctcagcctcccaagtagctgggattacaggcgcccaccaccacgcctggctaatttttatatttttagtagagaccaggtttctccatgttggctaggctggtctcgaactcttgaccttaggtgatccacccgccttggcctcccaaagtgctgggattacaggtgtgagccaccactcccagccaaataaatatatttttaatgcacatttacaattctaattagttttatatacctctgccagtatcttttaagcccaactgaagttatgtgattcctctgcagaattggttgctccatcctgcctacaaccaattctgatgcaggtatgagctcctcagcttgaggtgaagatctcaagcagcctttatcttaaaaaatttatttcgttttatgtatttattttttgagacagagtctcgctctgtcgcccaggctggagtgcggtggcatgatcttggctcactgcaagctctgcctttcgggttcaagtgattctcatgccacagtcacccgagtagcagggattacaggcacatgccgccacacccagctaatttttgtatttttagtagagacagggttttgccatgttggccaggcttatcttgaactcttgacctcaagtgatcttcctgtctcggcctcccaaagggctgggattacagccatgaggcactgcgcctggcctcaagcagtctttaaatcttcatttcccactgtgtgctttgtattgagctccaggccaaatcggactgttttctttgctttcccacctctaaactttgcccatgcccttctatctgataaaaagccatcttttccacataggcctgctaaaatcttttcattcctttaatgattcctttttagattcctttaatctatcattccttcaagattttgcttgttcatttgttcagcaaatatttgagggctgctatgtgttaggcactgttctaggaggtgagggtatagccaaatacacaatctctgctttcaaagagcttacattctaatagttcatcccactagaaggcaagtttgtcttagaccatctccttcattatcttttttacctttcctaaattgatacaatctttacatagatcatgatgaggaaggaggtaatatatttgaagtgaccactgtggccaagcacagaacattgcaaaatgctttaattttaaaagcatgtgtcctaaatgtagaaggaaggataactagaaatacagaaagttatggtcagaaagccgggggtggtggcatgtacttgtaattacagctacttgggaggctgaggcaggaggatcacctgaggccaggaatttgagaccagcctggtcaacatagcaagaccttatctccttttttttttttgaccttatctcaataaggtggatgcacctgtagcctcagctacttgggaggctgaggcatcaggattgcttgagcccaagagttccaggctgcagtgagctatgactgcaccactgcacagcagcctgggtgacagagcaagaccctgtctcttaaaaaaaaaaaaattatggtcaaagcaaaagcagtaataagtaggatgaccttagatgatccaccttccttggcctcccaaagtgctaggagtacaggcataagccaccacgcccggcctaaactgccatttttaatgaattgtaaagaacagaagaggtaccagaagcttagaaatagaaaaaagtacacgttaaaaggggaggcgggtaattgaacgaggggccatgatttcaaaatttccatccattggttccaactctgtgccttcagcgcttgttctcttttaaagtattgatagactactattgtgcatccagtcagtcttgttttgtcacactaaaaatttcaagataagtccataacaggagcataagtaagatactgcaaggttctgaccttggcctcaaccttactcaagatcatatcacttagcttggttcctgccatacttagcaaaggaccctatacatgctagatacttattgaagatttgtggactggacttaaataaagaggtagaggcatatcaatcacattggtaggtggtaaagtgttggacagaatatctgacacaatggatgacagaatcaagggtcaaaatgacctttttttttgagacagagtctagctctgtcacctaggctggagtgcagtggcatgatctcggctcacttcaacctccaccacctgagttcaaaccattctcctgcctcagtctcccaagtcgctgggactacaggtgcacgccaccatgcccggctaatttttttgtatttttagtagagacagggtttcaccatgttggccaggctggtctcgaactcctgacctcaaatgatgcgcccgccttggcctccgaaagtgctgggattgcagacgtgagccaccacgcctggcacaaaatgatcttaacagactgaaaagatggtctgaaaccacaatgacatttaaaagcaatacagctgggtgcagtggctcatgcctgtaatctcagcactttgggaggccaaggtgggcagatcgcttgagctcaggagttcaagaccagcctggccgacatggtgaaaccccgtcactaaaaaaaaaaaaaaaaaaaacgctaaaaatttaggcaggcatgggggtttgctcctgtagtcccagctactcaggaggttgaggcatgagaatcacttgaacccaggaggcagaggttgcagtgagccaagattgcaccacagcactccagcctgggcaatggagtgagacttcatttcaaaaaaaaaaaaaaaaaaaaatagagacaaagctaaaatggtgcagctctaagtccaacgatcataattgtttaagttaaagggatttctgcacacagcaattatttgttgagtccccaatatgtaacaaatacacactactcaaataaattaatcctcccaataaccttctgaggtagaggtattagtgtcccttttagagatgaggaaaatgtgatccaaagaggttaggtgacttgaccaagatcctaaggccaatatacgacgttttcgatctctgaattatctccaaagtctgtgctttttcctatcatgccacactgcccctctgcactctcatgaattgcaggaatttattccaagttacaaagaatcattccagttctgcttaaacatttctagtaattaagatagtttaatactatgcaaggcagcaaaaaggttacagacatagacttttgagaacagtcagatccagattaagaacagctgctcagccacttcttagctgcacaacactggacaaatccttatctctaaacaacagtatccttatctataaattgagactaaaaagtacccacatgacaaggatgctgtgagaattaaatgtgagacgctgtctgaaaagtgcttagctcactgtgtgacgtattgcaattgcccaataaaaattaccattcaaattattatagaaagttctttttatcaaaccaaactctacctcccaataatttctgtccactgatctcagttctgatcactgggactttataaaattagatcaaatcctgtatctatttggcacccatgtaatattagaagagggttatattctgagtcgtctcttctgcaaaccaaaactgtaatctgcttcaaatctccttcataaaaaaaggtcggccaggtgtggtggctcatgcctataatgcaatgccagcactttaggaggctgaggtgggcggactgcttgagcccaagagttcaagaccagcctggacaatatggcaaaactccgtctctacaaaaaatacaaaaaaattagaccagcacagtggtgcatgcctgtagtcccagctacttgggaggctggggcgggaggatccttgagctcaggaggcagaggttgcagtgagccgagattgtgctgctgcactccagcctgggtgacagagtgagaccttatctccaaaaaataataataagacaaggtttctggacaatgacttctatcactcaactcaggatgtaccctagtttaaaaatctcttcttaaacatgacacccagaatactctcgcaggtgtacagtaaccattgccaggtgcctgggactactgcttccactttctgaacttgagatcaaaaaagcccccactgaattgctgttgagccagttttcccacaccctatccttatacaactggttatttttcatctaaatgcaggactttacaggtactgcttttaagtgtttttgttttttgttttttcagatagggtctcactctgtcactcaggctggaatgcagtggcatgatcttggctcactgcaacctctgcctcctgggttcaagtgattctcgtgcctcaacctcctgagtagctgggactacaggagcacaccaccatgcctgcctaaattttgtatttttagtagaggcggggtttcaccatgttggccaggctgttcttgaactcctgacttcaggtagatctgcccgccttggccttccaaagtgctgggattataggtgtgagccatcgcgcccggcctttgtctctatttttgaacattagaattacattatctctcatataatacatgctaatataccaattagaacagaagttttgattgctagacttgattttgtttacaatttggtacagatcaggtgtgtatgtttactttttatggtttttctttcattccccttgctgatagcaagtagcagctactgtcagcttggaaaccaaaataaaatcaatagccctcggccgggtgcggtggctcatgcctgtaattccagcactttgggaggctgaggtgggtggatcacttgaggtcaggagttctagactacactggccaacatggtgaaaccctgtctctactaaaaatacaaaaatgagcctggtatggtagtgcacacctgtaatcccagctactcgggaggctgaggcaggagaatcacttgaacccaggaggcagaggttgcagtgagctgagatcatgccactgcaccccagcttgggtgacagattgagactctatctcaaaaaacaaacaaacaaaagacaaaccaataggcctctgaggcagtctgaagggcttcctgttattaaaatacacaggaattaatacatgggatttaactattttggtgacctgtaggccatttttggttttccctgtttcttggctgttcagggagttggaattattaaataagtaagatataactggatgtcacataatttttgccgccctttaaaaaaaaaaaatttaaagagacagagtacgttgcctgggctgaactcaaactcctgggctcaagtgtctgccttggcctcctgagtagctgggactacagatgtattccatcttgccaggctgatttttgctcctgaggattacaatctagtatagaaaacaaacctcatggttgacttaaagtgtaggattttacaagcatagtgttcatttagtagtgtataatggtatcataccttctgtgtggagtgcctgtttcccatgtgccaagtgctacactggttgtacttcatacaggacctttgcaagtcttcaaaaacaatcctatgagggaaatattaacatcatccacatatagataatgctgagctacagagaggttagacaacttgctcatcttccaaaaagatttaaactcaggtctgtcatagtccaaaggccggatggtttttaccacaggggaagaggtggaccatagtcataggaaacaactgtatatagagaggaatgattaattgagctgaacctaaaaggacaggtggggttttggtgtgatgtgttaggttgggttgggaaggtggatgaaggagttctgggctggcaagagagtctgagcaaagtgggtctgaatatcctgcattgaggagatggggtggtggcagagtgatcactctgtgaccaaagagaaggctgcaatttgagagggagtaagaggatgagacaattattattattattattattttgagaaagagtctctctctgtcacccaggctggagtgcagtggtgtgatctctgccactgcagcctccgcttcccaggttcaaatgattctcttgtctcagcctcccaagtagctgggaatacaggtgcgtaccaccacacccagctaatttttttttttttttttttttttgtatttttagtagagatggggtttcaccatgttggccaggctgatctcgaactcccgacctcaagtgatccacctgccttggcctcccagcgtgccgggattacaggggtgagctaccatgcccggcaaggtgggaaaattaggttagggccagatttggaggctcctaaaggatagggaaaggaatttgaagttgatgccataagaacgtgattgtagttttgtttgttgcagtagggagcagggtattaacatgttgacagctgcgctttttgaatgaattggtatgacagtggccaaagatggacaatgcagttaggagattgttgtagtttcctagtgatgagctgatgaaagcctgggctggggtggggatagtggaaggaggagcaaacttgagaggcattttcaaggaagaaatgacaggatttggcaaattgggtgccaggaataaaaagacggggaaatagccatagggttgcttgattgagggagcagaataatggcagaatggggaagggagattaattttgtttgtttgtttgtttcttttggagatggagtctggctctgttgcccaggctggagtgcagtggcaccatctcggctcactccgccccctgggttcaagcgattctcctgcctcagcctcccgtgtagctgagattacaggcccacattaccacgcccagctaatttttgtatttttagtagagatgggtttcatcatgttggccaggctggtttcaaactcctgacctcaagtgatctgcccgcctcggcctcccgaagtgctaggattacaggtgtgagcaaccgtgcccagtgggagattaattttgaattttggccttgtggccttgcaaaaccacaactagtaggagccgtttcactgatgcatactcaatgctccctagcctagcatccgcacaatgccttttctggccatggcggagagcacttcaaaaggaggccctgcggagggtggggtgggtagaggagcatggtagggaatgggaggggcaggtgtcttccaaagtttgcagttctcctaacttgttttgccctaggtccgctgaatgcagtattacagtcatggcaaatgtcaccgtactgatgtgcttaacatagatgtaatgttttctagagggtacgctaaaactcttggagggagtggggggtgggggttataaatctttatgttatttttctgttaatgtcaaggaacagttcatccttctgggtctgtatgtttaaactgagagtgaatattaataggaatttacggtactcatgttggaaattgctaccctcatttagaaaccattaacctttatgttaataaaataatgtttttaaatgagcatatgaaatctgtgttgaacagctgcggtctttccggaacactaacttaaaaaatgctcagcatactttttgaaaatcaaaagcatgtgggtgggatgaagtcacctgagcaattttctataattacaactttcaaggccttttcctttgtctttttccagctaacctaaaatacacatgcacgcatgtgcaccctcacacagacagcagcacaaacctgtgattttcttctttctctctatggactttttggccttgtttttgttaaatagttgcagttccctaggaggatatgtgttgtcttgttccttctctagtttatttgaaaccttatatctttgagaactttggaactccccagaacaggctagatgtccacctagactcccaagctttgaatgccctgtcctaaagtatttctaggtgcgttggatctaaactgattcccctagggtgacagtggaaaccccaaaatgccgacatcctagagaatgaccaggaacatgctcaagttgttacacagttttttgtacgtgctgaggttcctcagtgccatcctggtcagccagtactggaatgtgacagaactggcatttgtgcccaggaacagcctacgctgggaattcgcttctgcattctgataattaagtctgctgtgctgctaatattgttccctgaaggaaggagagctagggaataatatcattcccacttgtaccttttaattaacagaggagtggaatggaaagagttttaaagaagactttgatgagagaagatcggtacctgacatagtctggtaattccatcattgtcgaacacattttaagaataccaccgccagttttttcagtgagctaactgaaaataattctaaactttggcttattttatgtgtagaataaaattattgattttccaagagcattcattaagaagtgccttgctaagaagtgttaagcgtgaagtagtgtaatatgtctgtcctactattttaggggtcactccttcttcatcttcctcttctctttcctctaagtaaccaaagctcttcacctagaatggaatttggggcttacattttccttactatcatatagctgtttcttgttaccgaaagcagagagagctttttcagggaggttaaaattatcgttatcttgttatagtgttattttttccttcttagtaagttaggagcaatgctttgtcttcctgaagctgtctgaaaagatgcttgtatacatgtgtatagcgctttgggtcatagaaattaggtgttatgtcatctgtttcagaagatgcactaatgcatcaaaaacaagtgacagggaaaacaatgcagtgagtaatcttgttgcctcaaaactgagcaaacgttttgggagagcaagttcttgcgggacatcactaaataagaatgagttgatgtcacacttggcaagaagcaactctttaaaattttttttttccatacaaatagtacaacatgactgggaggagggattgtgggcaaagggtaaagaattatggagggaaaatgagcaggagaaggaatgtgagaatgagctgcttgctacaaaaataattaatatgtaatcaaagccatgtttgttttgtcaggaaaaatctgagtcagaacatgagctgatgaaggggagagatgtttaccatgtcctcccccacaccctcagagggccgttgtgtgcagatccctgcggagggttgtgtaaccatcttgactcattttcagggaagaatggcccctgtagctcttttggctcaatataatgctgcatcaaggatgagtgaagaagtctctggaatacagtgctatcaaactcaaaatatggtcattttaatgagaatttccaaacactaggaggcaatactgtgcagaccttgtgccaccacctgcctcccccttcccagatatctgtgcgatattgggaattcaggcagcccaatcgatagctgattttaccttttcctacaaggcagaaaatgtcaagattagccaactatttattgaaattagttggagttatctggctacatgagtgtctgtggtccagtgtatcataataagagtgggagagacggttggggtgctactggcatcttgggtgggccagcctttattgtgtgtcactgccgtgtattggcaatttttgtccctgcccactgaattgccagtggtgccccagtctctgcgatggccaggagaggccttccttcttccagattacctctgtgtgtttcaggggggctaaaacagtatgtgttttacagtattactaagcagcacagttttctttgttgttccttagcataaagatcttggaaagttttaagaagttgtgtgtttatactgtagcataggtttcattcaacctatcactcctattcactcctcagagtgaatttcagggaaaaacaacagtattgggggaaaaagtttggaaaaattggatggagggaaggaaaaaaaaaggtgaattgcaaaagggtttcttacgtagcccactattgttccccaaatcaacactcactctccagctctttgggtggttgctctgcattttcaagaggcagcctggggtggaggtcagggttgcaggtaaggtagaggggaaataagagaggacagggaagaggcaggcatgaataaaagatttggattggaatataaagatggaatacaatggagataatgaaagaccataacaaagaaacaggagattttacatggcattgttaagcttacaatgttggcattttggggacaattctgagtaccacagatctagaacttctaaaagaaaaaccctctgagataattacagcagttaaagaccttcacatacatgttgaattaatagtatttaatgtccctttgtaggtttcaatcttttaagcctgtcctgccaaagactgtgtccttctaggtgcttagccagtaatttaggtgtactgtcaccagttgtttccgtcatgacttctaagtctcagcagccattttcccttaggttttattaactgagtcagtaactcaaagtgtcattgttttccactcatctggactttctgaaaataacacagtgctttattggaaaagctaagcatagacattagccaaatgtttgctaaaaattaaccaaattaaatgttattaaataagatgtgcaaatagaggaaaattttgagaagtatgaacaaatcccactaatctttgttgtcagtcactacttagaaccttggcttcgcaccaaggctgaattaagttgaagaatgttttccgtaatgcttcccctaccttttaagttggtttgaaaacattcagttgcatgtgtaccactggatttttagctttttcactagttgttaccctggcagccttgattcagtgaaaatcttgtttttatcacaggctatttctctgagcagccaatgtttcacgctctctccctgtctaattgtctggccttggtaactcttagcaagagttgaaattacctcggtcaaccacatgacaaaagagtgggcatgggttttcctgaatgtctcctgaggtgaccaagggtggagtggtggtagcataataaaccccatgggaagtggagccatagattccatcagctttgcagaggggccttagacccagcagggtttaagaaactgctgtggataggatgccttgtcctccatagagattatcagctgctacctagaatttctttttcatttgcagtatgtcagcatacagaaaaaaaaaaaaaaatagcaaacacctgtgtattcatcaaatttgtcatattttaatattttgccatgtttgcttcagatctctttccctgcaggaagaaaaatacacgtttcaaataaacaacgccccctccccatcctttatatccttccctgatattccctcctcctcccactccacagggaattattgatctgattttggcattcatcatgcccatgtgttttcttcgtggcttgtctttttcctacatgtttttgtatatctaagcggtgtagaatattctttcacttgttttgactttatataagttgtgttctatatgtatccttcagctacttgtgtaactttcttttttcttttccttataattttgagatttatccatgttgatatatgtctcacttattttcactgctgcgtagtattccatcaaatgaatatttcacagtgtatccattgacttattagtgaatatttgagttgtttccagttgttttactattaaacagttttgcagtggacatctttgtacatgtctccttttgcacatgtatgagagttttctctagggtatgtaactaggaacaaattgctgtctagtagggcacatgtattttcagctttactagatacagtcaatttactcttcaaagtagttatgctcttttatcgccttactagctatatattagagttcctgttgttccacatcctcagtaaaaccggatattgtcccagctgttccttgcttattgattaatttaaagacaacatcgtgcttagcaaccatctcaaacatagggtcagatgcaaacttaattttcttataccatgcttcttccttttaaaagaattgttttgatttctgagttacaaatccaagataactataacatagcttttttgccatatttatttttttaataattttttttctgatcacgaaatgaatatatgattattttaaggaacttggaaaacaaaatgacaaaaaagaaaattaaaaattctacctagacatagccattgttaataacttgctatatttttccttctagtgtagacctatgtaaagtatacatttactttataattaaaatttgtcattttatatcacaattttacttaaaattctattgtggcatttcccatgtcattggatattgtttgaaaacatcatctaaggccaggagcggtggttcacgcctgtaatcccagcactttgggaggccaaggcgggcggatcacgaggtcagaagatcgagaccatcctggttaacatggtgaaaccctgtctctactaaaaaaaaaaaatacaaaaaaattagctgggcttggtggtgggcgcctgtagtcccagctactcaggaggctgaggcaggagaatggcgtgaacccgggaggcggagcttgcagtgagccaagatggcgccactgcacttcagcctgggctacagagcgagactccgtctcaaaaaaaaaaaaaaaaaaagtgtaaacagctggataacatttctttttgtaaatataaatatagtttaatcattctcccattggaggacattttgggtattaaaatgatactggagtacaaaatcttggtgcataaatttcatctgagtttgtttctttgggatagatttctagaagccagtaactattcatggaattagattggatagctgataaaagcagggcatcaagggagaaaaaagagttgagagagcaaaacaacatgcttaaggatcatgagattcgtgaattcagcttctgtcatatttgaattgagtggcaaatttgtctcttacctgaatttggagacccttctctaattagggatgattattagagggaaattctgccctactgtggacaccagagagttggttgtgtgttgtagtgttcaagagttttatccaatattctgcttcctgcagagttcctgaattgagggtcttttgtggaatatctcattgaagtagacttttaaccttgacttgctcaacatctgatcagaagcagctcgttgtcatataaggaaatctgctctgttatggaacatctttgagtagttgagttcccctttttcccataagtccaaatttgattccctgtcaccttcaattgttctttaacttgtttttaaacaaaagtctccctaaaaataattccagaagtatttgaactttatttctctattagcttctactgtaattaacatgaaaacaaacatgttttaaagtctttgtttccttctaaggtataatttagctttatcacgtcttcatagtgaaagttgtatacgtgaacgttggtaggatagaaaaactttccacatagttttatacttggtgcccagaaaacttccaaagtgtttaggtactactcattattatttcttagaaattgaatagaagcagtggcttgagtatacacagtcccactttttcgttaataataaccacatttccctttttttttttgcacaaaagtgttacatgtattttctcgtttaatccttgtacaacctattagggtaggtattttcctcatttggcagatgagggtgctgaggctcagagagatgaaagacctttcctgtcacacagctattaagggcagagctaggatttaaactcagatctaattctaaaacctgtatatttaactagtttgcacatctgtctccctgacttaattgcatcataaaatcaaagatatttctcttcaaaatatgttcatgttggattatttggctgtttcactgttagaggtctgttgcttctgctggcttttctgtggcaatcccagctgctcttccccgtggcttgggcacaccaaggatttcctttctgtgattgccccatatctccctagtccgctgtggggggcaccttcctgcttctgaggaaactgaagcaggagatgaggaaagggtaacaattaattacatacttttttttcccgagtattatcaactaacatgttccataaaggagcatgttttcacagctgtgtgctttagaaacagggagaaaggtttgagtttttatgactgaggtatcttcaacaaaggctgtgatgtacacgcttgatggacttggaacgtggaaacccattccctccctcagccctgggattggaatctttgtgtttatggtcacatgagtattcagatatgttatctctgaatgtgatgccctggtcagagaaccaaggagtggacttgctagattatatgatttaattaccctagatcaatcaagctttgacttactgatggcaggatatattgtgtattttttcctagttgctagaggaaaggaacaaagtttaatccttggctttgttgacctttggtatcacttttatcttgtagttccgtataactgcctttgtagactcttcaaaaggctgaaggcaagtgatttatagataagggctcattcagtacttgcacaagaagagcccatatcttcaaatatgggtgacgtaaatttacttcagaaacagaaatgagctcatttatttggagagatgtgaacagaatgtgcgtcttttgctccgggtgagaaataaatttaaattcagaactttgcttgggggaaatgaaatggaggaactaggcacttgagcctcttggaaattagagatctttagccaaggcccaagggagcactgtcttggtccatttataacaaaatactggagactgggtaatttataaagaacagaaatttatttctcactgttctggaggctgggaagttcaagattaaggtttgttgagtgctgcgtcttctagagtggatgaacactctgccctcaactggcagaaggagaatgggcaaaaaacaggagtaactcccctgctgagcccttttgtaagggcagctaatcccatttacccagagaggagccctcatggcctaaccacctcttaaaagccccacctcctattactgtcattggcaacacctgcattttggaagggacccattcaaaccatagcaagcaccaatagtatgtttcagaactcatccacataggagcactcctcagcatgtccaacagcagtctgtggagaactacttttttgttttggtttggttttttgttttcttttttgtgacacagtctctgttgcccaggctggaatgcagtggcatcatctcagcccactgaaatctctgcctcctgggttcaagtgattctcctgcctcagcctcccaagtagctgggattacaggtgcccgccaccacacctggctaatttttttgtatttttattacagatgggctttcaccatgttggccaggctggtctcaaactcctggcctcaagtgatccacccacctcggcctcctaaagtgctggcattacaggcatgagccaccgcgcccggccagagaactactttgtgtaagtctacgaggcaccatacacactttttcccttaaggaccttactgagtaactgggaagagagagcaggaatgtcaacaataatacagaagaagggttctatggtaaatgccgaaagtgaaccttcaacgaagtgagttccagagagacaacccataaaggtaaagatttagtcataaatgagctgtgttgctactgaaaacatcttgattctaaagtataaccacatctcaaccaagcaaaaactgtcttaagcctgaattaagaggaaaatgatattttaaatgaactcctcaagtaagttgccaaatcattgacactagaattttaagaattggtgactctagagctttcatggtttggctactgtattatctccctcaaggtgcagtaatatttctgtcaccaaaaatcattaattgataacattattctttctgttagttctagcacttatttccatcactgtgatttttttattatgatgattatttttactttacttacttagtataggggattacctgccttttaatgtcatcctgacaattaagacaaaatacagaacatgcttagcacagtgcttggctgagagagtgccatcattaatattaggcattatttttcttattcttgaaatacagtgttttatatagtgcctggcatgtagttaaattttagtaaattataataatgttgtttattgttttccaaaggatttttaacatgtattatcaattaatactctgagctacattcaaggtatatagtgctattcctcttttactaatacagaaactgaagttaagtacattggtcagatttttctggctgatttaagcagataaagaaattattaaaaggaatgtggatagctcacagaatcagcagaagagctctagaatcgtgttttgggctacctagccaagtaaaatggccaagatcatgccacagaactgagccactgccaagtacctgccgtgccttgcacggcaaacaatgctggctggcattggtgaccggactttgccacagggattgcttctactgctcccttggaaactgttttacagaaactgctgtcaccaaggaatgtacttcatggaaggccctattttgcaacatttgccccctatttacagtctggagtgggtggcaatttgctttattgccaactcattgtgtcttaactctctgtgaaagaaatacttcgtttatattttcttttaattggatataaactgagtagaagttgagattattttccttattagtagacttcgtgtgtggaaaagttagttttttctgaaattgatcttgttcttagcaattatctgctataagtattgcctcaactttttaggctactactaaatgagaactttccatctgatcagggcgtcttctccagtgtaaacaatcctgtttcccattacccattggagctaaggaacccatgatgagttaacacgtgcaagaagggttacccctttgagcaagaaaagtcctggcattagtatttcagatttttttcttgcatccttttctgatattttatttattttcatttaaagtggacctatggtttatcttgctgaaaatctcaaaaaaccaaaaaacaaacaaacaaaaaaaaaacgtgtcaggtccctaatgtgattgctgttaaccatataaaaataacctcccctcttttataatcagtcttggtgcgccttgcaaagcctacatttctaacctgtgtatacttcaaactactgtgagcatgtgttaaacacctttttttttttaaataaaaagaacactttcagctccttaaagcaagctcttttgggaaggaaagaatccctgagtgctgcagccatccatcctgctttgtctggaaagctaaggtttttgggttattgatgtttcaacaagtggagagcacctaggtctggtgagcaccagctgctgaagtgtggggggcacccaagtggcctgttcttccaggatggcattcattcttccaggcaagtgggacaaagtgggctttctgccttcactcagtgagagctgttgaaagattttctcatctgaattgtgaatgtttgtaatgtttattttcacagtaagagtgagggccttctcactttgaatatattcctttttgcaaataattttgaagtagtcctgatcctgtgttaaaagaaacatggtatgtcattatagaagaatccttcatcccccttcccttacaaacataaaattttcagagtttacatttggaagaaaacctggttcaattctctccattttcagggaaggaaatggaatttattctttcctttgtttatccttttatagttttcattttgttccctgttggtcacatttttttttttggccttcttattagaggggtattgtggaatatttttgcttagcaaaaattaaaatcaacatacctgactttgtaattgtaaaatatgtataacatacaatttatcattttaatcctttttgagtgtacaattcagtggcattaagtatattcacattgttgtgcagtatcatgaccttccatctccggaacttctccgttatcccaaattgaagtctattaaatagtaatttcccaatctctaccctcagccctgacaaacattattattctacttattttcgccatgaattttactattctttttgtttttttttttttttgagacagggcctcacgctgtcacccaggctagagtgcagtggcacgatcttggctcactgcgacctccctctaccttacaggctcaagtgatcctcccgcctcagcctcctgagtagctgggacctcaggtgcacaccaccacgcctggctaatttttgtatattttgtagagacggggtttcaccatgttgcccaggctggtctcaaactcctaggctcaagggatccttccacctcggcctcccaaatgctggggttacaggtgtgagccaccgcgcctggccaaatattactattctgtatgtttcttgtaaattgaatcatacagtttttgtccttttgtgtctggcatacttcagtttaccacaattttttcaggttccatctgtattctagcatgtaccagaatttcattctcttttttaaggctgaattctattatgtgtatataccacattttgtttatcctttcatccattgatggacatttgggttgtttctactttggccattgtgaataatgctgctgtgaacattgatacataaatatctgtatgagtccctgctttcagttcttttgggtgcatacccagaggtggaattgctgggtcatgtggtaattctatgtttattttttttcctcccttgtaattacccacaatgtggtaaaatacacttgacatgaaatttaccactgtaactatttttaagtataagttcagtggtattaagtacattgagattgttgtgtgaccatcaccactgtccatttcctgaatgtttttcatcttgcaaacctgaaactctatatccgttaaacagcaacttcctatcctctcttcctcccagccctggtaaccactgttctactttctttctctatgattttgacttttctgtgtacttcatataaatggaatcattcagtgtttgcttgtgactggcttacttcacttagtgtaatgtcctcaagattcacccatgttgttgcataggtcagaattttcttttaaaggctgaataccacatgtgtatatatatagaaaaatattattcagtcttaaaagggaattcctttttaaggaatgcctcattttgcttatccattcttctattgatggaaatttgaattgtttccatgttttggctattgtaaatcatgttctttgaaaatgagtgtacaaatgtctctttgagaccctgcttttgattcttttgggtatatactcagaagtggaattgctggatcatatagtaattttacatttaattttttgaggaaccaccacacccctttcgccagcggctatgctataccatgttacgtctccaccaatagtgagtaagggttctacatctttgccatcatttttttttgtttgtttttgatactagccatcttaatgggtgtgagggggcatctcattttagttttgaattgcccttccctaatgattagggatgtcaggaattctttttatctatttatttattttttattttattattattatactttaagttttagggtacatgtgcacaacgtgcaggtttgttacatatgtatacatgtgccatgttggtgtgctgtacccattaactcgtcatttagcattaggtatatctccaaatgctatccctccctcctccccccaccccacaacagtccccggtgtgtgatgtttcccttcctgtgtccatgaacacatggacacttattgttcaattcccacctgtgagtgagaacatatggtgtttggttttttgtccttgcaatagtttgctgagaatgatggtttccagcttcatccatgtccctacaaaggacatgaactcatcattttttatggctgcatagtattccatggtatatatgtgccacattttcttaatccagtctatcattgttggacatttgggttggttccaagtctttgctattgtgaatagtgctgcaataaacatacgtgttcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaccctctccagcacctgttgtttcctgactttttaatgattgccattctaactggtgtgagatggtatctcattgtggttttgattttcatttctctgatggccagtgatgatgagcattttttcatgtgttttttggctgcataaatgtcttcttttgagaagtgtctgttcatatccttcacccactttttgatggggttgtttttttcttgtaaatttgtttgagttcattgtagattctggatattagccctttgtcagatgagtaggttgcaaacattttctcccattctgtaggttgcctgttcactctgatggtagtttcttttgctgtgcagaagctcttgagtttaattagatcccatttgtcaattttggcttttgttgccattgcttttggtgtttttgacatgaagtccttgcccatgcctatgtcctgaatggtattgcctaggttttcttctagggtttttatggttttaggtctaacattgaagtctttaatccatcttgaattagtttttgtataaggtgtaaggaagggatccagtttcagctttctacatatggctagctagttttcccagcaccatttattaaatagggaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagtatagtttgaagtcaggtagtatgatgcctccagctttgttcttttggcttaggattgacttggcaacacgggctcttttttggttccatatgaactttcaagtagttttttccaattctgtgaagaaagtcattggtagcttgatggggatggcattgaatctataaattaccttgggcagtatggccattttcatgatactgattcttcctacccatgagcatggaatgttcttccatttgtttgtgtgttcttttattttattgagcagtggtttgtacttctccttgaagaggtccttcacatccctttaagttggatccctaggtattttattctctttgaaggaattgtgaatgggagttcattcatgatttagctctgtttgtctgttattggtgtataggaatgcttatgatttttgcacatggattttgtaccctgagactttgctgaagttgcttatcagcttaaggaggttttgggctgagaccatggggttttctagatatacaatcatgtcatctgcaaacagggacaatttgacttcctcttttcctaactgaatgcccttgatttccttctcctgcctgattgccctggccggaacttccaacactatgttgaataggagtggtgagagagggcatccctgtcttgtgcccgttttcaaagggaatgcttccagtttttgtccattccgtatcacattggttctttcatgtgcttattggccatttgtatctcttatttggagaaatgtcggttcaagtcctttgcccatttatgaattgggttgtttgaggttttttgttgggttttaggaattctctatatattctggatataatatacatgtatataataaatgtatataataaaatatacatgatttgaaagtattttctgcattttgtgggctgcctttttactctgttgatagtatcttttcatgcataaagttttaaaattttcattgtccaatctatctttttttgttgttgccagtgcctttggtgtcatacttaaaacattgttgcccaattcagtgtcatgaaacttttgcctgcgttttctcactataggaaactatagtaaaaaacattaaacgttttattgttttagatcttacatttaggtcatggattcattgttaattaacttttgtatatggtagtaggtaagggtccaacctcattcttttgcatgtggatagccagctttcctagcagcatttgttgaaaaaactgtcctttcccaactgaatggtcttggtgcccccaacaatcatatgactttatatgtgagggtttgttctgggccctctgctcatttctgtggtccatttgtctgtctttatgtcaatgctgcactgttttgattactgtaattttaagttttgaaatcaggaagagtgagtcctccagctttgttcttcttttcaggattgttttggctattcaggatctcttgagattccatatgaatttttggatggatctttctatttctgaaaaaaagtcactgggattttgatagggattgcattgaacctgtaaatcacttttggtaatattgacatcttaatattaaatcttccaatcaatgactatggggtgtcttaacatttgtatgtgtcctctttaattcctttcagctgtattttatggttttttttattgtacaagtctttcatctccttggttaagtttattcctaagtgttttattctttttgatgctattggaaatggaattgttttcttaatttcctttttggattgttcattagtgaatagaaatgcaactgatttttgcatgttgactttgtatcctgccactttggtgaatttatttatttattagttctgatagtatttttgtggaacattcaggttttctatatatgagatcatatcatccgtgaacagacataatttaacttctttctttctaatttcgatgccttttatttcttctcttgtcttattgctcttgacagaacttccattattatgttgaatagaagtggtgaaaacaggcatccttgctttattcctgatcttagagggaaagctttcaggtcatcaccattgaatatgaagtttgcttgcatttcttttatatggcttttattatgttgaggtagtctccttccattccttgtttgttgagtgttttatttgtttgtttttatcaagaaagggtgttgaattttctcaaatgctttctctgcatcagttgaaatgattttgtggttttctttttttttttttttttttttttttattgataattcttgggtgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattggggattggtgatgactctttttttttttttttttttattgatcattcttgggtgtttctcgcagagggggatttggcagggtcataggacaatagtggagggaaggtctggttttcctaggcagaggaccctgcggccttccgcagtgtttgtgtccctgggtacttaagattagggagtggtgatgactcttaaggagcatgctgccttcaagcatctgtttaacaaagcacatcttgcaccgcccttaatccatttaaccctgagtggacacagcacatgtttcagagagcacagggttggggataaggtcacagatcaacaggatcccaaggcagaagaatttttcttagtacagaacaaaatgaaaagtctcccatgtctacctccatccacacagacccggcaaccatctgatttctcagttttttccccacccttcctgcctttctattccacaaaaccgccattgtcatcatggcccatccccaatgagccgctgggcacacctcccagacgggtcgtggccgggcagaggggctcctcacttcccagtaggggcggccgggcagaagcgcccctcacctcccggatggggcggctggccgggcggggggctgacccccccaccatcctcccggacggggcggctggccaggcagaggggctcctcacttcccagtaggggcggccgggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggccgggcagaggggtcctcacttcccagtaggggcggccgggcagaggcccccctcacctcctggacggggcggctggccaggcggggggctgatccccccacatccctcccggacggggcggctggccgggcggggggctgaccccccccacctccctcctggacggggcggctggccgggcggggggctgacccccccacctccctcccggatggggcggctggccaggcggggggctgacccccccacctccctcccggacggggcggctggccgggcagaggggctcctcacttcccagtaggggcggccaggcagaggcgcccctcacctcccggacggggcggctggccaggcggggggctggcccccccacctccctcccggacggggtggctggtcaggcggggggctgacccccccacctccctcccggactgggcggctggccgggcggggggctgacccccccacctccctcccggacggggcggctggctgggcagaggggctcctcacttcccagtaggggcggccgggcagaggagcccctcacctcccagactgggcggctggccgggcggggggctgacccccccacctccctcctggacggggcgactggctgggcagaggggctcctcacttcccagtaggggcggccgggcagaggagcccctcacctcccggacggggcggctggccgggcggggggctgaccccccccacctccctcccggatggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgtggccagcagaggcgctcctcacatcccagacagggcggcggggcagaggtgctccccacatctcagacgatgggcggccgggcagagacgctcctcacttcctagatgggatgggggtggggaagaggcgctcctcgcttcctagatgggatggcggccgggcggagacgctcctcactttccagactgggcagccaggcagagaggctcctcatatcccagacgatggggggccaggcagagacgctcctcacttcccagacggggtggcggctgggcagaggctgcaatctcggcactttgggggtccaaggcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcggcgtgcgcctgcaatcgcaggcactcggcaggctgaggcaggagaatcaggcagggaggttgcagtgagccgagatggcagcagtactgtccagctttggctcggcatcagagggagaccgtggaaggagaccgtggagagagggggagggggagggggaggggcgattttgtggttttcttccctttagtcttctaatataggctgttacgtggattgattttcgtgtgttgaatcatccttgtgttccaggaataaatctcacttggtcatggtgtataatccttttatatgctcctgaatttggtttactaggattttgtttgggatttttgcatcaatgtttgtaaggtaaattggtctacagttttcttttcttgtagtgtttttgtcttgctttggaatcagggtaatgctgccctcatagatgagttagggagtgttttctctgcttcaattttttgggaaagtctaaaaagggtttatgttagttcttttaaatggttggtggaactcacctgtgaaactatcagttccagggcttttctttatcaggagatttttttattatgtattcaatctccttactaattataggtctattcagagtttctatgtggcttagccttggtaggttctagttctgtgtttctaggaatttgtccatttcacctaggttatctaatttattgctgtacaattactcatagtaccttgtaaagtcatttttattcccatagaatcggtattaatgtacacactttctcgttttagtatttgagttgtctctcttttttcttagttcctctactctagcaaaaggtttgtcaattttgtttatctttttaaagaatcaacttttggtgctggtgattttctctatttttttttctattctctattttatttatctttggtctaatctttcttatttctatccttctgctaactttgggtttagtttgtttttctagttccttaagttgtaaagttagattgctggtgtgagatctttctttttattttttattttattttattttttagagatgggtatcactctgttgccaaggctagagtgcagtggtgcaatcatagctcattgtagcctcgaactcctggactcaagtgattcttctacctcagcctcccagtaactgagactacagacacacaccattatgcctggctaatttttaatttttatttatttacttatttttttaaagagacagagtctcactaggttgcccaagctcttctcgaactcctgggctcaagcgatccttccacctccgcctactgagtagatgggattatagatttgagtcaccgcacccaactcttgttttttaatgtaaacttttttttttttttttttttgagatggagtcttgctttgttgcccaggctggagtgcagtggcacagtctcagctcactgcagcctctgcctctcgggttcaagcaattctcctgcctcagcctccagagcagctgggattacaggcaggcgccaccatgcctggctactttttgtattttttttttttttagtagaggtggtgtttcaccatgttggccaggctggtcttgaacacttgacctcaagtgatccacccgccttggcctcccaaagtgctgggattacaggtgtgagtcatcctgcccagcctaatgtaaacattgataaatttcccccttagcattgctttcactgcatttcataagttttggtatattgtgtttttgttttaattcacctttaggtttttttcagtgtcctttgtgttttcttcattgatctgttggttgttttagtatgttctttaccgtccacaaattgtggattttccagtttttcttctgttgtagatttctaacttcattctattgtggtggaagaagattctttgtataatatctatcttttgaaatcttttgagacttaatctgtgacctaacatatggcctatcctgaaaaatgtcccatgtacacttgagaagaatgtgtattctgttgttaggtacattattctgtctgtctgtgaagttgagtcagtttgttgtgtgttcaagtcctctactttattacttatcttctgtttggtggttctagtcattattgtgagtgggatattgagacttccagctattattgaagtatttttcccttcaattttgtcagtgtttgcttgacaaattttgatggtctctcattaggtgtataaatgtttataatttttaaatctttttttgagacagggtctaactctgtcacccaggctgcagtgcagtagcgagatcttggctcactgcaacctctgcctcctcattgatcctccatctcagcctcctgagtaggtaggactagtaccatcatacccagttaatttttatatttttagtagagatggggtttcaccatgttggctgggctggtctcgaactcctgagctcaagcagtccacctgccttagcctctcacagtgctgggagtacaggcatgagccaccacacttgatttgaatatttataattctttttttttatcttcttgctatatcaaaccatttatttatttatttatttatttatttatttatttatttatttatttatttttgagacggagcctcactctgtcgcccaggctggagtgcagtgacgcaatctcagctcactgcaaggtctgcctcccaggttcacaccattttcctgcctcagcttcctgagtagctgggactataggtgcctgccgccatgcctggctaattttttttttgtttttttttttgtttttttagtggagatggggtttcactgtgttgccaggatggtctcaatctcctgacctcgtgatctgcccaccttggcctcccaaagtgctgagattacaggcgtgagccaccacacccggcctgaaccttttattaatatatgatgtcctttgtctcttgtaaccgctttcagtttaaggtctattttggtcagctacagtaactcactcctataatcccagcactttgagaggctgagacaggaggatcacttgaggcagaagtttgagactagcctgggcaacatagttagacccccatctctacaaaaaaatttaaaaattagccaggtgtgatagcgcatgtctgtagtcccagctacttgggagtctaaggcaggaggattgtttgagcccaggaattcgaagatacagtgagctatcatcatgccattgcactacagcctgggtaacagcgtgagactctctttcagtatagctcttttggttactatttggatgaatatctttttcatccattttcagcctgtttgtgtatttagatgtaaattgagtctctagtagacaagcatatagttggatcaggtttttaatccattctgtcaatccctgtcttttgattggagagtttaatccatatacatttaaagtacttaactgatacagtggcacttacttctgtcattttgctattagttttctagatgccttatagcttttttttgtttgtcattttctgtattgctgtcgtcttctgtgttgattttttgcagtgaaacatttatattcctttctcattcccttttgtgtatgttatatagctgttttctttttttaaaattattatactttaagttctagggtacatgtgcacaaagtgtaggtttgataaataggtatatatgtgccatgttggtttgctgcacccaccaactcgtcatttacattagatatttctcctaatgctatccctccgccagctcctcactccctgacaggccccggtgtatgatgttccccgccctgtgtccaagtgatctcattgttcagttcctacctatgagtgagaacatgcagtgtttggttttctgtccttgtgatagtttgctgagaatgatggtttccagcttcatccatgtccctgcaaaggacatgaactcatccttttttatggctgcatagtattccatggtgtatatgtgccacattttcttaatccagtctatcattgatggacatttgggttggttccaagtctttgctgttgtgaatagtgccataataaacatatgtgtgcatgtgtctttatagcagcatgatttataatcctttgggtatatacccagtaatgggatggctgggtcaaatgttatttctagttctagatccttgaggaattgccacattgtcttccacaatggttggactaaattacactcccaccaacggtgtaaaagtgttcctgtttctccgcatcctctccagcacatgttgtttcatgactttttaatgattgccattctaattggcatgagatggtatctcattgtggttttgattcgcatttctctgatgaccagtgatgatgagcattttttcatgtgttttttggcagcttagatgtcttcttttgaggagtgtctgttcatatcttttgcccacttgttgatggggttgtttgtttttttcttgtaaatttgtttgaattctttgtagattttggacattagctctttgtctgatggatagattgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccattttgaattaatttttgtataaggtgtaaggaagggatccagtttcagctttctacatatggctagccagttttcccagcactatttattaaatagggaatcctttccccatttcttgtttttatcaggtttgtcaaaaatcagatggttgtagatgtgtggtgttatttctgagggctctgttctgttccattggtctatatctctgttttggtaccagtaccatgctgttttggttactgtagccttgtagtatagttgaagtcaggtagtatgatgcctccagctttgttctttttgcttaggattgtcttggcaatgcgggctcttttttggttccatatgaactttcaagtagttttttccaattctgtgaagaaagtcattggtagcttaatggggatggcattgaatctataaattactttgggcagtatggccattttcatgatattgattctttgtatccgtgagcatggaatattcttccatttgtttgtgtcctcttttatctcgttatttcatcgagcagtggtttatagctctccttgaagaggtacttcacatcccttgtaagttggatccctaggtattttattctctttgaagcaattgtgaatgggagttcactcataatttggctgtttgtctgttattggtgtataggaatgattgtgatttttgcacactgattttgtatcctgagactttgctgaagttgcttatcagcttaaggagatttggggctgagatgatggagttttctaaatatacaatcatgtcatctgcaaacagggacaatttgacttcctcatttcctaattgaatatcctttatttctttttcttgcctgattgccctggccagaacttccaacactgtgttgaataggagtggtgagagggagcattcttgtcttgtgccgattttcaaagggaatgcttccagtttttgcccattcggtatgatactggctgtgggtttgtcattaatagctcttattattttgagatacgttccatcaatacccagtttattgagagtttttagcatgaagcgctgttgaattttgttgaaggccttttctgcatctattgagataatcatgtgttttttgtggtcggttctgtttatgtgatggattacgtttattgatttgtgtatgttgaaccagccttgcatcccagggatgaagccgacttgatcgtggtaggtaagctttttgatgtgctcctggattcggtttgccagtattttattgaggattttcgcatcgatgttcatcagggatattggtctaaaattctcttctttttgttatgtctctgccaggctttggtatcaggatgctgctggcctcataaaatgagttagggaggattccctctttttctattgattggaatagtttcagaaggaatggtaccagctcctctttgtacctctggtagaatttggctgtgaatccttctggttctggactttttttggttggtaggctattaattattgcctcaatttcagagcctattattggtgtattaagagattcatcttcttcctggtttagtcttgggagggggtatgtgtccaggaatttatccatttcttctagattttctagtttatttgtgtagaagtgtttatagtgttctctgatgatagtttgtatttctgtgggatcggtgatgatattccctttatcatttgttattgtgtctatttgattcttctctcttttcttctttgttagtcttgctagtggtttatcaattttgttgatcttttcaaaaaaccagctcctggactcattgattttttttaagggtttttatgtctctgtctctttcagttctgctctgatcttagttatttcttgccttctgctagcttttgaatttgtttgttcttgcttcttttaattgtgatattagggtgtcgattttagatctttcctgctttctcttgtgggcatttagtgcttatgctgttttctttgcacttatcatgaggattatatttaagatcctaacgtggtaacacaataatttgaatttataccagcttagctttcttttcttttatttttttttttaagtgaaaacaagtttattaagaaagtgaaggaggccggatgcggtggctcacgcatgtaactccagcactttggaaggcccaggcaggcagatcacctgaggtcaggcgttcaagaccagcctgaccaacatggtgaaaccccatctctactaaaaattcaaaaattagccaggcgtggtggcacatgcctgtagtctcagctacttggaagaatcgtttgaacccaggaggcagaggttgcagtgagccgagatcgtggcactgcactccagcctgggtaacagagtgagtcttcatctcaaaagaaaaaaaaaaagtaaaagaataaggaatgacctccagaggcagagcagtgacagcttaactttcataacatagaaaaactctgctcctttccagcttagtttccatccctttcagttgttaatgtcacaagataatatctttatacagggtgtgtccaaaatataaactaatacttttttaatgcagtaatctctcaaattatgtaaaaaaacaaaatatggagttataaactaaagttacaataacattagcttttagactaattttttttaatgtatcagtctcttaacgcagaaagccaaaagtggagctacaaaccatggttacaaaagagttacgaaccatggttacaaaaacccctgtaaatacatgggcttttttttttttattttttatttatttttttattttttgagatggagtctcactctgtcacctaggctggagtgcagtggcgtgatctcgactcactgcaagctccgcctcccggcttcacgccattctcctgcctcagcctcccaagtagctgggactaaaggcgcccgccaccacgcctggctaatttttttgtatttttagtagagacggggtcccaccgtgttagccaggatggtctcaatctcctgacctcgtgatccaccctccttggcatcccaaagtgctgggattacaggcatgaacagtacatgggcttttataatttgccatatatttacctttactgagatctttatttcttcactcaactctctagtgtgctttcatttcaacctgcaggaccccctttagcatttcttgcagggcaggtctagtattaagaaactccctcagcttttttttttttttttttttttttttttcctgactgatacgcttaatttctccctcatttttgaaggatagttttactggatataaaattcttggttgacaggttttttgttttttgtttttttttcttttagcagtttaccaccttatggccccctaggtttctgatgagaaatctgttgataatcttattaaggttcccttttatgtgataaggtgtttttcttttgctgctttcaaatttctcgttgtctttttgtttgttttttgagacagagtctcagtctgtcacccaggctagagtgcagtagtgcaatctcagctcactgcaacctctgcatcccaggctcagatgatcctcctgccttagcctcccaagtagctgggactacaggcatctgccaccacgcctggctaatttttatatttttttgtagagatggggttttgccatgttgcccaggctggtgtcaaactcctgacctcaagtgatctgcccaccttggcctcccaaagtgctgggattacaggcgtgagccagtgtgcctggccctttctaaaggttgattataatgtgtcctggtgtgggtctctgaatcctgttttgagtttgttgagcttcttggatgtttgtattcatctctttcatcaaatttgggatgtttttggccattgtttcttcagatgttttctctccctttctctttctgttttccttttgggactcccacaatgcatacggttatccacttgatggtgtctcatcaatcccttagatcagttcacttttccttaatcttttttctttctgttcctcagactagatagtattcattgtactcattattcactcattctttcttctgcctgctcaaatctgcctttgaatccctgcattgaatttttcgtatcagttatttcagttccagaacttatttttcatttctttttaggttttctgtctctttattgatattttccatttgtttatacattgttttcttggctttctccatgtctcctttagctctttgagcatctttaagacagttgttttaaagtctttgtctagtggatttgccattgtcttttttcagggacagtatctgttggtttatatttttcctttgaatgagccatacttttctgtttctttgtatgactggtgatttttttttttttgaaaattggacatttaaatccagtaatatggtaactgtggaaacagattctcccccttctctgggtttactgttttttgggtttatttttggtattttgattgttacaggatgtgtctgtgccaagaatcagccagaggtatacatgttaggtctcctcagatcttttctgagcctgtgctcttccctgggcatgcatagcaactttctaatttcccctatatatgtggttgcttttgaatatcctggtctttaatgtccgggtcccagagagggaaaaagaaaaaagtgaaggagggtgaaaaaaatgctgccccctttaatcctctgaaagtcacttcagcgtgagtgggaagaccttgcagcagtgtggtggaggtgcaacaacagtgattaccgtctgtgtctctgtctgcacctttgtgatcagaagcagccaacattgatcagagcatagattcatatttagaggacagggtccttttctcccctgctgtctcccacaaactgtgtgcaagccactccaggaataagtgcgtagctgcctgcagtggggatgggagctttgagatggctggtgctattatgatgacagctgaaatagactgaaagtaattataattcatcatccaggccttcctctggatgttgcaagccttcaatagactctagagctacaaaatagttacatcagacagagtgcaccagtgcaattatttagttgggaagataaattcctggtgcttcctaccacagtcttccccaaattccctttttagttactttttttaggaacccccatactgttttccccagcaggtgcaccattttacattgtcaccagcaatgcacaagggttccaaggatatggagaacatccttgccaacacttgttattttccattgtttggataatagccatcctaatgattaagtggtatctcattgtgttttgtatttccctcatgattagtgatgtcgagcatccttcatatgcttattggctgtttgtatatctcctttggagaaatgcctatttaaatcctttgcccaattgtgtggtttgttgttttatctttttaaatttagctccttttcatatttgccttccttataaataactcctgcttcttctggtaatctgcttgaggaatgagatcatttctttgctatttcctacagtgctagtacatagtagtgtgtgcctggtaaacacttatagtggtaggataggccagtcatacagccagcttttgaaagcctgcttaattgactactacagttggtgactggggactttgagacagtgaggaaattaacacgaattgtgtgcctcctctttgctaggtgctgtggtaggcataactttatatagttcccataatactcctttaatatgtcacacttacagatgaaggatttgaattaagggaagttaaatttagactccctcaacatcacacaggttttaaatggcaatccttggattccaattccgggtctacctgactccaaactttttcattataccatgtggtctcccttccctagtctggtaagttcaaacagagagcaagcctgcgaacctggaaattgtttagggcagatgagcagttgaacatttacttaataggagacagagaatcgtgctatattgccgaggctggctttgaacttctaggcttaagcagtcctctcacctctgcataccaagtagttggtaactacagcctattccattttacttaattattcaagaggaaaaggtagagattgtgaaatgctaattttatagcagtgaacaggattcctcgaagacactgaggtgtgtcgtttgtggatactgatgacctttggaaatactgtgtctacttttgggtgtgacatcctctgttcttgtttctttggtaccataaattagggccactggccatggccaaatgggtgcctaacacagaaggatgaagtgcttttcattgcttaccacaaattcccttgaaccctttacttctctgagacttaagaaatgcaagaataaagggaacagagttttatcaaaatcctattgtgtgctaggcaaaccctagaagggacatgattattatcttgcttttacatatgagaaaattgaggctcaaagatgtaagataaattgtccagattcacacagctaataaataagggagctgaattcagctttttccatgctgcctccattaaaaagttcctctgtcttgccctctggtgggtttcggaggtcctgggagaaatgtttgtatcctcaccaaacattgtggtgggtggcatcttacatggggcttgttctgcacttgcagtttcttctgccacatggtttaaccagagcaatgatgactgccgttgccccctcgaggttagcactcctctgaggtcacagggtggggataaatgttctgaaggaatcagccttagaaagcacactttttctaagtatcccgaaggaatcaatcactaacgcacatcacaaaattctctccaagttgggaagatggttttagactttctctttcttttctttttttttttttttttttttttttgaggtgggagtctcgcactctcgtccaggctggagtttggtggcacaatctcggctcactgcaagctccaccttccaggttcacgcctttcttctgcctcagcctcccaagtagctgggactacaggcacccgccaccacgcccagctaattttttgtatttttactagagatggggtttcaccgtgttagccaggatggtctcgatatcctgaccttgtgatgggcccgcctcggcctcccaaagtgctgggattacaggcgtgagccaccgcgcccggccagactttccctttctttaagaagagaagggagtgcctttgagaactagagtttaagtaaaggatacatatagcttaagtgcttttatctttgaaatatactatgaccaatagactcgaaaatttcttattgtttttgggggtatcatagtcaatttgggctcctataacagaataccataaaccgggtggcttaaacagcaagcatttatctctgatagttctggtggctgggaaatccaaggtcaaggtgccggcagatttgcctctgccgaggacctgctccctggtttgcagatggctatcttcttgctgtggcctcacatggctgggaacagaaagagtgaggggaggctctcacatctcttcttctagtgacactagtcccattcatgaagcctctatactcatgatctactcacccactaaggtccccacctcctaataccattacactggggattaggatttcaacataggaaatttggggaaacacaaacattcagtccatacgggggaattttcttttttcagaatctgttgtttaattataccttcacagtaacttttgtcaaagttatatttaatttctacttcctggattctgtagcagtaaatggagctcgttatgtgtcccaatatttgtaatactgatttctagtcctagaagtatctaagcctctcagagttaaggaattcggtttggtaataggctaagctaatagccatatggctctgcactgtgctatagagaaactgtgggtttccccccacctgacatctcagaatgaaaaagatcactctgcagaatatttcccacacttctaaccctgatgatttttccactcaacattttacacaaagaggtaggtacagatggtagtttgctggatctctggaatattcagtcttggtcttcactcactccctggagcctactcctcatttttgtataagcaaagtggtttaaacagggtcttaggaaatatctccagtatttaccatttgcaaacctaacccttaatatatggaatctgttagatcaggtttttaactcagtaaacatctttgggtgcatccccgtattaaactaaagaagaagtagaaaactgaaggcaatggccctgttgcttaactgtaaggaacatgtaatttagaaacttcttctctttaacatggaaaactaaccataagtatgtggatcaacgttcttctttatggagtattaggagtgaagtgtcatgatgttatggtgtttttaacggctcagcaaaagaaaaaaaattatatagtgagatgaagtagatatgacaaaatattagttgttgaatctaggtggtgggtatttgggtatacatttttcccctacttttctacatttaaaaattttcataataaagggtaaagcagaaaaatcctaagtgtaaaaaacatttataaaactatacaaaaaataatttcaaggttcattctctattaatggtattggagttggtaggaaataattaaaataggagtataaatccagaagcccgcagaggccaggcaggtaatgtgggtgagtggagctgccgggcattggacaggagggagatggtggggactgagcaaacaggcaagtgcacaactcattgaaagcattccaaaaatttaaaaaatcttaatgctcattcagaatgaaacacttcagaggactggaagtttgtggtctcctaaaaatgacaaaatttaccgtctctaaatttgcccagctttctgtccttctccctcttttcagaagatccaggagaggcgtagctatcaatacgagagggagatggtttcctggcacaagagggtgatgggaaaacattgtgttcaatgcctctagaatttgcctgggttgccacaactttgttgcttcaggaatggaaaatgtggcccatcttcttattttctctgtcctgtcttgctcctgctatgacccggggcaggatttgcggtgggtttatggagattcctatgagtcaaggaagcacattctgaggatagagtcatgcacctgggttttgtttttagatggttagagggaggctgcaattgtgatttataagaatgacttaaagtgtaattcctttgattttgaagttggctaggcaacttaatttgaacatcctagtgtgcctattagacctggcaaccttctcaaaatccccctcctacttccctcgtttccctcaccctccacctttttctcaagaggtagaagtgagagttttgttttgtgagctaaggttgggttctgggccctctgcttcagccacctggcagcttgggctggccctgtagccttcctccacttcattctgcgattcaggctcccaatagtcttctgaagcaccggagagcttcctcatgcaccttagaagagcagattcagactgagacaaggactcgctcttaggcatatatgcagcctacagagatcctgggaagcctttttcctcctaatatcttcctagacttatgctttccttggaattccagcaatagaactgcatactcgtaccctaatcaagaaccttttatgtactaggtgctctactagacatgagataaaaagataagcaaaacgtggtccctgtcttcaaccagctcaccatttgttataccactttaatcaccttagagaaaatttttttttttttttttgagacagagtcttgctctgtcacccaggctggagtgcagtggcaagatctcggctcactgcaagctctgcctcctgggttcacgccattctcctgcctcagcctcccgagtagctgggactacaggcgcctgccaccacgcctggctaatttttttatatttttagtagagacggggtttcaccatgttagccagggtggtctcgatctcctgacctcgtgattcgcctgccttggcctcccaaagtgctgggattacaggcgtgagccactgtgcctggccgataaaatgttttaagatgtgttcggccatatgaactttggtgagaattaaagatgaggtttttacttatggagtagggggcacttgggatgggtgaagaagggagaactgccctgaagttcttactcatagatgaggaaaaacctcagctttttgttaaaatgagtttatttatttaaaaaatatttaagggggaaatgcattcatttggttaaaaaaagttctgttaaaagtatactatgaaattccccctctttaccccttgcctccatctaattcttatatatcatttcagagtttatttatgtaaatataagtaaatctgaacatatactcttgtttacttgcaccccaacccccatttttatgcaatgatagcacactctatgcatctatataccttttaaaaattttatcttatggaggtttttttccatgtaagtacatagagagcgccctcattcttttctttgttcatgtaatactatttatagatataccctgatttaattaacaggccctctattcagggacattgtggtgtttgctgacctttgctgttacagtcactgctgcaatgaatactcttgtatatacatcatttagcttgtgtgctactgtgtgtgtaaattcctagtggtgaagctgttgcatcagaggctatgcatttgtaattttgttatccatgccaaattgccctcctccatagggtgttaacaacttacacactaagcagcaaaacctctttcctcacagctccacctacaaagtatttttcatgcttttcgtttttaccaatttgacaggtgaaaaatgggcttgtggtaaagtttcaatttgtttttcttattataagtgaggttgtgcatcttttcttatagttgaggtattggtatttccttttctgtgaaatatcttttcataacttttgttcatctttcttttgctaattcttttttttttttttttttgagacggagtcttgctctgtcggcaggctggagtgtggtggcatgatcgcggctcactgcaagctccgcctccgggttcaagcgattctcctgcctcagcctcctgagtagctgggaatacaggtgcctgccaccatgcccaactaatttttgtatttttagtagagacggggtttcaccatgttggccaggatggtcttgatctcttgacctcgtgatctgcccgcctcggcttcccaaagtgctgggattacaggcgtgagccactgcgcctggcccttttgctagtttttaatttgccaatttcttttcttgtttttttagagatggagttggatcttggctcacttcagcctttgcctcccgggttcgagagattcttctgcctcagcctctcaagtagctgggactacaggtgcatgccaccacacccacctactttttgtatttttagtagagatggggtttcaccgtgttagccaggctggtcttgaactcctgacctcaggtgatctgcccgcctcagcctcccaaagtgctggaattataggcatgagccactgtgcccagccttatttgcaatttctaggcactctttatatattaggaagtttaccctatgtgatatgagttatcacaataggaggaaaaaggcttcctggggtctctgcaggttttttattttcctcagattttgggtattctttttgtattttaaattttaacttgtgtttgttgtcatgaggagtcttggtttttgtattgttgaatttatcagtgtttcctttatggcttttgcattatcctggtccactgttaatggcacaaaatcgttcattcctttttccatggtgcctccttcctcttttcctctttcaatttcggattgacagcaaaatgcttttggtatcttctcccaagtttgcgttcctggaaatgtatttcttgtcagtgatagggtagcccttgatagttttgttaggagattttagtggtctgtagcattcccattttcttggtacaggcactctgggaaactgacagtttcttataaaactaaacatgcaattaccatatgacccagcaattgcattcttgggcatttatcccagagaaatgaaaacttatgtttacacaaaaacctgtacatgactgctcacagcagacttgtttgtaatagccccaaactggaaacagtccaaatgtcctccaatgggtgaatggtttaacaaactctgatacatatataccatggaatactactcagaaataaaaaaagaattaaccattgatatatcaacaacatagacacatctctaaagttttatgttgggcaactaaaaagattcaatcctaaaagcttacatcatgtattatttcatttatataacacttttgaaaggacaaaattttagaaatgttgaatggattaatggttgccagtgttttaaagatggaaagggggatgagagaaagagtggggtaggtatagttacaaaagcagcacaagaactctttgtggtgatggaacttttcagcatctgaccatggtgatgaatacatgaacttgtgtataggaaaaaaaactaaatacagacacaaatcagtgcaaataaaatgaggaaatctgggctgggcacagtggctcatgcctgtaatcccagcactttggaaggctgaggcagctggatcaccttaggtcaagagtttgagatcagcctggccaacatggtgaaaccctgtctctactaaaaaatgcaaaaattaggcaggaatggtggcacatgcctgtaatcccagctactcaggggccttgttcaattgcttgaacaaggtttcagtgagctgaggagatcattccactgtgctccagcctggaagacagagcgagactgtgtctcaaaaaaaaaaaaaaaaaaaaaaaaaaggaaatctgcccgggtgcagcggcatactcctgtagtcccagctacttgggaagccaaggtgggaggatctcttgagcttaggagtttgaggccagcctcagcaacagagggagataccatctctaaaccaaaaaagggagggatgggtaggatctgaataaggtcagattatatctatgtcaatatcctggttgtgatattgtaccatagttttacaagatgtttccattgagggaaattgggtaaaggggacacgggatcctatacataggatctcaataaaaatttcaattaaaaaattcccaatttctgctaatactggattcaccaaaacatactgcctggaagcaggttcaggtcaagtaactggtgctctcctgtgttaggacttgtagtgcagcagctgagcagtggaatgtggaggagcctagcagtgcctcgggttccagccctgtatgctgctctgtctcagaagatctgagagcatcgaccagcatttcccaggattctctgggacaacctagctgggtagcccttcatacagcctgtctggagggagagaatactggcttcagctctaatatatcagaacagtgtggtgtggatgttggtggttggggacagtgaggggtggacattggtggttggggtcggtgaggaagggttcccaagatgagctttggccaggtgaggtggcttacactgaggcgggaggatcgcttgagcccagaagttcgagaccaacctgggcagcaaaaccctgtctctactaaaaatacaaaaactagctggctgtggtaacaagtgcctgtggcctcagctactctggaggctgaggtaggaagattgcttgggtccaggaggtcgaggttgcagtgagctaagatcacgccactgcactccagatgggcaacagagcaagactctgtctcaaaaaaaaaaaaaaaaaaaaaaagctttgctgtgccctgcacgtgacctactgtcatatgtattctgtgttccttgtgctgtagcattggctctgctgtgagacagaatggtctggcatgtggtagggcgatcactgggatccccaagaccctgctagggaatctctgaggtcaaaactatgtttgtaataatacttagacattatttgcaaaacatgctcattctcttacagaagtgtccagtggagttttccagaggctaaatgatgtgaaatagcaacagattaaatgcagaagcagctatgatattccagctgttttctattaaggcagacattaaaaagacattaataaaaataaaccagtggcatcatttcacttttttggtttggaagaatattttccttaaaatgttatttttgttaatgtataaaggggttatcattatatttaaatgatttaatatttaagaatgttctcagttttaatttttataggtgaatatcaaaagataaaactcacataaaagctctttggggtccttggtaatttttgagagtgtagaggttctgataattgagaactgttgatttggcagaaagcaataggcttaatttctagactgggctttgctttgtgaatgtgggcatcatttggcctcttcaattgatttcttctcctgcaaatgctattaattgccctgctacatacctataaaaatataatcccctatgcaaatacaggggagattaatggttacctggctaagctggtgttgaaagaaaatgtaaagaatgagtttctggcctgttagctgacagtctgtttacttgttaaatgtctccattttagcatctcctagcagtttctgtatacatttgatttctttttctcagtttttcagacaaccattttaattatttttaaaaattatattcccacattttcaattaataagggatttatattcctagtaccttgaagtgatgtgataaggtcaggagctctgttcttggagaaaccacttactagctatgtgacgtttggaaagttacttaacttctctgtgtcttggcttcctcctgtgtaaatggagctaataatacctcactttccagggcagctgtgaatacgaaaaatcgtgcacaagaagcacttagcaaaagtgcttggcacataacagatgccccataaataataattgcaacgattgtcattaacatataacaaaagatgcaagattaaattgaagtcttaccctgtcttcagtgaacttgttaaactactttattcacaagtttattagcagtaattttaatttcatttcatttttttctcctttgaagggctattgagtggccagacttccccaacaaatgccaaattggagaaactggactctcagcaggtgttgcagctctgcctccgatatcaagatcacctgcatcagtgtgcagaggccgttgcttttgaccagaatgctttggttaaacgaatcaaagaggtaatgtgctgcgggaaaataacattgctgactggttgttgtgattctctgcaactctggatgccatcttaagacttgacatttgtcactattgctttgaggagattgctttttcccagcagtaaaatgtgatgatgaaaaaagtggtccacagagctgggctaatttagagtttgaattctgatcaccactgatttgcttggccaagttgcttaacttctctgtctcagtttcctcatgtgaaaaatggggctaatagtagtaacttaccccaagggttgagtgacagattgcttagtaagtgttagctattattagtgcatgtaaagtcctgccatactaatttgctctagccaccattctgtctttgaattgactttaattgtttcctgtgtataatttatattttgtttcccagtagattaaaatttctttcaaagcaggagctttgatacgaaaagctccagtgattcttaatggttttatggaaacaattacgcctatttaacccgcaaagtttttaaaggaaagaagcaatgtaattcatgtgaaagtacttagtaaactgaagcacatgatgcaaatgttgtgtaattatcaatctcagtaaataggtacttcctttaagcacttaaatgtatcattgaccagctgctgcacagcacagttctaggggcataaaggaataagtaagtacattttccaaagtttccagtcaagaaaaactttatattcctgataccttgatgtactgtaatatcaaggaaatgttaggagctgtttactggagaaaccacttctgtgaatggcactcccagatttgtttaacaaagtggccctttaactctggtgagagaagatggacatggagaaacaagtgatggagcaagaatcactgcagattaacaatttgtatttagcaatggaggtagtgtatccttgagattacaaagcagtcattagttatattgacagatttaaatttgccaacacctccaacattttagtgcttagctttcataaaatgttgcatgcatatactcttctctcatgggttaaatactattatttggaaaactattaaacatgacctttgatattgcttttcattgatgtggctttgcaaatattataaacttattttactatattatggtctaccaagctttactttccaaacatgactattcattggcatcatgtgagttttttgtttgttttaatactgagttctcccctcctcccagtaagtctaggtgtggtctgtgaatcattattttaataagatgttatggtttggctgtgtccctacccaaatctcctcttgaattgtagcttccataattcccacatgtcatgggagggacccagtgggaggtaattgagtcatgggggcaggtctttcccatgctgttcgcatgatagtgaataagtctcatgagacctgatagttttgtaaaggggagttcccctacacaagctctcttgcctgccgccatgtaagatgtgactttgctcctcattcacttttagctgtgattgtgatgcctccccagccatgtggaactgtgagtcaactaaacctctttcctttataaattacccagtcttggatatgtctttattagcaatgtgagaacagactaatacataagtttaccaaatgatacaatgccaccctctattacccaggatttgggaaccagtggtcttaagcactatttctaaaataagttctacaaaactagtcccatataaagaggtcaaacgatttgcatattccctcaccaccccttggaaagtcacaaagcgtattatctcacttaaagttcttaggagtctcacaataaagaaagccagacttttgaaacttagttgacctcagaacacttatcttaggtaacatttattaatgtcccataaagtagtgattttagaacattctttgggaaatgctattgtagacataagactttacctttttaatttttttagaaacagagtcttatgctgtcaccgaggctggagtttagtgataacattcatagctcgttgcaacctctaactgctgggcagaagcgattctccaacctcagcttcctgagtagcttaggactacaggtgtatgccatcacgcctggctatgttgcctaggatgttttcaaactcctcagctcaagcgatcctcccgcctctgcctcccaaagcactgggattacaggtgtgagccactgcccctagccagactctaccattttttacagttgtgctagaagttaattaactatgacattaactctcagagaggagatcttagaattataataaattggctttttgatgcttattctttttaaaaagtcctttaagttcaagaccagcctggccaacatggtgaaactccatctctactaaaaatacaaaaattagccaggtgtgatggtgcatgcctgtagtcccagctcctcgggaggctgaggcacaagaatcgcttgaacctgggaggtggaggttacagtgagcccagatcatgtcactgcactccaaccagggcgacagagccagatttcatctcaaaaaaaaaaaaaaaaaaaacgaaaaacaacaacaaaaacctctaatccatatctgttgttttgcagtttagtaaagtgtggtacggagagattaactgactagctctatatcagagagctggggaaagtgttttgtagctggaagtaccagacagagcttctcattatagcacattttcaagacttcagagcagtgtttgtcagccctggttacatgttaaaattactcggaagttttttcctccaatatatatgatgggaaattttacacatatactgaagaagacagggtaaaagaaggcggagtaacacagtgaaccttaatgtactcattaccagccactacaatcatcagcttgcaaatactcctgttttatccatatccccactccctgccaccctcaactgtatattttatagtaaatccccagacattatttcattcataaatatttaagtatatatctttaaaagtgaaggattcttttaaaaaataacttttaaatttgaattaattttagacttggaggaaagtcacagaaataatttgagagtacctatataccctgccccatgcagcttcccctaaagttaacactttacataaccttcgtacaatgatcaaaaccaggaaattagcttggtacaatactagcaattaaatggaggccttattttgaattttaccagtaattccacgaatgaatgactgagtcgttttgaaagatgtagttataatgctgttatacctaaaatatttaacaatgataccttaattcattcagcatagctgaggtgctgttaagaaaattctgatgtctgggtctcactccgaaccgattagatcaaaatctttgaagggtgatagggttagggcggtgggatgttgggtattggtatttatgaaggtgctctaggtgattctagtatgtaaccaggggagaaccagtgttttggagcattcatttaaaaataaactgactttggcgggcgacatggctcatgcctgtaatcccagcactttcggaggccaaggcaggtggattgtttgagcccaggagttcaagaccagcctgggcaacatggtgaaaccccatctctacaaaaaagaccaagaaaaaaaacaaacaggcatggtggtgcgtgcctgtagtcccagctacttgggaggtgagaagatggtttgagctcaggaggcagaggttgcggtgagccgagatctccactccagtctgggctacagagcaagaccctgtctcaaaaaataaaataaacagtttaaaattctgtttgaagaactttgggattcactttgaatagtcagtaattacccaggattattgcaaaacagagaccagcactcacagtactgagcaatacctcagcagcgtgctcgggcagaggaggtgagtgcagttttggggctttcattggtggcgtaatgtgtccgtcttatctctgttggtgagtgttagcaaactcctgaatcatatccgtccgtctatgttcacctcagacctaagggttgaaattagtcacttccaaatgagtaaagcagaggatgtcattttgatcaaacaccaactctctgatattattccagatgtttcctggaaatttggttggaaagatgaggaagtaacataatgctatgtgttgacaagtgagggaacttaataaccatggagaatatgtgttagtggaagtatataaccgggatcaactagaggtccctaagattacagtacctgtgatcacttaagtctggatcaaagggaaacatggctataactatttctgattcagataaaggaaaatcagagagttagctcagctttccttatgttaaatttggatgatgctcttgaatgaaaagcttatgtttatagatttgtgtatgtgagggagaagaacggaggtaatttactttgcaatcagggagtctagtgacataccttaactactagtttctttaatggcgataggctgacccctcagccagcactgttgagcagctattgcagacccacctagtggggaggtcctttgggggttccagagacatgtaacatggtccttgctctttgagagtttagcctcgctgagggaatgaagatatacagaacagaaatatgaaaaaggcactgttgaaggggaatgctcatttgttatttataactaaagttctgtaagagttaaagattgggatatcctggagcagacggggtttaagctaggtctttgaaaaaaaaaaaaaaaccaggatttgggaaatgagaggaagaggggggcattgctgcaggggaacagcttgacagtcttagaagaaaattaactttggggcttcagggacactgaagaaactggcctgagtttcagtgagcttgctcagagaaatctctgcattaagaaccacagaatgttggaattggaaggaccttagagaccctctggtccagtgctctcattattcagatgcagaaattaaaggcttttacagaaagtaagcacttcgcccaggtcacacagtgaggtagtggccaaaattaagttaaaagtggatgaagatcaaaggggattttttgttatgcaggtggtgcacttgaacatgtttacaggatgagggggaagaggcagatgagacaagatcaaagatgaaggagaaagggggattcttagagcaagatccctgaggaggcaagagttggagccttgtgggacatctgttctgagagaacagggaggacgcaggcaagtttatgacaggagggtccctggcacagatcggtcacacccagcagcttgtatcctctgtggagaagagggaggtcatttgttgagtggtcatggtgactgggtacagtaatgagtgccattaggcattgagggctcagctgaggcagggcaacttgtatttgctctttgtatttgcagacaatttggcagaatggttctgagcgtaaactccagagccacactgccaaggttcaatcctggctccatctctgactacctgtgtgacctcaggcaagtcccttaattcttctgagcctcagtttccttttctgttcagtgagaacagaatgacatccacctcaggttttcgtgagggttcaatgagttattcttggtacagttctagggaccacgcctgccatgtagtagacactgtagtgttagctctttgttattgctttaaatataaatgatgactaaggagaaaggcctatcctaattgccatgaattggcccatttgaaattacttgataccagcagctgtctaaatattgccccattttaagttctgctcttaacaacccaagtataagcactaaatagaggcaaggcaaaaaaaaaatttttttttttttaagcccactgtggtttccttcaaaccctgcaggatttctttcatgccatgaatatgtagtttttggaatttctgtagtgaatttaactgtttattctgctttgtggatagcatactcgtgcctggggaacatgggtcttgagaaatgtgaagctggatggtggcaaaccattagtccttggcttctaggctgtggatacatggctgcctctgatttgggggatttcctgtatattgcctcatttctagttaaggattcaagttgacagacacttagttttaggttacatctatcattgaaatgtggggtaactgaaaagccaaccagaaaggagtgtgcttcctccccaggtgtggtttccctgggggcgagggatgaggctggtggcaaatacgcagccccaggaagatgcagcacagacttttggagcttctcttgtcacttccctgggtcttacttctgcctcattctagttgctgtcagtgggtaaatgtgttcatagattagaacaagttgcagcacagacttttggagcttctcttgtcactgccctgggtcttatttctgcctcattctagttgctgtcagtgggtaaatgtgtcatagattagaacgcctttgtaactaagataaagccacaagctttattttgttacagttcctgtgtgcttgcttgaaggccttgagagtacattcatgatatgattctagtaactcctgttttaattcttagatgtgttgataagcatagtgtattgacataaaccagtatgaagcatggagggggttcagatgaactggtaagaaaaacttgcaatccttggaaagccatatgattacacaggattatgaagaggccctaaggtttctctaatttagccctttcattgtgcaaataaagaaaccaaggatcttcgagtgtatatgggatttgctgggtatctttccattagataatgactaagatggtattagaaggtgagtcatcttttccactgcaccatactacttatgttctgcctctttggagtccttcatttcatttttggttattcctttttttacatggtaggtcctcaactggtgtttgaaggaatgcacgagagttgccattcatgggcctgcacacagggctgggcagggatttctttctgtcatcggtaccgtaatgtttaagacccagctggagtcattttccaagtatttgacctgacttcctgtactgtgtgtcctcccagggagagagactgatccagattaaatgagtagttccgagtgttgcacagagcatcactgtctgaactggcattagcattcactttgagctcctttggttaaaagcctggttagcgtgagctgttggccaggtgaaactgttgctatcgccctgacactgtgaaccgaatctcctttaaatgacaacattgttagagtcctgtggccgcttttaaatatattttggcttcagttgcttctttcttgacctgaaattataaaatgagttgggagtacctattgcaaagctgcaaattttgacaagaacattgagatgtcggcttctttttgctgaaatcctgaggcaagacatttcaagaaaattttatgttcccatagaatgtcacaagttactctggcatcaattccaggttgaaaccttacagtgtaattatagtttccccccttcttgtcctttgggcaacctttcttttctgtaagaaatacaactggtcccctgggtggcaggaaatccaggtgggggagtgggctgcttctggttcggcggactgtaaggtatgctgcacagggcttccttgggcctggccccacacttcctttgcaccagcactgtcctgccaaaagccagaaatcctggaagagggccgaatctagtttattacttgcctgttggaaatgtaggcttgtgttttttggcaaggcatgagcagagcccggttatttgactgctctgagatttaactccattccgcttttggacaatgacatatgagcatgtgtgaacagcagccccatttccccccagtttgcctgccctagacatgccctcagacagctggctctgccagctttcccagtgccaggttctagagcccctgttcttctccctcccctgctcatttccagtccaccagagcgggcagtgtcagaggtcccatgcagcctcctctcttgtgaggaaccccagagcacctgtagtctctaagccaactagccagtattgagggctcctgggttatggaaatgaaaccagggctgggaaaagatattccctgtcctgtatcacttccaatgaagagaaacaagaattttagcaaattgaacattgctgcagtgcctagaacaatgcctggcatgtagtagatgttgaataaatacttgtttaatgaacaactttatattcttcaattatctcatcctagggactgataagttttctcattctatcagagaaaataaaggttatgagggttgcattaggtagagtaagctaggctacagctgtaagtagactcaaagatgtgtaatggatcaaatgcaacagaagtttatttgttgctcttgttcaaggtgggtgtttctggttagcaggtgactctcctccattgagttcagggactcagtttccttctatcttgtggctctgccgtccccaaagaccaccttgctgatagtgtccagtggcaaaagggaaaaaagagtggactagcacagttaggaggttcttacgggccaaacctatgagtgttgcctatgacttcggctagaactcaattacatggccacagctaactccaaagaggctgggaaatacagtctattgtgtgcccaggggtacactaaattttgaacatctgtgtcatcttcgaacttagattcctaaaatgcatctgcagcccagctttgagattcagaaggcctgatgcaaggttccatggtaaattttgcttggtttaagtcctcctgccaatgaaaaccaagtgacattaggaacagatctaacaataagttaaaaaaaaatcaagctataatagtttatattcaatatgatttcaactgtgttaaatattctgtttgtttattttagagcagggttgtccaatattttggcttcccagccacattggaagaattgtcttgggccacacataaacatattaatgctgaggatagctaatgagcttaaaaacaacaacaacaaaaaaaactcataatattttaagaaagcttacaaatttatattaggccacactcaaagctgtcctggactgcatgcagcccacggccgaacaatcttgttttagagacagggtctccctggtctccttctgttgcccaggctggagtgcaataccacaatcatagcttccggtagcctcaaactcctgggctcaagtgatcctcccacttcagcctctcaagtaaccaggactacaggtgtgccacctacctggctaatttttaaatttttttgtagagacagtgtcttgccatattgcccaggctggtcttgaactcctggcctcaagcaatcctcctacccacctccccaaagtgctgggattacaggtgcgagtcatcgtgcctgcctatgttaaatattcttaataaatgattagacagaaggtaacatgacagtgacttaattgtggttgccctttagagatgagattatcagtggtattttgttttagcctgcttctgtttttctgtattttacaagatttctatcttgaacatgcattgctttttttttttttttttttcaatttgaaatacctttttttttttttttttttttttttaaactgatgggtaggctccatcttcagagattctgagccagtgggtctggagtagggcctggtacttgctcttttattttttaatttaatttttttacagagagtgtcttgttctgtcacttaggccagagtgcagtggcacaatcatagctcactccagcctcaaactcctaggctcaagtgatcctcctgccccagcctccccagtagctaggattacaggtgcgtgacactatgcccagctgactttaattttttttttttttttttgtagagacagggtctcgctaggtttcccagactgaccttgaactcctggcctcaagcagtcctcccacaatggcctcccaaatgccaggattacaggcatgagccaccatacctagcttctgttttgttttgttttgttttgttttctcacagtatgtgaatctcataagagttccatctccctgcctgcagctttttgactcaccaggataggaatatgcctctgagaactttttacgcacatgcctttacatgtctgcttcatttatgaactagtcagctctgtgtcaggccctgttgtaggtgtcgaggaaatatcactacaaaacagacaagaatccctccttcagagaccttacattccattgtggacacagacaataaacacggtaaaaaaataagatagatggcatgtaagatggtaaatacaagaataaaaaaaaaaagtaaggggatataaaatgtcagtagggtagaaattttacatggggtgacacagaaggccttcccagaaaggaacttttaatataaagacctgctggtcagtacagagctagccaggagactcttctttataactctgtctagatctgaaatttatcaggttatttgaccaatggcaaccccaaatcccaagattctgttctttactatcaccctgctcactgtcgtgtttatctgaatgttctgaactagagtcttatttgctatctctgttgttagttggtaggagacttgcagatctatactccttttaaaaacatctgaattgttttagatctcagggactcccaaaggatttcatcaggaggtgtccctaaagcttgaagcagcatttaattttcttctgcccacgttgacagactgactatagtattataagactttagttgacgtcctggcgatcctccatagttttcatttacacatgagtagagagcatttcacttgtctaaggtcctttcacaccattgctggaaactgcccatgacagccaacctgcagcccagagcaaaaggcataatgaatgtggaaggactctgcaggaccatacggagctatgtaaaagaaaggattattttgggggtgtaagagtcatttatatcaaatgcagccagacaaggagggattgcaaaatgttattctgtagaagtatgagcattagtggcgtaatacagcatcattacagtgatggtttcttcctgtatcccaaagtcccccagcctcctctcttcccctttctacctggaagtttacgaattctctctttgcccttgctgagacttagattctctggagtctgtcactcacctgcctctccatcagatattgtaatagtcatagttgtattctgcaaaatccgtgaaattcacatggctctagcctgaaatgtccagcctccactcctgctccctgacttctgctgtgccccctcctgctggtgtctgctccccttctctgcctgaggaatcctgctctcccatcagcaaccgccaacatcctggcacatgcagaggtcccggtttcccttgatcacaagggacctccttccttatgcctccctggtgcacaggaagtgtttgctggaaccgtttatgtggtaaagttgagtcggtgcctcagccatctgcatgaggaatgacatgggcctctggactctagatcaggctccagcctgatgtcccgagcagccatctatcatcctgcccgggagcacaaggcagccccagtggcagtataccaaatcattagaccaatatcatcattgtcccatgtgcggtatcttggttctttcttcaggcacggggtggaggattttagctgtaaaatatttacccacgcaccactgctaagctctgttctctgagtcaaaaaggggttgtgttcacacatggtttgggtgcatacacgagggaattacagagcacatagtccagttttctattgtttcattaccttagctgaggttttaagatgttaagtgtgtcactttggtcacacaaacttacttttacctctctttaattctggacatcggaaaagggagtccaggttagtggcgtggcttggagcctttccttcactatccacctgctgcatctgtggaggcttctccagcccctcacctgatgtggtagtgacagcagcaataatgttgcagctgtcgtttttacatgtttaccatgtgccaggtctagaataggcattttgcatatatcagctatatttcacgatcagctgagattcagagacctgaatgtgttcccggttacacagttgtcgaagtggagctgggatgcaggctcagagctaacgtccaccttcgaaactctaaagccgcgcttcctttccacctctttgtccattgtcttcaattcttttatttttatttatttatttattttttgagatggagttttgctctttgtggcccaggctggagtgcagtggtgcaatctcggctcactgcaactcctgcctcccgggttcaacggattctcctgtctcagcttcccaagtagctgggattacaggtgcctgccaccacacccggctaatttttgtatttttagtagagatgagttttaacaatgttggccagctggtctcgaactcctgacctcagttgatctgcccgccttggcctcccaaggtactgggattacaggcgtgagtcaccgtgcctgaccttgtcttcaattcttttttttttttttcttttttttgacagattttcgctctttcgcccatgctggaatgcagtggcgatctcggctaactgcagcctttgccttctggtttcaagcgattctcctgcctcagcctcccgagtagctgggattataggcgcctgccatcatgcctggctaatttttgtatttttagtagagacagagtttcaccatgttggccaggctggtctcaaactcctgacctagtgatcctcccgcctcagactcccaaagtgctgggattacaggcgtgagccactgtgcctggccgtgtcttcaattctttaaggtcttattctttcatcctgtctcctgctcatgcccaatgttcaagcatgttcccttaccctgtattcctttataatactcgctgcatagtgtcacagtatacttagcatctcaaaagcagtctttataggatgcaaccacactttaaaatagccctgaagaccccacatttacgttcttgaagtggcaactccgcctaccttgcaggtaacttctttatacttccaaccgtgctttggagaatggggctttttaacagtgtctcagaggactgtggtggtacagaaggtagacagagagtggactcatgcctaggagcttcatccttccccactgccactctggaggggttgcagagagggagcctcgaattagtcagaaagggctggggtgcttggttacagacggggccttttccaggaggcaaaagatctcagatgtctacgtgccctacaccgctgtctttcatgggacccgaggaaagctctcccaaggaacgggaggagtgggacttctgtccctcaggcttttatttttacttgtgatgtttttcttttcctggtttgctgccatcaatgccatttgcaaggccttttgtggggaggaggtataatctgcctgtttagttttggaagctgcttaaaggttttaggatttctgtcccactttcccacctagacgtgatgccaagggtaagaaggcatcggggaaactgggcaagtcgtaaagtaattattggaacagtcatacaattcaaattcctgccgttctgatatcgcttaattcttttgaagacctgaataaaatgtgttctttttctgagacatttagatacattgtttgaacaaaggaaacagggtgacttcaaaatgtccagtatgtggaaatcgatgccgttcagcctgtggtgtaattaatgaaaacattggcgacagtcggcctcattgtttgtcattgtgcaacaggaggtggtacactaataaggagccggggaaggtttacgtaattcagaaggaagcagacgtgtgcagttttgactgatgcccttctcactgcagatccaggctcaccgagcaggttcctattcctgatggacgtggagatgtctgattggattttgtcatttgatttttgacactgattaatgatagatttttatttcccttatggtcagaaataattgtcttgaaaagcttcactttagatcatagttttcacacacagttataattcattgggtaaagcatagtagaacaaactatggaaaaggaaatgtcattggtagactttggtcgcttaggacaggtgtggtggcccttggaatcaggagatctggagttctgtcctggccccatcagtcccagctgtgtgagcttagggatagtgcttgcccactctgggagcagccttcatctgtaaaaggagggggttgctcaggacccttgcacctccttccttttacagatgaagattgctttgtctaagcccccttggtgaggtcaagaattgtgaaatgtttgtacaagtgagatgtcaagagtacaaaatgtacagacgaactgccagtgaaaatgtcatttaagtttatctgctaacagtttattccctttggtctcctctcagtttttgttttgtaattgtccatgttttgtctggtaatttattattttttttattagaaaagtaaacaccaaagtgtttttccattccgcttgacagcataacaaattgccatttaaattcatctcttaaggatttcaaaaaggcattaaacacactgctcaacatggtatgtatttaattgaaatgagctgacttttgaattaattagctctttagaaaaaataggcaaaaatggagccgaaaagcatgggtttgaattctggcttcactgctagtacgagctgtgtgaccctgggcaccttttctcatctctgaatctctaatttctcatctctaataggagagggacactttccctatgagagtgtggtgaggtataaagataatgtatgtaaactgcacagtacagtatctgacagttagtagatacttaatggatagcagctgtaactgttatacattattttattacaataattaaaataactagagaatttgtgtatattatatactgggttctatctaccaaatcattctaatatgatgtgcattgattaccaaaagaaatagtcctccagtatggatgccagttttgtttctgttagagtgtgtggagtgagatttaccagagagggatttctcttttctggttgacagatcaaaggtacgcctatgagaatacatggcaagaatttattcttttttttttttttaacagtgataaaatatactttactttgttgagtcagagggttgtaaaaaaaattattgctaaagtaggtatcaggcaaacagaaaggtgctttagaagtccagttaccttggagtttatttaaactaagagaaaaacgtcataatgttttcatgcgatacatatctggttctttaacaattgtgtgacaaacagcagaaggaattaaggaatgccgcacttgtgatccatacaaaacaccaacactttaggttgtacataattaaagaaatatctcaaacactttttaaaacactgtagtagccaatacatagaggcatgccgtaggtaggcacaggaatgcagtttagaaaaataaataaatcacataggaactactcaatttccttaaaatcactgagcaagaaaagcaacattgaactggctgggcgcagtggctcacgcctctaatcccagcactttgggaggccgaggcgggcggatcacgaggtcaagagatcaagaccattctggccaacatggtgaaaccccgtctaatttttgtactaaaaatactaaaagtactttttttgtactaaaagtacaaaaattagctgggcgtggtggcgctcgcctgtagtcccagctactcaggaggctgaggcaggagaatggcgtgaacccaggaggcggagcttgcagtgagccgagatcgcaccactgcactccagcctggcgacagagcgagactctttctcaaaaaaaaaaattaaaaaaaaaaaaaaaaggaaagcagcattgaactttcatattgattttacacagcttttatacagtaccttgacttaaatccaagagcaaaacttgactgtcctcctctatttttggtaaacttacgtgactttcccccctggattttacctgggagtagcctttttaaatttttatttaaaagagggcaggtttggcactttatagtaatgtcaccaatgttaatatttcttgggatctcaggaagattcacattttttacagctgatacaggttcagcacaggctgaagctccccctcagccagcctcagatttttccagcttattttgtgcaccaatttgtgtaacaatcccattcatgtttgtctccaataccattcccccatcatcatttctgcaagaatattgtgaaccgtgtctacatggaaaatcaaatccagttcacaaacattttcaaaacatttgtctaatgtttccacaaatccatagggctggtagaacttggagagccgcggtttcccatgattgttaagattaggatcgccttgatcgtggctgggtcgggcccaccgggtaggcactgggggccagggtgcgggccggcgcgcaagcctcgcctcgtgatcttgccggcgatccttccccacccactccctcccgcacgccggcaagagtttattcttacaggctgccattgcaaactactgtcttcagaaacaaggtcacttcaaagtgtccagaatgtggtaattggtgccattcagcctgtggcgtaattaaggaaaacatttgcccattgttgtccattgtgctagagagaggcgtccaggaaagattcatactcccaaaccctccatgggagtggtgatctggagagggtcggacagccagaaagcacatagttgaccctgaaaggttttgttgcagcctgtcataccctaacctttataatctgtctgaatctctactgcaggtcaagtagccatggtctggtggggatagaggtggcaggtgggctagaacgtgccatatcttgatttgtggcaatgggcctcctactcttcggagtggagacagctaataccatgagtcaaagaccaaatcgggatagccgatgtataaaaacacaagcaccgggtttgcaaactggaagaaaggtcttgaagaaggtgtcagaagcaaaaaatggtaagtatgtgaggaggtggatattttaattagcatgactatagaaatcatttcactatgtatatgtatgtcaaaacatgtgtgctgtaaatatatagtttttattttttaaaaaatgaatgctgtcagtatgagtccatttaaaaataagcaggcttaaaggttcaaggaaattgctgagaactggcatctcacgcttccttttggggttagtcgatgcatggtatggctaatgtaaagatccaggatcttatgaacacagctttttaccttggactgttcctcttgcagactcagctaccaccttcctttaggattaaaaatgttttacttagcctcaacaatttgttttagagccactttcatagtgcctagtcctggattcccaaataggtttcttcatcttcgtaaactcgaaagtggccatctggggttcagtgtcaggaagggttctgagtccaagtcagatttaaagaataaccatgatgcattactggtatctgtcgggggtctgggagaaggaattgaatgtatttgaatacacttattttattattttttaaaactgagttatcattcacgtagttcacccttttacagtgtgcatttcagtggttttagtattcttgcaagattgtgcagctacaccactatgtaattccagaacattttcatctgcctagaatgaaactctatgtacatcagcagtcactccccatacctctattcccctatcccctggcaactaccagtctcctttctgtctctctggacttgcctgttgggggtatttcatataaagggaatcatgtgatatgtggcccttgtgtctggtttcttttacttagcataatgttttcaaggtttatccatgttgtagcttatatcagtatctcatatctttttatggatgaacaatattttattctatgaatagaccacattttgtttatccatttttcagtggatggatatttgggttgtgtctactttttgcctattatgaataatgctgctataaacatttgtgtacaaggttttgggtgaacatataatttacttctcttgggaatacatgtgaagtgaaattgctggctgtatagtaactttatgtttaactttttgagaaacggccaaactgctcttcaaaatgactgtcccattttacatgcttaccagcaatgcacaggggttccagtttcttcacaccctcactaacatttgtcattgtctgccttttaatttgagccatcccagtgggtgtgaagttgtattctttctgcttttgattgcacttttctaatgtccagtgatgttgaacatcttttcctgtgtttactggccatttgtatatcttctttggataaatggcttcagttataattccaaggccagattttgccctagggacagtactgatttatatagttaggctgactgcttcctaattgggagaattggtagttctgaatttcagaaacatctgagaagggtggatattgaagctttatataaaatatgtagcagttttcttttaatgtgattatgatttgggaactttttagttttactaccatgaaaaacagaacttccaagcatactttgccattcattgttagaataatataaacatacatgtttatagcagtgttctgttttcagatcatcctacatatattatctcattataaccattacaacactgccgtgaggtaggatgaatattagccattattatccccacttttaaaaagtagaagctgagagtcagcttgtgatttgcccaagttcaccaactagtagaatttaaattcaggccttctgacttactttgttaatggtaatgaattattagtgatgtcagggatttgaagggtgagcttacattgctaaaaatcagcaatatgcccatcttcaaataacagattgttactgacttcagaatgtattatttgaatagctgtaaaacaggatgaattgttacttttccatttagcctctttagctacaaagtacttacaataaaagagcagaattacatatcactgcctgctcattacattttgaacccagaaggaaatccacccaaagaaagaacaaagctgggaatggatttagaaccctaaaaagaggcagcctttggttagctgaccttgaaccatccatcatgcctcctcctcccagcctccatattcctaaactgacatccttggggaacaggaatttaaatgtagaacgagtgcagagaaagtgagatatctattgagatcaaataaaaattgaccttgagactaacattaactgacagacaccacattaaaagctaaacattacctttaaagggtgggaaagatgagtgactttttaaatgccgtcttgagctgggcacagtggcttacgtctgtaatcccagtactttggaaggacgaggagggcagatcacctgaggttaggagttcgagaccacctggcctacatggtgaaacgctgtctctactaaaaatataaaaattagccaggcgtggtggcacacacctgtaatcccagctacttgggaggctgaggcaggagaattgcttcaacccaggaggtggaggttgcaatgagctgagattgtggcactgcactgcagcatgggcaacagagtgagactcggtcttaaaaaaaaaaaaaaaagcagtcttgattaagtccatatgcagtcttttttgtttttaacatttcttttaaacttaagtattttggggatagaaaaataagtctattgatcatatggatgtgaattttgttaactgtgaaacacagcttacctactcatttttcttttgaccatgagggttattaaatttgcttttgatcatttcatgcatatctacatcttaagtttttagaatttaaaagttgtacactatctttatgaagttcttactgttatgttgcacatcttttctaacttaaaataagcccttgtagtatgtcactaatttggaaaatttacctttactttgaaaagaactacatcaagcatagtgaggccaggtgtggtagatcatgcctgtaatcccaacactttgggaggctgagcgggtggatggcttgggccaggagtttggagatcagccagggcatcatcttgagaccccatctccacaaaaaataaaaattagccaggcatggtggcatgtgcctgtagtctcagctactcaggaagctgagatgggaggattgctcggacccaggagttcaaggctcccgtgagctatgatcaggccactgtactccagcctgggcaacagagcgagaccctgtctccaaataacaaaccacagtgacatctttcataggatgacccatctgcctcaaaccagcatcaaagcttattttatgaggaaaatttatataacaaaagtttttgaagcaccgtactctcttgttggagaggatatcatttattaaagcttttggttttgctttcaaaatattttttgaaaaatatacatgtacgcatgtacgcctatgtatttttatttttaccatattggatagcatcaaacagtggtaatagttattctcatggctaaacatatagattaaaaacacatggaaggacttgtaggtaaataatgatttcagttattacgtagtgcgaaatgattctatcaggaaactgtgggatgagtaatgtgactctgctgtaagattttcagtagcagaagtacagaacaaaaataaaacatgtcagcaaaaaacacaatggtaagttgtcatctgagtgattgtgtaagccttgaagatagttaatgtaaccgagatgaggcgtccacataagctcctgccttcacaatagatatgttgtgtctatttggatatcacaaaatgtcattcggttttttattctgctttcatgtactacatttcttatcttgctttttcattcttcatgtaaaagaggtttctagacagagtttctgtttcagttcacatatattttatcacttatggagctcctttttcctgggaactgttctaggagttttatacattttatctcatttaattctcacgtcaaccctatgacgtaggcattgtcaatttcaccaattttaggggacagagcagctgagggtcagcaaggttaagtaactggcttaaggtcatgaaggtaatcagtcatctgcagaagcaagattttgactcagttctgtctgatgctactgtcgttatccataagcgatgtatgtatattttagttagaaaactggaatgtttggccgggcgcggtggctcacgccggtaatcccagcactttgggaggccgaggcgggcggatcacgaggtcaggagatcgagaccatcctggctaacacggtgaaaccccatctctactaaaaatacaaaaaattagctgggcgaggtggtgggcgcctgtagtcccagctacgcgggaggctgaggcaggagaatggcgtgaaccccggggggcagagcctgcagtgagccgagatcgcgccactgcactccatagaagctctctcccctccccacaaactctgagtcactcagcttgagctcaggaatgatttcagatgtctaaacaggtcatttgcagggtctgggtagtctgcccacagaggaggtaaaagctctggctcaatcttgaaccattgcaaatttaagccagtggatctgaaggcaattgagttctgttctgccactccagctcaggcaggacagctgcttccctgaaacagggccctctgaggttagatgtacagcctcagtgggcatcagtgtcatgaatagccgctcctcatttggcagcagtaactatccagagacaaaggataggattcgggataaccgtggtcataagctagaagtctccagagtccttagaggaatttgaaaactgaacagaatttttttctttccacactgtgtcagggctttagcaaaggagttctgttgtgacaattgtctgggtaacatctgcctactgttttttgttttgttttgttttgttttgttttcctgatctgtagtccatcttgcttaacagtgcccaagggcacaagcttcacactgttaatagttttactcttaacacctccttggctcctttgtcccaagaaggtgagatcccacttccaggtgatctcctgcaggacttttccctgagcctctaacccatttctagcccatatttccccctcaagaacaataattcagtaatgttttcagttctcctgaaacaatcccaaattttggattttttcttaatgttgaattataagagttattgatatattcattctggatgtaagactgtcatttgatatatagtgaaattttttctttctttgtttatttttgcccattattttcatagggaataaaatattatgaaatgttctcagtctgctgcttgccttttcattttatttcttttcttttctttcctttttttttttttcttttttgagacagtctcgctccgtcacccaggctggagggcagtggtgcgatcttgactcactgcaacttctgccttttgggttcaagagattctcctggctggccacggtggctcacgcttgtaatcccagcactttgggaggccgaggcaggtggatcatgtggtcaggagcttgagactatcctggctaacacggtgaaaccccatctctactaaaagtacaaaaaattagctgggcatggtagcacacgcctgtaatcccagctactcgggaggctgaggcaggagaattgcttgaacctgggaggtggaggttgcagtgagtcaagatcgcgccactgcactctagcctgggtgacaaagccagactccgtctcaaaaaagaattaaaaaaaagagagagatagtctcctgccttagcctcccaagtagctgggattagcaggcatgtgccaccaggcccgactaattttgtatttttagtagagacagggtttctccatgttggtcaggctggtctcgagctcctgacctcaggtgatccacctgccttggcctcccaaacttctgggattacaggcatgagccaccgcacccggccttaatggtatctttttaagagaagtttttagttttgatgaaaatcaatttaaccatttttattttatggttaacactttttgaaacttagaaatctttgcataccccaaggtagcaattttttttttttttaaagacagggttttgctcttgttgcccaggctggagtgcaatggcataatctcggctcactgcaacctctaccttccaggttcaagtgattctcctgcctcagcctcccaagtagctgggactataggcatgcaccaccacctccagctaatgttttgtatttagtagagacgggatttcaccatgttggtcaggctcgtctcgaactgctgacctcagatgatccacccgtctcagcctcccaaagctctgggattacaggcgtgagccactgagtccagccaaggtagcaaagatttttctcctatattttcttctagaagttttatagttttagcttccatatttaggtctgtgatccattccatattaatttcttgtgtatgcactgtgagatgtaaggctccaggttcattctttctctttgtggatatctagatattctagcacaaattgttgaaaaacttttttcccccattaaattgccttgagatctttgtaacaacaataaaaaaatcaattaacaatatatttttagatcatttttacactgtcttttgttttatggatctgtgtgtctctatgccagcaccacactatcctgattactgtagttttatagtaagtcctgaaatcaagtactgtaagtcttcaaactttgttctttcaattattttggccattctgtgtactaagaatcagcttaccaattcctgtaaaacaatgccttctagactttttacttggattgcaaatgaacctcttaatcaatttggcaagcatcagcaccttgaccgtgttgaatctgacaatccatgaacatgatatacttcatttcttgagatcccttttagtttttcagagcgatgttttgtaatatcagtgtacagatcttatacatattttgctgaatttttccctaagtatttcatgttgccgacgcagttgtaaatagtattcttttattccactgtcctgtcattcattgttatgtagaaatacaattgatttctgtatgctgaccatgtatcttgcagccttgctaacttcactttagtagtttttagtagatttttaaagattttctaagtgtattatcatgtcatctgcagataaagacccttttgcttattcctttctaatttctttgccttttacttaatttattgcattggctactgcatatagtacaatgttgaatagaggtggtaagagtgtagacatgcttgccttgttcctaatcttagggagaaaagtgtctttcaccaataactgtattgtcagctggaagtttttcatagatgcactttatcaggttgaggaagtttccttctgttcctactttgctgaaaatttccataataaatgcatgttcagttttttgagtgctttttcttatatccattgagacaatcatagatttctaacctctattctgttgaaatggcaagttactttgattgatttttcagatgtcgaaaaagtgtgtctccttgacataagcattgcttggtcataatgtattatcctttttgtatatttctggattttatttgttaatattttgagttcatgtactgagtggaccagccaagtaggcagatgggcccgcaccatccatataaggtatttggaacaactttgagcacattctacagatgcctaataaccttagtgaggcctgcagttctatgctcaaataacctccccttctttttcacttgtcctttgaaatggactgccccagagatggtatatgaatctgtagggcaaagtttgaagtatgagcttgagtaaatgatgagttccttgaagacaaaggctttattgcattcttttttttttttttttttccccctgggatagggccttgctctttttttccaggctggagtgtagcggtgtgatcacagctcactgcagcctggacctcctgagagcaagcaattttctcacctcagcctctggagcaggtgggactacaggtgtgttccatcacacctggctaatttttattttattttttgtagagatgaggactcagtgtgtcgtcgtggctgctcttgagttcctgggctcaagtggtcctcctacctcagcctcccaaagtactgagatgacaagcatgaaccaccgcacctggccagcattcctatctgtcagtataagattatattaactagtgttacagaaaccccaaatgatggtggcttatacaaaatgaaagtttattcatctctctcaggcctggtctcctcttacacataaacatcctcatggacccaggctgcttctagctcatgatctgccaactcaaagatgtaaccttcattattctcatggtctacatggggtgcacctgcatttcagcagcagcagagtggaggaggggacagtgaagaagagaagcaacaaagagtgcatgccggctgcctttccaggaaggtgcctggaagctgccaggagagacttctgcatgcacacaccactgattataacttggtcatgtgtcacggcaaggcgagggttttgaggcaagagttgtggagaataaagagttgttcactttctatttgaaaatcagctagtttattcatttaatttttcttaagttcctgaaacaaagttatttgcaatttatatgtttctgggcctgagtttcctggaatagtaaagtcatgttaacagaaacagtggaaaagaaaattcatgttaatgtacacggtaagctgtgtgggtgtaagtagttttggttctcaatatctatcctaggacctcgcatagtgcatggcacatggcacgtgatgctactcaataactgtctgttgcctgtgtggtaatagctcacacttacccagtgctcactgtgtgctgggcaggatgataatgttctccttgcagaatctcatttaatcctcaggacagtcttttaagtggccactcttgttatccccactaccttgcagatgaggaaaccgaggcttacgtatattttcattcatttattcaacaaatatttattcaggacctgctatgtgctgggtactggagatatagcagggtttaaagcacaccaaatccttgctctcatggaatcagccttctgggtaattttctaaaatcacatagatactgggtcgagggtagcccttaaacctaggtggtctgactcctgaacttgcaatcttaaccgttgttttattggtagatgaatggattgatgagtgtggtgaacaaaaattgtgactatccatttcacaaacagcttcgtggttgccctttagctccagcttggatggttagattgccctgtctgaagctggatttattttattttatttatttttggagatggagtctcgctctgtcacccaggctggagtgcagtggtgcgatcttggctcactgcaacctctgcctcctgggttcaaacgattctcctgcctcagcctcccaagtagttgggactataggcgcacactgccacgcccggctaattttttgtattttaatagagacggagtttcgccgtgttgcccaggctggtctcgaactcctgagctcaggcaatccgccctcctcagcctcccaaagttctggtatgagccaccacgcctggccaagctgggtcttttgaatggctatgggtgctcagtgaggcaaccctaggtgatatcataacacctctgcttatccagaagacaattagtatatatgttatcttgttagaatccatgtgccaaaaatagaaataggaaaggcaaataaggatatatccctagattgtcaaaatggtgattcagaattgtgtgagatactggtttactgcctacagtcacatcaaatgtgttacaatgagcatgtgtctgggggttcgtggagtaaaggtagggattatggatcaaggacaatgttacctcaagagcaaaggtcagagacatcaaaaataggcatcaacagttttaccatccttttccagatagtccattgttgcttgcaccaagttgagactttctttgcaacaaagaatgggggaaacatttaaaaggtaataactttccctacatgtgatctagtcttctttaatgcagtgccacgtgccaacaaaagtctcataaagcaccagtgatacagggtcttgctcaggaaatatgtgtaaaagaggggagctgctggacttcggagagctggggtccagtgtaggttctgtcactgtgagatcttcaaagtcacgcaaactcaagtttcctcttgcggtttttttcttccatggagcataatggaagtaagacatgatgtcagcacgcatgaacaacctgtttgaactcagtgtgctcatctcagcattaacagaaagtgcctttacaaaagctttggagacattaaacacgggccccagctggatgtggaaacatgtagggaagtacatgccatttgacaagtacctgtgaagatggctgtgaacagtcttcatcaggtgtgaatcggggatggattgactgccaaggactttagacttgataagttagagccttggaggccatttcagatagaaactcttcaagcatctatctagtctggtagggttgcggggtggagggccaggaatgccctgccaagtaaaatgtgatgcccgagaaggttcccaattcaggattccacctggctcccacgagccccgctgtctctcaggtgtgtggagtgtttctcagtgctcattgcaaggccaccctgaaaaggcccagcgggtgactgtcaggaccacaggactctcctggctcactacttccaaagtgctgagcgccagacagggctgcagagaaccccggaaagtgtgcattgtttccacattatttggagtttctcactcccatgttttttttttttttctcttctccttctccccgtgcccaactagctgctcctcctgccctgcaggcactcaagcaagaggcccgccagaggacagcaacactgatgtgcttcggtcgcctcccgcccctcctgccctccccacagatgatagcaaaagggaaattattttttcttggggctggctttggtcccccgtgttttcatgagtttgtttttgtgtctctcgaagccattttcagaggctctctggtaccgggtgttgagcccttgtcctgatgcaaggtcgggaaggggcgtgctccaggaataaaccagaaggaagggctggaggagcctgggaaccttgggataggagtgtgggcctcagtagttgagctgttttctcctggcctgggaaagaaacaaggggtgagggggtggaagtggggtccatgctgaggaaggggtgcaagtgcccaacacgatggcggtctctctctctatttttatctgggtgatgggtactaaagagcctctgtaaggggaagagaagaagtcacgcaagggcagcccagagcccgcagtttctttaatgggggagaagggcacatgagatagtcctcacagtttgacaaatgtggtgtgttgtaaggacgggagccttggttgcatttttggccctggcagggagagcctcccttccattgcagtgttccccgagtgtccgccaaactgcagccgtccagggaagagaaggattgagtgaagaacatgcattttggggtttgggatttttgttattgttgttagaaacagggtctcactgtgtcgcccaggctggagtgcagtggcatgatcatggctcactgcagcttcgaccttctggactcaagccatcctcccacctcagcctcccaagtagctgggattacacgcacacaccaccacgcccatctgctcctagtttttttctagataagcaacctgagacacaaaggataagcattagcagctcatacacgtgacagagccagattcagccttggcctgactgatttccacatccagaattcccctcatatagggagatagaaatctcaggatctcaacaaggtacaaataacgcacattcccagaacatagagccagggacagtcccctctcagttctcttctaaaggtggttctggcacaacagttgataaagctgtgtccctgaagggctttttagccctgggtgcttcctgtaaaacttgtcagcttccactggatctgcgggactgtgtccctcacaggctggacacccggccctgcggagaggacttgattaaacaaggtataatgtacttctctttcccatccacagatggatctgtctgtagaaactctgttcagcttcatgcaggagcgccagaaaagatacgccaagtatgccgagcagatccagaaagtgaacgagatgtccgccatcctccgccgcatacagatgggcatcgaccagactgtgcccctgctggacaggctcaacagcatgctgcccgagggcgagcggctggagcccttcagcatgaagcccgaccgcgagctcaggctgtagctgctgcccggcctgcctggggctgggagccccagacaccgacaccctgaggacgtgtggagctaaggtcatatcatctgaccaggtctggaggctggcgggaggctccctgaaagtgggtgcgaaggagtccggctggcatgaaaatctgactttgcccagctcttttccttgatgcagtttcccggtgtggaaggaacctaaccagttctcggtgataactgaagctggaacgtgtgaattattaggaattctttgaagaactctgcattgagaattatttttatttagtttttttttttttttaattgagagtatatagtccagtccaggtaccggaataaaaatatggagacaaggggaaaatattttacgaagctctgtgttctcaacgccctcatgaacttttcagtaggctgtctggtttatgtgtggtcaacttgaaaaactaattgaatctaggtctctgtattgttcctgtttctaccctgactgtttccgtcacaccaagcccttatctggggcgcgtcttcctgcccaggtggaacactggcattttgttgactgtcaggttaggtgtcccttagtcgtcatcagaagctgaagccttcctttccacaccctcatcagattcatctccactgataaccggtttccttgatgcagacatagtttagctttctttgactgcagagatgtctcattccacagacatttcttgaacccatttgatgtgtccaatattgtgccagggatacaaatatggccgtatagcctcaggccttcatttctgaaaagaaaaaagctcaaaaagctgctgaatttctctgggagtttaggaaaggaagttatttgagtaacaacaaaagtgcttagtgtcgtactttacacatcataggtgttctaatggaagcaaggactggagaagcaaagagtggaatgtgaggagcagacctaggcagacaccttgagactaaaagtcagagctgaagggagtcgctggggccaggacggcatgcaggcctgtaccctgttccctaagttcctgcaagcgtcgggaggtgtgttttcagataccagaaagagccttcagtagattcacaagattaaaattgatgcgcttaattt

SEQ ID NO: 1175 - DNA, 109578 bp, Homo sapiens
cttgaactttgaaagctttattggttctttcctttctccattcccttcccaaatgcaagcaaccaaagaattaattcaagaggcagaggcacagatttgtagtttttgcactatataatagtacaaatattgtattttatattattttctcttaaaacatacaaatatgatacaatacaatttattttaataaaatgccaaccaatatagtacaacaaaatgaattcaatacattaagatgcaatacattacaacattaaaatcccacataagaacagcagtacccccaaggcccccaatgagtacagtatatctctaatgaagtagtcagtcagtcctgctgatgtgtatacattctagttaggagggtactggattggtagctaaagcttccaaggtaaaaaataaaaacaactcctaatgtctttcccaccctcccaagtcattcctttcccctcttgttggaaatcctggaacagaaatcaaaagagttttggcataactgacacgttctctgtcactgtcttcaattatacagtatgagctttctctgcccattttcgatttcctcatcttagtgtactaaaactgtgaaggcagcttaggagtgatgacaatgctacaaagatgatacattgcaatggccttaattccatgtccctgcagggttctgccacgtcccaaaacctttcccttttgagtcctgcagggcaactctcaggattagcatttgttaaagcaatttagaaatcccaggttaaaatgtatattatcacataaattttataacattgttgaagtagtatatcatggcagggttactatctgttaggagaaacagatttctcaataaattttgatttctacagtttatcattagtcttctcattttataaaaaatgaaatctgaaggcaaaaaagtgtgctgaaggaagtgctctgatgtacaaaaacttcttcaaactagtgtagaatgaatgatagcaatgattcttttgcctctttgagcatgtctttcctatcttatcttgcccactaagcagaacgttacgatatttctgtttttgcattggatgctatctgccaaacagcttttcctaattgaaaatgcagtcctgtttaaaacctttgatttacgactacttgtacatgcttgctcattacaattttgacattttttacatagtgaagaccccaaacatatcagtgaaacatgacaagatcataaagaacagtatcatattattatttagtcgcttttacagtggcaagccaattttgaaatatctcatttaaaactcagacccaattcactgagttatacttttaatagcttcctcagcacactatttcccatgcattaaatatgataaaataatctatcactgcccatcggtcttgtaaaaaggaagtctgaatacagagcccacaacactaaaattgtttttctagctacaaagtatagcatcatcaacacagacacgatttggactccctgacaggtggattggaaaacggtgtttaaagagaagagaacattttaacataaatgtcattaagaatcccaaaggccttatttgtactacacaaacttcagatgatagaagcagcaaaaaggctgcagaacgtacatgggactctcaattaaatacaaggttcacataaacactctgaaatatacagtaatatgcatttttctttgtacccatttctgaaaaatgttctacattaaaagtctcacttttggctagtttctaaatgaccaatcaacccaagaatcatattttgtcaattcttactttatacattataataatctattttgacattttgaataagggaggtgcgttgaacccatatttcgaaacctaagttacttgatggaagtaggtagtggctttccaaaatttaacagtgtagctgatcccttcaaattgagaaaatcagaattaacagacatttctgctggttatcagtagccaaagatagctgcccaccaggttctttcacttttcagtgttatggccccagagatctgccaggtcacataaatacacagcttctatcctccgtttggaatggggactgaggaaccagcctcacaccccctgttccatttcaattattccccattttaggctccttttttctccttttttttttctcccccctccgttatcttcacctcccttcataccccagggtaacatacccctagggtaactaataaaaaacaaaacccacccaaaagtttctttaaaaaaaaaaaaaaagactctccggaaggattaattacacagtgaacaactaatactctatggaattcttaaactcatctcttggaagttcttaaaatcatcttttgtaaatactaacatcctcccctccccacaaaaattgcaaacaggggaaggaaatggtaggttctgcatgtccaattcaccattttgttttcataaggatccctcaatcattctgtttgcttttttaatgttagcaactattaaggcccccatgttctatggtattaaggcattgtttcctgaaggaacacactaacttataatgaacaaagaagccaggccaaagagccataggtaaaatttcaagatacaattgatttttctttcctttgggctgacaacttccaggttactaattgttttcagagcatttggggctccataaaactggcattctggggaaatgctattgtttactctttcacgtttgacaaaagcaattcccacgtgaaagacaagtttagccgtgggacagaatctgttacctaaaggaggaaacagtctggtgagttcccaagcttgagaagttgtcatattgtcacctcctattgaactgcccagccactgtgtttctcagccatggctattttggtcattatagtttttttttttaaatagtttatgcaagtcacatataatgatcaatcataaataaaaacaacagaacaatgcatattaaattggtgaaaaagtcattttccctcaaacgcaagcttaaaacaagagattacaacttctcttgatttaaaactggtgtgtattttttaaattactttgaattctgcttctgtagttttgccgcttcttaatccccataaaaatcctattaacatttgcatatggggaaagtggacttttttaaagggcaaattttaaatttacatttagaagaatgcattaaatctctggttacaatagcctttatttccttgataaattgattgtggtacacctttgaatgctgtcattttaacatgatgaagttccttaaaataataaccagaggacaggaatatttaaaattaaggcatgatccactttctttcagctgccatcaatagctgtgtggtgcagtcagagacagcaaggagcaaaccctttgctaggctagtctactgtggcactaactgcataattacctggatcgcatgagaggagggaggggacgttgatttggatggactcttataattcacactgcgataaacctttactatctctgaattacaccaacatcttgcacccctggggcccattttagaagctccagttcaagataaatgtgcttaacgtaaaaaaaaaaaaagcattttcaaataaataagcattataacttgctatccaggtgctatttacaaatcaagagcagatgaaatagtcccaaataaaaccaggcagaagtccgacagagtctcaaattcaactgtactcattctgagctggaaaattaacttattcgtgtccatctttggcagaaaccagcatttgtttaaattattcagtttgtgcagcttcaacacttaaaaataaaaagaggttggcatcaaaatggaaggaaaggatcatcccaagttgttgtttatcaggcaggagaaaacagcaagagcaacaaacacagagaaggcagtgcagggatcctccaaatccaaacgtgcaccaagtcggccccccggagcagccccctcggcctgaatggggggcccagagctggggcccgggggtctcattattactgctatcatctccgaactcattttgggaggagcatctcctccgagcctgaaagttagcaacagtgacaataaatcaagatgatatgagacaactgttactttttaatgagtcctttaatgttttacattactttgtgtggtacaatcattccttgtgcttttaaatttggagatccgagagaaaacagcctttttgttgcagtgctcacctctgattgtaatttctttcttctggaggatttcttcccctgtgtatacattcctggctctgcaggcataggtgcctgaatcttgcagggaaacattcatgatggtaagattaagagtgatggagtgctccttagtgatggccattttttgcttgctaatactgtagtgcattgttctgttattaactgtccgcagtaaaatccaagtaacgtctctgtataagaacttgttaactgtgcaagacagtttcaggtcctctccttccgtcggcattttttccaagttaacatgaaacccatttggcacatctataaaataagaataaagaacttcagttcacagaaaaatcagtgtcttttaatgagatattcaaagatcttaagaattgttcgtgcacaaattatctcagtatccacattaaaaaggatgagtatttggggtaaatgagcaaacacagcaggtgggaatcaactaagttcattccatcagaagtgaggtaggaaatgcaaaacagaatagttattaggatggcattttctcctgattcacgtgaagttgctcttcaaagtggcatattttctccaacttggttgttaactttatttccctttttttttgaatcagggtcttgctatgttgcccaggctggagtgctgtggcatgatctcagctcactgcaacctccacctccagggttcaagcgattctcctgcctcagcttctagagtagctggaattacaggcgtgcatcaccacgctgggctaatttttgtactttttggtgggggtgatatttcaccatgttggccaggctgatctcgaattactggcctcaggtgatccatgctcctcggcctcccaaagtgctgggattacaggcatgagccactgcacctggcctcatttcctatttttaaaatcatgtacagtattcctactggcaagtgacactggcaagtgggcaaaatagtgaagtaacataagagcaattcatcctaaaaaccaaaggcacacttacggtcaaacttatccaaaatagtttgcgaacaagtgagaataggaagtcctaggtaaagtgccaatcaattccactttagtcctagacttttgcagtgagaagcaactgttattcactatcctcctcctgctcctgtcccagattacttgccctggtccagcaaagaccacagtgggccagtggcacagtgggccagagaggagcccgctgacttactcaggacttcttttatggggatggttctattcagacctgagagagcaaagatttcttctgaaaatgcggacaactaatctggaagagttgccagattctaaaatgggggtgatagaggggtaaagagaataattttaaaaatcaaatttactctctaacatattttaaacatgttctgaaggtggctatgtcattaaaagccattttctccaatgtcgattcccagctaatctttgttataagaaaataagtcttgggaccccaaaatcactaagctaaagggaaaagtcaagttgagaactgcttacgacaaacctgcctcccattctcttcaaagtcatccctctgctctctgagacaaatgcataccttattgcctcctttggaaaggctaatcagaaactcaaaagaatgcaaccgtttttctctcacctatctatgacctggaagccccctccccacttcgagttgtcctgcctttccaggcggaaccagtgtacatcttacatatattgattgatgtctcatgtctccttgaaatgtataaaaccaagctgtacctcaatcgccaccttgggcacatgttgtcaggacctcctgaggctgtgtcacagacatgtgtccttaactttggcaaaataaacttcctaaattgactgagacctgtctcagatattttgggcaccttcatctccatctcccaggtgtctctgtcaacaccccatgagctcttcccctccgcatgcctaacctgggccatcagttcactttggggctgagaatttcttagtatcattttggcccagtctcacgggaggattttaaaaagtctgccggccctgaactgacccgctctcaaaaccttcccattgcttattactagtggtgtatctgcatttgagcaaagaatttgggccaacatcttacaaagtgctttgaagatgaaaagcattatgttatgctattattattattatactttgcacacaaagctataaagaaacctttaaacgttaaggggacaatagtccaaaattagatatcatatcaactctttcctaaatctcactttgcttgtttttctgatttttctgagctttggctttattataaagtgtcacgtctgaagaaatgccaaagtattcatttggaacctgggagcagggcgtaacagtggcttacgaagccgtcagtggctgaggagagaggataccagtggaggttttcctgcttttaaaatgaaaatctaagaatgtgccagaagatgcaggaggggcagctgacagtcacttttaagataacaataaggtgtcagaaatagttgctctaattcagcatctttttatatttgggccattttccaagcatgaggagtaaaacatcagccatcaacttttacacagatagtagagcagaggtattgtgcactggttgcaatcaactcttacaagaccacagactttccatttatgagctctcatcctggtagttagaacccaagtgagcccaagtaacaccattgagatcgtgtagagagtttctatttactttagtgatttgaaacttcctgtggaaatagctcacaggtttcctgatggaagattttgtttatctttgccaagcaccaccaggaatctcaaaataaaatgcatttagtgacattgggaaaccagggagataaggcagtgctgttcctgtttcaccctcagtaattgctaacacacccatagtcatgctgagtgccagcaaaacagcaaaaacacacacataggaaaagcaaagaaccaaattcgttttgaggcctgtttcttatataggggacatggtcactgaagctaatttgttatgttatcagacagccttttagaaatgactatttctcagtctcacccctttggtattctcttttgatccatggaagatgataaataaaaatcccagagggatttttctccttaattcatgttgacttttttttttagtctgagtacaaaaacagacccaagaaagaattgccttctaaccctcaaagtgaaaacaagaaatcttcccacacttaagtatctgtggcgaattcagcacagtcatcatcattaccaaataatactcatccatctaacatattatcacatccatggcatcttatgaggtgtcatggagaagaatcaacccttgctcagaagaggcattcaacccagggttagacgaaagtgtcatctatttataaaggtgcatacttgggggtagatatttcaactcaattggatcaggcatgtgcattaagttcatgaaagggacaagcataggaatttaaaaggacgccagggatgtcatttgttgggtaaaaataaagaaggctctactgccaccgaagagtggaaatattacttaaaaagagagtgaatggttaccaggaagttctgcttgtttcaagtggatgctatgtacaagtgtgtgccaaagtttggagtcgaagcggtcaaggattctaatggccacagtttaccattttcatcaatttggaaggcaactcaaaaaaatttttgtgtttgtttttgttgttgttgttgttttgaggcaggctctcgctctgacactcaggctggagcatggtggtgccatcatggctcactgcagcctcgacctcctgggctcaagtgatcttcccacctcagcctcccaagtaggtgggaatacaggcacgtgccagcaggcctagctagtttttgtattttttgtagagacaggattttgccatgtttcccaggctggtctcaaactcttgtgctcaagcaatcttcccatctcagcctcccaaagtgctgggatgacaggcgtgagccattgtgcttggccccaagtaactgtattttaaagaaggggcaacaggattgaaatgaggaccagtaaagatccaaatctagataagaagagcgttaaaattttagacaggcacttttaaagcattaccctcactgagtcaagtataaacactgaacaaatatatgttcatttttttcaaaaaataaacatatgaggtacaacattcatgagtctttactctcatctctagtgacaaagatttgagtgagagaaagataataattatttaaaaactaataatgaacgtaagcaagttaacctaatatcacaatcaaaaccagaacttttcaggactggtagaaaaggattaagggaaagtatattccaggcaatgagggcttggttgactggacttgtgtcagttttaaagttaaagctcttggatttctagaggaaaagaactgtgagcttcaagtaggtatgtctgaatcgaattctcattttgtatggataagccttgggatctagaagaggtttccaccccgccatggttatacattgtacaatatggtgagaggtaggagggaatttctgcctgaattcagcaggagatcacctttatcaacttgggccctttcagcaacaacaccatgggtagaaatatgatgcagcgatgagactctgggctagccagaggttggtgctgtgactaatgctaggcatcagttagctttcattgggaacagtgattaataaggaagtgagcatgatgttccccttttctcttagcacatcctcttccagtactgccctcagacccaggcaagaaggatccctgtcgcagctctgttctggtcgcagctcttcccacaatgtgaagagtttatggggccaagtgagcatgcctaccgacagcctgtgtcactccattcctatatcatgatccaggtccctgggatctcagaattccctataaggctgatttaaatctgcttctaggttggctcttccctaggtctggcctcctgagatcagactgcttgtcagtattcacacctttgggtctgtccaggcagtggccaaaggagactatctgtgaggggcatggggagagcttagatgtgtgggctgggagacaccacacatggtgcatggccccttgcagtgtggacagggtaaggggcggagaggggaggtgggtgatttagtttttctgcacggccaggtgctgccacaatctgctctggaatctgagtagtctcagagctctaaattgatcctgacctctcaggtcatcatgaaagtatatttgtccatagggggctaaaaggtatttaatggcttgtttgcttgatgtagaacttgtcagtagttagacgtatggtttgtgggcctccactggtactcttgtcttggctctgaaaatgtcagggcaagtctgttttcttctctccacctattcaaatcccaccttctctcttcctgttcaggtcctgcttccttctcagaggcttacagctgcactgtccaatatggtaactgtgagccacatgtggcttttgagcacttgaaatgtggctactgtgtcagaggaactgaagcatattcagtttatttgattttatttaaattgatttaagtgtaaaaactgaagcagtgtaatatttttaaaaaatactgattacatattgaaatcacaatagtttggatatattgggttaaataaaattaattttacttttaaaaaaacgtggttactagaaagttttaaatggtatttgtggcttatattatatctctattggacagtggtggctttagaaagcaagctcacctgtcacattacctctgcacataaattttgatactaggatatatgtaatttgacatttcttgtttgtttccttggtgttagaaacctgttcctagaaagacaggacttcattgatgttcctccaagtgctcagtagagttgaactgtaccatttaacagtgctgattaaactgttacaaagttattgaatgttcagaacaaaacaggaatttttcagtcttttgtattctaaatcagacatactacgactatgggttgagacagtaacttgtttccaaccaaatataaaggacagtgcaaacctttgtatttaattagtccaaatcccatttgctcatctggaaaatacaagagctatgatgcagaatagcctctagaatccctgacagccctgacgttctatgagaatctactcagggatatctcccatggcacagcttctctggggcttggctaacttgccagaggcccctgtgatctgacaacacatatgtgtcatggaattggacatgtctatttctttctggagaacttttggcaatttctgcagcctgccccgggcagtgagaagtttccagaaagttggcttactgcccatgtttcctcagaaattgggggagtgtggagccaggcaattgtttttatactttgagctacttacttccttcctgtacccattgagggacatagggagtgccatttgtgtaccttggaggtttttaagatttgcagagaccatcatatttaaggctaaaaattcttaaatgctatcaaaaaatagcacattaactattgttaataaagctctgtttcagattgctacagagcctcattccccaaaaagtctaaattacctaagttgtaaaaaaattaaccttttggttaaaacaaaaacaaaaccaaaaacgatgtcatcatattatatgcattataattggtttccttgattggtattgaactgctatgtaccagaccctgtgctaggtactgaagggaatgaaaaaatgagcatacaagattcccaattcataatccagtctgggagggagacaaacacaaataactctaaaagagaatacagggaaataactccttacgagatccgatgaggtagaattctattcctgagagcaaggatgaaggcactcaaagtttgacaattctatggaattaaaaaaaaatcactcaagctataaatgcactaaaagcaaacaagactgaagagagaatgaagtcaccaggctgtctctggttataggatgtgtggcttacctgtgatataaaagcttatgtttcttcccacagtcccaactttattggaagctatgcaaatgtagattccagaaattctagagtcagccacaaccaaggtgctagccatctgcaaaagaaaaggaaactttagctagcaacaggacaaataactaattgaacaccccaagctacttctgaggttgaaatgattcagctactccattcattctgcaaagagagtattgcataggtggtggttaccagaaggctctccccttgccgagccccaacaagaatggaaaaataacaggaaagcaggtcctcaggagaccggggcctatgacatccgactcatatgagggtttcaggcttatttatctcgtgctgctggcgtaacaattacagacctgaagctgagatgtgggactgcacgtcctaccctatgaggtggtcagttccacatcaatgagaggaacaggtgaggctgaggccttcccttttgtttgggtgacctgagagcatagatgccagttataacaggagccttctctgctgtttggttctataacaggcatgttaagtgagcaaggacagaagataatgtttggctgaaacttttttttttttaagaaatggggtcttgctatgttgcccaggctggccttgaacttctgggctcaagcagttttcccgcttttgtctcccaagtagctgggacaacaggcacatgccactgtacctggcttgaaactttttttctatgctcaaataatgtggcatgcagcactggatggtcctgaaggagaccgtgtgtgtgtgtgtgtgtgtgtgtgtgtgtgtgtgtgtgtgtgtaaattacctaatttctcttaataaattaagtatctattcctaatctagaagatgaaaatttaaattatgaattaatgcaattatattgttccactagactttagtgctattatttgacaacttagtccctaaagaaacattagcagtcaaaattgcatgaacttgaaagcactttccaaattctgatgtctaaaaagtaatgaaacaaaattttagacaacttaaagacttgcattcttccaaagaaaaaaaattggcaatatgaaacaaattgttaaacattcttaaatttaacccaagcttgcattaaaaagtagtgtataatctatatgaaaaaaatgagaaagctagtttctcatacttaaaattatggaaaagaaaagttagtccagttacttataaatctttgcagcctatgtcctaggacaaaaataactggttatgggctttgaaattgcagaggctgtgcaaatgattccagactaatagagtgtccttgctgaagtataatgacaagtgacttacaggctaaagtaatgtaaggctgaaatgtgacagctgactttccaaggtggtggacatactctacaagtggtttggctgtaggagagagtcctaacattttcttgagtttctaagtaatgtgctaggcactttagttgtgttctcttatcccatctaataaattaaggtatttctgtctttaatctacagatcaggaagacttaaacacatgttcctcatgtttttagccagcaaattcattggtccaaattctctacaattttcactgtggtatagtgagtagtacacagtgctttctcttctgtttgttggaaggatctgcttaattacacctacccatatactccctgtgtattattgaaattattggtaatgaaagtgtctgcaatatgtggcagacaatttagcagacatttattgagtgattatcaaggcattgcccagatgttgtaagagagacagagatgaatatgacacaatccctcccttaacattatcattctttaaggtgatagagaagaatttccctccttgaagatcatacaaaaattattctctcttttgcaaggaaagcgcatatgaaggcaaataatccatgggaaagtgtacgaaagagagctcaggtgtcccttttcttattttgatgatgaatctttttaagaggtgggacataaaaaattctgaatagccatttccttgtaattgttgtacccacccgtttagagtcacggaaggaaatggaagtagttggaagagaagcttgtaggtggcaacatgaaagaactgttagctggtggaagctggaagacaggagagatcgtcaaatacgactctgactcccttacattgtctcaggaagcttagacccttcaaagcagtatgcaaaaaattcagaaacaaggagctcagatgaagcctttttaagctggggtgtcagctccagcactgttttttttatgaagttagttctcaagtgtttatcctaatgggcctcaggagaaacttacttagattctcagattaattgttgctcagtaagtaagtgaaaaacccatttctgttggcttgggagtgtttgaaattatggacagcatttatctgcatctatgagtcatgtttgggtttttatttaaaagattttgatttcattgaacttagagcaaccgagaacaagaactgggtttcgtggcaagggaaaatcaagtcagatgtatacatttgccacatttaagacctgtgtaggtaacctgggaatggccgtggccattttacaagtccccaacaaatagtcaaataggtccaaatttatgtataatcagagaataaaactgaggtgccccgaagtgaaatgaatccgggtcacaagatggagacagaaatgtattgaatttttcttcttttgtgtgaatgacaccttccaaacaagacacattactcgtagtcaagcctgccccagaaatcatgtctccaaagcttctattaaaatagaagcagaaaacaacgttgatgggagtttacattatttctttgtttctgcgaacctttatgtatgccttacaatgcaccaggcagcatgcaaggcactttacaggaattgtctcatttaatcctccccaaaaccctgtgagatgggtatattaccctattctacaggtaggacaactgaggttccgagagattagatgattcacccaaagatgcaaaggaccacagacaggcctgggcagaatttatgctcaggtgtgtctgcctccgcgcctatgctcctaatctctacaccagattgcttctcgccttgagactctttaagttgaataacacagatctattggcaaaattctgtctacacctttaattgaatttttccttgagaatacttcctttaatccgcagagatgggtaacataaattaaatactactactatttacagaaatactagttggcttctctgatgacattttacataagctgcaagctgctcttcaactgttgttatgtggtttgaaaatatatttgataaatacaatggttatcactaaagaagaaaagttaaaaataaggtgaaacatatcctatgatcagttttattaaaatttatctcatttctagagtacttctctttcaggggatatatttttaaattataaattcaaacattttctcattaaaaataaaattatttgacaattaaaatttaaactttatagggccagagaaaggagctcaggtgcaaattgtagatcagtgtagtctggctggactagaaggcagctttgcatgagacagtgagtttcaatgtctgagtcttctgaataaaggaaaaaatctgttcctcagtccttatatccaaatactatggtgttaagggaaaaaaacgaaaatagcatcacagttagggcatgcaatatcaactaaatactttcaaagagaaagtaaccaagaatttgagttgtgcgtttgaaattataatcatttattctataaggtatgcaaaaataaattcttaaggatatctacttgtattagtgctataattagttttcattttccacaattgaaaataaatgaaagaggactgaggaagagaaaaaagcagaagtgctgaaataaaattagactattaggcctgatgcggcggctcaggcctgtaatcccagcactttggaaggcagaggtgagtggatcacctgaggtcaggagttcaagatcagcctggctaacaagacgaaaccctgtctctactataaatacaaaaattagctgggcatggtggcaggcgcctgtagtcccagctacttgggaggttgaggcaggagaatcgcttgaacatgagaagcagaggttgcagtgagccgagatcatgccaaaatacataaataaataaataaataaataaaattagactatcaaattttatattagtcttaaaggactcatgctttctactcttcatttttactgcttttgctttttgtggtgcttccagttgcctggcctggccctcaaggatttacatgttagagacagatccttcaagcccattctctaggctctttggtatgacccaggaatgctcataaaactatcagcaagtactgtaagtttggagtttttcatgttccttccttccttccccttcactaagcattagtaattcgttactacaatgttgtttgaacctcactgaatagaatggatgggctgatgtgtcattcagcctaattccagcactcgttttttaaacatctatatatggaacactgattttaatctcgggatgtttctaatatagcttcctttcaagtgtttcactgagaaataaaagtagatgtgtaaaggtcatggaagaatctaaaattaacacagggtggcacatttgagccaactgatgggaaaacagaacgtgagatttagaaaaaattggggtgtgtgtgggaactgaaacacaagctgtaattctgtggttaggattcttgctcctgtcatggatttgtctcatacaggacacatttctcaaggtacactcagaaggatttcaatggaaatattgctaacacattaaaatggtaatgattctccaaccttacagaattaatgctgtgataacgtatttcctgtgtgttttttctaacacggggttccttctacttcctactccatatctacaaacctaacagtttggcaacaccacttagacaatacgaaagtgcacatttgctactagcaactccagttgatgactcacttttcacaaatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgatctgtggagtagcattgctgggcaggctaccatgtgacggtggataaagggatcaccgcagtctaagctgggactttaatttgctttctaaaaatgtatagaaaataaaaacagttttaattgtgaaggaaaaagcactgcatataattcagaaacagcaaaacttccattttgtcaccatcatatgacagatacattttttcacacccacaaaaagatatattagtagatgctaaaagtaaaattactaaattctcctaaattcaagatatgaactcaatcattttatttaaagtctaatatattacaattacaactgctaatgggatatgtaccatatatatagatataaaatatatctatatatatagagagagagactttgtttagtgtgagtattaaaagttttttcagtgcaaacaattgtttaacaaagtcttcattgtatatgatcacaatcagtttagggaattgcataagggtacatatgacattcactttactaaagtagtacttgtatagggctttctcattatgttatgttatgttactttacgttacgttacgttatgttatttatttatttactttttgagacagagtctcactctgtcacccaggctggagtgcagtggcacagtgttggctcactgcaacctccacctcctgagttcaagcgattcttgtgcctcagccttccgagtagctgggattaccactacgcccggctaatttttgtattgctagtagagacggggttttgccatattggccaggctggtattgaactcctgacctcaggtgatccgcccgccactttggtaggtgatcggcttaccaaagtgttgggattacaggcatgaggcactgcgtctggccttcattatgttatttcatttcatccttgtaacaggaagtactagctaaggcaagtatcattagttctgttttttttggaggaaagaactcaagctgagagaggtgagctggtttgtatgtggttatacagagaggaagtgtcgtagtttgactccagggctcctgatggcaggttgggtagcacaagtgcagaggtctatatttaaaatcttctgcgtaactgtaaaattaccagacaataaatttgttttaaaccttcatggagaaaatcttgggacgttcttttatcatgggcatgttttgatactccacctccactgatttttataggtttttacattatatatggagtcaagttgccacttcatggtttgggttagccagaaacttcacctagctttctcatttttcatttcatttcctattgtatatttttgtggataggataccaaaatagcactagaagttaccactgaaattaagcttataaattcttgtgttaatatccggcagttaacagtacatcctcctgacatggtcaggaaaaagcaaaatgaattgacacaaccaatgaatggcatcttgacatttttctagtactttgtgacaactaatttgctgttcactgctaataaactgaggtagtttccttattaaaaatatctgaaggccgggtgtggtggctcatgcctgtaatcccagaactttgggaagccaaggcaggcggatcacagggtcaggagttctagatcagcctggccaacatggtgaaactccgtctctactagaaatacaaaacttagccaggagtgatggcgtgtgcctgtaatcccagctacttgggaggctgaggcacaggaatcacttgaacccgggaggcagacgttgccgtgagctgagattgggccactgcactccagcctgagcaacagagtgagactctttgtctcaaaaaaaaaaaaaagaaagaaagaaagaaagaacaaattaaactttcaagtttatataacttcctctaagtatttcattaaactgctctcttatcaatagctatacatcacggactgttttaaagtactgcttatttctgtcagagaaaaagagttgtaaaccacctacagctactgctatagttataaaaacttcctaagtgtttaataagagactattggtgttatcatataagctattgccactctgactaatttctacagtggcttacttggctataagggcattaggttttgcaaaggaaagactttggtttgagtctctcatttatacttttaagctgtctttgggttaatcatcttatcttccctgttttatctttaaaatagagataaccactctcatctgccaaagaatgatggtgacattagcatatgtcaaaaagtttcacataatgaaaattatagatgttatttgttgttactgttaaatcatacatgaggaacgatgccatctactttgtcatcttcaagtgcaaagtgtacggctgaatagatgacataagcatacccacactcaagcaggcagtggaatctgtattaacagtctctactccaaatcaagaaatatatatgtaaacagacatgtcagcaaggggatacttgatatgttttttctttttaaaagaatcatggctgggtgcagtgactcacgcctgtaatctcagcactttgggaggccgaggcaggtggatcacctgaggtcaggagtttgagaccaacctggccaatatggtgaaaccctgtctctactaaaaatacaaaaattagccaggtgtgatggcaggtgcctgtaatcccagctacttgggaggctgagacaggagaatcacttgaatccaggaggcagaggttgcagtgagccgagatcacgccatcgcactccagcctgggtgacagagtgagactccatctcaaaaaaaaaaaaaaaaagaaaagaaaagaatcactatccctgtgccagacaatagcagatttttaagtgtattctttactaattcaacaggaaaaagccactaggtctgagatccactgagacttgcctagctgacaggcttgttagctattgccaagcttcagtgggggttaggggagtataaaatgaatagtgcgctgatgaggtcaaggaatcttgatagattgtgtgtgtttgcatatccccctcaactcaggctttgctcttgcagacagagggaaatacatgatatttcacaaaatagaaacattcagttttagctctaagtcttgcactagcttttgcttactgggatcccactttatgtacatcagtgattctcaatccccgttaggtactggaatcacctgggaagattttacgagccctaggctgcactccggagatttggatataataataattggtagagtattctaataggcagccaggactgtgaaccaccaatgtggaccagtttgatgttcaagtggacagtgccatctctaccattaggaatgagtactcattatgttggaactggtagcttgagtagtctctgtgtgtatctccatgaagacatagctcagatattgtctttcttctctctgaatttttgtttgaacatttaaattacttctggtgccaataaacctagaattgggagctgagagtgtatttgtggaataaatatcccagtgcgcatttttacaaacaataccttattctttccttctattattgccatgcgctgagtgatgctctcaattctgtttcccatgttgctgtcagcatccaggataaaggactcttcattattggaacaaaagtcacacctattaaaaaaaaaagttgtcacaatgtggctttacagcatggttcagtcaatggggacaggtgaaatgaaaacttggtgtaagtcctcagataacaaagtcacaaattttatgtgtgatcttcttttccttagattttttcctatattcatcctcaaaacttaaaaatagcaaatatatttggctgatacttgaaaaaagccccacactagtgtgtcaccatacatccttttcgttgtaaatgttaatattaaataaaaatgcataaattagaaaatttagtatctagattttagtttttagtggaagtaacattcaaacacggaaaaaatgaagttatgttaatgaataaaaaactcaaggaaatcataccattttatatctataaaaggctggcttttaatcagaatatgcagttggatggctaagtttttccagggctaattaagtgcatatggaaatcaacatcatgaaacagttattaaattcagtctctctctgctcaagttttggggaactgttcaagctctcaggcctcaagtgtttaattataaaataaaggtgttgatgttatttatctttgaggtccatgaattctctctctgttttaaacatttcaccattttgcattctgactttctggactagaatttttttgagcagaaagcttgctggtctctaatttgcacatgtcttgggcagattctacagattttttaaaccaagaggaattttattattattattattattattattattaatattagagacagggtctcactctgtcacctaggctaatgtgcagtggtgcaatcataggtcactgcagcctcgaacctctgggttcaagcaatcctgccgcttcagcctgtagctgggattataggctaagtgaaattttcaagcttcatttccagaaaaaaatgagtggttcatctttagcagccaagagcaggaatgacttatgtgagaggaaaatgagaggctaaagtcagtgagaaaaaggggaagacagaagggaatgtggtcagaaaaacgttccgttactattcctccctggtccttgagctgagaaggaactccagagtgttaaactatcgcatctgcaggggtactggccctgtaacgtcctcctgcagagtactcaccaccttttaagtgctgacttaatggttctgagtccccgctgggccaacagctacaggaggacaggggacaaatcgacgtattcactctgtccccatagctaagcagggcccgagcatgccgtcggcgccccataaacatttgcacacatgcagacaggcacaaggtacccgaagttgtttttgctaagagtttctactttctttaattgtttattattatcaaacacaccgataagtagagagaatagtgtgatacacccccatatacccgccacccagatttcacagttatcaagattttgtcacattggtttcatctaccccttttttttcttctgtattttatttatttatttattttaaaatttttctagcctggccaaatgaaggatttctgtgttttaaaacaaatctcaggcatcttgtcattttagccctatgtacttcagtgcatctctctaaaaaatgagcaaatttttccaatataaccacaacactacttttatacctaagagaattagcaataattccgtggtggtgtttgcacctaaaccgtatatcagatttccccaaatgtttttaaagatgtctgtcttacagttagattacaagatttaaaatttaaaaagaatgaataaaaggtgaccattcctcaaggaatttctgcagtttttaccaggtataaccttataataatcatgaggtaaaataaatgaacattttaatgcttattgataagtagagtaaactgagccaaagagaaattatgtactttctcctttattagaaacatcttaatgacaaagtttaaaagtcattatatgagagtcactttgccttattttttcattatcatattctccattttctagactataacatccccatgttaatcttgcgttagacttgctatctttcacacactcgtattacaggtatgagtgtatataatgtgcacatatacacatgtgtatacctagattagacatttgcatatgtacttgggattgtgacatcaaacagctaaagttctcttgtatctggaagacaagcttttagattgtattccttttcccccaaagcaaggaaaaagatcggggataccttagtcaaagatcttaatttcatactcttgggctttaggaaatgcaaagaaatatgttagagtaaggcaagcctgggtgtttctcaagggaaatacagtctgctatctgagttcacttggggctgttgacctctgacaccccacacctcccccatcccacacccatgactctgagggcagttactaagggcacaagccctagtatggaaactataggccagacttattgccagctcttccacataaaaaggacagattctgtggctattttctaatttaggggctgttatttttccctctttgtaattggggctataaaaatagaatgtcatttagaagccttactatataacagcacttgaaaagagatttagggggaggggaatgtgcctaagccttaagaatacatcaagctcttaaggaagtagattgtgccatgtttgaagatgcaaagataatcactgtgctgggaactgtcttgaggggggaggaagccgaacaacaagaggaaagcagcgttcgctcctgatttcgcacaggaagtccacagcacctcctgccaaagcgagataagaaagctcccatgcactattctggacaaggccactgttatcagcctcagctcggcgctgtcctctctttgctccaagcctccgtccctttcctaatgagctatatgactcctacctccatttgcatacagcatgccaagtacaatggcagggaggtatttataacccctgaaaggaaaaaaaaaattatgggctaagagtgtactccatgtcatctctgctgattgctctggacctgaaacaacttaatttcggactagagattgatataaataaattaaaagaaagcagccaattatgtttccaacacatggagctaggacctcatgtgtgatatgtcagccttctacattccaagtgggagccatctgtggaactccccatctggtctaagttactagtcttcttctcttgacacattatgggaaactgccaccctctatatatgcagatgacactactgacctacatgctttgggttgattttcttgtaacagtgatgaatttgccctcttcccaccacactcaaaagtatttggcttctctgtgaccaaagacagatgaaggcagtctggggccacagaaaaaggcaaagccaacagaggtcaaacctacgatctttctttctttctttttttttttttttctgtcacccaggctggagtgcagtggagcaatcttggcttattacagccttgacctcctgggctcaactgaccctccaacttcagccttccgagtagctgggactacatgtgtgtgccatcatgcgaggataatttttgtatttttagtggagatggggtttaaccatgttgcccaggctggtctcgaactcctgggctcaagcaatctgcctgcctcagcctcccaaggtactgagattacaggtgtgagccaatgctcctggccaaacctaccatcttgacagtattgactgctggcagaatttgtactcagttctggatcatttcagaacctgtgcacttgaccccaacaccataagtaacatgatatccatgtactaccatcatgtgacaagaaattattatgcttcagtacttcttggacatagtaagaaaagacatctcaaatattcagtacacaaataccattactatgttgaggattccatggctttttttttttttagctacttttgcataacatggtcagtctctttccaaaatttgctaaacatctctcatctcacacaaccaaaatatgttgaatgaccagtgcatgcacagtctgcaattacagtttatattacagtttctatgagagctcactttgtcaccctgcagttcctgaattcaagacaggttccattcacctttacaaatccaacactcaatgaagtataatgcacaatgcacacccaaaggtacccctttgtgttcacctgtgctttttcttaattgctggtttttaacaattcttatttttagattttcttcactcctcctgccttcctctcccctccccctacttaaagctcagagctggtactttctttcctttagaggatagattgtcacatctggtggaatcagaagggaaagcccagctgggtgagcgttagctactgatagtaagtattgtgttttctttgaagtggttctcttgtgaggaaatgatcgattctcttggagaattgggtgggatggttcaacacttcatttagcctttctagaaattgcccatctgtttagtgcctgttatggtacccaagactcctatagcaatccagtataaaattctcatttcataaatgatttcctgccagtctaataaccacattgattctagaaggtctgctctacagccttagtcttaagacacacagatttttttaaaaggatcctctttcaataaatgatattaagctggcatttcaaatctctgttgtgccaatatctgattcttggctgcttgaagggaaacaagttttgtgagctgctactatgtgctactaaagcttgggctagaagcaatacacattttgcctcaattagttctcacagtcaccctatgaagcaagcattatgatccttatttcataaatccttttatcaataaggaaactgagactcagaaaaatcaaatgctttgctcaagttcacagggaaaggagcagaattaggatcagaacccagactctcctaactcttcactatcccagagctctgtgcatcacgtagggtgacttctgatcccaagaaacctccccagacctttcccaccatgggagaagtctggctcagagtcacctgttacagaggaaaactctggggggcctctaaattcaaactagcacaaagtcagacaccaggaaaattaaatttatgtttttaagagggagaaagaagatgtgcctgtctatcggtggacaaggacaggggcaaggggcagaagactactttatagttacatttttggcataaattctagttcgttttggtcataaacatgctttgatggtgaaattataggaactctttaccttctactggctgatacattttatcattaaaaaaaaaatctggccaggcgctgtgactcacacctgtaaatcccagcactttgggaggccgaggcaggtggatcacctgaggttgggagttcgagaccagcctgaccaatatggagaaaccctgtctctactaaaaatacaaaaattagctaggtgtggtggcctgcagtccagctactggggaggctgaggcaggagaatcgcttgaacctgggaggtggagtttgcagtgagccaagatcatgccattgcgctccagcctggtcaagaagagcgaaactccatctcaaaaaaaaaaaaaaaaaaaaaacttacaacaaaataaaaccatccaatatttatcacaatttttttctctccttggtaacatatttttgtctgcatgctcagtgagcatgttctgggatgaagctggcctgttttattacaaactccaacactagaatgagtggcccggggacaggagtgtgggtgagtggtgatttgagtacccaacacccgatggctgcctatttgagccagagccattgtctgggaatgaatgtttatataaatgtataatgaaagcacatttaatttggcaacaaagagggtccagaaagttctacaaagtctcaagacagataataatctccttctctttttttcttttttggatgatgaaatctgaggacttgtgtgaactctgcttatctgtttaatgagattgtactgcacgtgctaactgtgattagaatctgtttgtaaagaatattgaatcatttcaagctaggaaacaaaaggatagaggagtaatgaaaagcaaattgaagctgtaaaatgtcttttaaaaaaataggaaggaaaaaaaagcccatctggaaccctgccagagggcacaaccggggctggcccccattatggcggccatcctgtagcagggcctgatgtaaacattcctctgctactgtgggtgtcgtgtcaaaacattagcgattgtgtgtctgagccatcagattaacagaatctgcaaacactatctttcccccttctctttctttttctctttctctttctttctttctttctttcttttctttctttctttctttctctttctttctttctttctttctttctttctttctttctttctttctttctttctttcttctctttctctctctctttctttcttttttgagacggggtctcactgtgttcctcaggctggagtgcagtggcaccatcctggctcactgcaacctccgcctcccaggttcaagcgattctcctgcctcagcctccagagtggctgggattacaggcttgtgccaccacgtctggctaatttttgtatttttagtagagacgggttttgccatgttggccaggctggtctcgaactcctgacctcaagtgatccacccgccttggcctcccaaagtgctggggttacaggagtgaggcaacatcccaggcccctcacgttcttttttttttttttttttttttttgagacggagtctctctctgtcgcccaggctggagtgcagtggcgcgatctcggctcactgcaacctctgcctcccaggattacaggccagagccaccacggccggccacgttctcttaaaacagatgaaacaatataggagagtggatgctggcagaaaaaggcgtagcattggaaggagtgtttagacagaatggttcctgctcctcttgctccaggaaaagggcctgggccttcagggtggtcacagggtcaggctgaggagatcctggaggagtgactttcttgtgcagtgagagaccttgtgacgccttggagctcatactgaaaattacttcttgcctcaatggagaagggggagtggagaagagtttcgggggttgtgggctttgggtcggctccctggacaatggtggaggggatccagcgtcctgggccacctctgtttagataagagcttttccgtgagcgtcttggctcatgctgcttcctgctctcgagggccctgtggtccattcacactcagaacatggcccttcttcccagcctctgcttttccttcctcctggctccttctgctggcttctagagtgagtgccagcaatctccccgccctccaccccccaagccagacactctctccctcccagctccccactctccttcacacagtcttttccagggccaggggatcctcgtggccccgcactggggtaactgaaaggctaaaagagtgggtgtttacttggctacacccagataggagcctcacaggatacctattttgttcattcacttttcttcttagtgaaggactagttggtgaggaagggtgatttgagaaataagaaatctttaaaaaaatattaggagtgcctacaaaaaatatcctttaacacattcaagaaggaggcttaaaatagtagctgcattcactcagtggagaatattttaagctatcattatattttgttctcacaaaaaggaagagaacagcttacttcttatttagtggtcaatactgaaacatccagaaagcttttgggagtggaggtagggaatcacaggttagcataagaaacatagatgttagagctagtcagacctgaggtgaaatcatggttttataacatcctagttatgtaactgtggatgtcaaaaacctgactttgagaatcgtagtcacagaagattgctcagagggcttaccagtcttgttgatttcttgtatcattctaaaattttgtccttagatcacaccagcccacaaaatcacttttaataaattctgctttggtgctatgtcattggccaacattgagggatgttagttaccagagctgacactcactgtggaagaagtgtggtcagggagtttgcctactattagtgtcccgcagcgtatgagagaagaaatcatttctcttggatctcagttctctgaaaggtatcttatgagccccttaattttgcaaatgtttgtttcacttcttctcgctcttgacaactggaaagtaaagcctgtgggccgtaactccatactagtcttacacattttttgacttcaccaaggctgcttagttatgtattgtcctttttgtgaactacctcaaattctttgggaatggatgtgttcttagcatagccaactcaaaaaagcaaccccatgctaccatgtcttactagttttattacaggcactaaaaatgcacacataagggaaataatttaaataaagaattgaaagaagattggtttgacatcagcaaatattagggtgatacttaatgtgtaacacacttagcacagtgcctggcacacaggaaacaaatcattaatgttagttgtcagtttattatctgatttcatcgagagctacttacgtatggacagggactatattttgttcatcattatagctttggtgcctggcccaatcacttgggaaacagtgggtgagcaacacttgtcttttgctcagttaactccctgatgaaagagtggatcctgccaaagaatggccagatgagatgtggacccaatcacacatcagatgtcaaccctacctcacatcagatgtcaaccctgccatctacacttcaatcaagtgtgctgaaaaaggggctctagtgactgtcaaatgacctcacatacacccctgacctaagcactatgtcaccaccatcagcacctctccatttgcaatgatgaatattaatggatacatgggatctgccagggccctggctaacctcagcacagcagtgtcagcacctgacaaacccatagtcatggacagtttcaactcaggcaaggatgctgacatgcaaagcagtgtcatccagtctaatggcaaataggaaactgactggcaatggcctcctcttcttgcctatcttcaaagataggcacaaatattggcttgtcaataatagcaccactttgcccgggtgcggtggctcatgcctgtaatcccagcactttgggaggccaaggcagacggaccacctgaggttgggagttcgagaccagcctgaccaacatggagaaaccctgtctctactaaaaatacaaaaaattagccaggcgtggtggcgcatgcctgtaatcccagctacctgggaggctgaggtaggataattgcttgaacccgggaggcagaggttgcagtgagccaagatcgcgccactgcactccagcctgggcaacaacagcaaaactccatcttaataataataataataataatagcaccattttattcaactaaaacagagtttgctcactcctatctcatgtaagatgtaaaatcacaccccttgcaagaattagatgatttaattccttctgttatttagaaacatatatgtttattgaagagacaagtcaaattcatggaaacatatcagaatacaattgagcacaggcaagtaaaatgacaaaagcccatatactactataggctgaacaagacttgggtgattgaccatttgaatagctgaggtagaattcaccaatgagagtagatccttggatactgtaactcctttgatttcctaaataatctgaaacagccaccatttctggtcccattctgatttctttggaataaacagtcagaggacctgtcccaagatgcaaatatatttcctgggagaacattaacctaatagcatggatcatcttgtcaggacattagtgtgtatatgatgccacttcagagggaagtggctttgcagtgggcagccccagagctgcctaaaagtactagaagtaccaggtacctttcagcaaacaaacttagcactcgcaatgtaccagccactgtgctgagtacttcacacctattatgacatttaacttcctcaaacaaccttatgatgtcagtgctgttaactccatttgtagatgaggaaacccagactcagagaggtggtttattttgcccagaatcatacagccaatggatgccagtaggtggcagagccaggactcaggcaacagagcccacgtccttaaactctaaactatgttgcatctcttgatgtcaccacactggttttcaggattgtgagcttttgatgtcaccctactggttttcaggatcgtgagcttttgactaaaaatgactcattttaatgtctaagtagttgtgacacaaccaatcctggtagtgacaaatgatatgctttcaattgcctggttgatgttgtgctggaaagctgctcactttcaggctctttgacatgttaaccaggactagtgtcctaataagatactcaaactctctacctgatctggaaaatggtaataattctagcatttctcttagagaagttctgtgataattaaatgagatgatgcatataaagcacatatccagcacttaacaccacataggtaaatgcttaataacttagctataaagaaaataaaaataggaaccccaggctatacagcctctatcagccaccatcttctattatatttggctctagatggtctttaagtaccaatttttgttttcctcatcctacgtgttcaagtacttttttcatactcacaagggctgatttgtcaataaggtagcaatcagtgatcatcttatataattttcaatgatgatgacaaggcaaatggaacattaaagacctaagaaattggaataacatgcacccatgtaatgttttttaaaagggtgagtgaaaacccaagactttgattttcaggcatggagggtagagtttctgagatacagtgcgcatactgcaggctgaaggagtgccacaggtagaagaccaccaataataagtctgtgaaagtccatcagcctggaaggagggacaaagtgggcttctggccaatagatagcagaacatccaggcactagccaggtagtgactgcctgcctcaaccattcagcctctactgaaaaaatttcacatcaggtccaaaattacctttccaattttggtttttattttttctcaaccaaatctgatgaaccaaccacattcatctctggcaagttcttttcaactttccaacccgtttgtatgcctgtgttactgcatcacatctttgtccctctccccttccatttaactttccaagatctacccatcctcttcagggcccggatcccacctcctccttggtgcggcctctaaactgcaacattcaccatctaccacccatggtcggctcgtttggccagattataagcacctcccatggagactcaatacagtgttatggtggaaataatagtaaacaggaaatcagagacatgcatctagtcccgagcttgccattaagtagctgtgagatgagataactatttatctttgagccacaatttctcacctataaaacaatctctttttaaaaattaaatctttaacattccttaattccgtttttttttttttgagatgggggtcctgctatgttgcccagggctcctgggttcaaacaatcctcccacatagctaggattacaagagcacgccactgtgcctggctcaacattcttcaatgctgagtgaattaatcgtttgaagtgactaggtcaaggcatgccgaggctgaaattagcagcctctatgtccccatttcattccctcatcaactacaaaccctcatgtttcctccttcattttcttttgacccctccttttcatctcctttaattgctctcctgactaaatagccatgagttttgtgaggcccactgagggctgagtgcttgctgaatcctaatccaggacattaattctgaacaataaatgagagaatggggcttccctgccctgcaagagatcaaatacccctggatggtgggaaaatcacagaaaaggacaatacgaataggggaaagtgccacaataagcaggcccattaactgttagttagacttgccaccctcctgaggctggtcttatttagacctgctcatcccactggagtttatactccagtttctactcccaactgcagatctggggcccaagacagctgtaggtcatcactggttctcaaagatatcatgaaatttgagcccaattcacctatttgctgctcgtctttttctcctttcctctcccatcctctgctcaactctaactcaacagatgggtcagctctaactcacgacagacaagagcaaacctaccaggttaggcaggcgccctcccaaacctattccctgcagacttcagctctttcctctgggaatccacagggatgtcctctgaggagtcctatgggacaccagggaaaaataaccttctggaagaccaatctatctagccccttgtattttatttatttatttatttaagacagggtctcactctgtctcccaggctggagttcagtgacgactgcagcctcaacctcccgggctcaagccttcctcccgtctcagcctcctgagtagctggaaccataggcgcatgtcaccatgcccagctaattttttttatttttatctttttgtagagatggggcctctctatgttgcccagaccggtctctgcaactcctgggctcaactgatcctctcacctcagcctcccaagtgctgggattatagtcatgagccactgtacccagccctccccctttataccataatctgaaaacacctgagaaataactccctgagcttcagttttacttatgggaaaatagggcaagtaatcaccattccgtaaaactgttgttcagattagagataatgtgtgtaaagggatgaacatggcttttggcaccaaaaatgacttattgattaagtctatcacagctattataatgaagtagaccattgcattcaaggtggcaaaacgtcctaggaggcttctagagaaagtatgaagaaacaagggctagtgattagaagctcattaaaaggcactgtcagggccagagtctaaatccatcatgccctttccatcttatcaatccaacaggttctgctttgtcacctaaaagggcactgattttacattaaagtcacatagataccatattttaagaaacaatctaccaagtcagtgaagatatactaaaatgtagatccccaggcagaagtgcatgttttataagtgatttgttctacttatctatcacctaaagatcttgtgtcaggacattagtttctagattcaataataaaaatgctcattcaatttttaaaaatctgtaaatttggccaaagacaatctgagaggttctgccaatcttcttaaggaatcttcacaaattttgtgtcactatcttctggtaacctgagaagctacactgaatcttgctgaaaagatcactataaaaaccatccagcggccgggtgcggtggctcatgcctgtaatcccagcactttgggaggccgaggcggatggatcacgaggtcaggggatcgagaccattctcgctaacatggcgaaaccgcgtctctactaaaattacaaaaaattagccaggtgttgtggcacgcgcctgtagtcccagctacttgggaggctgaggcaggagaatcacttgaacccaggaggcggaggttgcagtgagccgagatcgtgccactgcactccagcttgggcgacagagcaagactccgtctcaaaacaaaaaacaaaaaacatcccgcatagatttcctgtgactcagccttttagtttaatttaaaacacataatgaaatgtttgatagcaattacaggagacagttaactcattagaaacaattattcatcatattcactgtattactaagaagagtgggaaaaggaggaaaatctcacaaagcagagaaaagtggcaaaggggcctttggcaaaagaactcatgctctgttctcaggactttgtatgaaatattaataagggctgttgtccgaacagtcacattaagcagcatgcacttcctcgtccagtaattatataacagaatgcaagaagtttctcattagtaagtgaacattcacttttggcttgtgatgaaagcctcctgtataagatggccagttttatttggctgtttgttcaagctcaaagtcctgctaaagtggtctttggtcaagtggtcttctttaaagtcctcattttgattcaaggttttgtttgtggtaaattaaaattctctgtagcatggctgaattgaggctgcatacccagacacacactgcatagaatatatgttgagacacatggatggatacaaattgtatgtgtacttaggaagaatgtgatcaatattaaaacatgaggtatgtgaccgtatttccaaaagaagaggtcttaaattatagcttccctcagacatctgacctacattttgcccccaggaaatgttgactttttcaatttttatagtgttaaaactttcattgtgtaggtggaaaataaaatatgggacataaaactgttacagcataaaaataatagacattcatgttggcagtcaattaaatttgggtctttgagtacatttctaattaactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaagcacaacaaaactgcattttacattccataatttgcattcatttcttagaaatgtttggcaaaactgctcactgttgtcaaactagctctatagtaggcagaaatatcctttaagttcattaaaggttctcaggtcttatttaaagaaatgtaccccaatgctagcaatgattacaaccttgcaaatctgtggtgctctgtaactttctaaatacattacctcattcgatcctcatagtctctctatgaagtgtatatcattatctttactttatatgagcagaggctgcaagctatagacatgtggaaggcactatatgcttaacatccttatgatgctctctggctttttgctcagactcatgggagcaggtttaggaatatctatttagaagtctacctgttggctgaggatgagaaaaataaaatattccaccttattcagtgttgataacttattttggtgttattaatattcaaaagagatatcacagttttattatcacttttcttttctttctttttcttttttttctgaagcggagtttcgctcttgttgcccaggctggagtgcagtggtgcgatctcagctcattgcaacctccacctcccaggttcaagcaattgtccctgagcagctggaattataggtgcctgccaccgctcctggctaatttttgtattttaagtagtggcggggtttcattatgttgcccaggctggtctcaaactcccgacctcaggtgatcctcctgccttggcctcccaaggtgttgggattacaggtatgagccactgcacctggccccactttcctttttttaattaaaaaaaaaactaaaaagggaaagattctgctttatttcttcttggttcattacctgtatgagtttaaaagtaatcatcctttccctcctctcttttattcctaatgttttataagaacaaattctaggcaaaacgaaagccacaatattactcagtcaaaacttagctcgccttcatagcatattttactactttttttttaaagggtgacattttcagttgaactatcggtagttataataacttaacatatttacatatttattagactctaagacactaaataatttgagttaggtctgaacctctttctatagtagatacattaactgtctggccatattaaaccaattaatagttttgagctccttaaacaagtacattctgtcctcaaactaagcgaatgctttggccgtggatatacatagatacgccctttcactagagcctaaaatttaaatgccaggaattattctacgtatttgagagtaatgtgcatatattagtcacccaatctcttttgatgatcatgtatagacaccagtatgcaaatatgttaccatataactcaaaataagtgcaatggagcatttcttactcatgtgttactaaaattcctgtctacaactgaatctaagttagtctaagtgtatataaatatgtttatataaagacatatttgagaacttttggtaattaaagagggtttcatttatctataaattttagcttcatctctctgagagggtgaaagagtggttctgtttattttctggtgtacaaagtttctacatatatttctgaaacacctctaagttaactgtactgatttaaccaccaagcaccaaatctgggcctcacacaggtaggctactcaattagtacctgctgactaatgtacatcgagctgtcattcttgtacatcaaagatgtgtacgtttttggcagataatttcaagcagcaacgtattaaagaaataaagcatatgcaaccttaaacttccatttgtgatcagtcttgtaagtagtgaaaaaaaatgccttgaacagagaataattcaaatggccaacaaacatttaaggtaatgctctgagtcttgagaccattctgaaaggaataagacatgttttcaggccttggcgaacttattccatcacacagaagagagatcccttacaccacaaagaaattggaaagaaagctaatgtttacaaagttccattcgaggtggcctcattccccaaaccatattttattagcatcacttaaacccaaatttataaatattatgttctatcaccataattgttattttctaacatagttactagttctaatcctagatagaatagaaattttagatttaatattgccaaaacaaaatttaaatatatttagaaaaggctctgttattccagaaaaattcaactctacacttttatccgaatctaatagcttcaattatttagttttttttttatttatttgcatgttaggttggcacatatgtcaagaccctaaacggatgggtcgataaatattgatgcataccccaaatttgcaaaatagtatagaatttcagtagatctcactgtcttatgtgttaaacattcacagtggtaaagaagatatttaagatttgtaagtcttctctatttctattcttagaaaatgacagtcaaatgagaaatcagatgtgtggaaaacagctacttcccaggaattccatagctcaccagtaactttccactctgagagtaatacaccctaagcaaaacgagttggaattgtgggaagaatctagaaaatcaaatagccacttctatctgtttatgttaggattatgctttgtttacttttcctgtcaatctttttttttttttttttttgaataacaatcctcctgaacactctgcaagtggagttaaaagtaataaggaaaatagtttggcataatgataatccttgggcagtttcaataatatcttattgttgcacctatcaagtctattcctgttcttcaaattagctcccataaactatccttagtatcatccctctagactaaacaaaaagaggaaaaagcaaacaaggctcagtcatcaacaggatgcaaggaaatgctgcacaattagcagagggtagggatgtattcatttagcaaatatacactaagtatctactgtgtgccagccttggcccagcctaaagacacaagggtgctctcaatcagctcttagcttagagagagacaaacctttgcgcatcgagtgatgtaacaagggcgtgaacaaagtgctgttcatactgagggggaagaagtgattctgaatgaggcagtgaggagagttcacagagaaggtgacgtaagagctgagccatggggtttgataaataaagccctcttaggaggcaggcaatgggtggaggtgcatttcagacagatggaagagcaaagcccaaaagtaggaaacatagtgatcactggtgttgggaagaacttggatcataaccaaagaatacaaaatgaaaaatgggaatgctaatgcaactgacatagtggtattgccaaagtctagggatcttcagttgagaaacaggagaccagagttccaacctgagctcatgtcacagctcatgggaggaccttagttttgtgcttgtgcttctaaaactgtaaactagagagaaaaattatgaaattgttagccagtgatagggtatattcagtaagaaagaagagtagctgttgcccacctttttccaaggcagggagagcctttgcctcaaatatacagtacatcccacatgcagattcccatctgcgtccattaaaaaatcttaattccaggtgtcaaaaagtatttgaaagttagtaaaaaaactgactgtccctaccttgcttcggaatgattatggttacaggggtgccagaaccacttgattgtaggttgagggataccatatgcggtacaagtcaggatttgtctgctgcccagtgggtagagagccgggtctggaaacgatgacacggccttttcgtaaatctggggtttcactggaaaggagatgaagaacgggacagaagtcaagagcagttctaatgactttctcctgggccacacatgaaggaccacattctcactggctttgatgtcagggaaacaaacaagaaacaaaaaaacaaataaaccctcctatttgtcaagaaaatgcagatttttaaaagtagtagcagggttttgagattattaataatttgattccatggtatgtacattgtgattacagtgataaaagatcatgccgcctatggaatacaacaaacaaacacgagattgttaagatgggaacttaacgttaagtgttttttcaaatgattatttgaaattttgctatctttgatgttgttacgctgatttttgaattcataaatgttcactaatttgttgcctaccagaaccagaagaaagtatgaacagcaaacttaccattgacaattagagtggcagtgaggtttttaaacacatttgactgttttatgctcagcaagattgtataattccctgcatcctcttcagttacgtccttgataattaacgagtagccacgagtcaaatagcgagcagatttctcagtcgcaggtaacccatcttttaacctgtggttaaaaacatgatcagtaagtcatttcacacggcctctcaatatcactttgataacacggtcattgaagtttttgagctcaagttgaccaatttcaaacctttgatcatcagtgttgatttttaaaatgtaggcattaacttttgagtaaaggcagatatgatttttagactgggtaacacttcatatttattggcaaggaagaagaaataaagcgagcgaagatagaaaagcagtagcttagtgtgcccacaggcatactggtggccactgtgacttaagtattaacccagaagcaggggctctgattccatccgagatgtttttcagagttttccacgaggctccatcagcagtataagggccattgtaagtcagatcaagtagatcacttctccagataaaaataaaaatagacttttctattgtggtctcatgtggagttcttattagttttataaatggtcacaccagttgtccctttcataaactagagtgaaatcaagactatcaagatttttcctctgaggaagaacagttaaggcacagaaaaaaaaaaaacagaaagcataaacttaaagaaattttaaaaacgtattaaatactgaatcgatgcattgatatcactctgttgcacacagaactgagagtcagaggcttgggtgcttgacctggctctgctactcactgcaggctgctgcaaatgtgactaaccagtttgggctccaattttctcaaattttctagaggttctcaaagtttccttataactctaaaattctatgatttcattaaaatgcatggttctttaaataggcagttttaatccattaggagtttcttgtgttctgtataaaggtttaatattgggaacttagttcattatcatgcatgattataaagtcctacaaacaaattcccattactagtgtgtctcagatccaaagtaattaaaatgaggatgctacactttgtgattacaaatattgtcttggtattactttaaattatttcctacaacaagtcagcatttttgacggtggattgaatttttttttaatgcccttgctacttagttactgaagaaatcaacactaacagatgagcgtgccctcagacactggaagagtgaatgtacctcctggagtcatcagattactattcaatttactattaaacctaaaaatttactactaaacgtttttgatattctgaagcaaaaaagatcatttttctactgcaatggcatgaagacatagcacaaagttaaaattttctctttaattccctattaagtatttgagggaactgcaaacaaacactgccctcatatgacattgaaagccaaatcagctctggttagggagattctaaaatggcgccacatccctattgtatggattgttttgctaatcagttttgtactataccctttgtttaaaatgtaatgacttgagccaaagatattggcatttaacagtaattttgtaaaatgattgcagatcataaacagattacattgttttacatcaggtgttgtaccagtgttttaaaaaacaactgctgaaggaggttttgaatatgtatctttctagccaaaaaaaacttaattagttcaaataggccccatcgtccccctcttcaaatgagtaagtcttgtctctattaatgtttgtttaattttaaaacaggactggaactttcaacccagctgtatataaaagaattattttcagcattctcattacaagagcccacttcttcagggttaatagagcatgttacatattcaaaatgcttcctagtcattgctcaacacatcccattcaaagaatgttgacatcataggaaggtttagagatgcagaaagttagccacagtaagagactagactgaagcgagcactcaaacaaacctcatctctcgcttaccttgctacattatttccttttccccagcccttctcacctccaccacccaagaatctacagagttctgagctctctggggctgtctgaggaacgtctcttggtattttgtcaggaattcgagtcattaggctcttgcagcttcccacttacaaagtatgtcttaaactgttatggaaataaggatggtcctaccatacaacttccggcgagggaaatgccttcactttcatagagagccggtaagaccgcttgccagctacggtttcaagcacctgctgttttcgatgtttcacagtgatgaatgctttatctttgaaaggagaagtgatacatacattagaaaagaataatttccataaacaaaaccttagggcctcattcagggagggtgtaatcaatgagtaaataaacagagctgaattatgatagagcctatcaatgagcccaaatgttgatcatgaataggatactttaaaagcactgtaattggtgaacgcctttcaaatcaaatggtatcacgtcctagccacataaaacagtggcagagcaacagaaagtgaaacaccttaaatatctctatcacaataacaaagaagtgggaagatatttctaaaaatctacctggccactataagcaaggtgagaaaaagttgctctgtacaccctaaaacaaccaatttgatatcaaaaatcaactggagaaagacaaaaggaaataaaggctactgatagaattgttccatagtttctgccctccacactgtttccttttcagcaatggaaataaggtctttaagcattttctttatagaatttgcatactgaaattaagcaacagcattaggattccttgagagtaaaagcaggaataaaatagcattaattctaaatgatttagcataccatatttttatttctctaattcatggtagtacctgagaaatttttcttagataataaagataaaactcatcatctttttctgttttgtttatacagaacactaagaatttcataaatatattaggttctaaccgaattattagccataataagcatctaaagaaaggactctctgttcaattcaaaagtattaaatgtaaagagtacttaatgtggtttgctttttgacagggggaggagggaaccatggccaagctgtattcattcatgataatgtaactcttggccaacagaaaactgacttatttagagaacacagacatctacaatgattagaaagcatagcatgagttggcaacgctgaactatgcttaccatatatatgcactgaggtgttaacagatttgaatgatggtccactccttacacgacaagtataaagtcctttgtctttgttctgcattttgtcaatagtaagaacactgtagaatatgttggcatgggaattgctttggtcaattcgtcgccttacggaagctctcttatttttctagaaagaaaatgtataacaaatgtagaaggagtgagtgttcatgcttaaagttatataggattttaacatttcttagatcattagttcgacaacagcttctgttttatactaagaatcatgtcaaatccacctagagcgtaatgtttggaaactacatctgtgtctagaggtgcttcaaatatgtagcatagcaggatttatttagcacttaattttcttcaaatacactttcacatatactatctcaattgtttgtcccaacaacctaatgagattggcaggctgactgcccttttagtgatgaaaaaactgaaggaagtgataccctggcccaagttggctaggaactgaagttgtttgagcataaatctagtgtccttcctctggcacacacacctctctacacagtaacctgttccctaggcatagatatcgcacacaaacgtggacaatcataagccttagttagtgtctggcttaatgacagtgcttctctcaccaaatcaccatgtgagtttccttttttgtccctacgagatatgaaggaaaatataatgagtcttggctgtacttactaaggtggaataatgctatagtttcattatttcactatttgaacagtgcttgcccatgtcagctaaatcacagtaaatggatctttaaccaagacttggaaggtgctgtcccaggtttgtctcagagaagatcaagaattagccttaggctctgcaatctgacctggccacaatgacagtcctgctcactgttttgagaagacaagatcacattgccgtctccttttttttttaagcactatattttataactaataagttatttccacctctcaatccttccccatagtcatagggggcggaggggaggagcatggaaaaatgtctttgggagctgtccagaactgatttttggatcttgagcttagttctcctctgtgccacgtttaatacacttctacccacctgtccttttacttccccattggaacagacagacacatgttgaggccattttcttcattctcagcaataaccagagagaaaagtcaattgccactatcaaaagtcagagaactagtcccctaacgtaacagactgagggagctttctgcagctctatttatacaggtactacttcctttgccaagctgagtaacactggtattgcttctgacttgggaaagaactcatcctgtgttttagaattgcttcgcccagtactgcagccaccagccacgtgtggctattaaaattaaatgaaatcaaaaattcatttcctcagtcacactagtcacatttcaagtgctcatctgccatatgtggctagtggcacagtactggagcacaaatacgggatatttccatcacagaaagttctgctggacagtgctgttttagaagattattagcatttaatagatgtgttgtagatactcttacttacagcagcaatgctagcaggataaaagtttcttccctcttggcacttacggagaatatttgatttctattaaaacccagaaaatattgctacaagccatagcatttttatttaaatgaaacaatacctctcctagagaatagtttatgactgataagtccttaatgtgtccctacagggcactcgttacacgtttttgttgctaagttattccatttccatggcgagaaatgtcgatgaaaaacaacactagcttgaggctgatgcattaatctttcatacataatttaatcataaattgactttgtaattgggcaatctgaacgacataacaaatgattgtacttgagatatgccgcataaatcatgctgacacacaagaaatgggggctagaactactgtcaaaatttccgtaacagtttatcatagtttccccatctatacatttttaaaacaattattgtttgcaaggatgttcgatttgaataagggaacccaacgcaggcttcattcttctcatttttctgaaggacagaattgctcccctgacacttaacaaatggaatattggatggctgggttgtaatatcttttccaaacatgctccaatcaggtgcctgactgtctgccagtatcttaaatgaatgcgctgacagagacagcctcctggaaagttgttgttgttgttacaaaaggcagtccctgcctggcatttggtgataaatttctctctcatctctaaatcctacagagtagtttccaagaatgaaacaatcccttttcttccacctagaatcatgcaatagaaataccagtctacactcttcaaaacaaaacccccagacatcaaaagacagtatctatgcatatcacactcatgaaatgccaggcaaagaaagcactcaaaccaaacccaaagcttctttattgactaacactgccacaggagtcaggattttctgatttttcccatctcaaaacccctgcgggatttcacttgcttaaaatactgtcctgcagaagaaatagaaaaatgggtcactcacttcatcagggtaactccaggtcatttgaactctcgtgttcaagggagtggtagcagtacaattgaggacaagagtatggcctctaagtaatttgactgggcgtggtgtgcttatttggacatctatgattgtattggctgcaagcataagagagaaattttttaaaattaagatttcattacacagataaaaatacagagcacttcggcttatgttcatgcctttgaagcatcacttactttgtcgatgtgtgagatagtttgtcttatacaaatgcccattgactgttgcttcacaggtcagaagccctatttctttgtacgttgcatttgatatgatgaagccctttctactgtcccagattatgcgttttccatcagggatcaaagtgtcaagtggaaactgaaaaggaagaggcatgcattaacaaggtcctattagcactggttggcaatactgtttcaccagcagtttgtgaaaacatgatttttcatctaaaatgaaaatagtaaaactttgtagtttgcttataacaaactaggttaaaaactctagtttgttataattggttcttgagtttttttgcatatagcaaaagatatttgcattatgataaattatagtaattatgataatttactatcagccttggcaacaagtggcatctacccaggatagacctacttgtcatgtcagactttcagttggagcccataactctttggcctccgggaatcttcataataagctggtcagacactcaatagacaaaccaattaagaggccgggcgtggtggctcacgcctgtaattccagtactttgggaggccgaggtgggcggatcacctgaggttagcagttagagaccagcctggccaacatggtgaaaccccgtctctactagaaatacaaaaattagctgggcattgtggcaggcgcctgtaatcccagcctctcgggaggctgaggcaggagaatcgcttgaacccgggaggcagaggttgcagtgagctgagatcacaccactgcactccagcctgggtgatagaacgagactctgtctcaaaaacagagagagaaaccaattagcattttttttctaccggggctgccagattattctcatttgttttcatcatccagcgcttttaacaagccatagtttttcctcccattttgcatagtttactgaagaagtggctgtcttcaaaagagtgtaaataattccaggtcctccaagattcataacattaactcagcactcactggggctgtcattctgacgatcctgctgtgtcacaaggaaggcatcagctctgcctctggaaaggaaactcccagaagctgaagctgctgatggtgaaggcagcctcggaggccagagactctgcaatgaatgaagtgctctctaatgctcagaagtattcccaagcacggtgagtccaaacagaagaaaataatccatgatctgactttctccttatgccttcttctgacatcaagaatgtaacatttaaagactacaagataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaaggcagatgggcaggtggatctcagcctcgaaaggaagccctgggcagcaaggcctgtctgcagctgaccatggctccgacaaagcaggcatgtgaaaaggagagggaggggacagaaaattagaagaaaagggacaataagagaaatgaaagggaaagatattaacttcatgtcagcagaaatacgtcataggttagaatatttccagtatatatgtgccaaaccaaaatccctgtgaaaattttacacttctctttctctctttttaaattgtgcactccagatcgtaggcagaaaaaacagtaaatagactcccaccagccccagatttttatatgggaattttggaatgctcctgatgaccaaacaacccatctgcattagcgctcccatgaaagagaacgtttccctctccacgtggtgttttccatattaatcatacagcaataattatctcagactaatgggagtaatgccatgctattgaaaacatgacttggtaatataccaagtacagtattgggtgttaaactgttaaataatgctaaagctaacccttgaatagggctgatcttgtacttagatactgttctaagtgctttccatatatcacctgacttaagttttctaacagcaatgtgaggtggtactattgtcattacccccttcctcagatggggagagtgaggtggagagaggtttgataactcattagtttgcccagtgacaagtgcagtatgttcagagtgcaggcaatgtggcaccagcctctgctcttaaccacacttgtcttcctcctatatgaactagaccattcaagaaggatggcaggaacactgaatgagaaggcaaggtattggctcaaatgcccagtatgacctgcgaagttcctgacactctggaaaccagggtgtttttatcttgaccaactgaggagttcaactcctctggcgtttccagctctgctgtataatgactttctatttcctggcgatggcacacaaatgtagtggaggccaaaacctgtctctgatggactatgttgaaggcctacgtgagtaacaacccaggagagtgaatgcaaggaaagaggataaggagaatcctccaccacatttcaggactcagggttgatgggtgagactgaacatcattctctgaacttttccagcctaactgccacagctaccagcaccaaacacttcctgagtgcctgctctgtgatgcactgtgcgaggtgctgctctggggcggacttgactttctctcttaaagttctaagctctcagaacttagcacagttttccgtttggggagcttttatccagttctgagtcctggtatactcctaactcttactgctgattaattagctagaatgtcataggtttagtttttgtctttattagattctaccctaaatcttttacctttccatatgtacaatttacaatatagtatgaagaaaagtttcacgtatggccttctttcctccctttttccctaagagatgaagtttgggtgctcagcaggagacaggccttttatcacaaggaacttgccaattcaaaccaaacgtgctggctccttatgcatgaagccagaacatatcgatgcctggagaactgggcaccctgctgacattctgtcttctctgcagtaatctggataatccactctctgcaaagttattaatttgtgtaagcagcagaattgatttttctcacatttgcacacagttgggtttgtggcaatacataacatttttcacgatttcagttctttcattattcacatcgatttatgcttaagacaccatcattttattctatttaaccacatgcatggacataacttctagcactattccttatagtaaaaggatgttacaggaaagtccactgagaagcccaggtgtttgtaaggaaattattccagaaagatagaacgagtaaaacttcattatgcttatttgcagtgaaagtatgctgagaatagcggtgttcaaatttaccttttttaaagtaacagtgatgttaggtgacgtaacccggcagggaatgacgagctcccttccttcagtcatgtgtataatttcggggatttcactgtacatctctacgaaaggtctacctgtatctgaatgagaagaaaatgaaaaaaatatatacataaatgattgacatgcaagcatctagacactgtagctagtgtggtatggtaggcattgccacagtcacgtcattctcccttaatgtaatccatacattcacatctttgtctctgaatttggccctctgtgtttctacccagaaaaagaaagcttccctaataaaacctaatttcatatctgttgttggcctctgatcagattgccccaataccttaatatgcaatgtggtatggggggaccactgtgggaaaaagcctaaaagtgcagtaggagagaaaggagaaaattctgcatagacttctcaccacagctatgctaagtgcctcaggaagcgccctccagagcctttgtaagtgctcaaagggcatagatgcagtggcgaaggtcaactctctttggagaattcaaggtgatgcagaagtctagcaagttgaggagaggattatcatttgaatgacagaagcatgacttaaaggttttctagacttttcctcggaggctaataataatgaatgagaaggtctgagctgcttagggggaggcggacaggccggagaagctgtgttgaatgctgcatttatttcatatgtatattaggcttatttctttagtatgcgctacttacctgctaatagcaaagtctgtgcaagtgcctgcagagaagtctggaaaagactttaagcaccaatacttccttaaaaagcgtggcatttggccagtctcagaggcaaggaggattcaaacacctgttcagcttccctgtaactcctcagggaaccagaatgagtccaagatccttttagaaacattctcagtctaccctgcccttgccctcgggaatctattgacatcctcaggcaacgatctcttcgggagtcattgtgttctgatcgtcccgcatttgttccagccttatatactaaatggaaagaagtcctgtgtgaactctctccatttggacctgaaagaaccaaccaggcccccacctgcttgctggtcctgcctcaggtttgtggattacgaagctaattcaggatgctgaatggagaaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagccaaaaaagaaaaaaaagtgggccattgctgtagcctgctgaagatgggatagttttctgcacagcagtgtggaatggaggcacagatgtgagctctagagagaccctttcaccacagcccatcttgtgtggtccctggcacctatatgttaattattcccactcatcctccgggaagccttgctagcccccttccttcctgcacccttctccaccctagcccacattagggactttcccagtgttcccattgattctgttacaacacggtccacagaaccagcagtttttttctctgggtactccttggatgctacattcctagaggagaggaaatggattgtattcatgtctgtctcatgtgtactgaatgaatgagtgaacgggtatccaaccccgtccttttacagatgagaaaagaggcacaaacaggtgaaatgagttgtctagatgggcacagccaggcctgtaggccagttacttctgcctccaatctagagccccttccctggcggcaccctgaaggctgaacctctggctacgttctcttgaaggcccccatagaaagggctgccagcaggtgacaatggtttttcagagatgaaggctgatttccacacattcagtgggaaagtaagtgcctcatggtactgcatagtgttggagaaattctgaaaaagggctgaacaccaaggcatggtgtgtgagagcaggctttggggcaggctttgagtcggagggaggtggttcagagtacgcctcaaagcctgggtttaatcctggctgtggtcctgtgtaactgtgagaccttggggaaatcattataccctctgtgcctcatttgtaaaatctaagtgaaagggctatgatgaggattacatgaattaatatatgtaaagcacttagaatgatgcctggcaaatagttagctgttaattttcttattattattatgactcatttgaacttatgaacaaagtgttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgctgctggtaccagtaggtagatatgaaaatcacaaattatactcatcatcttaactatcaaaaatataaatatatattgatatagtggcataggaaaaaggattggaaacaaacatactaaaattttaagagccaggtgcagtggctcacacctgtagtctcagcactttgggaggctgaggcaggaggatcacttgaggccaagagtttgagaccagcctgggcaacatagcaagatcccttctctgcccaaaaaaagttaaaaatgattatctttgggtgttggctttatggattattgttgttcttatttaccttcttctatatttgtcagtctttctagaatgatcatgcattattttatagtaatatttttaattattaaagttaaaactcaaatgataaagctccatccatttttgcttaaggaaaactataaattttgcatttgatttacctgagtttcatcctctataatagaatgagacattaactgtcacagttaataaacttatgtgtttattaggaaatctcagtgggtgtagtaacatatgcagagagaaaaagttaatcagatagacacaagggtttcttatcagaattaaattcttcctttaaataaagttgctgagctagacattcagccatggactattgggatttgatcattcctttccttcctcttgtgagtctatatttttgtctcttttgtgcatcccaaggtaaacacaaacactaagaaatggtttaattcatttaactaaattgtaaatccttcatatttaatttactgtctccttaagcaactgttttcaacaaaggacactggcacaaaaagttcctacaggagataataaaatcagtgtagtcatttctagactaatgaataccaatcccaaatgaaaatagaaaaggttaattcaacatatctttgaatttcttctttccctttggtactgtggatccccaaaaaacttaaattttactacagctattggcctctaaaagccaataccaatttcagcactgggtccactgaaattctatccgaagatatcagaacttcagtgatttgtgtccctccaaacactatgcaaaacacattatttgtgtgacagtcaaaagtggcattataaatccactgtgtttgcaaatgagcatatgactgtagatacacacacacacacacacacacacacacacacgaacacacgaacaatactctctgggcttattaatagtatatttcctctgcaatttacttcaaggaagggctaagaatgaatttgcctgacatataataatacaaacatattttgttttgtaggaccatagatatagaagaggtcacggttccattaatatcaccagtaaaaccacttactactcccgtaggacacatctgtctttgtcacaaaattaaaaatgacttccaatcccagccagcactgcagagtgatttcctgagaccaaattggctggttgttgaaagagtgaggaagagctgctccaaagactgccggtgtactggcagctcagacacactgtcaccagggactcatgccaacactcagctaggtggaggtcacactgccctcacctctctgaactcttagagctcaaagcagtgacaggaaactggcatagaatatgaggttttctcacccactgggagtatctgggctgtcacctatccttcaggacaacaagtgggctcagacacagagaaagatcaaacagggacccttgctcagaatggaacgatgtctattttttaaatgtgttttttccttttgaaatctgtaatcatgctggcacattgaagcatacagacatagtggcccctgcatgttatcctcaatggattccatttccaactggcatcacctgggagctctgctgtgttcagagcaagtaaacaatgttcaaaatttaggacttgtgacttgaagaggagttcaagagtaaacacattgttttctagcacatgtacatatttatggtttttacaaagtttttcctggttgcctttcttttaattgcatttttatcctggtcatgaggacatctagtcattttaaaggagggtatgattttcatttactgaagatgaaggggagaggataaaaaatgaattaaccaatcccatgaaaagggttctatctagacataagagttttcacatcacacagatcttcatattgtggaccgtaagtaatactcaaggagaatgtactgattggtaaaatattttatttgaaatatgagcaagaaaagaaaacaggcaggttcttccatgacttacactgcctatcaaagccactgacaactcaaaacagagctttggagcaaccacaagaaagttggagtagttatactaacatcagacaaaatagacttttaaataagaaattattagtgaggaaatggttagtgaagatagagaggggtgtttgataatattaagagggtcaatccttgaggaagatataacaattaaaaacatatatgtacctaataacagagcactaacacacaggaagcaaaacctgacagaatcaaagggagaaatagacagttcaacaataacaggtgaagatttcaataccccactttcaatagtagatagtgggctaggcatagtggctcatgtctgtaatcccagcactttgggaggccaaggcaggtggatcacttgaggtcaggaattcaagaccagcctggtcaacatggcgaaaccccatctccactaaaaatacacaagttagccagtgtggtgatgcacgcctgaagtctcaactactcgggaggctgaggcaggagactggcttgaacccaggaggcagatgttgcagtgagctgagatcacaccactgcactccagcctgggcgacacagcaagactccacttaaaaaaaaaagtggatagaagaactggacagaagattttaaaaagctagtagaacaccagaacaacactactaaccaactatacccaacgacatctatagaacacttcacccatcacagcagggtatatattttcctcaagtgcacatgaaacattctccaagatagaccatatgctagaccataaaacaaacctcaataaatttaaaaggatagaaataatacaaagtatgttgtctgaatacagtggaatgcaattaaaaatcaataacagaaataaatttgaaaaattcacaaatatgtggaaattgacacatccctaaataatcaatgggtcaaagaagaaatttaaaaagaaattagaaaatactttggtatgaatgtaaatgaagacacagcatactaaaatttaaaatttacgggatgaagctaaaacagtgtttagaggggaatttatagctataaatgcttatattgataaagaagaaacatctcaaatcaataacctaaacttccaccttagaacattgagtaaagaacagaaaactaaacctagagaaagcataagggagaaaataataaagattatagtagaaattaaagagaatgcaaaacaacagaataaattagtttcattaattttctaaaccaaaagctggttctttgaaaagacaaacacaactaataaaccttaagccagacaagccaagaaaaaaagagacaagactcaaattactagattcagaaatgaaacagggccaggtgcagtggctcatgcccgtaatcccagcactttgggaggctgagacgggtggattatctgaggcaagggttcaagaccagcctggccaacatggtgaaaacccatctctactaaaaatacaaaaattagccaggcatgatggtggactcctgtaatcccagctactcaggaggctaaggcaggagaatcgcttgaacccaggtggcagaggttgcaggagccgagattgtgccactgcactccagcctgggtgacagagctagactaaaaagaaatgaaacagtggacattactattaaaattataaattaaaaagcattatgaaggaatattataattatatgccattacattagatcacagatgaaatggataaatgccgggaaagacacaaactactgaaacaagctcaacaagaattagacaacccaagcagacttttaacaagagattgaattgtaacaacaacaacaacaacaacaacaagctgctcacgagggaaagtcagggcccagatggcaagtcaattctaccaaacataaagaactaataccaatttttcacaaacttttccaaaaaatagaagagaagagaaaactttccaactcattctaggaggctagttttactctgatatcaaaatcaaagacatcacaagaaaatgacaaaccaatatctattacgaatatagctgcaaaaaactcaataaagtactagcaaactgaattcagaaacatataaaaagaattatatacaatgcccaagtgggatttttttcaggaatgcaagattggtttaacatccaaaaaccaatgtaattactatatcatgtcaatagaataaacatcaaaacccacatgactatcttaaaatggcagaagaaggatttgacaaaaatccaagctcctttcgtgatgaaaacactcaggaaaatgggaattgcactgaatttcctcaacctaataaatggcatctagaaaaaaccctacgtctaacatcatatttaatggtgaagcactggaagtttccccctaagatcaggaataagacatcgttgtccaccctcaccgcttctattcaatagtgtactagaggttccagacagagcaattgggcaagaaaaataaatccagattgggaagatcaaaatggtacaggtattttggaaaacagtctctgttttcagatgacatgatcttacaaaatgctaaggaatccactaaaaaactactagaattaataaatgagttcagcaagattgcaggatacaatgtacaaaatgaattatattcctatacatttgcgatgaacaatctgaatgtgaaattaagaaaacaattccatttataacagcatcaaaaagaataatgtgtttaggaatatatttaacaaaagaaatgtacaacttatactttgaaaactataagacattgtggaaagaaattaaagaagatctactaagtgggaaacatctcatgttcatggattagaagacttaatattgttaagatgttaatgtcccccaaattgatctacagattaaatgcaataactgtaagaatcccagatgacttcacagaaattgacaaggtgattctaaaattcatatgaaattgcaagagacccagaatagacaaaacaatcttgaaaagcaaaaacaatcttggaagaccgcactccacatttcttgatttcagatgaaaactacaatgatcaagacagtgtggtgctggcacaatggattagtggaatagaattgagactccagagatgaacccatgtgtctatggccacttgattttcaaggagaccattcagtggggaaagaataatcttttcaacaaatggtgctggaacagctccacatgcaaaagaatggagttgtactcttatatcacaccatatacaaatattaaccaaaaactgctaactataaaaaatatatattttatagttatataatataatatataatatattatatattttatatatatttgcaaaagggtctcacttttctaggctgaagtgcagtggcaggaccatggctcactgcagcttcaacatcccaggcgcaagtgatgcccccacctcagcctcctgagtagctcagactataggaatgtgccaccacacccagctaatttttttttaaaaatttttttgtagagataagggtttcactatgttgccagggctggtctcaaactcctgggctcaagcagtcctcctgccccggtctcccaaagtgctgggattgcaggcatgagccaccacacctggcctaatacaatattctcagaagaaaccagaggtaaatcttcatgatctcaaatatggcattggattcttatatatgataccaaaagcacaagcaacacaagaaaaaataaactgaactttattaaaatttgaaacttgcatgcttcaaagaacactgtgtagaaagtgaaaaggtaacccaaagaatgggagaaaacatttgcaaattatatatctcataagggacttaaatctggaatgtataaaatatatttttatatgcctcaaatatatttttaaaatctacatatataatatataaacatatgtttagaatacataaaaatctagatatattatgtatctatatattatatctctagaacatataaaatatattataatatacaattgtatgaaataataaaaagttgaagaactcttacaactcagtaataaagacaagctaattaaaaatgggaaaaggatctgaactgacatttacccaaagaagataaacaagcagggaataaacaaatgaaaagatacttaacatcataagccatcatggaaataccaatcaaaaccacaatgagattcactgcatacccactaaaatggctataataaaaaagacataattacaagtgttggcaaggatgtggagcaactggaactctcatccactgctggtgggaatgtgaagtagtgcacccactttggaaagcagtctggcagttcctcaaattgttaaacatagagttaccagatgacccagcaattccacccctaggtatctacccaagtgaatgaaaacttgtgtccacacaaaagcttgtacacaaatgtttactgtagcactattcataataggcaaaaggtggaagcaactcaaatgtccatcagttgattgatggatagctaaaatgtgatatgtccatacaatggaatattactcagaaatagaaagaaatcaagtgctgatacatgcatgatacatgaaagaacctcaaaaatattatgctgagtgaaagaaattagtcacaaaagactacaaattatgtattctatttatataaaatatccatgagacaaatctatgggaacagaaagtagataagtggttgtttagggctggggggataaggggtgatagctaaaggctatggagtttattttgagacaatgacatattctaaaattgaccgtgatgatgatggttgcatatatctgtcaatatgctacaaaccactgaatcatcattttaaatgggtgtggtatgtaaattatatctcaataaaacttattttgaattaaaacagaggtttagtctctttcttagaaatgatgatccactgtttcctgagctggctgagctggaatggttcccagagatctcccagggtaaactcctcaccttatgagtctttgcagcatttctctcccattcccctcctgcatccagtttaggccactcacaaaaaataaaattttcccctgtgatagaaccatcatgatttaaatatgtctttcaaggttgggtgcgatggctcacacttgtaattccagcactttgggagcccaagacagaagcattgtttgaggctaggagtttgagatcagccagggcaacacagtgagaccccatgtctacaaaaaaattttaaaaattagctgggcatggtggtacacacctatagtcccagctactctggaggctaagataggaggatcaatcgaagcccaggaattcaaggctgcagtgtcactgcactctggcctgggcgacagagcaagaccctgtctctaagaaaaaaaaatgtccttcagttccttgttggcagtccctggtgggcaggtggcataatgaaacatctctgccttcacatagatgggaatacttgcctggtgtgtgtgggtattatagtccacatggaatgcgcaatttaatatctcctagtaagctatcctgattatccaaatgaatatcttaagaacctcaactataatttatcagctaaaaatataacaactgtcgccactattggtggattcatatacaaattcaaaggtgataaaaaatctcactgagactggcttaggaatatcagaaaatcagttgctagtttctgccatccagacagacacttacatgttacacaaatatttctatttgagcagggtaaacttagagaaaagtcattgtgtttcagactcaagatgccattctgaaatgaaacatttaaaaatgtattatttgtgtggtaaaaaataagaagtgcctctttctaaaaaagagctctttgcctactacctgcctttcctcagaagaaagacattgctttttgttttgttttgttttgtttgttttgcattgcttcacttataacagcagatcgaacagcaagagcagagcaaaggagaagaattagaaaggaggaacaggagtggtggttccttttctccttcctctggcttcgcctaagccccctgggatgctctttggaatgtgggtgtctagcggcaggggatcaggaaaaccgattcccctcaatccaatgtccagcagaggcggacacatggcacactgtcaacagatgtttatggagaagatataagattgaagcaagcaagaaaggtgaaatcaggacgtattatgtacccagcactgtgcacacggacagtccctggactccagtcctcagagtctagctgagcagacacacacacacctcacacacaagaatgctcatgttgattagaggaaacagtactgatacctgccttgaagggaagtagggacctcattttaaaaatttacagctaagatctgagtaagtgagttgaagatctcagtgagagtggaatgctggctagatttaagcttgatggactgtaagattaagaatgtctcagctttctgtgctctctgggttttcacactaagctggctggcggtttctaggttctgttaaccagatgactgacctcagtcagagatcttcatcttgatcagttgagacatctcagaagaaaaagagaaagggagaagggaaggagggaggaaaggagggagagagggagaaaagaaggaaggagagaggaagggagggagggaaatgaaaaagaaaaagcaaggaactctaatggattactataaatctttcttctactgctaagatttttggccatgtcccaagtcctattatttattcccagctctgcctctgaatcataacattataaaactgtcaaaggacttttaagatgccctaattctgcctatcatgttacagatgagaaaactgaggcccagagaggagagactgtcccacaagcacaggaatacaattaatggctgagcaaaaactgaatttacgcttcctgatctgaggctagtctccctccaccacaccaaaatctggccctgacactcctcaatgactcaagcgtgacaattacatcttcaaatatccacactcagtgggagaaatgagggcccagaaacaggggtagcatggggccttctgacggggactagaaatgggaagcaacggactgatgaagactcaccgcggaaaccaagcttcagtcattggaccctctgcttagctctctgctgtaaggtgctgaggactttttaggagatggtgaggacaacctcagaaccaacagttggccaggcacggtggctgacgcctgtcatcctagcactttgggaggccgaggtgggaggactgcctgagctcaggagttcgagaccagcctggacaacacggtgaaaccccgcctctactaaaatacaaaaaattagctagacgtggcggcaggcacctgtagtcccagctactcgggaggctgaggtggaagaatcgcttcaacctgggagacagaggttgcagtgagctgagatcgtgccactgccctccagcccgggtgacagaacgagacttcgtctcaaaacaaaaacaaaacaaaacaaaaaccaacagtcacaccagagcaagccctgttttctggagcctggggaggaaattccctctcaggggcagaggatgcctggtcagactcctctccagcagggacactggggacagtgggttttccgagaggacagccccgatgcattccatcagcatagctgtgtgcggggcggcgggggaggggagcgggtcggggtggaggagggcagttgaggggaggcaggagtcaggggaggagtcgggctgtgtcgaagtgctgcgctgatgacctgcgccaccacgggactctctagggctcagcttcctcatctggaatgtgggacaggcactttcctgttcctaaactcgcgatttgttatgcattcatttgaaatgttcacactgggcgtagcacactgacatccctccgggggccagacacacgagtggaggaactggaggtgggacaggaggtgttgtggcagctgggaacgtgagcccatgcctgaaggggccgtccctgcttgctgcagtccattgttgccaagtggaaatatgcgccagtgtggctagtgtttccagtttttaaagataagtaggaaatgaaatttttacgtgaactcttctagctattaagcattggcagctaaaagtgctgtgtctgccaatcaaaacatgtgtgccagctgaatccagcctgcatacttccagtttgcaaccctgcatgcactcctgtcccttctctcccattttataatgcacacaaagttctgagggagttggggtgggagcccaggcaaggacacgttagaaagaccgggggctttggagtcaaccagacttgagcccaaagctttgacaggataatttacgaagtatgcagccttaaacatggtattgaatttctttaacttttctgtaaaggaatttctcttattgggttgtttcgaggatgaaatgagatgatgtatgtattaataacaagcctgagccggacattaataaacgatagtgacctacaccaggtgcttaatgaatcccagcagaggaaaggtcctgaggcctcatctgatctggtcccatcaagtgagtgtctgcttcctagatgcgtggggactaatcactcccaagacattccttccttccactttgggacagctttgcatgtcagaaagtgtttccttaagtcaagctgaaattcttagatagttgttctgccatctaggattataaagacgaagcttaatctctttttcacataagagaactttgaatgagactgtcactcatgtctcctattttcccacccagttctttatatttttagattaaatatttaagtcctttcaattgcttcttgccaatgaaaataataaaatcatcaaattacttcatgctcacaaccctatgaggcaggcacccattttaaagatgatgacaatgaagtgtaaagggattaataatttgcttgaaattcctatttttaatgtccctcttgaggtgtaaactaaacagcaagtctggcaccacctaagtctggcactacctttattcctggtgctatatatttcttcctttcctcccctccccctccccctcccctttcctttcctttcctttcctttcctttcctttcctttcctttcctttcctttcctttcctttcctttcctttcctttcctttcctttcctttcctttcctttcctttcctttctgacagagtttcactcttgttgcccaggctggagtgcaatgctgccatctcagctcactgcaagctttacctcctgggttcaagtgattctcctgcctcagcctcccaagaagctgggattacaggcatgtgccaccacaccgggctaattttgtatttttagtagagatggggtttcaccatgttggtcaggctggtctcaaactcctgacctcaagtgatctacctgcctcggcctccccaagtgttgggactacaggcgtaagccaccacgcctggcagggtgctacatatttcttaatgtatcccaaggttggatacattctcttggtaaatatggagtcaactgaaagtctgaagtcttttgcatgtgtgctgtctcagcaatggcttcccccatccagtactagggtagttagtgggttttgcaagccaaatacaggcctttacatgtattcctgttaaatctcattttgctaatccctgttcactgctctagtttgttggaaaattttgggatcgtgatttagtcacatgacatgattttgacccccacatttgtctcattttctcaatgtgccctcaatttcctttttaaagtcaaggaagtcaggtaagactaatatacttaaaaatcccatgtttctttcatttaacaaagatttactgagcaccttctgtgtactataccctgtgctgggtcctggggctatcatggtaagcaggacgaactcagtcctgtccgtagagcttgtgagaggtgagtcctgtgtgaaaggtcagtaggagcaccatcccgagtttgggggtgcctagggtgcttcccagaggggggatatttaacttgagacctgaaaagtgaggaagagtgagctgttacagaagagctgggtggggggagtggggaagggtggaatgtcccaggcagagcacccccagtccacacccctcttactgctctttccccagtatggttaattgtaactcattttctttgacctaccaaactgcaggccccttaaaagttgttggtatcatctttgtacttcctactgtgtccagcacggtgtttttcacacacagggattactaccaatcactactgcctcctaagtgttaggcagtctgtattgtctcatgtagtctcctaatagcccctgaagtaatactcttctcattttacagttgagaaaaccaagctcaaaaaatggtaataatgagtggtagtattaataataataaactcgtatatagtgcatactatacaccaaacaccgtcctaaatgttttgcacatatgcactcttgattatgggaggtggttataggcaagaactttgttgccatctctgccatacactagttatataaccttgaaaaagctacttaacctttctgagaaataaatggagatgactgtgataatactttcagactaagatcaggatcaaggcaaggatcttccctctcactactactttccaacatcacactggaagtcttaactcatgcaataagacaagaaagggaaatagaaggtatacagattggaaaagaaaaaataaaattgcctttgttcacagatgatgtgatcatctgtatagaaaatcaaaaagaatcaacaaaaatacccctggaactagtaaaagattatagcaagcttgcaggacacaaagttaaattcaaaagtcagttgctttcctatatacaagcaatgaaaactagtagagttgaaatgaaaaacacaataccatttgcattagcacccccaaaagtgaaacacctagacataagtctatcaaaatatatataagaatctatatgtatgaggaaaactacaaaactatgatgaacaaaactgaagaaaaactaaatgaatggagagatatttcatcttggataaaaaggttcaatattgttaaaatgtcagttcttcccaacttgatctgcagattcaatgcaatcccaatcaaaatcccagaagttactttgtggatatggacaaactgatcctaaagtttatatggagaggcaaaagacccagaatagccaatataatattgaagaagagcaaagttggaagactgacactacctaacttcaagacttactacaaagctatagtaatcaagacagtgtgatattggcaaaaggatagacaaataggtcagtggaacagaatatagagcccagaaataggctcacataaatacagtcaactgatctttgacaaaggagcaaaaatcatcttgtcaataaatggtgctgaaaaactgggcatctgcatacaaacaaacaaacaaaaaatgaggctagacacagaccttacactctttagaaaaatcaacacaaaatggatcatagagacctaaatgtaaaatgcgaaactataaaactcctagaatataacaggagaaaacctagatgaacttcggtatgacaatgactttttagatgcaacactaaaggcatgatctacaaaacaattgataagctggatttcattaaaattcaaaactcctgctctgcaaaagacaacatcaagagaatgagaagacagggcacagactgggagaaaatatttgcaaaagatacagctgaaaaaagaattgttttccaaaacatacaaagaattcttaaaactcatcagtaagaaaacaaacaactctgtttaaaatgggtcatttcaccaaagaagacctacagatggcaaataagcatatgaaaaggtgctccacgtcatgtcattgggaaaatgcaaactaaaataacaatgagagaccattacatacttattagagcagccaaaatccagaacactgccaacagcaaatgttggcaaggaggcagagtgataggaattgtcatttgctgctggtgggaatgcaacacgagacagccactttggaagacggtttggcagtttcttacaaaactagcctttctattgccctaaaattgagcaatcatgttccttggtatttgcccaaaggacctgaagaattacatccacccaaaacctgcacatggatgtttatagcagctttattcattattgctaaaacttggaagcagccaagatgtcctttggtaggtgaatgggtaaataaactatgaatataattatataatgaatttatataatgaatataaaaatatataaactatgaatataaaaatatttatatgatggaatattattcagcaataaaaagaaattagatattaagccatggaaagacatggaggaactttaaatgcatattacaaaatgaaggaagccaatctgaaaaggctacatactgtatgattccaactacatgaattctggaaaaggcaaaactatggaaacagtaagaaagataagtgtttgccggccgggcacagtggctcatgcctgtaatcccagcactttaggaggcggaggtgggtggatcacgaggtcaggagctcgagaccagcctggccaacatggtgaaaccctgtctctactaaaaatacaaaaattagctgggtgtggtggtgggcacctgtaatcccagctacttgggaggctgaggcaggagaatcgtttgaaccctggaggcagaggttgcagtgagctgagattgcaccactgccctccagcctgggcaacaggatgagactccctctcaaaaaaaaaaaaagaaagaaaaataaggataggtgtttgccaggggttgggattaaggaaaggatgactaagtagagcacagtagattttagggcagtgaaaatactctgtatggtactataatagtggatacatgtcattgtatgtttctccaatccatagaatgtccaacaccaagggtgaaccctcatgtacactttgcacttgggtgattatgatgtctcactgtaggttcattaattgaaacaaatgtaccattctggtggggaatgttgataatgaagactatgcatgtggggacaaggggtatataggaaatctctgtaccttcctctcaattttgctgtgagcctgaaactgctctaggaaaaaaaaaaatcatacacacacacacacacatagacatgcacacacatctaatttttaaaatgagagcactacttcacagggttgttgtaaggataaaatctgttaatgaatgcaaagtgcttaggatggcacccagcatggattaagacccacctaaatgttaaccattctccttattaagcaatttgtccaaagtcaaagacctagtgagtatccgaacagggatttgaaagcagtctgaagcctggatcatgttgtttcaactgtagcttattaattgacatttgatgaaggaaggaaggaagggaggggtgtttactgctttagtaagctacctattttgaacaacacaatcagctagccaacataattcagcaaaaatacatcaaatgacacacaacaaatattttaaatagttaaaggaaaaactgtagaatattagaactggaaggaccataaagataaaaacagatcacctcctcatctccaagcaaggcaagcatttcattatcattgttgaagttatgaaatgccagaaacttaaagccttttcagcttaaggggatttcttctgaaaaagtcccttgcttatttttcttaaaagatcacttgagggagagtttttaaaatccttaaaaccataaagttttgatcaattgtttttcacacttcttgattgtaggggaaaaatgagagaatatggtcaattttattacctttggacttcattgccatctttagatttcttttccttttttctttccttttctttttttttttttttttttgtgatggagtcttgctctatcgcccaggctggagtgcagtggcgcaatcttggctcactgcaacctccacctcctgggttcaagcgattctcctgcctcagcctcccgagtagctgggactatacacatgcgccatcacacctggctaatttttttgtacttttagtagagacggggtttcaccatgtccgtcaggctggtgaccccaagtcatctgcccacttcagcctcccaaatactgggattacaggcatgggccaccacacccggcccatctttagatttcataattccaccacagtcatcaacttttcaaagccttaaattgtgtccaagtggcttattcaggactatgttcattctgattatttttgagtacttatatagttctactaaatgcctgatgatgtataactgcgtcgttgctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactaggtttttgatgaagatgtgtgcagatgggccagaaaattcctaggagttctttagagaatttgaaggataattctgcagatgcacgtcagtctcaggttgctgccattttaggaatctcacctgggtttccagacatgtcatccagagactgagagtcctacctttgttcaccccaacatgttcacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttcttcctgcaaaatgtaaactgtttttgcctattttcccttggaggagaattttgatgaatagaaacaatattttctctttaaagtttctctcatgaaattatagtgattccattgacatatttttgaagctttggcaatctgttcagccatgtgctgctctctgcccaacacagtgctgacctgcatgaaagcgtgaacaccttctttcggtctggggatgaagggcccacattcctggtgcatttccatcttacaagggtccttctgatccccacagggggaaagtggaggcggcaaggctcggcgatgaagcctgcagattgctactctgttgatgtccctgctggttccatggagatgtttattggacttgccataccagtctggcagattgggcaacaaacaccatctgcccaaccatcacccagctgggcagtgttgactgagccttctgtgtgtgccaaattgtgtcagatctgggaagggatctaaaggcaggcagtgctggagcaacagccacgcctcacagaacatgaatagggctccccattaggggctattaacagagccctcttcactccttagagacccacttctgaacaatagttattctctaaaaaataaaactcatgctttaaaaaatacttacaaatctgtgagctatggtcctagagagtaactgggggacttcacaattgcaggattctgtgactttgctttttatgtctctcacagatcaaacaacagggccttgtgtggagtaggtatgtaatcaacatctgcagacagattcctgttggtggaaactcctgggccaagcctccgagtgggaaaactcagttcaggagtgaaatgagtggattgcacagaaccaccaaaagcagtggacccaaatcagctaaaggagagggcttctttccactgccacattttctccagacctctgtttcagtactggtgtgcccctccccccaccccacccccccaaaaaatcacagtgcttacaattggcactgcttacctaaataatagatatggtctatcctggtaacttttaaacttattatgctaactttcacaaaaagaaatacattttacgtcagacccattacacacacacacacacacacacacacacacacgcacgtatgtactttacatttatgagggtaaaatggatatatgaatgtataaaattgaaacaaaaatagttttactaaacaacacttacccttactctttgcaatttacttggatattttcttttctattctgggttggtttttcttttttgagacagggtttcactacgttgcccaggctggagtacagtggctattcacaggtgcaatcacagctcactgcagcctcaaatcctgagctcaagtgatcctcttgtcccagcctcctaaatagctgagactacaggtggatgccccagctcctagcttttttttttttaatgcaggttgaaacccattcatttgattccatagcccattaatgaatttggaggcacatttttaaaagccctgctcaacttagtaaatttttcctttaaagaaaaagaataaatttgagattacaaaattttaataactgtataatctatgttcttaacaattaaaacaacaactagctcgtagtttgatgtcaagagctgcaactccagtacaggggaaatagacctaacctagctggatcctcatcctggtttctcaatgtatgagctctgtccagctcatgcaagtcactgaggttgttttctcatatataacatggaagaaataccaactccctttctctcagagataattaagtaaaagctcttaaggaaatctgaagttcagtacaaatgagttcattgaatcctcctcagaatcgccactgcactccagcctgggcgacaaagcaagactatctcaaaaaataaaagtaaaaataagaataaaaaaagaatcctcagaatatctgcactggtaggatttctacttgctcaaggtttcatagccaggtagagcctttttttcccccgctaaacacatttatataaaagcataattattattctctcccagaatatctaagttgttagaaattctactgctttcagttatatacccaatgtgtccgataatgtttctacctcagattatgccgctgtgcaaatctcatgagttttatgcatatgggaaaatcaactgcggaaaaatttcttataaaaatgctccaacccattgactttaatagagccaaagaggaaaataatcaagtaaagagaaacagaagagaagagatgagtttcttttacagggatgaactagaagggatccacccagccccatcattttgcttttcgattgtaatttttcaagaggagatattatatttaaataggccctagaagcttacggctggtgagagagagatataagctaacttcacagtgtggggagctcaacaccctaagtttaaggtcttgctaactaaattaaagatactgacaagtgttaactacttcagagatgccattaaaaaactcgtctggtcagttttcttactttacagtcataactcatatattacaataatattttcaatgaaatcctctaactgtgagaaaaggctgacctggagcccatttcctgtgtacaccagagtgtcagaaaagaagtgcaaaagtgctcctttctctctccaaggggatgaagttcacttaaatggccccaacattactgttcttctagaaattaatagaagaattgtactctattgtaattaggaggtgctttgtaatttgtttttgtttatgacctggtgtttcgtagctataattagattcaattcatttttaacaaagcaatttttacaaatgcatatcatattttccactattatgattcaaaagccataccaagggtatatccagagagaatgatgataatgatggtgcctttgcatcaaggtaatttagtgtggcaaacctccacctggctgtgggaccaagtggccccttccaggattctgagtgtcacattgattcccctctttccctcagccactcaacctctgatcaccaaggccaacgaatcccccaattctgtcaactctccttccccaccacgaccaaagtgaactcaggacaccaccttccacctgctttgatgcacagagcaggcccctatctggccttcctgcctcagtcttgccccttccgacctcctcctgccactgagaatgtgaagggaaaacctgaccaccttattccagtgcgagcactttcccatgactccccacagagccctaatgtgaagtgaattcttggtcctttgcttgtaaaatgaagagaacgatgcttcattggatggttgtgaggattaaatggcatcaagtaaatgaaaccatttgtttaagtgaaaagaaacaaatgtaagaaattattatattagcggaaatttaaatttactagataattcggtaattaagtaaagtagttaaatataattacttgggtacttaaattgatttaatacattatgctagaggtttggtggatttatacaagctggaatgataaagtgctgatattgatttttctgtacattacatatcagatgttacatcctaatcagtgctcaggtgggaacagcgcctgttacacagcaggcaatcaataatgcctaagtaagagtttgttcataatttacatgctgggttttgtgacatgtagacagagctatactcctgattctttttcttaaaaccctattagactacaaatctaccttttcaaaagatgtgtttacatagggttactcatccttagagaaaaataaaatgaaatcccaataatctgcagatgcttattggggctgaaatcccccaaacatattctaaagtaaatattcaacaataataaatacatgataaccaagttaatatctagcgagtaatcacagctgtatattaggaaatggttggagttttattaatgccagagacaatgctctgagtcatcagagataagttttgtgctcctgaactaaaataaacctgtcatggaagtgttcggtaacaatggaagcagaagatcaaattttctcagaaagagagttaataaaataatgagagagagacataaaatattagactcctcggaaaagttatgattgtttaatggattatatcacagctaccttggactttaataaggtgtgattatgagaccaatatcaccctaacaggaaacaaataacaaaatagatgttactgttcatagtagtacagttacaggctcatagtaactgtttcctaaatatttgctgattaaattaattagcaaacaagattcagaaggctcttctatggttaccattattgattccaatatcttttagtatcagtgctatttaaaaatagtggtctcataatattatcataacaatttttccaccaagctcatataatattcgtagtatatgtatgtatgtatatgtgtgtattccataataatctatgaaatacaacgcatttcacaatccttccttatccaaaaacaatctaagtgatagataatttcctaatgtccaacaaattatgcaagtgttttatgatattggaacttgtaattttctgcgaatggttgtggactattacaggaaggcagacatgataaatacatgacctaacggccactgctccccgacaatcccacaagagacatcaataatcaatcatggcactttttcccactaagcctggaatttatcctcaatgtcaattttaacatagtattccacaaagcacctgttaatccattcatttattcatttagcaattattatggatttcctaatatgtgcaaggcactgtaccagggaggcacattgcagataaaagtaaccaggacagacatggaccgtgccatcacagggcttagattaacaatggatttgacactcaaagtcatgattgtttgccagatctgctctgttgtatagttgaaatggaactaattctaaatagcagtgtctctcctttgtgatagtaggggactgagtggagaggcttgcactccctggcttcataaagccatgatgtctattgaatagtttaggagttaaaggtgaaaatagctgaacactatttattagaaaaaaagagatggttttctttttattcatttaagtgttcaatttgcaagtcagactgataaacctataggagaaagttttatgaaaatattagaatgaataaatttttctcccactcccctatagagacaggggcagtctgtgactcactgcagtgttttcctttctccacagatgtcggaaagaacacaatatgctacgtggaattagagaaagagaacagatggctgagtacatggctttttccaccactatcaagcgtgttgtctttccccctcagctgcaaaattacctctctgaaagtctctgctcttaatgctgcaccttctctacccttcctcattcctgcctaccatcctttcatccctgctttagaagtgggctgacttccccaagcaaaattccccggcctacctcccactcatatgtggaagtgagctgattgcatcccttgacggcaaactgcttggatggttagtcccttacagttatctaccccctggacaagcacaaaatgtcaaaacagaatttggaggatcggggacatgaaagtggctcagtcaaaatcaggctgatagcagctacaaagaggttactgtcaataacaggcaactgttctgctgtctcctaagactaatcctgaatttggatatgtacatgttatgctcagggaaaaacactgtctagttgccttatttcacaaattaaaaaaaatctcatggccaggcacggtagctcatgcctgtaatcccaacactttgggaggccgaggcaggtggatcacctgaggtcaggagttcgagaccagcctgaccaacatggtgaaacccagtctctactaaaaatacaaaaattagccaggagtggtggcagacgcctgtaatcctagctacgcaggaggctgaggcaggagtaatcgcttgcccctgggaggcagaagttgcagtgagctgccattgcactccagcatgggtgagagatcaagactccatctcaaaaaaacaaacaaacaacaacgaaaaagaactgcctcactaaaatgttagttctattgtactacctccaatgcaaagacccagttcctgacctcaccagaaggtagacccacaatgtatatttagctattgatgctgatggttggttgttttcttttgttttttttaaacctgattctgtgcctgaagtgcctactaatattgctttgtgttctctacagccttgtttgtgtgtgtgcgtttttttctttaatcccctcaagatttgaaaattggaactaaacaaggaagaagaaagtgacaggccatttttattattctttctcagggttccaattttactgtgagtttctacttcttaaaagattttgcatttctcccctttgaatgttacttcatttgttcattctctaaggaaggaagaacagtatcataaaaattatgaatgaatgaaaatgatttttttacgagtaccataaaaaatgaatcaaacatgattcatttttgccctttgccctttgcactgtatcttggtcagtgccagttctcatgtcattatagtagttcctcagtgaacatgaaataatacaacattgtccattggaaccagttatataacactcgagataacagcaacattgcgtttattaatttagtagaaacaacagtattttacagttccaacatataagagaatgcagctgtgttaaatgacaaaaatcatgtattctattttgggcttctcaataactaagaaatagaactaaaatccttttattcacttattcatccaactatgggccacatactgtgctaggagctgtgggtacagaggtgacctatacagaccagtctctctctttgtggagcacatagtgactaactgggccttgacaattctggttaaaattgacatccacgaaagtgtctacaactaggatggaatctctttcctaacccgtttctttcatactcactaggaaagcaacctttccaatggatcagggtagatttatgactcatttgcaaagcaaaagcaaacagaatgtagaaaatggaagtcttaccactaataaatatatagattgcagattctgtttccttcttctttgaagtaggtacagctagatatttgcagctgtagaagccagtgtggtttgcttgagctgtgttcaaggttaaagtactgcagaattgtttgccatttcttccacaggcagatttagttatgctcagcctttcgctttccttactcaccatttcaggcaaagaccatttatgggctgcttcccccctgcaatcacagataagaaaacaaaacatatttatggctgggccctaggctcagcaccagttcctcagcattcattttattaggaagcggaggtcctctcttaagtgtagtcatcttcctctttacgggaaagcaacacattcagaaaagctgtagaacaatactcagaataaagatgcagaactatttgggcatcccttcccccatttccctgagtgagtaatgctctcccttccccatgaatcccctttcatgggaagctggatgcctatggtttgcactttgcagatcacaggagatcactgaggtccctacctttttactctgccagggaatgattttgccttaggcatggcaactagattattcccaaaccaacacagccacttacctgcattggagatgcagtgtctggcctgcttgcatgatgtgctgggtgccttttaaactcagttcaggatcttttaattttgaacctgaactagatcctgaaaaacaaatttttaaaatgtattatttgtaaattgtcttcttacctttttttaagttatctttccatgaaggtgagtttttcatttttaatttatttacatctttaatttacttgtatctttaatttataagcaaaagatacactaatacaaatttctcttaattcacaaattttttctagctctacccttgctcataaatattatatatccttttataccaaatgacctaaataacatccaaaagcctatttatgtagaatggtaatggattcatataggttcaatgaaattatattaaaatatataactagttataatattcaaatatgcaataacttagtaaaaactctcaagaataaatgtcagtgtcatccaaaatatattttcaatactgaactttttccagtgtgggtcatctagtcctataggcctgtctcatctttttttctgaataaaaagtacagaaattttcctgggctctgaatttcatgcaatcattagttgagcaatgatatttttggccaatcatttccctttctgaaccagtttcctcatttggaaaactaattatagaatcaaaatcagttttagaagacatttggtttgtcttacgtaatctatgagttccctctacaatggtacagtcaaaagggaactgttcacacgcttacgtgacattcgacaaacatctcggaggattgttgtgaggcaataaagtgaggtggtgaaagtgctttaaaatctacacatctccatatgatgcaataatgacatccattttagtgactagctgtatcaccctagacaagtcatctctctttccagatctcagttatcttatctgtaaaaaagagattggactagacgaccttgaaatctctgaccttccatttctcacagtcccagcctgatatagcttggatgctgaccctccaattctgatggtgaattgtaatcctcaatgttggaggtggggcctgatgggaggtgtttgggtcgtgggggtggatccctcatgcatggcatggtgctgttgtttagatctgattatctgaaagtgtgtggcacctccccccttctcttgttcctgctgccaccatgtgatacacctgctcctgttttgcctttgacatgagtaagggctccctgaggcctcactggaaggcaagcagatgctagcaccatgcttgtacagcctggagaactgtgagtcaattatacctcttaataaattaccaagcctcagatatttctttacagcaatgtaagaacagcctaacagacagcctcatgattttttgaaccataggtgctacagaggctgagcctcccttgaagctattactgaccaatcagaatactatcactaaggatctctctcgcctccttcctcccctcatccctcagtctctcttctccttctccctcttcttcaccagcctcctcctcctcccctcttcccaggcagctgcaatgcctccgaaaggcagggaatgaggggcccaggattagcgttccttaggcgggaatagaagttagcaggagagaggaaagaaattcttggagggaggaaaacttagtatttggcaccaatctcagggtatagttttctttaaaaaatcagtttaaacagtggaagcaaaggtagaagctctaagtgaatggtcatggagggtttaccattaggtcacagatctgtgagatgatgtgtgtgtcaaataccctggttatgcccagcagtcctctccagcgtttctcttggatttgactatctcaaaaactggattcagttagaagatctgcgtttgaggcttagcttttccacctactgactgcatgaccttggcatcacttaattggctgctcctcaggctcctcgtgagtggaactggaaagcctacgagccacctcacaggcagggtgtgtgcattcggtgctgtgctgtggaagaggctggcttgctgcctggcacgtggcagatgcccactatcaccaacatctaggggaatcacttcccctccccctgcttctgtcagaatattttgctgggtatataatttcaaagatactaaattaacatatgcttttctggtattgctgatgatataaattaatatcttttaaatttttattttattttatttttgagacagagtttcactttgtttcccaggctggagtgccttggtgcgatcttgactcactctgcaacctctgcctgccaggttcaagcgattctcgtgcctcagcctcctgagtagctgggactacaggtgcgcatcatcagcgtggctaattttttgtatttttagtagagatggggtttcgtcatgtttgccaggctggtcttgaactcctgacctcaggtgatccacctgcctcggcctcccaaagtgttgagattagaggcatgagcccagcctaaattaatatattaaaagtaatttttacagacagtagatcccggtatcaaagtactcctaaataaaatggctgaatattaactaaattaaaatccctgtttcatatggatcccattggtctatcaaacaacctcctagatcaagtcaaccccttcaggtacctaggaatgtattttaactcatacttatctttatgagtttcttgaggcaacatgtggcccaaaatcagggatctgtggaaacgccagacttttctaaagccacagccagcaatggataacacctgccctgagaaacttccatgccagaatagtttctgcccttctttatggcatggaactctggggatttaattgagcaattgttcatgtgctggaaaagatccatcgaagcttcctgtggaaacttctggcattacttgtagttatctctgtggtctgtctggagatgctgagcgctcccgtccaggaaaagaagcagttcccctgtttgtgacatcccactgcctacatcttggtttccagaccacatgaatctttctttatcagcaacttagaacaccagtactcctgaccctcatcagaggaaaccgctaacttcaaagaaccacccaaagcccagctgagagaagtgctatttatttatttatttacttatttttgagatggagttttgctcttgtcgcccaggctggagtgcaatggcacaatctcagctcactgcagcctccgcctcctgggttcaagcgattctcctgcctcagccttccaagtagctgtgattacaggcgcctgccaccacacccagctaatttttatatttttagtagagacggggttttgccatgttggccaggttggtctcaaactcctgacctcaggtgatccgcccacctcggcttcccaaagtgctaggattacagacgtgagccaccgcgccgcgcaagaagtgctatttagagaagatctcttagacagtgtgccctctacttgttcgtgtccacactccccatgctgtcccccaaccagaagacaacataactgagtggttaaaagacactgacaaaaatggggttattctaaaaaaaagcgttgccacataatttgtctccagtaacatcagtgtattttgcacctggaatgaggaagctagataaaaaacagttaaccaaaacacaggtaaacagaagtataaggaacaaatttccaagtaactggtgactttgagtgcatcactatccttcagttaataggaaactagaatctcataaaggttattggaggtgtcaagattatagtttaacaggaaaacgaataagaaaaagggaaagtgaaaatatttatttcttgaatgttttgaattcacattattaggccttaacacatttctttgaggcagtttcatgtccatgtacctatctgagtaacaaagattcaacatttgttttagcatctactgcatgctagacacttgcccatcttattagtgatttatataaagatagatgtgtatgtacgtacccataaacacatgcatagtcatagcatggggaagtcagcttgatcgtctcagtagctcagagtcatgttgcccatttacataacaaacctacaggctatttcattttcaagggtggagtgctataatttagcaatgaatctcagatgcagatgagaactttctaatgcttcacatggcagcctagaaatctgatttaaaagaatgatttttgtcctcccaataaatgatcttgtcccttctgtgaactactgttttcatcaaagtcaattacaatataatcataagaggcatacagatctccttacatcacgaaaacatttaaataaaataaaacaaaaaaactcaacatagagcatgaaaatgggctttatcccatgctactttgttagaaaaactgttaaggtcaagcagtgtaggctaatagcattaaaaaaccaacatgtgaacgtggacttatttgaacactgacactttgtattgatcttatctgagtcttttcttcattgtttttctgttctgtattatctggcaggtggaacagaactttatgactctttgacacaaatcccttctctcctttcgcacatgctagacctcacatagaaagcctatacgtagagtgttctaaaatgccacccctaattccccaccttagtttcattaggcaaaatggaatgttttctttgacttcattgggaagagtgaatacatatccaagtaaatgatggctttattttgcaactaaatccaaagcccagatgattgaggctctttcttcaaatgctcttcaaagctgccatgatggatactaaaagagccaactcccactggaggtcattatgaaccagacagccttgaggtcacttgtaaaactcaagactctcaatgtaaagtctgtaaagtctgactaagagtatgtttagaaaactgctatttttactaatctaaataaacagtgttctagctggtcgaacccaacttcaagacaaatcccctggtttctctcccaccagatgccaccttggcaccccttattctgttgaagtcttagggttattctctgtaagaaaggagctttatttgaatataattcatgaaacatctgtgtttttccattttttattatgagtcattaatctccctagctctgccatttgtgagttctgttgtggccatgggcgggccacattaagcctccgattcttcatctgtcaacacaggagattagggttcggtttttaggatcctttccagctaaaaattctgatcctggggtcacagtaattgataacaatgtataagttagaaatcacattttagaaatacttatggttagtaaaaagacaacagcctaattttaaagatcaaccaaggctctgaatagacaccttcccaaagaagatatataaatgaccaataagcccatgaaaagataaaggacatcattattcatcaggaacatgcaaataaaaaacacagggagacaccacttcatgccgactgggaaagcttaaataaaaaagacagataagaacaagtgttggtgagaatgtggagaaactggaaccctcttacatcgcaggtaggacttttaaacggtgcaacccactttggcaagcagtatggcaattcctcgatggttaaacataagagttgatcataatttaaacacatgactcagcaattgcactcctaggtatctacccaagacagatgaaaacatccatccacataaaaacttacacacaaatgtccacagcagtattacctataacagccaaaaagaaacaacccaggcccagcgcagtggctcacgcctgtaaccccagcactttgggaggctgaggagggtggatcacctgaggtcaggagttcgaggccagcctggccaacatggtgaaaccccgtctctactaaaaatacaaaaattagccaggcatggtggtgcgcgcctgtagtcccagctacttgggaggctgaggcaggagaatggcttaaacccgggaggcggagattgcagtgagccaagactgcgcaattgcactccagcctgggtgacagagcaagactatatctcaaaagaaagaaagaaagaaagaaagaaagagagagagagagagagagagaaagaaaagaaagaaagaaagaaagaaagaaagaaagaaggaaggaaggaaggaaggaaggaaggaaggaaggaaggaaggaaggaaagaaagaaagaaagaaagaaagaaagaaagaaagaaagaaagaaagaaagaaagaaaggaagaaagaaagaaagaaagaaagaacccaatgtccatcatctgatgaatgggtaaataaaatatggcagatccttacaatgtggtattatttggcaataaaaaggaatgctgatatgtgctgccacatagatgatcttgaaaacattatgctggcccacagagaaaacgtcatgtaagcacacaaggagaaagcagctatttgcaagccacagagagatgcctcaggagaaaccagacctgccagcaccttgatctccttgatctcaagcttccagcttccagaattatgagaaaataaattcctctagttttattgttaaaaaacaaaaaacaggccgggcatggtggcttatgcctgtaatcccagcattttaggaggctgaggcagctgtatcacctgaggtcaggagttcgagaccagtttgaacaacatggtgaaatcctgtctttaccaaaaatacaaaaattagccaggtgtggtggcatgcacctgtaatcccagctacctgggaggctgaggcatgagaatcacttgaacctggaggaggagatttcagtgagctgagattgcaccactgcactccagccctgggcgacagaaactctgtctcaaaaacaaaacaaaacaaaacaaaacaaccacagacacacacacacacacacacacacacacacacacacacaaaccccacaaatcattgtgctaagtaaaagaagccagtcacaaatggccacatattgtatgattccatttatatgaaatgttcagagcaggcaaatcctggagacaggaaggtagattagtggttgccagggcttgcggggaggggatggagggtgactgataatcagtattgggtttcttttgggggtgatgaaaatgttctaaaattagattaatggtgatggttgcacaactcttgaatggaccaaaaaccactgaattatatactttaatattcttgtctcttacagtcatattttggggtgtcatattctggtctcctatagtatgtgagatttacctcaataaagctgctatttttaaaaacccagcaactgatgactaaagtaatcacagagttatgttgaaggcctagaatatccagttattttgaaatttgttgccacatattaccccatcagtgtgagattttacactagttgtttttccagcttaaaactttagaaggctgattttagagacctaattttcccttaatgttctgtaacatcactacctaatagtagaagtttacaaacatgttgcaaaaaacttgctgttccctcccccgttacaatcttttcaatttaatttagtgttagttttaaatcactcctaattgcatattttgaattttccctatttaaatggaaatttttaacaaattatgtcactaggactctgaataaatctggtgtttccttttatatcaattttttatttctaatttatttgtttttaacttaaagctctgtatattccgtttatttgaaatgaaatgcatctgtctttgattttgcatactgtgttttcagtagtacataatcctgaatgataaatggcctctttatctaaatagagatccctaagtatcatgtttctaaaatttgaatttaagatcatgagccttttacaaaggttgttcgaggttaattaagcataattcacaataagagaaaatattctttccttaagatgtagcttattaaaggccgaaatctcatagactaaatctcatagaatctttggggttggtggcaaggatgggagaagggttaagaatgcaattgcaaatttccggacgctaccaacatttttatttgcgatgcttattcttatagggctctgaaacttaataaaaaaaagttaactcttagttcttaacctctgtgtcatatctctatccaagtatttatcagataatatgaagtgggcattataagtgaatgcctagattaaagtaaccacattaaatggagactacactaccagctatgctgacagggcccatgctttgatgaagagcattataatgtcccatctcctctcacttccagaatgatggagaaaggccagagagttcatattccatccaccaacagactaaatagaagatgtgaaagtcatggggattcgtatgaactgaaagcatattttttcagtcccacagttagcaatgatactaatttttaaaatgtcaggtttgtcttccaaaacaattggccttaaatcaagaaagaatgtaaagaaatgaaagaatgtgcacataaatacacacacacatgcacacacacacacacgcttgctgacacgcatgcatacacttttctctccatgagaacgtcaagtttgtttgagtggtggtggggaggttgatgtagaactagaagaggtttttggtgtgtgctttaattacatttttcattcagcttaggctcagggaaagctctttctaggcggggatttagaaattgacttgaatgtggcaagagtatgaagctgtgactcactgctgactaatcccttatgcagataagattatttgtgacttttacatgggcaactttacaaatatgtaatattttattttagagtaattgtgttattggtctttaaggtccacaataggactgaatgtttaggcagctgctgtccagcaacattatatttagtttgtagaaagtttctaatcctaggaacctgctttttcctttaaatctttatagtatattaaacgcactattttaccacactgatttcttgctttagaggttttgccattctaagtaatcctcaaactattagattcaatatgtgaagtctctgatctcaaagtctgaatagaaaattcaaaatagtcacgtatatagcatttatgtcttgaatccaggtgtcaaaaaataaatcaagaaattacctaaatgtttaacaccagcaactggaattggcacttctccgcaattatgttcatttcaataattctgctctggtttgttcattttaaggctgtcttacaattcatattttaattgtctgtcaatgaaactcatagataggttttgtagctcttggcacaaaagacatcacagtgttagccactgaagtggccaaagtctaaaatcatcaaaacttggacagttttcatcccatccatacatgggtcattgactttactcatttttccttaagcttcagaaaagttatttacacggaaaaaaatctgtgtggtttaaaatgtttaccaggaaaaaatgctctaataacgtcaacattcctactgtctatgtttatgagggaaacatgtcttccgcatgcctctctgagctttttacttgacactgccttctttgagggtcacagtttaacagggcacattcattgatcattaggcctgtcaccaggctaccatcagggacctacccttccaatgacctatagccatgcacaactccttttcatgtgacatcagagttaattaaggttggtttgggagaaatctcctgctgaccaaggagttaccttttcccaaaaaatgctctactcctacaccgctggtctgttattaaatgagttcaaaaaccacctccatagagctgtctaacaatatgtcatttcagtttaccatacgatgtcatgaaagttatctgagctgcctagggcaaaggtcaagatctggttgacagggcacgagacataactcgtaaaatactcggtagagaagtctggtagaccttcgtctggttatgcaaatggacacgaacagagaaaacactctttacaccctaaaaatgcatacaggaacgttttgtctgttaggaagggcttggacacatctctgttttctctatcagtggcaggacacttttacatttgaagcatactccccacgggcttatgttcttatccaatgtcactgtttagaggtctgagaggaaactgagctctgacgtcacgtcttatagaatggatcataattgccagtagtgttatgctactcagaagttgtttcaggctgaaatatacacattttcagattgtgaacacctggaagagacatgacaactgattgctcagtggagatgccatttcaataaacacactcaatgtatgtgagactaaatatacaggtggcttagtgaaagtaactgagtttttaaattagtttgttaattttttatcaatttgtgcatcctctttagaatcatagtgtctgatcagtgacaaaatgcttttagctgcaagagcatttgcatagagttgtattattaagactagtagtactaataacatgcttgaactgccttaactttagatttctaatctctaaattatttaggattgcaaatttcagttctgccaaaggcatcctccgtgttctctttaaataaacaattaccagtttggaagcatagcatggaatgcatgtgactcgcaatctaaaatggaaagttttctgttttacatagcatcaggattacagtttggtctatgtccagatattttaccaaatactctgctttcattactgttcagtgtcaaagttccaggcatctatagagatgatgacagcatgtttcaatgttatggatttgtcatttatgtggatccctgtgggttcccttagaaggaaagtctcacagaaaagatctgggagatatttgatcaattccgtataggagcttgccatgtaacagtttaagtataaaagcgggaattggaacttttaaattttattcaactacgtcttataacctgtcatgtgacataatcttcagatccacacacagttccttctggaaaaaaatgaatatgtcatggagctgtaatgtgatgctgttaaactaccataaaatgcatattgttccagtttctattttgattcccaaatagtgccttcacatttttgtataataaaatgaataagaaaggctggcaaacaggcagacagacaagtgtgcaccttagcactgtagctgttcatgccagaaaagccaaaaatgttattatagcaatacaaagccttatctattctcctcatgcagactttcagcttcagaatcgattacaaataatgacagaataccatttgctttgtatataaaaatggaggagagatgaaatgagattggaaggccgaatgtgataaagttctgatgttaattttcagcttactttgatacagtttatgaagtccaaattatatagaaaacatctttctggagtcctttagactgttcataaagggtattctttaaattcacccactaacaggaaagttgagaagatctctatctttgcaaccaataatatatacaaaccctctgacctttgagatttaaatggccaagagtgtgcaataaagttatccatcataggggaattgagtttttgaaagctacattagcaaatttctaagactcattaaacacattcttgatgattgtgttttctattgtcataatcagtttccttctaagttaaacaatttgaaatataattgcctttcattacacatattttggagattaatcatgcttcggaaatggggtggacatgttgattaaactgttattttttattctgggtttttctaatttcacattttcttaagatatccttcacgtagtaagtatttgtaagagctgtgctttcctaagatttcaaaaacttaaaaaaatcttatcttagatggaattcatgttatacaagttttgctgagagtcaaatttctggaaggaaaagtaatccattaaaagtagtacattttcaccagcagtatctgaatttttaaaagaaataatttaccgaatgtttttcactcatttcggcatgtgatattaaggccttccttacaaatacccatagaagactttagcgttgtttgtattcaatgcctggggaatgctggttttcattctcaggggatatatacccatacaccttcattactctatctagaactttatttctagaaattagcttttttaaaaatatcatccaagacattatatctctgatagaagaaaaacaacaatttctgttatcagttggccaccaacccaacagctttaaaataacttatgaatcagctcattctgtaggacaaaaccaaaaccaaagtagaagttacataaaaccaaaaggaacagctctgtggagaggtagtaaggtgcccaatgccgaagctgctcccatgaaattaagccaccacctcctttggatgagactgatgaactgagttaagggttggactcttaggtgcaatcccaggagtctgggaactccatcctcatttagctatgcttcttatctctcttttactgccaccaatcctggtttttcccctcactacattctctatatgacccctttctctcactcccttaccttgtttatttttccatctttaacctcaacatttattctttcatttaattttttgaacgtataccgatagagatacaacaataaacaagacaaacgaggttgcttcctttacagtgtttatagcttagcatggacaacagataaataagtatatatagatatatatgtaatgatgcataaaaataatttctgcttaaagaaatagaaaattacattatatttgtgtgttatcatggggaagtgccaggtgtggaggtacctcactcagcccagggagtgagagtcttctattagaataaagttggaggtgagacctgaagaatcaatgtgtatttgctaaaagaaatagcagggtctctttctccttcaaagacttccacatctttccaccctctaagcttcatctttccttttaaacaagtgttttcttctaacagtttcacatacatttccttgtttcttagaactcttgttttcctcagcctctgtgctgggaggagaaagctctatcatcttctttcaatgctgtggttcgcatattttttgtctggggtctacctgacttcacctgccactaggaaaaaagccacaagtaatcatactttagatacatacccaggtcacgttgtgcttgttaaaacagagcaccacggaagacgaccggggtggagactcagcaatgagggaatgaatgaggactgtcagatgtgatgcgttagccaggacttcatgttcttaacgtgtccttccttttggcaggtcacctagccagtaccacacatgacccagagccaagaggaaataattttcaaccaaaatgttctcattccaggtgacaaaacaatggcagcaatagtaacattacctagtgactcgggctctgttggtgtacctagaaattaaaggttccaatcaactatcttctgtgctgtttgggaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgaggaaccatgactcctagaagggcctcagacccagagaaatggctcaggatatgatttcagtcagttcagccagtatttattgagtgaccattatgtgccaggcactgtactggattcacaattgcaaagatgggtcagaaacatttcttcctcttgaaggtctttcagctctaagctggcctcttaggggctgtcatttagaagtagaataggtgaatactaagaaatatggaagataatctaagtcaacaaatagagatctcctgcaaactatgtacactatgtctttaaggaacacatcctttaatataggaagtcacacattcttcaccaacataagtgatttatcttagtaaaactcagttaaattcacaaaataagaacacttattcaatgataaacatgtaacacaatgaatacaaccatatctatacctcaaaataaaatataatggattacttgatgataatcccttgagcatcttttaaatgaatgtattaaaatgttataaaataaaaatcttctacacattcctgaactcagcttggaaatagggcatgaatctagaataatgactggctataaaatcgggatcaggagaattaaatttaatatggctcatgtttttcctcatgcagttgtgggagaaaatacagacctcgccgggtgtggtggctcacgcctgtaatcccaacactctgggaggccaaggcgggtgggagtttgagaccagcctgaccaacatgaagaaatcccatctctactaaaaatacaatattagcccagcgtggcggtgcatgcctgtaatcccagctattcaggaggctgaggcaggagaattgcttgaacccaggaggtggagattgcagtgagccgagatcactccagcctggacaacaaaagtgaaactccatctcaaaaaaaagcctggacaacaaaagtaaaactccatctcaaaataaataaataaataaataataataaagaaagaaaaagaaaaaaaaagaaaagaaaatacagccctccaaatcattggaagaggaatatttcttaaacctcccctcctaagtttgtatttaacattatcccaaaatggtgaatgaattactccagcaaggcaattccatgcccatcggtttggactataaagcgcatttaagaaataacaacaaccaagcaaactttatttctacagtttaggattttactccctctaagaaaagataatctggatatagaaccactaagtttaatgtcagtctcaaaaggctaaagtgaagtagaaattcctgaaaattcactcctgttagtttcctgaatttcccatttgccttctaagtgactttgcgtagcgaatactttgatagggtatttttcattgaccagttttgaagacagaggatgggatgggagcttgagtggctgaaccacttttagcttgtacatcaacaatgtgtgtcaaatatttcctaaccctcaagaagttacaggtactcaaagtccattccagggcactgcaattactctatttccacacatatatttttctctagttctaccagaagtccttatggagaggattctgaagccataaaaattttcaaagaacagcagtgaacaaaaatctgatctagcaggagacattaagtggaaaaagagagttaaacaatgttttccaaaaagaaaacaataccattaatcatagatgcagtgttgttgccagagtttacactgccttttaaaactgtttgtttgtaatcctctctagcatatccctgcctccccatctgtttacatacatttttggtttctctaatgccaacttagagaaagaaaacaatcataaaaatccaacagtggatttttacatacatagacaccatgcatatttttacatagtatatacaccattccgtataatttccatctaaagcatgtatccatttgaccaaacgttccagctttttctttggagtgaaagataaaactcctcaataggtggcaggataggatttttctcagcttctggtaacatgacagtattctggttgaaaaagtgtccttctccgagtaacaggtcaagaaagaagaaggaaaacgctattttctccttcttgacttcttgcaggtctatgttaaaggaatgatctaagaaggagggagagacacaggagctacggggcttaaagaaatgctccccgtgttgctcactgtacaaggactgccaatcaaacagggaaatcaaagtgactgacagtaacttgtttaagaaaaaggctcttggatggttgtcttttctcataaatatgacagtttttttattccaaaccctgaaaacaaaactcttgccttttttctttaattcctagatttaatcattcaagatactttgagtaaatgttggtggaaagagtccccgatttcaaaattaaaaagacctaggtttgaatcttggcttggctgttccataaatggatggccctcagcaagtcagcagggtttcctcagccttggggcttcaatccataaaacaaagttacaggtgtgcacagtaggtggctaggaagagacttgatggagttaacacagaaagtgccctgtgctgacatgttcacatttttttcccttccctgggggacagttaatgtcctcccctatccaattcatgtagcatctgccttcagggtcaaacacacttccaggtcgttctgtgaggtattttagtttcattctggaaaagctgtgagctttctggaatctgaaaggtgcagaggagcccacgttggattcctggaaaccatctgtgagagggcagtcccagctttttcctcggacctgcctgatatgagcttttctagaataaagtgctgtcctcatgctgttgtttgtcatctgaactggtttaaagccatatctaggagagcagtttggaagcccacataaaatcatgtccttgatggctttggggctccttttctgactaagttttttgggaggtccttgaatgcctacgataagaaaactcacatgattaaaattctgtcttattggagatgtgaacagtgtctgccacatacagcagtggaatctcccaaggccactttaagctggagtagcagtggcttctcacattctttggagatggccaaactccaaggacagaaggagggaaagactagcacagtccccttgatgctttttccttctcctcttttcatttaggcttgaaggcatggtaggaggatccctaaatgtcgggtttgcaagtctgatagactcagattcaaataattccaagtttacttaccacttctgtgatcttagggaaagtatttaatttacctaagcatcagtttttgcatggttaagaggaccgtacctctcgggactgagtaaaataatatatgtaactcctgttgtggtgtggggggaggggggagggatagcattaggagatatacctaatgttaaatgacgagttactgggtgcagcacaccaacatggcacatgtatacgtatgtaactaacctgcatgttgtgcacatgtaccctaaaacttaaagtataaaaaaagaaatatttgtctgtaatatttaaatgcctaataaatatataattgaaataaaaaatatatgtaaatcaattacatatattgattgtatagtcagtagggtttggttgcctcctttctcccttccccaaagcatgtctgtccctgcagtctcggcacctccagaaaaaggtgctaaatcagggcctctatgataagagccccaagaagctgcagagctgcctgcactcagaatcttggggtcagctgtcctcccttgctggtgtcatgttagtcatcagaggctgctgcccagcatgcctgtcaggtactcaaaacaaaatttgaattaagaatagaaagctcttctctggggcctgttttattttttatttatttatttatttatttttactcccagatactgtttagaagggtcaagacattatgtagcatttattgttatttactataataagttatttactgtattttcttggccaaactccagcttaatagctagactgaaaagcaaacatgaagtgttacacaatggtgtggtccattgtgaggctgtgctcctctccacgcagagaggcatctgcttcccacccctcgcatctgagctgggcttgctttgaccaatagaatgtggtagagcggtgttgtaggcgttccaaagcctaagcctcaatatgccttgcagcttccaccatcacactcttgcaacaccgctgcccccagggaaaggaagccccggccaggctactgaatgaggaaagatctcatgaagagggaggcccagcaccaaggacccagtggaaatgccaaggactatagatgcatgagaaacccaggtgagacccgaagggaaactactcagctgagcctagcccaaaggtctagaagaatcatgaagcataatgcattgttgtgttgggtgactaagttttggcacatctcgttatgtagaaatagatggcagatccaaatggctattgtgcctcagccttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagcacatactcttcctggcaggaattctcgtaaatagtttcttccaccttgtcgtatgtctagtgatgatttagtgccttttacagattggcatttgggcaggtgcctcccatgtggccaggcctctcaaactggcccctgggcagaggttctcaaagtgtgatctctggaccaggcacaacagcatcccctgggaacttgttagaaaagcaaattcttggccctatcccaggcctactgaatgagaaactctggggtggggcccagccagctagttttgcaagcccaccaggtgattctaatgtgtgatgaaatttgaggttcttaacctcagctgcccattggaatcacccaggagctttaaaattacctatgcctaggtccctctcaagagctcatgattaaattggtcagaggtacagccaagacccgaggatttttaaaagctctccagattattctaatgtagagcccaggctggggaccacggccctagagagaggcaaaggctttcatagacatcacttggcagactaattcctaattagggttttgctacaggtggccttgagtttaagtggttttatatttgtgtataataacagccaaggcttttcatttatgctaggttcacttcaggcctcttttaacaaaagaatctgataattgttgtagctctgcctgtgtagtccacatgggtggttcggtggcttgagaggaaatccatttgtgctccacccattaaatagaaggatagaagaccaggctgagaaaaagtgcctgtgagcaccgtgataatctgtgaaaaggtaaaagcatttgtcaagactggcaatgatgacaaggaagaatgttaagtgcaaatacattccatttcaagacagtaagaggcacatgaaatgtgtgatcggcagcggcacaatgcagcgagacaatgacacctccctgacaaccaaaaattctgcaggatacttaccgctgctggtttttgccaccaagtcattttctttcaaaagcaaaaggcttgtagaactttatggtgaaaacctggctatttaattgcatttttactattttccaccaaatccatattttccaagaccttgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaagttcccaggggatgctgatgttgctggacctcggagcacacagagagaagcacgttttggagtatgatgtgggaatgtgcagtgtgggccgggatgggggtgaggatagggaggcaccagctcgagcccaagccatgggattccaatttttaagaacatgtctcgcacctagcagggtagtcctgccaggaacccatttatatgaagggttgaggaaacctcatcctaaagaaagaggaagttagacagaccagtgtggtcctgtaaccaaggcccctattaaaacagagttgattctgactgtggccagacctctgtcattcaggtatgcatctcagcccagcacccaaggacttgggtttaagagagggcaagaaagtcaaaccctaaaatttgaggactctgttctctctaaaaattgtataacacgctgcaggaaaaggctgaggtgcttagcacctcaccaacagaggctaacacaggacttctgcagtgaccagagcctggctttggtggctcacaggccccagcgaagcatcatgcccacacaggaggggaggacatgagacagtttctcaaagagttgaaaatcatagctgatctcatacatctcaatcgctcactgaagaggacaaatattatctgttgagaacagttactttaagtaatcccttgtaaatgaggccaaatgaacaggcaggagcacattactatactggaataaactcatggaataaatttgtgtctgagattgcttctgcgaaatgatagtgtggccacatattcattcatttactcattcgttccaacacttaccgagagtctctgtactaggctttatattaggtgccagcggtctaaggacagctaagacatggggtctctaccaaagagaaaggacacagacacataaaatcctgacaatgcaaagtgagaattactgaaggaggagtacacctcagggctacaggagagcagaagaaatggcaagtgctgtctgggagctacaaggaggagctcccagagatggtgattactgggctggatcttgccagcaggagaggaggagacacagagggagggaaaaggtcttgcaggcagacgagcagcatgaacagagtgatgaaagtgaaggcgcctctgaagaagggggaataatttgtttgactagggtagagtttgtgtagctggaacccagtgtgtgtgtggagagaagtggcgaaagacaaagctagtaccataagccacaagtatgtaagccacagctgttcaggaaaaggataccaagtgctcgtaaggaaagttaatcttctcatcaaatctcttggcatgctactaagcagccatcattttgattcttagtttaaaccccttatgtgcgttaagaaaatagaagaaaacttcatattaaaaagatgtcatttcgaaagaaattttagcactgtaataatgttagtcaataaatatttgaacatctgtcttccgtctggggaagaggaaatacaccagtgaagaagagatgttgtctgtagcaggaacatcaggttctgttcctaggcctgccgctagccagctgttgaccttgaaaaacagcactggcctcctctgggccggttttctcatctctggcatgagtagattgggtcaatgaggttccatctagctcttacaacgtgtgtgtgtatctgtgagacaagatcaagttcctcaaagagctcaaaattgaggaaaggagcagcaatcagaaacagctttcaggcatccagctttaccaagatggatgggaaatccccaggaattcttgacatctccccacatccgccccagcggcaatgcaggaaatctagtccactatcttcagcagactcaatgcaactgtttccttaatgaacccccctgcagccccgtgagctaagtcagaggctttcttttcaagccctccctcaaataccccattcctccaatttccttcccctccctcaatctggtataaaatccagcaatttaatcagcagcatgcaatttccacagcacccaagagtgtgaggaaccaccagtgatcctggaaagcatctggcaggagatcttgtcatttcttacaagcctctcctataaacgaaggccaatggagcagaatggactgttcggttctaccaaattgcttaaaccaaatgccacagatggtctatacttttaactactcacagtaatatatttttacttaaaaaaaagtctggtatgatttcaaatgcccttcctcccctacctgcaatgacaaatgcactgaaaaatgatgatatttacttgatacccaacacacccctaactgtgagatccaaaccaagaattagacacgcctggcctctactaacaccagcaggcttcgcatttaacattcacgtgccaagatagcttctctcactttttctccattcttatccccacccacatacacatatcagtttaaagcactacagaagctacttactctgttatttgttcttgtcttgcccaactgcccaagccaggtcaaatatcagccataactctgctgtgtagatctcaataggctgcataaccttcctcgaggacattacattattttggtcaatatgaaaccattttttggtaacacatcaccttcaacttccatattaaataaatttaaagtagacttagaaatgtctcgatcatttttggaaagaacaaagtaattacttggtttgtttcttaaaagtcacgtaaagtagactcaattttaaataaggggtttagtatccctgttaaaatctggaactttttttaaaagaataaagccattctgttaatcaaataagtgttagctttaaaaattcaagaaataaataggggtttaaaatgactgctatccttagaagagttaatgcaactagagttttgagggagcatctactttatagagttatacattctgctagtgaaaaaagcccaagataaagatgactgctggctcaggcatcctctaccagcccatctcttccaaaacagcctattcaaggccaaattgactggctgtttaggtacatgctactaaagaaaaagaaagtttaatgtgattagcaggggaaacccagttcatcctaacagccccagcatcatatggtttctcatccactctatatacaaatataaataaggtggggaagagaaaagagaaagacagacacggtgttcaggccatttcttggaatcattcattgaattttggagtcagaaaagggccttagaaatcaaccacctatactaacgtcttcattttacatacgaaaacaaagtacccacttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatctttttatttcccagaatgtctggaagaggtaaataagcgctttagaggggaaaggcattatctttttgtaatactgagcctctggttattttacctctcaatgcatgtgcacaccaggcatgcacacacacagaatattaatagctgataagtattcaaagattacatagtacctgaaggaaggcagacccaggttcataatgacgcaagagaactctgcagtggggaaccgtggcttcttactagacattgcttcccggatatgcagcctctcagttgagcatgaaagccctgatgcggtttgtaaagtaggcggtagctgattgttttactgtgagatgcttgttaaccagacagagaaactatgagttttcaaaagcacccatgatgccgactgagctaacatgaactaacagagtgttctgttaactgttaggtaaagaggttctcagcttgccaatgttagtcctttcttcccaaaaaagtgcaaataaaaaaaaaaaagaaattcagagttgcaaaactgctgccccatttaagtaaattataatctaagaaaaatcacaagaggatcccactcacatttctgtaaagtttccactgatctaagatgcttccaattacaaagaaaacgatgcttcactaaagtcagcatgttttcaaaataaagatataattatgtgaagcagaaaatctaataaatcacgtacttttccctccgtaattttagattcatgtaatttagctagatttatctttacataatagtcgagtgaggtatttaaattctctaagcaattatattttaatacaagtgacttttcaaaacaaaaaatgtatttgtgaaatagaaaatacaacattttatttaatatagttatgttagcacctttcccaacctacagtgagttctcagaagttaccacttcgccctgtctccgggtttagtagtttctccaatctaattggaactattacttgttacttggaaactgacggtctagttagtcttcccactgagaaagaatatttaattattactgctttttgggtttaacaagctttttgttgttgttgttgttgtactacgctccatcctattgacttttcttcccgggaatcattgcaatgacttattttatattactatattttatttcatattttaccttttctccacgatgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgat

SEQ ID NO: 1176 - DNA, 127032 bp, Homo sapiens
gcatgtatgttaagtttaatagaataaaaagtgaattttgtctgtttatttatttatttatttatttgttttttgagacggagtttcgctcttgttgcccaggctggagtgcagtacacgatctcggctccctgcaacctctgcctcctgggttcaagtgattctcctgtctcagcctcccgagtagctggcattacaggcatgagccaccatgcctggctaattttgtatttttaatagagacagcatttcaccatcttggtcaggctggtcttgaactcctgacctcaaatgatccacctgccttggcctcccaaagtgctgggattacaggcgtgagccaccatgcccggccatttgttattgttatgattgtcttggctctccaactaaaggataagttctttgaagttgacacataatagttttcaataaatggtagctatgatgatgatgatgatgatgatgataatgatgatagctatgatgatgatgatgatgacgatgatgatgatgatgacaatggtgatgatgacgatgacgatggtgacgttgatgtatacagttctaggtacacagtaaataatcatatctttagattggcagcttttttttttttttttttgagacagagttttgctcttgttgcccaggctggagtgcaatggtgcaatctctgcgcactgcaatctccaccttccgggttcaagcgattcttctgcctcagcctcctgagtagctgggattacaggtgcccaccaccatacccggctaatttttgtgtttttagttgagatggggtttcaccacgttggccaggctggtctccaactcctgacctcaggtgatccaccagcctcagcctcccaaagtgctgggattacaggtgtgagccactgtgcctggctagattggcagcctttaattgattagctaagagcagtgtccgaactaagaaccagaagagccaaaatatagaaatggctaaaagtgacccaggaaagctagaggcaagatgtcagattgactttccacaaaggagattttatatatccagtcaaactttggatttttggaaaactatgtctgaggaacataaattcaagttgagtaaaatggcaaaggctgacaaaattggaaaatgaaggccaggcacggtggctcacgcttatagttccaacactttgggaggccaagggggtcggatcacctgaggtcaggaattcaagaccagcctggccaacatggtgaaactctgtctctactaaaactacaaaaattagccaggcgtggtggtgggcacctgtaatcccagctactcacgaggctgaggcaggagaattgcttgaacccaggagatggaggtcgcagtgagccaagatcatgccactgtactccagcatggatgacagaacgagactccatctccaaaaaagaaaaggaaaatgaaaaacgattaatccataaatgacactaaaaagatgagtgatttcagtgcttctgaatggtgaccatgtggtttcttctttattgagaatttcaccctaagatcaagcctcatggcaaagcctttgtgaatgtaaaaaagaaaaaaagttgacgtatgggataatttgagacacagtgaaaagcagccttgcaataatatgttaagctggaagagaatatgagaatgttgcaaaacatagcgtctaaaggagacttgatggcagtgtaagccctgataagacgatttacgctttagccatgaaaaagacagagaaagaacaggaacacttagaaaagaataagactggggacagtgatgaaaaatgccatataggccgggtgcagtggctcatgcctgtaattccaacactttgggaggtagaggcaggaggacagcttgagcccaggagttcaggaccagcctgggcaacacagtgagactactgtctctataaaaaataaaaaaaattagcccggcatggtggcatgtgcctgtagttccagctacttggggaggtgggagagttgggaggaggctgcagtgagccatggtgacgccactgccttccagcctgggccacagagcaagaccctgtctcaaaaagaaaaaaaaaaaagctgtataatattcttctcactgtaacctctgaataagggaaacaccatagacaaaggtcctttcatttgggataatgtctattccttcactactttaacttacaaaatagagttatgatggggggagaggggaaggatagcattaggagatatacctaatgttaaatgacgagttaatgggtgcagcacaccaacatggcacatgtatacatatgtaacaaacctgcacggtgtgcacatgtaccctaaaacttaaagtataataaaaaaatggagttatgatagcagaatagtttctaaaagccttgaagaggctatagttaaaatgaatcctttgaaacggtgccaaaaacacacgtatttctaaatatttaaaatgaaagcatctttgtgcgctttcactgtgaactttgctcttgttctaataaagcatttcaggatgattcaggcacttaaaaatgtgtcaaatggtcctaactctatggttattatctatataaccttagctatcagctatgtttatttgtaaactgtgaacacatgcatgtaagtttgtgcgcacacccacacactcctgtcccaattaatccttgtgctatgttcagattggccatagcctatccacaaggttggatccattagtcccgaagaagatggccagtcacctacagggctttttttgtgtgtgatgaagtagcgactctaatgaccattttaagacaggaaaatcagtactattgcactccataagaacttagtcaagaaagtgtttttctctcaatagaggagtagttacataagttatgggaatacaaatcatattacagtgtatgcctgctaaaaagagtggggtagaacaatacgttttgacatagaaagacctccaagatatatcaagtaataaaagcaagtcttaaaatgacatatggtgtgaccttaactcaaattttatctcggaaatgctgggtttcccatataagcccactaccagtcactcactgtaatccattatcttattttattttcatcataacagtgatgaccatcagaacttataccatatgcttatatagtagtccccctgtatctgtggttttagtttaccaacgtgcaaaaatattaaatggaaaattccataaataaacaatttataagttttaaattgtacaccattctgagaagcatgatgaagtctctcgctgtctcactctgtccctcccaggatgtgaaccttccctttgtcccgcacgcatctccacgctgtagctgctacccatctatgaatcccttaggagctggctggcctaccagatagatggtcccagtatcacagtgcttgtgttcacagaacacttattttcctcaataatgtgctccaaagcacacgaatagtgatgaagctgtgaagtacttccttttagttaaaaggtgaaagttctcaacttaataagaaaacaaaaaaatcatatgctgaggttggctaagatctatggtaagaatgaaccttctatccatgaaattggaaagaaggaaaaagaaacctgaaaaggcatttaagtttgtgggtagaaggcatgaacagagcgtgttctgatggacagcaattggtataatctgaggtgtcaggcatcctcttggggtcttggaacaggtcccctgtggataaggggacatgacagtagttttgtttgttaaatttgttgcctgtattttcccattagaatgtaaattcaaggtccctgttttgttcccagcacctaatatgcctgtcacaaggttgactgtcagtgaatatctattgaatgaataaatcattggtgtgtgtgtgtgtgtgtgtgtgtgtgtgtatatatatatatatatatatatatatatttttttttttttttttttttttgagacagagtctcgctctctttcccaagctgaactgcagtggagccatcttggctcactgcaacctctgcctcctgggttcaagcaatcctcctagctcagtctcctgagtagctgagactacaggcacttgacaccatgcctggctaatttttgtatttttagtagagatagagtttcactatgttggccaagctggtcttgaactcctgacctcaggcaatctgcctgcctcagcctcccaaagtgctgggggattacaggcatgagccactgcatccggccatatatttttaaagcccacatttgtacatatgcacacgtataggttaaaaaatggaaaaaacattgacaagatacatatcaaacagttaatatgtattacctctccataagggaaatttgtatagcttactctatttctgtacagtggaaatgtattcatatattcctcgtttaaataaaatgtatatatatatatatatatatatatatatatatatagctgggtgcagtggctcatgcctgtaatcccagcactttgggaggccaaggtgggcagatcacgaggtcaagagattgagaccatcctggccaacatggtgaaaccccgtctctactaaaaatacaaaagttagctgggcatggtggtgcgggcctgtagtctcagctacttggaaggctgaggcaggagaatcgcttgaacccaggaggcggagcttgcagtgagcagagatcatgccactgcactccagcttggcaacagagtgagactctgtctcaaaaataaataaataaataaaataaaaatgaaacattaagacatgaaactgtagccctttttacctctttctcagtggcaaagagccattaaatgaaaagtttaaaagctatatgagttcaaatacttaaacattgcaaaactttgtaatattgactatgttagaatgagtgagtgaatgtttttgaggcaagaaaagtcgatttatattttatgacaatttacaattttagattaaggcaataaaaggacaaatcaaaacccattcagtcagaagactgtcccaccgtgtggaggtgggggagggaacgtgatatagagtatgttttctgcacttcattttgtttctcagtgatgctcagtttaattatgactgagttgtatgagatggctacttaaactaatatacagtcttgattgtttaagtctccttggtagcaggagattatataaaaatcaggtttatcatttgaatggggaggtgaactttcttgactttgatttttttcagcagcaatttagagtcgtggactgagttcactgactagttatctgagagtatatttgtttgcatattttccttaattgaattgggcatagtggtgaccccagttgcattgctgtgtatgtgccactttaggtcctgattaaactgtctgaagtttatgcttgaggggaggagagatttccatgcagattctagacatgtaaaatggaaaaagtccatctaattattttgcaaaaacatgaaagcatgaaagcatgtttaagggagtgtatgagttttccttctgtagtcatccaatctttagtgtagggaggaatttgttgattagggattgagatccctctcactctaagagcccaggcactggctcttagttttggggttagtgtctttggacagagtacagcctctgagagatctctgggatgactgctgggagagtttaccacccccactaacccctcgatgtccccaaatctctttgtatctcttctctttgtttttcttcatgccccatttctttttcccagccattgactgctcttcagacaaaatttgctgctgatcttggccatgttcaaagtacatttccgtgtgttgcaagaggtcacagagagaatcaaaagaggaggttaattcatagtcaaaaaaggagaagctttaatgggcatgggatttccgattggggttatgaaaaagttctgtaactagatagtggtgatggttttgcaacattgtaaatgtacttagtgccacttaattgtacactttaaaatggttaaaatgataaaatttatgttatgtgcattttgccacaatttaaaaaaatgaggcctgggcaacatagaaagaccaccatctctacaaaagaaaaaaaaatagctgggtatggtggcatgtgactatagtcccagctatgcaggaggctgaggtgagaggatcacctgagcccgggaggttgaggctgcagtgagccacgatcatgtcactgcactccagcctgggaaacagagcaagaccatgtctcaaaaaacaaacaaaaaacaaaacaaaatataaagaaaaaacccaaaaaaaccctttttctaaagtgatgcccacatttacaagttctctcctatttcttttcttttttttttattgagatggagtctcgctctgtcgcccaggctggagtacagtggcgcgatcttggctcactgcaacctccacctcccaggttcatgccattctcctgcctcagcctcccgagtagctgcgactacaggcgcccactaccatgcccagctaattttttctgtatttttagtagagacagggtttcaccgtgttagccaggatggtctcgatctcctgaccttgtgatccgcccacctcggcctcccaaagtgctgagattacagttgtgagccaccgtgcccggccctcctatttcttatgtcctaaatttttcatttaaaaatttaataggacctaacacacacaaacaaacacacacacaccccaccaccactaccaccaccactaaacttaaacaactagcagggggccctgctattcatacgaatagatgtttgtgttgaccaatgcatgatccctcagttggaccttactgtggccagcagctttcaggaggcttttctgggctgaatagagatgaggatgttatgctgtaaaatgcatccaggaaattttctttaggcaaagctttaggataggatatattgctatgtatgtgtgtgtatacctatgcatgtaggtgcaagacctaaatcacctgaatcttgccaataaaaagagatactttggggctgactgattcttcataaatagcttctattgctttccaattcaaaatggaactttactcatggattactttacttttctgaatataaattatagaactctaccactgtacttttcaatctcattgaactagccaaacattaacaagtaattgcagaattgcagaaagcgcataaagcaacattttcaatttttttttttttgccatgatagggctgtgttaaagtcaggttccctctgttggctgagatgagtgttgtaggtctgaactttggcaatgtcaacaggttagttttcgcatgctgttaccccactacctctcttacttcattactctcctttcttctacctcctaaaagaactttatccttggaaaagaactgagccttgattctgcaacatagtcctggcagggaagaagagctacttgcatatcagcagtgaagcttggttttccttgatctggatgtagagagcccctgaccttaatgacacatattgaagagacagggctagcgagaacagctgcttagctaatcacaccagcagatcagctctggtctcaggggtgctaagtagagcagccagctcaccctcacaggcactgctctgcgcacaccctggatatcttgttcacatttcttttctgcaataatagttcttcattcattgtgtaccgtaaggatagatttcatgagaaggaaaaggcaactacaactcaagttttgcaaaagatatttgacatttctgaatttcattaaggaatttgattaaggaatcaagcaaaactgctgattctagtagcctgagcgtgacagatggtcagtttttcatccctgggtattaacagcctcattcctctctctcttctaaggttccttaagatctttcctggatctagtcaaatcacttgataattcagaggtgattctgtcctcttaggtactaggatctgaatatggtgcctacagatgcagacatttggtgtcagtgatatagtgtgacaggaaagatgtcctctaacagttagataaacacttagtcctagtgatcaagaagatttcatttaagaaggagtattaatcattgggttagagtgattctctcctgctccaccctcagtctgtttaagacagaatttactctttctgaactctttgttgttctaatactactgctttaaccttaaaatattctaaaaatgttttgctatcataaaaatttagcttaaataatagtttgatgatggtttattggttcaggcaggctttactaagaacatctaagatcaagattgccttctgttttctcaaatatttccagagagggagggtttgttacttttttcagccttttaatgactctttcagagcacaatcacttgtgagatggtttgtgcctgtgtcagtgcaaacctaaactagataggccttctgccatatattcttggccaacttatgttacttccttacagtgccactgtgaagagggttgccagtagcccctcttgcagcacctgctcagcaatgtcataacttgaaatattttacgacctcattggagaacctgggaagagggtaaggtagaaaggagactttttgattattttggagagctgccagtcctttaggcgggtggcctgaagagggagtaaagacactcagggtcaagggttctccaaggtgacactgtaccattgttccaagtctggtttgcaaaccttaaatatttttagcccaacagaaagaaatgtttctaaaaggagctttgctgtccatgtacccctaggaatcagaccatactcaaagcaactactgtcaaacaggattcatctctgactttgaactcttgtgtggtgcttcttggtattagtcccttcacactgcattttcctctcttatctctggctctctgtattatattcacttcagcttgtctactctcttttcacctgcctcttcaaagtaaataggtcttaaattaccttcatctttcaacactttgcaccacatcagtcccttctaagagttcccagttgcttctttactcagttctaatttggagcccctactaatttccccttatctcttcctcctttctgtatatacagctaacaacaattgagaacttattgtatgcacagcatgaacataggaaaattaaagcacaaagggtgtatcttttcagctatccaatgtattaaagatattttgataccatgattgagccatagaatttttctgattgcccatttattaatttgccttattccatttttagaccaattgacacgataatagcgaataaggcaggacacacagggttgttgcttgaagaagcgtatttcaggtaaatacatgcatcacttaattactctagatttttggttcttcagatttcagttttcttgttcactgctgtatttgcagagcctagcgcagtgccagacacaaagcagtgacttataaatatttgttaaataagtaaatatatgagtattaggctgataggacatgcattctggacctttacaacttaaaagtaacacccaatctgagttcaaaataattttaaactttatacatgtctagttttttaaaaatgctttatgtgtttttaatatgctttaaaaatgtttcaaaacatgctttaaagaaaccaaagtcttcaagagacttaatctttaatttaccttatatcttaaaagtaacccccaatctgggttcagaataatgtttacctttatacatggcatgtctagtttttaaaaaaaatgctttatgtgattttaatatgcttttaaaatgtttcaaaacatgctttaaataaactgaagtcttcaagagacttaatctttttttttttttttttgagttggagtcttgctctgttgccaggctggagtgcagtggcgtgatctcggctcactgcaaccttcgcctcccgggttcaagagattctcctgcctcaggctcctgagtagctggggctatcagcatgcgccaccatgcccaactaatttttgtatttttagtagagacgaggtttcaccatgttggccaggatggtctcgatctcttgacctcatgatcagcctgcctcagcctcccaaagtgctgggattacaggcatgagccagcgtgcctgaccgagacttaatctttaagggctgagaatgagcagatattcattgttttaaatacatgtttattggtgcccactatatcatttaaaactgatgctcatttgttctcttgtgagtgaggtgagctaacatttagttatgctcaatgctaaatgcccatatgttcagtgtgcagagtgcaggcttcagagtcaaattcttctggtctgaaccttggagggctactcactaactctatgacctgggaccagttatttttcctctctatgtctcagcttcctcatccattagtctgtaaaacggtcagaatcattcagcaaacctcacagaattgtaatgaaaagcaaacaaattagcattaggtaagttctaaagcagcagcagaaacctcgcaggtgcttgttaagtaaaacagatctgtggaatgtatctaataatgtccctacctcaaaggatagttgtgaaaattaaatgagttatctccaaaacacttaacacggtgccttggtacctggtaaacgctcaataaatcttatattgctatgtttaatagagaagacatattaagatattataaaataaacacatgtaacaccagagaacaatgaagtgatgtgctcaatgacatgagttgtaaataaacctagacatcagaaaaaaggaagaatcacttccctggaaggtgagagaagatctttcacgacatcaagaattagtggggctgggcgtgttggctctcacctgtaatcccagcactttgggaggctgaggcaggcagatcacttgaggtcaggagttcaagaccagcctggccaacatggtgaaaccctgtttctactaaaaatgcaaaaattagcctggcgttgtggcatgcacctgcaatcccagctattcaggaggctgaagcaccagaacctgggaggcggagtttgcagtgagccaagattgtgccactgcactccagcttgagcgacagcgcaagactccatctcaaaaaaaacaaaacaaaacaaaaaagcattagtgggaggagaataacgtagtgagaggaaagagaatttttcaggcaagaactgaaggcagcccatggcccagaggaccgaagggagaagaggagaaaggaaaaagtgaggaagagtggtgtcagggcgcagcaggaagttagtgctaacgagctggatggggccaagcaatcgaagccctgagaagcctgacagcggtgctgggagttgggcacgcgcagcagacagcatgccaaccccgaggtactcaggcagtgtggtgtgcaaggccctgtctcttcttgtttgggttgccctggccaagattgtctcttgcaatccgttcacatgcgttccagggcctgcatgcttaagatcccttttattcctgcttgatgccctttggctcaagaatttactactcagcttttataacactttcttaaaactgcctttcttctggtgaatggctgtgccccactgacagttttttcctgaaaggaaatgataagggaggaaaaagctccaactaccccaagtaggcattttataggcgcttgtacaaagcttgagcccttgtgtgtgcctcacttcctctctaatattttctttggaatgggagcaagtcatcatttaaaaaataacaatgataatggactggatcctatcaatgatccaaggtcactaaaattctcttgctatatcaatcctttttgagctgccaggcttcatctaaaaggtgcacctcaagtatctaaaggacacacagtttattttcagggttttaaaactcagtcaagctggctaaaggctgagtatataacaaactacttttcagtctttgcaggccatgatcttaatactcttccatttcagttttgcaacaattggcgaatcagggattatcactttggttacctttattcataggtttacaaaaagaaatagtcataaaagagttggcagttttgaagatactcatatatacaaacataagggtcatcgtcatggagcatattgcattggctattgcatttgctcctgaaatgggaatattacgtatggaactttacagaaactatatacatggggaagattatctccagaaaattaagaaagccctttcctaaaggctatagtggttttacagagtgaataaaaggaagcgagagaaagaaaattgctgacttggtatagctgaacttaataagtgctaaattgctaaatagtagcatcctagaatgatatttatagaatattttgtgtaagactttatatgacctgtttttagatattattcttttggtttggccctcagaagatcagagaaagctgggtggtggaggggtggtggggggagaatctgtattattttgttttagggttgtttgacatttgagcttattaattaactctgatgccttccagtgaattctgccaactcactggacaatttctgtataaatgaggtgggtcagaaggcagcattgaacaagccaagactatgggccagcttacgttaactcatttaaaccttaccatatccctgtgtggtcagaattatcccaattttataaataggggaaaaagggctccgagagtaaggaataatgagttgcccaaattcttatatgactcatgagggccatgctaggactcaagccctgatctccccagcacactggactctttttttgcatgtggtagctgctgagacacattctcttgccttgtctctcctctagtctcataatggttctaagcttcccaaatcattttaactctgattctttaacccacttccaaattataaaaactgaacttatttcacatttacttctttcaaagaatcactcaacatcctacactaatctttcataaaatggattttgtgatcaagtaagtttgaggaatacagaacttagcacagttggccctgtgcggtgggtcacacctgtaatcccagcaatttgggaggtcaaggtgggtggatcacttgaggtcaggagtttgagaccagcttggccaacatggtgaaacccccatctctactaaaaatacaaaaaattaaccaggcatggtggcagatgtctgtaatcccagctactcagaaggctgagtcaggagaatcacttgaacacaggagatggaggttgcagtgagccaagatcatgccactgcactccagcctgggcgacagagcaagactccatctcaaaaacaaacaaacaaacaaaacaaaaacaaaaaaacttagtacagtttaccaatttctttcacaagctatttattcatgtatttattcatccttttattctgggagaacctctcaagggactagctttccacaaaactacccatcttggtagtgtgtcatcttaggcaaatcactttacctctttgagcctaagttttccattctacatgttagactaaagatactctaaaggtcccttgagctttaaaacttccatgatatgggccccacccccatgccaaatcgaggcttttgtgctaccactatgagtttgctaaggatagcctaagattttctgaaaaccatttattcattcattcatggaacatttatttattaattgtcaagtactgtgttaggttctgaagatgaaaagacaagacataaataagacaaataagataaactatctatctgccctctggaggggagacatatatgaactggtgatttaaaaaaatacataagagaggagtagaaatatgcataggtaatactgacacacatgaactgatgatttttaaaagtctcagcaagagagaagtagaaacagttataagtaataaagactcacggaggatctgcctcctatttgtgggagttgtgtaaggcctagttggagagagaacacccaatctgggtcttaagggatgcgacaaaggaagggaaggtactccaggcggagagtaaacaggaaccaaagaaagcatagggagtttaaacagcataatgtctgcagtgatctaccagagtttggcactgctggaatataaagttataaaattcaagtcaggcgactctgagcataacgtcgtaggagtaggcaggggctagatattgagggcattctctgtcagattcttgaacttcatcgaagtgtgttagggttgaagagttggagccggtggaagacttgaagcagggaagtgacatgttcacagctgcattttatactgttgtgttgaaagtagatgcaaagagagatagggagacaagtttggagaccactgaaggtgttcagaggctaggtaatgagtgtctggaccgagagaataatggggaagcagagaaaggaatggatttgagaaatatttagtatttagtaggtgtaatctgctcagtctggtgattgattagatgaagagggcaaaggagagaccatcaccttctagtttggatgattaaatatttgatgtcagtataagaggaggtgctactttatggagaaaaatgaagtgatgtgattggttttgaacctgctgagtgtaaggtctctctaagacatttgcagatatcttaaaatttggagttgttataccacaaccccattctgtgcatcaaactcaaatggaggtttcattttgtgtagaggacttacatttaaggactactccatattgctgtttatttgatttagattgttggaatattggaaataaatggcaattttatttttaataaaatatgaatatcaattaaaatcataaataatttcattgtactcttatttaaccacagatttatgaagcaggcaatagacagtgtttatacttattggtttaagtctcgttgtttttaagagtacagtcagcccacagcgagactccatctcaaaaaaaaaaagtacagtcagccttctgtatatgtggatctgcatctgtgaattcaacaaaaaaattccacaagttccaaaaaccaaagaacttttcacgcaccaagtactacattgagttcacatgaaatgatgtgtaggtattgtatcaggtattaaaagtaacctagagccgggtgtggtggctcatgcctgtaatcccagcactttgggaggctgaggcaggcggatcacaaggtcaggagatcaagaccatcctggccaacatgatgaaaccccatctctactaaaaatacaaaaaattagccaggcgtggtggcgggcacctgtagtcccagctactcgggaggctgagtcaggagaatggcgtgacctgggtggtagagcttgcagtgagctgagagcgcaccactgcactccagcctgggcgacagagcgagactctgtctcaatttaaaaaaaaaaaaattagctgggtgtggcggcgggcacctgtaatcccagccacttgagaggccgaggcatgacaatcgcttgaacccaggaggtggaggctgcagtgagctgagtgagatcgtgccactgcactccagcctggtgacagagtgagactgtctcaaaaaacaaacaaacaaacaaaaaaagtaacctagagatgattaaagtatgcaggaaggtatgtgtaggttatatgcaaataccatgtcataccattttatataaggaacttgagcatcagtgcattttggaatctgcagaaggtgctggaaccaatttcccacggatcccatggcactatatgtattgttgaaagaaaataaacctatacccactggtgtagatttatgttttttactagtatgatcaaacacaatttaaaaagttttctttttaccaaatccttaacatctgcgtagatgaatttaaaagattataaactggccagacgcagtggcatgcgcctataatcccagcactttgggaggccaaggcaggtggattacctgaggtcaggagtttgagaccagcctggccaacatggtgaaaccttgtctctattaaaaatacaaaaattagcctggcatggtgacagcacatgcctgtagtcccaactacttgcccagctacttggatggttgaggtaggagaatagcttgaacccaggaggaggaggttgcagtgagccaagatggtgtcactgtactccagcctggttgacagagtgagactccatctcaaaaaaaaaaaaaaaaaaaagaaagaaagaaaacgagattataaatctacttttctgaacttcacatatgccaggtgttccaagttctacaatacctcaaagccaagaaactaactgctcactttcccagccgtcatggtgaactgaatcattttctacatggctcttctcatttctttctgaatgcactatttaaagacttccagctgaatagattctgcaggatctttctatgggttaggaatatggtctgcataggaactggcccaaatattcctcactggacattgctatcagcatgaaccagatcccagtgtttggggctctatcagcaagtaggtctatacatactggaagcaggtgacgggactgttaagggaaaggggggctgatgaaagatgagaaataataaatggaagaaaaaaaagtctcttaccaggctcttgttgtattttgtggttgtttttaaaccaagtgatctgaggctcggggacaccattagcatgacagtctaaagtggtggaactgctgatggccactgtgtgatcactgaggtttcgcaggaggtatggtgcttcctgatctagtgaagaaagaaagggagctgtgattactcgtcaactttattcttgtattgtctatgcatatcaacatttaaaatatacagagaaacagcaaaactcaactattaggtttcattttcatttgttcactttctcttcaatcattaacctgctgcttctactttaataagatgctacgataaattgaaatttattacaacacagtgaaatcaaggactagattttgtatttttagatttcaatacaaaggcttttgcctagctagctagtttccttcctttttttgagaggagcttttctaaaactcaaggattttgcataatagtttagaagctataaatcaaaaacatgattttgtgtatagtcttgtaatgatttttatataaatatatagtgctgtagtgataggctaatataattttgtgtgagttttgattgatgtatttgtgggggcgtgtttgtgttactcaactgtcagtaacctaagttgtaaggcagcagaccaaacaggagaatttcttgaactttgaaagctttattggttctttcctttctccattcccttcccaaatgcaagcaaccaaagaattaattcaagaggcagaggcacagatttgtagtttttgcactatataatagtacaaatattgtattttatattattttctcttaaaacatacaaatatgatacaatacaatttattttaataaaatgccaaccaatatagtacaacaaaatgaattcaatacattaagatgcaatacattacaacattaaaatcccacataagaacagcagtacccccaaggcccccaatgagtacagtatatctctaatgaagtagtcagtcagtcctgctgatgtgtatacattctagttaggagggtactggattggtagctaaagcttccaaggtaaaaaataaaaacaactcctaatgtctttcccaccctcccaagtcattcctttcccctcttgttggaaatcctggaacagaaatcaaaagagttttggcataactgacacgttctctgtcactgtcttcaattatacagtatgagctttctctgcccattttcgatttcctcatcttagtgtactaaaactgtgaaggcagcttaggagtgatgacaatgctacaaagatgatacattgcaatggccttaattccatgtccctgcagggttctgccacgtcccaaaacctttcccttttgagtcctgcagggcaactctcaggattagcatttgttaaagcaatttagaaatcccaggttaaaatgtatattatcacataaattttataacattgttgaagtagtatatcatggcagggttactatctgttaggagaaacagatttctcaataaattttgatttctacagtttatcattagtcttctcattttataaaaaatgaaatctgaaggcaaaaaagtgtgctgaaggaagtgctctgatgtacaaaaacttcttcaaactagtgtagaatgaatgatagcaatgattcttttgcctctttgagcatgtctttcctatcttatcttgcccactaagcagaacgttacgatatttctgtttttgcattggatgctatctgccaaacagcttttcctaattgaaaatgcagtcctgtttaaaacctttgatttacgactacttgtacatgcttgctcattacaattttgacattttttacatagtgaagaccccaaacatatcagtgaaacatgacaagatcataaagaacagtatcatattattatttagtcgcttttacagtggcaagccaattttgaaatatctcatttaaaactcagacccaattcactgagttatacttttaatagcttcctcagcacactatttcccatgcattaaatatgataaaataatctatcactgcccatcggtcttgtaaaaaggaagtctgaatacagagcccacaacactaaaattgtttttctagctacaaagtatagcatcatcaacacagacacgatttggactccctgacaggtggattggaaaacggtgtttaaagagaagagaacattttaacataaatgtcattaagaatcccaaaggccttatttgtactacacaaacttcagatgatagaagcagcaaaaaggctgcagaacgtacatgggactctcaattaaatacaaggttcacataaacactctgaaatatacagtaatatgcatttttctttgtacccatttctgaaaaatgttctacattaaaagtctcacttttggctagtttctaaatgaccaatcaacccaagaatcatattttgtcaattcttactttatacattataataatctattttgacattttgaataagggaggtgcgttgaacccatatttcgaaacctaagttacttgatggaagtaggtagtggctttccaaaatttaacagtgtagctgatcccttcaaattgagaaaatcagaattaacagacatttctgctggttatcagtagccaaagatagctgcccaccaggttctttcacttttcagtgttatggccccagagatctgccaggtcacataaatacacagcttctatcctccgtttggaatggggactgaggaaccagcctcacaccccctgttccatttcaattattccccattttaggctccttttttctccttttttttttctcccccctccgttatcttcacctcccttcataccccagggtaacatacccctagggtaactaataaaaaacaaaacccacccaaaagtttctttaaaaaaaaaaaaaaagactctccggaaggattaattacacagtgaacaactaatactctatggaattcttaaactcatctcttggaagttcttaaaatcatcttttgtaaatactaacatcctcccctccccacaaaaattgcaaacaggggaaggaaatggtaggttctgcatgtccaattcaccattttgttttcataaggatccctcaatcattctgtttgcttttttaatgttagcaactattaaggcccccatgttctatggtattaaggcattgtttcctgaaggaacacactaacttataatgaacaaagaagccaggccaaagagccataggtaaaatttcaagatacaattgatttttctttcctttgggctgacaacttccaggttactaattgttttcagagcatttggggctccataaaactggcattctggggaaatgctattgtttactctttcacgtttgacaaaagcaattcccacgtgaaagacaagtttagccgtgggacagaatctgttacctaaaggaggaaacagtctggtgagttcccaagcttgagaagttgtcatattgtcacctcctattgaactgcccagccactgtgtttctcagccatggctattttggtcattatagtttttttttttaaatagtttatgcaagtcacatataatgatcaatcataaataaaaacaacagaacaatgcatattaaattggtgaaaaagtcattttccctcaaacgcaagcttaaaacaagagattacaacttctcttgatttaaaactggtgtgtattttttaaattactttgaattctgcttctgtagttttgccgcttcttaatccccataaaaatcctattaacatttgcatatggggaaagtggacttttttaaagggcaaattttaaatttacatttagaagaatgcattaaatctctggttacaatagcctttatttccttgataaattgattgtggtacacctttgaatgctgtcattttaacatgatgaagttccttaaaataataaccagaggacaggaatatttaaaattaaggcatgatccactttctttcagctgccatcaatagctgtgtggtgcagtcagagacagcaaggagcaaaccctttgctaggctagtctactgtggcactaactgcataattacctggatcgcatgagaggagggaggggacgttgatttggatggactcttataattcacactgcgataaacctttactatctctgaattacaccaacatcttgcacccctggggcccattttagaagctccagttcaagataaatgtgcttaacgtaaaaaaaaaaaaagcattttcaaataaataagcattataacttgctatccaggtgctatttacaaatcaagagcagatgaaatagtcccaaataaaaccaggcagaagtccgacagagtctcaaattcaactgtactcattctgagctggaaaattaacttattcgtgtccatctttggcagaaaccagcatttgtttaaattattcagtttgtgcagcttcaacacttaaaaataaaaagaggttggcatcaaaatggaaggaaaggatcatcccaagttgttgtttatcaggcaggagaaaacagcaagagcaacaaacacagagaaggcagtgcagggatcctccaaatccaaacgtgcaccaagtcggccccccggagcagccccctcggcctgaatggggggcccagagctggggcccgggggtctcattattactgctatcatctccgaactcattttgggaggagcatctcctccgagcctgaaagttagcaacagtgacaataaatcaagatgatatgagacaactgttactttttaatgagtcctttaatgttttacattactttgtgtggtacaatcattccttgtgcttttaaatttggagatccgagagaaaacagcctttttgttgcagtgctcacctctgattgtaatttctttcttctggaggatttcttcccctgtgtatacattcctggctctgcaggcataggtgcctgaatcttgcagggaaacattcatgatggtaagattaagagtgatggagtgctccttagtgatggccattttttgcttgctaatactgtagtgcattgttctgttattaactgtccgcagtaaaatccaagtaacgtctctgtataagaacttgttaactgtgcaagacagtttcaggtcctctccttccgtcggcattttttccaagttaacatgaaacccatttggcacatctataaaataagaataaagaacttcagttcacagaaaaatcagtgtcttttaatgagatattcaaagatcttaagaattgttcgtgcacaaattatctcagtatccacattaaaaaggatgagtatttggggtaaatgagcaaacacagcaggtgggaatcaactaagttcattccatcagaagtgaggtaggaaatgcaaaacagaatagttattaggatggcattttctcctgattcacgtgaagttgctcttcaaagtggcatattttctccaacttggttgttaactttatttccctttttttttgaatcagggtcttgctatgttgcccaggctggagtgctgtggcatgatctcagctcactgcaacctccacctccagggttcaagcgattctcctgcctcagcttctagagtagctggaattacaggcgtgcatcaccacgctgggctaatttttgtactttttggtgggggtgatatttcaccatgttggccaggctgatctcgaattactggcctcaggtgatccatgctcctcggcctcccaaagtgctgggattacaggcatgagccactgcacctggcctcatttcctatttttaaaatcatgtacagtattcctactggcaagtgacactggcaagtgggcaaaatagtgaagtaacataagagcaattcatcctaaaaaccaaaggcacacttacggtcaaacttatccaaaatagtttgcgaacaagtgagaataggaagtcctaggtaaagtgccaatcaattccactttagtcctagacttttgcagtgagaagcaactgttattcactatcctcctcctgctcctgtcccagattacttgccctggtccagcaaagaccacagtgggccagtggcacagtgggccagagaggagcccgctgacttactcaggacttcttttatggggatggttctattcagacctgagagagcaaagatttcttctgaaaatgcggacaactaatctggaagagttgccagattctaaaatgggggtgatagaggggtaaagagaataattttaaaaatcaaatttactctctaacatattttaaacatgttctgaaggtggctatgtcattaaaagccattttctccaatgtcgattcccagctaatctttgttataagaaaataagtcttgggaccccaaaatcactaagctaaagggaaaagtcaagttgagaactgcttacgacaaacctgcctcccattctcttcaaagtcatccctctgctctctgagacaaatgcataccttattgcctcctttggaaaggctaatcagaaactcaaaagaatgcaaccgtttttctctcacctatctatgacctggaagccccctccccacttcgagttgtcctgcctttccaggcggaaccagtgtacatcttacatatattgattgatgtctcatgtctccttgaaatgtataaaaccaagctgtacctcaatcgccaccttgggcacatgttgtcaggacctcctgaggctgtgtcacagacatgtgtccttaactttggcaaaataaacttcctaaattgactgagacctgtctcagatattttgggcaccttcatctccatctcccaggtgtctctgtcaacaccccatgagctcttcccctccgcatgcctaacctgggccatcagttcactttggggctgagaatttcttagtatcattttggcccagtctcacgggaggattttaaaaagtctgccggccctgaactgacccgctctcaaaaccttcccattgcttattactagtggtgtatctgcatttgagcaaagaatttgggccaacatcttacaaagtgctttgaagatgaaaagcattatgttatgctattattattattatactttgcacacaaagctataaagaaacctttaaacgttaaggggacaatagtccaaaattagatatcatatcaactctttcctaaatctcactttgcttgtttttctgatttttctgagctttggctttattataaagtgtcacgtctgaagaaatgccaaagtattcatttggaacctgggagcagggcgtaacagtggcttacgaagccgtcagtggctgaggagagaggataccagtggaggttttcctgcttttaaaatgaaaatctaagaatgtgccagaagatgcaggaggggcagctgacagtcacttttaagataacaataaggtgtcagaaatagttgctctaattcagcatctttttatatttgggccattttccaagcatgaggagtaaaacatcagccatcaacttttacacagatagtagagcagaggtattgtgcactggttgcaatcaactcttacaagaccacagactttccatttatgagctctcatcctggtagttagaacccaagtgagcccaagtaacaccattgagatcgtgtagagagtttctatttactttagtgatttgaaacttcctgtggaaatagctcacaggtttcctgatggaagattttgtttatctttgccaagcaccaccaggaatctcaaaataaaatgcatttagtgacattgggaaaccagggagataaggcagtgctgttcctgtttcaccctcagtaattgctaacacacccatagtcatgctgagtgccagcaaaacagcaaaaacacacacataggaaaagcaaagaaccaaattcgttttgaggcctgtttcttatataggggacatggtcactgaagctaatttgttatgttatcagacagccttttagaaatgactatttctcagtctcacccctttggtattctcttttgatccatggaagatgataaataaaaatcccagagggatttttctccttaattcatgttgacttttttttttagtctgagtacaaaaacagacccaagaaagaattgccttctaaccctcaaagtgaaaacaagaaatcttcccacacttaagtatctgtggcgaattcagcacagtcatcatcattaccaaataatactcatccatctaacatattatcacatccatggcatcttatgaggtgtcatggagaagaatcaacccttgctcagaagaggcattcaacccagggttagacgaaagtgtcatctatttataaaggtgcatacttgggggtagatatttcaactcaattggatcaggcatgtgcattaagttcatgaaagggacaagcataggaatttaaaaggacgccagggatgtcatttgttgggtaaaaataaagaaggctctactgccaccgaagagtggaaatattacttaaaaagagagtgaatggttaccaggaagttctgcttgtttcaagtggatgctatgtacaagtgtgtgccaaagtttggagtcgaagcggtcaaggattctaatggccacagtttaccattttcatcaatttggaaggcaactcaaaaaaatttttgtgtttgtttttgttgttgttgttgttttgaggcaggctctcgctctgacactcaggctggagcatggtggtgccatcatggctcactgcagcctcgacctcctgggctcaagtgatcttcccacctcagcctcccaagtaggtgggaatacaggcacgtgccagcaggcctagctagtttttgtattttttgtagagacaggattttgccatgtttcccaggctggtctcaaactcttgtgctcaagcaatcttcccatctcagcctcccaaagtgctgggatgacaggcgtgagccattgtgcttggccccaagtaactgtattttaaagaaggggcaacaggattgaaatgaggaccagtaaagatccaaatctagataagaagagcgttaaaattttagacaggcacttttaaagcattaccctcactgagtcaagtataaacactgaacaaatatatgttcatttttttcaaaaaataaacatatgaggtacaacattcatgagtctttactctcatctctagtgacaaagatttgagtgagagaaagataataattatttaaaaactaataatgaacgtaagcaagttaacctaatatcacaatcaaaaccagaacttttcaggactggtagaaaaggattaagggaaagtatattccaggcaatgagggcttggttgactggacttgtgtcagttttaaagttaaagctcttggatttctagaggaaaagaactgtgagcttcaagtaggtatgtctgaatcgaattctcattttgtatggataagccttgggatctagaagaggtttccaccccgccatggttatacattgtacaatatggtgagaggtaggagggaatttctgcctgaattcagcaggagatcacctttatcaacttgggccctttcagcaacaacaccatgggtagaaatatgatgcagcgatgagactctgggctagccagaggttggtgctgtgactaatgctaggcatcagttagctttcattgggaacagtgattaataaggaagtgagcatgatgttccccttttctcttagcacatcctcttccagtactgccctcagacccaggcaagaaggatccctgtcgcagctctgttctggtcgcagctcttcccacaatgtgaagagtttatggggccaagtgagcatgcctaccgacagcctgtgtcactccattcctatatcatgatccaggtccctgggatctcagaattccctataaggctgatttaaatctgcttctaggttggctcttccctaggtctggcctcctgagatcagactgcttgtcagtattcacacctttgggtctgtccaggcagtggccaaaggagactatctgtgaggggcatggggagagcttagatgtgtgggctgggagacaccacacatggtgcatggccccttgcagtgtggacagggtaaggggcggagaggggaggtgggtgatttagtttttctgcacggccaggtgctgccacaatctgctctggaatctgagtagtctcagagctctaaattgatcctgacctctcaggtcatcatgaaagtatatttgtccatagggggctaaaaggtatttaatggcttgtttgcttgatgtagaacttgtcagtagttagacgtatggtttgtgggcctccactggtactcttgtcttggctctgaaaatgtcagggcaagtctgttttcttctctccacctattcaaatcccaccttctctcttcctgttcaggtcctgcttccttctcagaggcttacagctgcactgtccaatatggtaactgtgagccacatgtggcttttgagcacttgaaatgtggctactgtgtcagaggaactgaagcatattcagtttatttgattttatttaaattgatttaagtgtaaaaactgaagcagtgtaatatttttaaaaaatactgattacatattgaaatcacaatagtttggatatattgggttaaataaaattaattttacttttaaaaaaacgtggttactagaaagttttaaatggtatttgtggcttatattatatctctattggacagtggtggctttagaaagcaagctcacctgtcacattacctctgcacataaattttgatactaggatatatgtaatttgacatttcttgtttgtttccttggtgttagaaacctgttcctagaaagacaggacttcattgatgttcctccaagtgctcagtagagttgaactgtaccatttaacagtgctgattaaactgttacaaagttattgaatgttcagaacaaaacaggaatttttcagtcttttgtattctaaatcagacatactacgactatgggttgagacagtaacttgtttccaaccaaatataaaggacagtgcaaacctttgtatttaattagtccaaatcccatttgctcatctggaaaatacaagagctatgatgcagaatagcctctagaatccctgacagccctgacgttctatgagaatctactcagggatatctcccatggcacagcttctctggggcttggctaacttgccagaggcccctgtgatctgacaacacatatgtgtcatggaattggacatgtctatttctttctggagaacttttggcaatttctgcagcctgccccgggcagtgagaagtttccagaaagttggcttactgcccatgtttcctcagaaattgggggagtgtggagccaggcaattgtttttatactttgagctacttacttccttcctgtacccattgagggacatagggagtgccatttgtgtaccttggaggtttttaagatttgcagagaccatcatatttaaggctaaaaattcttaaatgctatcaaaaaatagcacattaactattgttaataaagctctgtttcagattgctacagagcctcattccccaaaaagtctaaattacctaagttgtaaaaaaattaaccttttggttaaaacaaaaacaaaaccaaaaacgatgtcatcatattatatgcattataattggtttccttgattggtattgaactgctatgtaccagaccctgtgctaggtactgaagggaatgaaaaaatgagcatacaagattcccaattcataatccagtctgggagggagacaaacacaaataactctaaaagagaatacagggaaataactccttacgagatccgatgaggtagaattctattcctgagagcaaggatgaaggcactcaaagtttgacaattctatggaattaaaaaaaaatcactcaagctataaatgcactaaaagcaaacaagactgaagagagaatgaagtcaccaggctgtctctggttataggatgtgtggcttacctgtgatataaaagcttatgtttcttcccacagtcccaactttattggaagctatgcaaatgtagattccagaaattctagagtcagccacaaccaaggtgctagccatctgcaaaagaaaaggaaactttagctagcaacaggacaaataactaattgaacaccccaagctacttctgaggttgaaatgattcagctactccattcattctgcaaagagagtattgcataggtggtggttaccagaaggctctccccttgccgagccccaacaagaatggaaaaataacaggaaagcaggtcctcaggagaccggggcctatgacatccgactcatatgagggtttcaggcttatttatctcgtgctgctggcgtaacaattacagacctgaagctgagatgtgggactgcacgtcctaccctatgaggtggtcagttccacatcaatgagaggaacaggtgaggctgaggccttcccttttgtttgggtgacctgagagcatagatgccagttataacaggagccttctctgctgtttggttctataacaggcatgttaagtgagcaaggacagaagataatgtttggctgaaacttttttttttttaagaaatggggtcttgctatgttgcccaggctggccttgaacttctgggctcaagcagttttcccgcttttgtctcccaagtagctgggacaacaggcacatgccactgtacctggcttgaaactttttttctatgctcaaataatgtggcatgcagcactggatggtcctgaaggagaccgtgtgtgtgtgtgtgtgtgtgtgtgtgtgtgtgtgtgtgtgtgtaaattacctaatttctcttaataaattaagtatctattcctaatctagaagatgaaaatttaaattatgaattaatgcaattatattgttccactagactttagtgctattatttgacaacttagtccctaaagaaacattagcagtcaaaattgcatgaacttgaaagcactttccaaattctgatgtctaaaaagtaatgaaacaaaattttagacaacttaaagacttgcattcttccaaagaaaaaaaattggcaatatgaaacaaattgttaaacattcttaaatttaacccaagcttgcattaaaaagtagtgtataatctatatgaaaaaaatgagaaagctagtttctcatacttaaaattatggaaaagaaaagttagtccagttacttataaatctttgcagcctatgtcctaggacaaaaataactggttatgggctttgaaattgcagaggctgtgcaaatgattccagactaatagagtgtccttgctgaagtataatgacaagtgacttacaggctaaagtaatgtaaggctgaaatgtgacagctgactttccaaggtggtggacatactctacaagtggtttggctgtaggagagagtcctaacattttcttgagtttctaagtaatgtgctaggcactttagttgtgttctcttatcccatctaataaattaaggtatttctgtctttaatctacagatcaggaagacttaaacacatgttcctcatgtttttagccagcaaattcattggtccaaattctctacaattttcactgtggtatagtgagtagtacacagtgctttctcttctgtttgttggaaggatctgcttaattacacctacccatatactccctgtgtattattgaaattattggtaatgaaagtgtctgcaatatgtggcagacaatttagcagacatttattgagtgattatcaaggcattgcccagatgttgtaagagagacagagatgaatatgacacaatccctcccttaacattatcattctttaaggtgatagagaagaatttccctccttgaagatcatacaaaaattattctctcttttgcaaggaaagcgcatatgaaggcaaataatccatgggaaagtgtacgaaagagagctcaggtgtcccttttcttattttgatgatgaatctttttaagaggtgggacataaaaaattctgaatagccatttccttgtaattgttgtacccacccgtttagagtcacggaaggaaatggaagtagttggaagagaagcttgtaggtggcaacatgaaagaactgttagctggtggaagctggaagacaggagagatcgtcaaatacgactctgactcccttacattgtctcaggaagcttagacccttcaaagcagtatgcaaaaaattcagaaacaaggagctcagatgaagcctttttaagctggggtgtcagctccagcactgttttttttatgaagttagttctcaagtgtttatcctaatgggcctcaggagaaacttacttagattctcagattaattgttgctcagtaagtaagtgaaaaacccatttctgttggcttgggagtgtttgaaattatggacagcatttatctgcatctatgagtcatgtttgggtttttatttaaaagattttgatttcattgaacttagagcaaccgagaacaagaactgggtttcgtggcaagggaaaatcaagtcagatgtatacatttgccacatttaagacctgtgtaggtaacctgggaatggccgtggccattttacaagtccccaacaaatagtcaaataggtccaaatttatgtataatcagagaataaaactgaggtgccccgaagtgaaatgaatccgggtcacaagatggagacagaaatgtattgaatttttcttcttttgtgtgaatgacaccttccaaacaagacacattactcgtagtcaagcctgccccagaaatcatgtctccaaagcttctattaaaatagaagcagaaaacaacgttgatgggagtttacattatttctttgtttctgcgaacctttatgtatgccttacaatgcaccaggcagcatgcaaggcactttacaggaattgtctcatttaatcctccccaaaaccctgtgagatgggtatattaccctattctacaggtaggacaactgaggttccgagagattagatgattcacccaaagatgcaaaggaccacagacaggcctgggcagaatttatgctcaggtgtgtctgcctccgcgcctatgctcctaatctctacaccagattgcttctcgccttgagactctttaagttgaataacacagatctattggcaaaattctgtctacacctttaattgaatttttccttgagaatacttcctttaatccgcagagatgggtaacataaattaaatactactactatttacagaaatactagttggcttctctgatgacattttacataagctgcaagctgctcttcaactgttgttatgtggtttgaaaatatatttgataaatacaatggttatcactaaagaagaaaagttaaaaataaggtgaaacatatcctatgatcagttttattaaaatttatctcatttctagagtacttctctttcaggggatatatttttaaattataaattcaaacattttctcattaaaaataaaattatttgacaattaaaatttaaactttatagggccagagaaaggagctcaggtgcaaattgtagatcagtgtagtctggctggactagaaggcagctttgcatgagacagtgagtttcaatgtctgagtcttctgaataaaggaaaaaatctgttcctcagtccttatatccaaatactatggtgttaagggaaaaaaacgaaaatagcatcacagttagggcatgcaatatcaactaaatactttcaaagagaaagtaaccaagaatttgagttgtgcgtttgaaattataatcatttattctataaggtatgcaaaaataaattcttaaggatatctacttgtattagtgctataattagttttcattttccacaattgaaaataaatgaaagaggactgaggaagagaaaaaagcagaagtgctgaaataaaattagactattaggcctgatgcggcggctcaggcctgtaatcccagcactttggaaggcagaggtgagtggatcacctgaggtcaggagttcaagatcagcctggctaacaagacgaaaccctgtctctactataaatacaaaaattagctgggcatggtggcaggcgcctgtagtcccagctacttgggaggttgaggcaggagaatcgcttgaacatgagaagcagaggttgcagtgagccgagatcatgccaaaatacataaataaataaataaataaataaaattagactatcaaattttatattagtcttaaaggactcatgctttctactcttcatttttactgcttttgctttttgtggtgcttccagttgcctggcctggccctcaaggatttacatgttagagacagatccttcaagcccattctctaggctctttggtatgacccaggaatgctcataaaactatcagcaagtactgtaagtttggagtttttcatgttccttccttccttccccttcactaagcattagtaattcgttactacaatgttgtttgaacctcactgaatagaatggatgggctgatgtgtcattcagcctaattccagcactcgttttttaaacatctatatatggaacactgattttaatctcgggatgtttctaatatagcttcctttcaagtgtttcactgagaaataaaagtagatgtgtaaaggtcatggaagaatctaaaattaacacagggtggcacatttgagccaactgatgggaaaacagaacgtgagatttagaaaaaattggggtgtgtgtgggaactgaaacacaagctgtaattctgtggttaggattcttgctcctgtcatggatttgtctcatacaggacacatttctcaaggtacactcagaaggatttcaatggaaatattgctaacacattaaaatggtaatgattctccaaccttacagaattaatgctgtgataacgtatttcctgtgtgttttttctaacacggggttccttctacttcctactccatatctacaaacctaacagtttggcaacaccacttagacaatacgaaagtgcacatttgctactagcaactccagttgatgactcacttttcacaaatctgggccaaaactcgccaataaggaaactaaattttattgtcctctatacccttccttaagttaaacaaaaaaatacaacaaaacaaagaaaaaaaatccaaggtgctccagcgtgagtgtgatcgctgccccactgatctgtggagtagcattgctgggcaggctaccatgtgacggtggataaagggatcaccgcagtctaagctgggactttaatttgctttctaaaaatgtatagaaaataaaaacagttttaattgtgaaggaaaaagcactgcatataattcagaaacagcaaaacttccattttgtcaccatcatatgacagatacattttttcacacccacaaaaagatatattagtagatgctaaaagtaaaattactaaattctcctaaattcaagatatgaactcaatcattttatttaaagtctaatatattacaattacaactgctaatgggatatgtaccatatatatagatataaaatatatctatatatatagagagagagactttgtttagtgtgagtattaaaagttttttcagtgcaaacaattgtttaacaaagtcttcattgtatatgatcacaatcagtttagggaattgcataagggtacatatgacattcactttactaaagtagtacttgtatagggctttctcattatgttatgttatgttactttacgttacgttacgttatgttatttatttatttactttttgagacagagtctcactctgtcacccaggctggagtgcagtggcacagtgttggctcactgcaacctccacctcctgagttcaagcgattcttgtgcctcagccttccgagtagctgggattaccactacgcccggctaatttttgtattgctagtagagacggggttttgccatattggccaggctggtattgaactcctgacctcaggtgatccgcccgccactttggtaggtgatcggcttaccaaagtgttgggattacaggcatgaggcactgcgtctggccttcattatgttatttcatttcatccttgtaacaggaagtactagctaaggcaagtatcattagttctgttttttttggaggaaagaactcaagctgagagaggtgagctggtttgtatgtggttatacagagaggaagtgtcgtagtttgactccagggctcctgatggcaggttgggtagcacaagtgcagaggtctatatttaaaatcttctgcgtaactgtaaaattaccagacaataaatttgttttaaaccttcatggagaaaatcttgggacgttcttttatcatgggcatgttttgatactccacctccactgatttttataggtttttacattatatatggagtcaagttgccacttcatggtttgggttagccagaaacttcacctagctttctcatttttcatttcatttcctattgtatatttttgtggataggataccaaaatagcactagaagttaccactgaaattaagcttataaattcttgtgttaatatccggcagttaacagtacatcctcctgacatggtcaggaaaaagcaaaatgaattgacacaaccaatgaatggcatcttgacatttttctagtactttgtgacaactaatttgctgttcactgctaataaactgaggtagtttccttattaaaaatatctgaaggccgggtgtggtggctcatgcctgtaatcccagaactttgggaagccaaggcaggcggatcacagggtcaggagttctagatcagcctggccaacatggtgaaactccgtctctactagaaatacaaaacttagccaggagtgatggcgtgtgcctgtaatcccagctacttgggaggctgaggcacaggaatcacttgaacccgggaggcagacgttgccgtgagctgagattgggccactgcactccagcctgagcaacagagtgagactctttgtctcaaaaaaaaaaaaaagaaagaaagaaagaaagaacaaattaaactttcaagtttatataacttcctctaagtatttcattaaactgctctcttatcaatagctatacatcacggactgttttaaagtactgcttatttctgtcagagaaaaagagttgtaaaccacctacagctactgctatagttataaaaacttcctaagtgtttaataagagactattggtgttatcatataagctattgccactctgactaatttctacagtggcttacttggctataagggcattaggttttgcaaaggaaagactttggtttgagtctctcatttatacttttaagctgtctttgggttaatcatcttatcttccctgttttatctttaaaatagagataaccactctcatctgccaaagaatgatggtgacattagcatatgtcaaaaagtttcacataatgaaaattatagatgttatttgttgttactgttaaatcatacatgaggaacgatgccatctactttgtcatcttcaagtgcaaagtgtacggctgaatagatgacataagcatacccacactcaagcaggcagtggaatctgtattaacagtctctactccaaatcaagaaatatatatgtaaacagacatgtcagcaaggggatacttgatatgttttttctttttaaaagaatcatggctgggtgcagtgactcacgcctgtaatctcagcactttgggaggccgaggcaggtggatcacctgaggtcaggagtttgagaccaacctggccaatatggtgaaaccctgtctctactaaaaatacaaaaattagccaggtgtgatggcaggtgcctgtaatcccagctacttgggaggctgagacaggagaatcacttgaatccaggaggcagaggttgcagtgagccgagatcacgccatcgcactccagcctgggtgacagagtgagactccatctcaaaaaaaaaaaaaaaaagaaaagaaaagaatcactatccctgtgccagacaatagcagatttttaagtgtattctttactaattcaacaggaaaaagccactaggtctgagatccactgagacttgcctagctgacaggcttgttagctattgccaagcttcagtgggggttaggggagtataaaatgaatagtgcgctgatgaggtcaaggaatcttgatagattgtgtgtgtttgcatatccccctcaactcaggctttgctcttgcagacagagggaaatacatgatatttcacaaaatagaaacattcagttttagctctaagtcttgcactagcttttgcttactgggatcccactttatgtacatcagtgattctcaatccccgttaggtactggaatcacctgggaagattttacgagccctaggctgcactccggagatttggatataataataattggtagagtattctaataggcagccaggactgtgaaccaccaatgtggaccagtttgatgttcaagtggacagtgccatctctaccattaggaatgagtactcattatgttggaactggtagcttgagtagtctctgtgtgtatctccatgaagacatagctcagatattgtctttcttctctctgaatttttgtttgaacatttaaattacttctggtgccaataaacctagaattgggagctgagagtgtatttgtggaataaatatcccagtgcgcatttttacaaacaataccttattctttccttctattattgccatgcgctgagtgatgctctcaattctgtttcccatgttgctgtcagcatccaggataaaggactcttcattattggaacaaaagtcacacctattaaaaaaaaaagttgtcacaatgtggctttacagcatggttcagtcaatggggacaggtgaaatgaaaacttggtgtaagtcctcagataacaaagtcacaaattttatgtgtgatcttcttttccttagattttttcctatattcatcctcaaaacttaaaaatagcaaatatatttggctgatacttgaaaaaagccccacactagtgtgtcaccatacatccttttcgttgtaaatgttaatattaaataaaaatgcataaattagaaaatttagtatctagattttagtttttagtggaagtaacattcaaacacggaaaaaatgaagttatgttaatgaataaaaaactcaaggaaatcataccattttatatctataaaaggctggcttttaatcagaatatgcagttggatggctaagtttttccagggctaattaagtgcatatggaaatcaacatcatgaaacagttattaaattcagtctctctctgctcaagttttggggaactgttcaagctctcaggcctcaagtgtttaattataaaataaaggtgttgatgttatttatctttgaggtccatgaattctctctctgttttaaacatttcaccattttgcattctgactttctggactagaatttttttgagcagaaagcttgctggtctctaatttgcacatgtcttgggcagattctacagattttttaaaccaagaggaattttattattattattattattattattattaatattagagacagggtctcactctgtcacctaggctaatgtgcagtggtgcaatcataggtcactgcagcctcgaacctctgggttcaagcaatcctgccgcttcagcctgtagctgggattataggctaagtgaaattttcaagcttcatttccagaaaaaaatgagtggttcatctttagcagccaagagcaggaatgacttatgtgagaggaaaatgagaggctaaagtcagtgagaaaaaggggaagacagaagggaatgtggtcagaaaaacgttccgttactattcctccctggtccttgagctgagaaggaactccagagtgttaaactatcgcatctgcaggggtactggccctgtaacgtcctcctgcagagtactcaccaccttttaagtgctgacttaatggttctgagtccccgctgggccaacagctacaggaggacaggggacaaatcgacgtattcactctgtccccatagctaagcagggcccgagcatgccgtcggcgccccataaacatttgcacacatgcagacaggcacaaggtacccgaagttgtttttgctaagagtttctactttctttaattgtttattattatcaaacacaccgataagtagagagaatagtgtgatacacccccatatacccgccacccagatttcacagttatcaagattttgtcacattggtttcatctaccccttttttttcttctgtattttatttatttatttattttaaaatttttctagcctggccaaatgaaggatttctgtgttttaaaacaaatctcaggcatcttgtcattttagccctatgtacttcagtgcatctctctaaaaaatgagcaaatttttccaatataaccacaacactacttttatacctaagagaattagcaataattccgtggtggtgtttgcacctaaaccgtatatcagatttccccaaatgtttttaaagatgtctgtcttacagttagattacaagatttaaaatttaaaaagaatgaataaaaggtgaccattcctcaaggaatttctgcagtttttaccaggtataaccttataataatcatgaggtaaaataaatgaacattttaatgcttattgataagtagagtaaactgagccaaagagaaattatgtactttctcctttattagaaacatcttaatgacaaagtttaaaagtcattatatgagagtcactttgccttattttttcattatcatattctccattttctagactataacatccccatgttaatcttgcgttagacttgctatctttcacacactcgtattacaggtatgagtgtatataatgtgcacatatacacatgtgtatacctagattagacatttgcatatgtacttgggattgtgacatcaaacagctaaagttctcttgtatctggaagacaagcttttagattgtattccttttcccccaaagcaaggaaaaagatcggggataccttagtcaaagatcttaatttcatactcttgggctttaggaaatgcaaagaaatatgttagagtaaggcaagcctgggtgtttctcaagggaaatacagtctgctatctgagttcacttggggctgttgacctctgacaccccacacctcccccatcccacacccatgactctgagggcagttactaagggcacaagccctagtatggaaactataggccagacttattgccagctcttccacataaaaaggacagattctgtggctattttctaatttaggggctgttatttttccctctttgtaattggggctataaaaatagaatgtcatttagaagccttactatataacagcacttgaaaagagatttagggggaggggaatgtgcctaagccttaagaatacatcaagctcttaaggaagtagattgtgccatgtttgaagatgcaaagataatcactgtgctgggaactgtcttgaggggggaggaagccgaacaacaagaggaaagcagcgttcgctcctgatttcgcacaggaagtccacagcacctcctgccaaagcgagataagaaagctcccatgcactattctggacaaggccactgttatcagcctcagctcggcgctgtcctctctttgctccaagcctccgtccctttcctaatgagctatatgactcctacctccatttgcatacagcatgccaagtacaatggcagggaggtatttataacccctgaaaggaaaaaaaaaattatgggctaagagtgtactccatgtcatctctgctgattgctctggacctgaaacaacttaatttcggactagagattgatataaataaattaaaagaaagcagccaattatgtttccaacacatggagctaggacctcatgtgtgatatgtcagccttctacattccaagtgggagccatctgtggaactccccatctggtctaagttactagtcttcttctcttgacacattatgggaaactgccaccctctatatatgcagatgacactactgacctacatgctttgggttgattttcttgtaacagtgatgaatttgccctcttcccaccacactcaaaagtatttggcttctctgtgaccaaagacagatgaaggcagtctggggccacagaaaaaggcaaagccaacagaggtcaaacctacgatctttctttctttctttttttttttttttctgtcacccaggctggagtgcagtggagcaatcttggcttattacagccttgacctcctgggctcaactgaccctccaacttcagccttccgagtagctgggactacatgtgtgtgccatcatgcgaggataatttttgtatttttagtggagatggggtttaaccatgttgcccaggctggtctcgaactcctgggctcaagcaatctgcctgcctcagcctcccaaggtactgagattacaggtgtgagccaatgctcctggccaaacctaccatcttgacagtattgactgctggcagaatttgtactcagttctggatcatttcagaacctgtgcacttgaccccaacaccataagtaacatgatatccatgtactaccatcatgtgacaagaaattattatgcttcagtacttcttggacatagtaagaaaagacatctcaaatattcagtacacaaataccattactatgttgaggattccatggctttttttttttttagctacttttgcataacatggtcagtctctttccaaaatttgctaaacatctctcatctcacacaaccaaaatatgttgaatgaccagtgcatgcacagtctgcaattacagtttatattacagtttctatgagagctcactttgtcaccctgcagttcctgaattcaagacaggttccattcacctttacaaatccaacactcaatgaagtataatgcacaatgcacacccaaaggtacccctttgtgttcacctgtgctttttcttaattgctggtttttaacaattcttatttttagattttcttcactcctcctgccttcctctcccctccccctacttaaagctcagagctggtactttctttcctttagaggatagattgtcacatctggtggaatcagaagggaaagcccagctgggtgagcgttagctactgatagtaagtattgtgttttctttgaagtggttctcttgtgaggaaatgatcgattctcttggagaattgggtgggatggttcaacacttcatttagcctttctagaaattgcccatctgtttagtgcctgttatggtacccaagactcctatagcaatccagtataaaattctcatttcataaatgatttcctgccagtctaataaccacattgattctagaaggtctgctctacagccttagtcttaagacacacagatttttttaaaaggatcctctttcaataaatgatattaagctggcatttcaaatctctgttgtgccaatatctgattcttggctgcttgaagggaaacaagttttgtgagctgctactatgtgctactaaagcttgggctagaagcaatacacattttgcctcaattagttctcacagtcaccctatgaagcaagcattatgatccttatttcataaatccttttatcaataaggaaactgagactcagaaaaatcaaatgctttgctcaagttcacagggaaaggagcagaattaggatcagaacccagactctcctaactcttcactatcccagagctctgtgcatcacgtagggtgacttctgatcccaagaaacctccccagacctttcccaccatgggagaagtctggctcagagtcacctgttacagaggaaaactctggggggcctctaaattcaaactagcacaaagtcagacaccaggaaaattaaatttatgtttttaagagggagaaagaagatgtgcctgtctatcggtggacaaggacaggggcaaggggcagaagactactttatagttacatttttggcataaattctagttcgttttggtcataaacatgctttgatggtgaaattataggaactctttaccttctactggctgatacattttatcattaaaaaaaaaatctggccaggcgctgtgactcacacctgtaaatcccagcactttgggaggccgaggcaggtggatcacctgaggttgggagttcgagaccagcctgaccaatatggagaaaccctgtctctactaaaaatacaaaaattagctaggtgtggtggcctgcagtccagctactggggaggctgaggcaggagaatcgcttgaacctgggaggtggagtttgcagtgagccaagatcatgccattgcgctccagcctggtcaagaagagcgaaactccatctcaaaaaaaaaaaaaaaaaaaaaacttacaacaaaataaaaccatccaatatttatcacaatttttttctctccttggtaacatatttttgtctgcatgctcagtgagcatgttctgggatgaagctggcctgttttattacaaactccaacactagaatgagtggcccggggacaggagtgtgggtgagtggtgatttgagtacccaacacccgatggctgcctatttgagccagagccattgtctgggaatgaatgtttatataaatgtataatgaaagcacatttaatttggcaacaaagagggtccagaaagttctacaaagtctcaagacagataataatctccttctctttttttcttttttggatgatgaaatctgaggacttgtgtgaactctgcttatctgtttaatgagattgtactgcacgtgctaactgtgattagaatctgtttgtaaagaatattgaatcatttcaagctaggaaacaaaaggatagaggagtaatgaaaagcaaattgaagctgtaaaatgtcttttaaaaaaataggaaggaaaaaaaagcccatctggaaccctgccagagggcacaaccggggctggcccccattatggcggccatcctgtagcagggcctgatgtaaacattcctctgctactgtgggtgtcgtgtcaaaacattagcgattgtgtgtctgagccatcagattaacagaatctgcaaacactatctttcccccttctctttctttttctctttctctttctttctttctttctttcttttctttctttctttctttctctttctttctttctttctttctttctttctttctttctttctttctttctttctttcttctctttctctctctctttctttcttttttgagacggggtctcactgtgttcctcaggctggagtgcagtggcaccatcctggctcactgcaacctccgcctcccaggttcaagcgattctcctgcctcagcctccagagtggctgggattacaggcttgtgccaccacgtctggctaatttttgtatttttagtagagacgggttttgccatgttggccaggctggtctcgaactcctgacctcaagtgatccacccgccttggcctcccaaagtgctggggttacaggagtgaggcaacatcccaggcccctcacgttcttttttttttttttttttttttttgagacggagtctctctctgtcgcccaggctggagtgcagtggcgcgatctcggctcactgcaacctctgcctcccaggattacaggccagagccaccacggccggccacgttctcttaaaacagatgaaacaatataggagagtggatgctggcagaaaaaggcgtagcattggaaggagtgtttagacagaatggttcctgctcctcttgctccaggaaaagggcctgggccttcagggtggtcacagggtcaggctgaggagatcctggaggagtgactttcttgtgcagtgagagaccttgtgacgccttggagctcatactgaaaattacttcttgcctcaatggagaagggggagtggagaagagtttcgggggttgtgggctttgggtcggctccctggacaatggtggaggggatccagcgtcctgggccacctctgtttagataagagcttttccgtgagcgtcttggctcatgctgcttcctgctctcgagggccctgtggtccattcacactcagaacatggcccttcttcccagcctctgcttttccttcctcctggctccttctgctggcttctagagtgagtgccagcaatctccccgccctccaccccccaagccagacactctctccctcccagctccccactctccttcacacagtcttttccagggccaggggatcctcgtggccccgcactggggtaactgaaaggctaaaagagtgggtgtttacttggctacacccagataggagcctcacaggatacctattttgttcattcacttttcttcttagtgaaggactagttggtgaggaagggtgatttgagaaataagaaatctttaaaaaaatattaggagtgcctacaaaaaatatcctttaacacattcaagaaggaggcttaaaatagtagctgcattcactcagtggagaatattttaagctatcattatattttgttctcacaaaaaggaagagaacagcttacttcttatttagtggtcaatactgaaacatccagaaagcttttgggagtggaggtagggaatcacaggttagcataagaaacatagatgttagagctagtcagacctgaggtgaaatcatggttttataacatcctagttatgtaactgtggatgtcaaaaacctgactttgagaatcgtagtcacagaagattgctcagagggcttaccagtcttgttgatttcttgtatcattctaaaattttgtccttagatcacaccagcccacaaaatcacttttaataaattctgctttggtgctatgtcattggccaacattgagggatgttagttaccagagctgacactcactgtggaagaagtgtggtcagggagtttgcctactattagtgtcccgcagcgtatgagagaagaaatcatttctcttggatctcagttctctgaaaggtatcttatgagccccttaattttgcaaatgtttgtttcacttcttctcgctcttgacaactggaaagtaaagcctgtgggccgtaactccatactagtcttacacattttttgacttcaccaaggctgcttagttatgtattgtcctttttgtgaactacctcaaattctttgggaatggatgtgttcttagcatagccaactcaaaaaagcaaccccatgctaccatgtcttactagttttattacaggcactaaaaatgcacacataagggaaataatttaaataaagaattgaaagaagattggtttgacatcagcaaatattagggtgatacttaatgtgtaacacacttagcacagtgcctggcacacaggaaacaaatcattaatgttagttgtcagtttattatctgatttcatcgagagctacttacgtatggacagggactatattttgttcatcattatagctttggtgcctggcccaatcacttgggaaacagtgggtgagcaacacttgtcttttgctcagttaactccctgatgaaagagtggatcctgccaaagaatggccagatgagatgtggacccaatcacacatcagatgtcaaccctacctcacatcagatgtcaaccctgccatctacacttcaatcaagtgtgctgaaaaaggggctctagtgactgtcaaatgacctcacatacacccctgacctaagcactatgtcaccaccatcagcacctctccatttgcaatgatgaatattaatggatacatgggatctgccagggccctggctaacctcagcacagcagtgtcagcacctgacaaacccatagtcatggacagtttcaactcaggcaaggatgctgacatgcaaagcagtgtcatccagtctaatggcaaataggaaactgactggcaatggcctcctcttcttgcctatcttcaaagataggcacaaatattggcttgtcaataatagcaccactttgcccgggtgcggtggctcatgcctgtaatcccagcactttgggaggccaaggcagacggaccacctgaggttgggagttcgagaccagcctgaccaacatggagaaaccctgtctctactaaaaatacaaaaaattagccaggcgtggtggcgcatgcctgtaatcccagctacctgggaggctgaggtaggataattgcttgaacccgggaggcagaggttgcagtgagccaagatcgcgccactgcactccagcctgggcaacaacagcaaaactccatcttaataataataataataataatagcaccattttattcaactaaaacagagtttgctcactcctatctcatgtaagatgtaaaatcacaccccttgcaagaattagatgatttaattccttctgttatttagaaacatatatgtttattgaagagacaagtcaaattcatggaaacatatcagaatacaattgagcacaggcaagtaaaatgacaaaagcccatatactactataggctgaacaagacttgggtgattgaccatttgaatagctgaggtagaattcaccaatgagagtagatccttggatactgtaactcctttgatttcctaaataatctgaaacagccaccatttctggtcccattctgatttctttggaataaacagtcagaggacctgtcccaagatgcaaatatatttcctgggagaacattaacctaatagcatggatcatcttgtcaggacattagtgtgtatatgatgccacttcagagggaagtggctttgcagtgggcagccccagagctgcctaaaagtactagaagtaccaggtacctttcagcaaacaaacttagcactcgcaatgtaccagccactgtgctgagtacttcacacctattatgacatttaacttcctcaaacaaccttatgatgtcagtgctgttaactccatttgtagatgaggaaacccagactcagagaggtggtttattttgcccagaatcatacagccaatggatgccagtaggtggcagagccaggactcaggcaacagagcccacgtccttaaactctaaactatgttgcatctcttgatgtcaccacactggttttcaggattgtgagcttttgatgtcaccctactggttttcaggatcgtgagcttttgactaaaaatgactcattttaatgtctaagtagttgtgacacaaccaatcctggtagtgacaaatgatatgctttcaattgcctggttgatgttgtgctggaaagctgctcactttcaggctctttgacatgttaaccaggactagtgtcctaataagatactcaaactctctacctgatctggaaaatggtaataattctagcatttctcttagagaagttctgtgataattaaatgagatgatgcatataaagcacatatccagcacttaacaccacataggtaaatgcttaataacttagctataaagaaaataaaaataggaaccccaggctatacagcctctatcagccaccatcttctattatatttggctctagatggtctttaagtaccaatttttgttttcctcatcctacgtgttcaagtacttttttcatactcacaagggctgatttgtcaataaggtagcaatcagtgatcatcttatataattttcaatgatgatgacaaggcaaatggaacattaaagacctaagaaattggaataacatgcacccatgtaatgttttttaaaagggtgagtgaaaacccaagactttgattttcaggcatggagggtagagtttctgagatacagtgcgcatactgcaggctgaaggagtgccacaggtagaagaccaccaataataagtctgtgaaagtccatcagcctggaaggagggacaaagtgggcttctggccaatagatagcagaacatccaggcactagccaggtagtgactgcctgcctcaaccattcagcctctactgaaaaaatttcacatcaggtccaaaattacctttccaattttggtttttattttttctcaaccaaatctgatgaaccaaccacattcatctctggcaagttcttttcaactttccaacccgtttgtatgcctgtgttactgcatcacatctttgtccctctccccttccatttaactttccaagatctacccatcctcttcagggcccggatcccacctcctccttggtgcggcctctaaactgcaacattcaccatctaccacccatggtcggctcgtttggccagattataagcacctcccatggagactcaatacagtgttatggtggaaataatagtaaacaggaaatcagagacatgcatctagtcccgagcttgccattaagtagctgtgagatgagataactatttatctttgagccacaatttctcacctataaaacaatctctttttaaaaattaaatctttaacattccttaattccgtttttttttttttgagatgggggtcctgctatgttgcccagggctcctgggttcaaacaatcctcccacatagctaggattacaagagcacgccactgtgcctggctcaacattcttcaatgctgagtgaattaatcgtttgaagtgactaggtcaaggcatgccgaggctgaaattagcagcctctatgtccccatttcattccctcatcaactacaaaccctcatgtttcctccttcattttcttttgacccctccttttcatctcctttaattgctctcctgactaaatagccatgagttttgtgaggcccactgagggctgagtgcttgctgaatcctaatccaggacattaattctgaacaataaatgagagaatggggcttccctgccctgcaagagatcaaatacccctggatggtgggaaaatcacagaaaaggacaatacgaataggggaaagtgccacaataagcaggcccattaactgttagttagacttgccaccctcctgaggctggtcttatttagacctgctcatcccactggagtttatactccagtttctactcccaactgcagatctggggcccaagacagctgtaggtcatcactggttctcaaagatatcatgaaatttgagcccaattcacctatttgctgctcgtctttttctcctttcctctcccatcctctgctcaactctaactcaacagatgggtcagctctaactcacgacagacaagagcaaacctaccaggttaggcaggcgccctcccaaacctattccctgcagacttcagctctttcctctgggaatccacagggatgtcctctgaggagtcctatgggacaccagggaaaaataaccttctggaagaccaatctatctagccccttgtattttatttatttatttatttaagacagggtctcactctgtctcccaggctggagttcagtgacgactgcagcctcaacctcccgggctcaagccttcctcccgtctcagcctcctgagtagctggaaccataggcgcatgtcaccatgcccagctaattttttttatttttatctttttgtagagatggggcctctctatgttgcccagaccggtctctgcaactcctgggctcaactgatcctctcacctcagcctcccaagtgctgggattatagtcatgagccactgtacccagccctccccctttataccataatctgaaaacacctgagaaataactccctgagcttcagttttacttatgggaaaatagggcaagtaatcaccattccgtaaaactgttgttcagattagagataatgtgtgtaaagggatgaacatggcttttggcaccaaaaatgacttattgattaagtctatcacagctattataatgaagtagaccattgcattcaaggtggcaaaacgtcctaggaggcttctagagaaagtatgaagaaacaagggctagtgattagaagctcattaaaaggcactgtcagggccagagtctaaatccatcatgccctttccatcttatcaatccaacaggttctgctttgtcacctaaaagggcactgattttacattaaagtcacatagataccatattttaagaaacaatctaccaagtcagtgaagatatactaaaatgtagatccccaggcagaagtgcatgttttataagtgatttgttctacttatctatcacctaaagatcttgtgtcaggacattagtttctagattcaataataaaaatgctcattcaatttttaaaaatctgtaaatttggccaaagacaatctgagaggttctgccaatcttcttaaggaatcttcacaaattttgtgtcactatcttctggtaacctgagaagctacactgaatcttgctgaaaagatcactataaaaaccatccagcggccgggtgcggtggctcatgcctgtaatcccagcactttgggaggccgaggcggatggatcacgaggtcaggggatcgagaccattctcgctaacatggcgaaaccgcgtctctactaaaattacaaaaaattagccaggtgttgtggcacgcgcctgtagtcccagctacttgggaggctgaggcaggagaatcacttgaacccaggaggcggaggttgcagtgagccgagatcgtgccactgcactccagcttgggcgacagagcaagactccgtctcaaaacaaaaaacaaaaaacatcccgcatagatttcctgtgactcagccttttagtttaatttaaaacacataatgaaatgtttgatagcaattacaggagacagttaactcattagaaacaattattcatcatattcactgtattactaagaagagtgggaaaaggaggaaaatctcacaaagcagagaaaagtggcaaaggggcctttggcaaaagaactcatgctctgttctcaggactttgtatgaaatattaataagggctgttgtccgaacagtcacattaagcagcatgcacttcctcgtccagtaattatataacagaatgcaagaagtttctcattagtaagtgaacattcacttttggcttgtgatgaaagcctcctgtataagatggccagttttatttggctgtttgttcaagctcaaagtcctgctaaagtggtctttggtcaagtggtcttctttaaagtcctcattttgattcaaggttttgtttgtggtaaattaaaattctctgtagcatggctgaattgaggctgcatacccagacacacactgcatagaatatatgttgagacacatggatggatacaaattgtatgtgtacttaggaagaatgtgatcaatattaaaacatgaggtatgtgaccgtatttccaaaagaagaggtcttaaattatagcttccctcagacatctgacctacattttgcccccaggaaatgttgactttttcaatttttatagtgttaaaactttcattgtgtaggtggaaaataaaatatgggacataaaactgttacagcataaaaataatagacattcatgttggcagtcaattaaatttgggtctttgagtacatttctaattaactaccattaacaattgtcttgtttctgtcctgttaattttacataccccactgatgcgccaaactatgtttcccccaaatgatctatccctaacacatccctaatgactcaggccctcctttctttgccaatttgctgacgtaaacaatagagaaatgcaattaggcaagcccctctcggaagcccttctcagagttcctagatgcctctgcttttctgtgatattgtaggccaccccaccccccatccccggatggaaggcagtaaaccacccttactcttagagtggtcagctttctcttgacaccatccaccccagccccccatagtactctactgctggtgcacacgaagagtgtttcagacatgagatgtcacattgtcattgagaatggcgggaaacattattttctagttaacttctaaagcatgtaactattttagactccagtcctgacctacttttagagttttgcaagcggttccttgagagtccatgcatgtctactagatttttcttagaaaaccccccattttatctaagaaagccaaaagaataatgttctccctcaaccttccatgagttgagaacccaacatttttcacaccctgaagggactcatctgcagaagagcaaataaagcaggcaaagctttagagctaactgggcagagaatgagcatgccttcatttgtttgggctggatcgaggctggcaaggtggtccaggttggcactgcggaaaatacggcttggccccaatggtggaggagctgctgcacttttttttttccttactgggcccttattaacattataatcacagagtcagttttgtatcacagagtttgtacctccatttaagacttttctgacagccattctactttcataagttgaaattttctgttaatttgttaccgatcctcagagttaatggtcaaattgccttacagtttacaagaaacagaagggaaacatcagtgtgcaaacactgggaaatactttcaagcccttttgaaggaagaaaatataatttacagtgattttctaagttaactcattcatagctgtgtatgataggaaaggggaagcacgaccattgccatttacagaaggggaaatagaaacacagattaaagaactggccaaggtcacacagaagtcagggacggtgccaagaatagaacttgcttccttgattcccaattctctatccttgggaggatgtagtagatattttacagatacatatatagatccaataagtaatcaccaaatatgtttaatcttgtataatgcaaacataaatgctaaagacaagtggtattacctttatgttttacacgtggttggtgcctaataaatatttgtgtgatgagcagatggttgacagtatatttagattgaatatcagtgacgtgccaagttgctttgtaagatgtcagcaatattaatgcaatgtagacagaaatgtttctctacatattttgactagttatcacagatagcttataaagaaaacgagttttttcacaaagaacccgatgttacctaagtttttttcccatgagtggggaataacttagtacgtggtacaactctgtctattataatcaatcagtgttacttcttcctttgaaactatgatttgtgataattatatagggagagagaattaaactggactgtgatctaaagaatgtgtgctctcaaaacaaaactgcagtaatcaaaggctgcaggcattgaacctccctagaataaagacccaaacacattcaacattttagaaacagatctttgttttagaaagaagaaaagacaatccagaaacaaccaggtggactctagacacccatggaggaggtgatcagagctcatgagagtaccaggaaggagatcagcagaagccccccaccatcccgtttgtggggaacagatgagcgcaaagacccattcaggccacacaattgtccagtcagctacccgagggtctccttggtattcaagcacacgtaaagaaaagtagactttcaacatcttagattcttcctgagaaaacagtgatctgcagcacaaactgattatgccaagactgtccttgccctatcctctcctgggttcctgaaatccaccctttccattccacagagaaggtccccttccctccagtcctgtattattattgttcctttagaaaccaaccaacctccttgccatggacaatcttatctaaatagtatctcctgtgaggctgcatcagtactctggcagagttcatggaggactgtaagatcaagcggagctcagtccttggggggtttactcgtactacttagttgttcaaaatgcaggcggaacgtgaagttctagaaattgaaagtggactggctgagcaggcatcagctcccccacatgcccagtcagcccaccccagcctcagccaacccacagggcagaaccacttcctctcatgacaggaaaccaatgaatggggcaggccacacgaactgggagaattacttcattccctcatgacacccttccatttactcttccttttacttttgtctaactcttctgtagttccttaatttttcttcttctgaaaagtcatattttcctgaattccacagccaccctccaccccagacctactaaattactattcttaaagcacaacaaaactgcattttacattccataatttgcattcatttcttagaaatgtttggcaaaactgctcactgttgtcaaactagctctatagtaggcagaaatatcctttaagttcattaaaggttctcaggtcttatttaaagaaatgtaccccaatgctagcaatgattacaaccttgcaaatctgtggtgctctgtaactttctaaatacattacctcattcgatcctcatagtctctctatgaagtgtatatcattatctttactttatatgagcagaggctgcaagctatagacatgtggaaggcactatatgcttaacatccttatgatgctctctggctttttgctcagactcatgggagcaggtttaggaatatctatttagaagtctacctgttggctgaggatgagaaaaataaaatattccaccttattcagtgttgataacttattttggtgttattaatattcaaaagagatatcacagttttattatcacttttcttttctttctttttcttttttttctgaagcggagtttcgctcttgttgcccaggctggagtgcagtggtgcgatctcagctcattgcaacctccacctcccaggttcaagcaattgtccctgagcagctggaattataggtgcctgccaccgctcctggctaatttttgtattttaagtagtggcggggtttcattatgttgcccaggctggtctcaaactcccgacctcaggtgatcctcctgccttggcctcccaaggtgttgggattacaggtatgagccactgcacctggccccactttcctttttttaattaaaaaaaaaactaaaaagggaaagattctgctttatttcttcttggttcattacctgtatgagtttaaaagtaatcatcctttccctcctctcttttattcctaatgttttataagaacaaattctaggcaaaacgaaagccacaatattactcagtcaaaacttagctcgccttcatagcatattttactactttttttttaaagggtgacattttcagttgaactatcggtagttataataacttaacatatttacatatttattagactctaagacactaaataatttgagttaggtctgaacctctttctatagtagatacattaactgtctggccatattaaaccaattaatagttttgagctccttaaacaagtacattctgtcctcaaactaagcgaatgctttggccgtggatatacatagatacgccctttcactagagcctaaaatttaaatgccaggaattattctacgtatttgagagtaatgtgcatatattagtcacccaatctcttttgatgatcatgtatagacaccagtatgcaaatatgttaccatataactcaaaataagtgcaatggagcatttcttactcatgtgttactaaaattcctgtctacaactgaatctaagttagtctaagtgtatataaatatgtttatataaagacatatttgagaacttttggtaattaaagagggtttcatttatctataaattttagcttcatctctctgagagggtgaaagagtggttctgtttattttctggtgtacaaagtttctacatatatttctgaaacacctctaagttaactgtactgatttaaccaccaagcaccaaatctgggcctcacacaggtaggctactcaattagtacctgctgactaatgtacatcgagctgtcattcttgtacatcaaagatgtgtacgtttttggcagataatttcaagcagcaacgtattaaagaaataaagcatatgcaaccttaaacttccatttgtgatcagtcttgtaagtagtgaaaaaaaatgccttgaacagagaataattcaaatggccaacaaacatttaaggtaatgctctgagtcttgagaccattctgaaaggaataagacatgttttcaggccttggcgaacttattccatcacacagaagagagatcccttacaccacaaagaaattggaaagaaagctaatgtttacaaagttccattcgaggtggcctcattccccaaaccatattttattagcatcacttaaacccaaatttataaatattatgttctatcaccataattgttattttctaacatagttactagttctaatcctagatagaatagaaattttagatttaatattgccaaaacaaaatttaaatatatttagaaaaggctctgttattccagaaaaattcaactctacacttttatccgaatctaatagcttcaattatttagttttttttttatttatttgcatgttaggttggcacatatgtcaagaccctaaacggatgggtcgataaatattgatgcataccccaaatttgcaaaatagtatagaatttcagtagatctcactgtcttatgtgttaaacattcacagtggtaaagaagatatttaagatttgtaagtcttctctatttctattcttagaaaatgacagtcaaatgagaaatcagatgtgtggaaaacagctacttcccaggaattccatagctcaccagtaactttccactctgagagtaatacaccctaagcaaaacgagttggaattgtgggaagaatctagaaaatcaaatagccacttctatctgtttatgttaggattatgctttgtttacttttcctgtcaatctttttttttttttttttttgaataacaatcctcctgaacactctgcaagtggagttaaaagtaataaggaaaatagtttggcataatgataatccttgggcagtttcaataatatcttattgttgcacctatcaagtctattcctgttcttcaaattagctcccataaactatccttagtatcatccctctagactaaacaaaaagaggaaaaagcaaacaaggctcagtcatcaacaggatgcaaggaaatgctgcacaattagcagagggtagggatgtattcatttagcaaatatacactaagtatctactgtgtgccagccttggcccagcctaaagacacaagggtgctctcaatcagctcttagcttagagagagacaaacctttgcgcatcgagtgatgtaacaagggcgtgaacaaagtgctgttcatactgagggggaagaagtgattctgaatgaggcagtgaggagagttcacagagaaggtgacgtaagagctgagccatggggtttgataaataaagccctcttaggaggcaggcaatgggtggaggtgcatttcagacagatggaagagcaaagcccaaaagtaggaaacatagtgatcactggtgttgggaagaacttggatcataaccaaagaatacaaaatgaaaaatgggaatgctaatgcaactgacatagtggtattgccaaagtctagggatcttcagttgagaaacaggagaccagagttccaacctgagctcatgtcacagctcatgggaggaccttagttttgtgcttgtgcttctaaaactgtaaactagagagaaaaattatgaaattgttagccagtgatagggtatattcagtaagaaagaagagtagctgttgcccacctttttccaaggcagggagagcctttgcctcaaatatacagtacatcccacatgcagattcccatctgcgtccattaaaaaatcttaattccaggtgtcaaaaagtatttgaaagttagtaaaaaaactgactgtccctaccttgcttcggaatgattatggttacaggggtgccagaaccacttgattgtaggttgagggataccatatgcggtacaagtcaggatttgtctgctgcccagtgggtagagagccgggtctggaaacgatgacacggccttttcgtaaatctggggtttcactggaaaggagatgaagaacgggacagaagtcaagagcagttctaatgactttctcctgggccacacatgaaggaccacattctcactggctttgatgtcagggaaacaaacaagaaacaaaaaaacaaataaaccctcctatttgtcaagaaaatgcagatttttaaaagtagtagcagggttttgagattattaataatttgattccatggtatgtacattgtgattacagtgataaaagatcatgccgcctatggaatacaacaaacaaacacgagattgttaagatgggaacttaacgttaagtgttttttcaaatgattatttgaaattttgctatctttgatgttgttacgctgatttttgaattcataaatgttcactaatttgttgcctaccagaaccagaagaaagtatgaacagcaaacttaccattgacaattagagtggcagtgaggtttttaaacacatttgactgttttatgctcagcaagattgtataattccctgcatcctcttcagttacgtccttgataattaacgagtagccacgagtcaaatagcgagcagatttctcagtcgcaggtaacccatcttttaacctgtggttaaaaacatgatcagtaagtcatttcacacggcctctcaatatcactttgataacacggtcattgaagtttttgagctcaagttgaccaatttcaaacctttgatcatcagtgttgatttttaaaatgtaggcattaacttttgagtaaaggcagatatgatttttagactgggtaacacttcatatttattggcaaggaagaagaaataaagcgagcgaagatagaaaagcagtagcttagtgtgcccacaggcatactggtggccactgtgacttaagtattaacccagaagcaggggctctgattccatccgagatgtttttcagagttttccacgaggctccatcagcagtataagggccattgtaagtcagatcaagtagatcacttctccagataaaaataaaaatagacttttctattgtggtctcatgtggagttcttattagttttataaatggtcacaccagttgtccctttcataaactagagtgaaatcaagactatcaagatttttcctctgaggaagaacagttaaggcacagaaaaaaaaaaaacagaaagcataaacttaaagaaattttaaaaacgtattaaatactgaatcgatgcattgatatcactctgttgcacacagaactgagagtcagaggcttgggtgcttgacctggctctgctactcactgcaggctgctgcaaatgtgactaaccagtttgggctccaattttctcaaattttctagaggttctcaaagtttccttataactctaaaattctatgatttcattaaaatgcatggttctttaaataggcagttttaatccattaggagtttcttgtgttctgtataaaggtttaatattgggaacttagttcattatcatgcatgattataaagtcctacaaacaaattcccattactagtgtgtctcagatccaaagtaattaaaatgaggatgctacactttgtgattacaaatattgtcttggtattactttaaattatttcctacaacaagtcagcatttttgacggtggattgaatttttttttaatgcccttgctacttagttactgaagaaatcaacactaacagatgagcgtgccctcagacactggaagagtgaatgtacctcctggagtcatcagattactattcaatttactattaaacctaaaaatttactactaaacgtttttgatattctgaagcaaaaaagatcatttttctactgcaatggcatgaagacatagcacaaagttaaaattttctctttaattccctattaagtatttgagggaactgcaaacaaacactgccctcatatgacattgaaagccaaatcagctctggttagggagattctaaaatggcgccacatccctattgtatggattgttttgctaatcagttttgtactataccctttgtttaaaatgtaatgacttgagccaaagatattggcatttaacagtaattttgtaaaatgattgcagatcataaacagattacattgttttacatcaggtgttgtaccagtgttttaaaaaacaactgctgaaggaggttttgaatatgtatctttctagccaaaaaaaacttaattagttcaaataggccccatcgtccccctcttcaaatgagtaagtcttgtctctattaatgtttgtttaattttaaaacaggactggaactttcaacccagctgtatataaaagaattattttcagcattctcattacaagagcccacttcttcagggttaatagagcatgttacatattcaaaatgcttcctagtcattgctcaacacatcccattcaaagaatgttgacatcataggaaggtttagagatgcagaaagttagccacagtaagagactagactgaagcgagcactcaaacaaacctcatctctcgcttaccttgctacattatttccttttccccagcccttctcacctccaccacccaagaatctacagagttctgagctctctggggctgtctgaggaacgtctcttggtattttgtcaggaattcgagtcattaggctcttgcagcttcccacttacaaagtatgtcttaaactgttatggaaataaggatggtcctaccatacaacttccggcgagggaaatgccttcactttcatagagagccggtaagaccgcttgccagctacggtttcaagcacctgctgttttcgatgtttcacagtgatgaatgctttatctttgaaaggagaagtgatacatacattagaaaagaataatttccataaacaaaaccttagggcctcattcagggagggtgtaatcaatgagtaaataaacagagctgaattatgatagagcctatcaatgagcccaaatgttgatcatgaataggatactttaaaagcactgtaattggtgaacgcctttcaaatcaaatggtatcacgtcctagccacataaaacagtggcagagcaacagaaagtgaaacaccttaaatatctctatcacaataacaaagaagtgggaagatatttctaaaaatctacctggccactataagcaaggtgagaaaaagttgctctgtacaccctaaaacaaccaatttgatatcaaaaatcaactggagaaagacaaaaggaaataaaggctactgatagaattgttccatagtttctgccctccacactgtttccttttcagcaatggaaataaggtctttaagcattttctttatagaatttgcatactgaaattaagcaacagcattaggattccttgagagtaaaagcaggaataaaatagcattaattctaaatgatttagcataccatatttttatttctctaattcatggtagtacctgagaaatttttcttagataataaagataaaactcatcatctttttctgttttgtttatacagaacactaagaatttcataaatatattaggttctaaccgaattattagccataataagcatctaaagaaaggactctctgttcaattcaaaagtattaaatgtaaagagtacttaatgtggtttgctttttgacagggggaggagggaaccatggccaagctgtattcattcatgataatgtaactcttggccaacagaaaactgacttatttagagaacacagacatctacaatgattagaaagcatagcatgagttggcaacgctgaactatgcttaccatatatatgcactgaggtgttaacagatttgaatgatggtccactccttacacgacaagtataaagtcctttgtctttgttctgcattttgtcaatagtaagaacactgtagaatatgttggcatgggaattgctttggtcaattcgtcgccttacggaagctctcttatttttctagaaagaaaatgtataacaaatgtagaaggagtgagtgttcatgcttaaagttatataggattttaacatttcttagatcattagttcgacaacagcttctgttttatactaagaatcatgtcaaatccacctagagcgtaatgtttggaaactacatctgtgtctagaggtgcttcaaatatgtagcatagcaggatttatttagcacttaattttcttcaaatacactttcacatatactatctcaattgtttgtcccaacaacctaatgagattggcaggctgactgcccttttagtgatgaaaaaactgaaggaagtgataccctggcccaagttggctaggaactgaagttgtttgagcataaatctagtgtccttcctctggcacacacacctctctacacagtaacctgttccctaggcatagatatcgcacacaaacgtggacaatcataagccttagttagtgtctggcttaatgacagtgcttctctcaccaaatcaccatgtgagtttccttttttgtccctacgagatatgaaggaaaatataatgagtcttggctgtacttactaaggtggaataatgctatagtttcattatttcactatttgaacagtgcttgcccatgtcagctaaatcacagtaaatggatctttaaccaagacttggaaggtgctgtcccaggtttgtctcagagaagatcaagaattagccttaggctctgcaatctgacctggccacaatgacagtcctgctcactgttttgagaagacaagatcacattgccgtctccttttttttttaagcactatattttataactaataagttatttccacctctcaatccttccccatagtcatagggggcggaggggaggagcatggaaaaatgtctttgggagctgtccagaactgatttttggatcttgagcttagttctcctctgtgccacgtttaatacacttctacccacctgtccttttacttccccattggaacagacagacacatgttgaggccattttcttcattctcagcaataaccagagagaaaagtcaattgccactatcaaaagtcagagaactagtcccctaacgtaacagactgagggagctttctgcagctctatttatacaggtactacttcctttgccaagctgagtaacactggtattgcttctgacttgggaaagaactcatcctgtgttttagaattgcttcgcccagtactgcagccaccagccacgtgtggctattaaaattaaatgaaatcaaaaattcatttcctcagtcacactagtcacatttcaagtgctcatctgccatatgtggctagtggcacagtactggagcacaaatacgggatatttccatcacagaaagttctgctggacagtgctgttttagaagattattagcatttaatagatgtgttgtagatactcttacttacagcagcaatgctagcaggataaaagtttcttccctcttggcacttacggagaatatttgatttctattaaaacccagaaaatattgctacaagccatagcatttttatttaaatgaaacaatacctctcctagagaatagtttatgactgataagtccttaatgtgtccctacagggcactcgttacacgtttttgttgctaagttattccatttccatggcgagaaatgtcgatgaaaaacaacactagcttgaggctgatgcattaatctttcatacataatttaatcataaattgactttgtaattgggcaatctgaacgacataacaaatgattgtacttgagatatgccgcataaatcatgctgacacacaagaaatgggggctagaactactgtcaaaatttccgtaacagtttatcatagtttccccatctatacatttttaaaacaattattgtttgcaaggatgttcgatttgaataagggaacccaacgcaggcttcattcttctcatttttctgaaggacagaattgctcccctgacacttaacaaatggaatattggatggctgggttgtaatatcttttccaaacatgctccaatcaggtgcctgactgtctgccagtatcttaaatgaatgcgctgacagagacagcctcctggaaagttgttgttgttgttacaaaaggcagtccctgcctggcatttggtgataaatttctctctcatctctaaatcctacagagtagtttccaagaatgaaacaatcccttttcttccacctagaatcatgcaatagaaataccagtctacactcttcaaaacaaaacccccagacatcaaaagacagtatctatgcatatcacactcatgaaatgccaggcaaagaaagcactcaaaccaaacccaaagcttctttattgactaacactgccacaggagtcaggattttctgatttttcccatctcaaaacccctgcgggatttcacttgcttaaaatactgtcctgcagaagaaatagaaaaatgggtcactcacttcatcagggtaactccaggtcatttgaactctcgtgttcaagggagtggtagcagtacaattgaggacaagagtatggcctctaagtaatttgactgggcgtggtgtgcttatttggacatctatgattgtattggctgcaagcataagagagaaattttttaaaattaagatttcattacacagataaaaatacagagcacttcggcttatgttcatgcctttgaagcatcacttactttgtcgatgtgtgagatagtttgtcttatacaaatgcccattgactgttgcttcacaggtcagaagccctatttctttgtacgttgcatttgatatgatgaagccctttctactgtcccagattatgcgttttccatcagggatcaaagtgtcaagtggaaactgaaaaggaagaggcatgcattaacaaggtcctattagcactggttggcaatactgtttcaccagcagtttgtgaaaacatgatttttcatctaaaatgaaaatagtaaaactttgtagtttgcttataacaaactaggttaaaaactctagtttgttataattggttcttgagtttttttgcatatagcaaaagatatttgcattatgataaattatagtaattatgataatttactatcagccttggcaacaagtggcatctacccaggatagacctacttgtcatgtcagactttcagttggagcccataactctttggcctccgggaatcttcataataagctggtcagacactcaatagacaaaccaattaagaggccgggcgtggtggctcacgcctgtaattccagtactttgggaggccgaggtgggcggatcacctgaggttagcagttagagaccagcctggccaacatggtgaaaccccgtctctactagaaatacaaaaattagctgggcattgtggcaggcgcctgtaatcccagcctctcgggaggctgaggcaggagaatcgcttgaacccgggaggcagaggttgcagtgagctgagatcacaccactgcactccagcctgggtgatagaacgagactctgtctcaaaaacagagagagaaaccaattagcattttttttctaccggggctgccagattattctcatttgttttcatcatccagcgcttttaacaagccatagtttttcctcccattttgcatagtttactgaagaagtggctgtcttcaaaagagtgtaaataattccaggtcctccaagattcataacattaactcagcactcactggggctgtcattctgacgatcctgctgtgtcacaaggaaggcatcagctctgcctctggaaaggaaactcccagaagctgaagctgctgatggtgaaggcagcctcggaggccagagactctgcaatgaatgaagtgctctctaatgctcagaagtattcccaagcacggtgagtccaaacagaagaaaataatccatgatctgactttctccttatgccttcttctgacatcaagaatgtaacatttaaagactacaagataaacactctgccttgggattaaactttatttataaagggtcattgctccataaagtggcccagccaaattcccctgatgccaggttgccagcccaatttcagtggtggtagactcccaactaccactattccttattcccagttgaaaaagggggaaaaaaatcaaattaccttcccccaacagattataaaggaaataccaaacagccacaaagaagctcgaaaccttttctatcgccttttaaaaagtacacctggcatccctcgctctatccagttatcatttatttctattgcttgctgaaggcgctgatctggatttgtgatcctatggcagagatttctagtccagaagccactagtgcctctcttccagggactatgcctacatcggaatgtattaccggtgttccttgggtttgaaattaattacatcctgtttatgaagaactgaaagcaattaaaggattcgctttcatgtttcagtaaatcaaggtgctacctgtaaactcaggaatgcagtcggtgggaaaaaaagaaccttctcttctaatttagtgcaagcaaaggaaaaacccagaaaaatttaagtcagggactgaaatctatggtactttacaaataagtgaaaacaagcatgtgctgaatctaaaagaaaggattgctgacagacgtcctcagtacaacttaaaaatacactaaaatttcctccgaagtgtttctcttactctcatctatccattacggctgttagtagcattccattgacaaagtaactttacatttagctgacaagatctaaagcagtcaaagactgtagcccatcagctgtggccaccaccgcatgtgtaagaatgaaggcagatgggcaggtggatctcagcctcgaaaggaagccctgggcagcaaggcctgtctgcagctgaccatggctccgacaaagcaggcatgtgaaaaggagagggaggggacagaaaattagaagaaaagggacaataagagaaatgaaagggaaagatattaacttcatgtcagcagaaatacgtcataggttagaatatttccagtatatatgtgccaaaccaaaatccctgtgaaaattttacacttctctttctctctttttaaattgtgcactccagatcgtaggcagaaaaaacagtaaatagactcccaccagccccagatttttatatgggaattttggaatgctcctgatgaccaaacaacccatctgcattagcgctcccatgaaagagaacgtttccctctccacgtggtgttttccatattaatcatacagcaataattatctcagactaatgggagtaatgccatgctattgaaaacatgacttggtaatataccaagtacagtattgggtgttaaactgttaaataatgctaaagctaacccttgaatagggctgatcttgtacttagatactgttctaagtgctttccatatatcacctgacttaagttttctaacagcaatgtgaggtggtactattgtcattacccccttcctcagatggggagagtgaggtggagagaggtttgataactcattagtttgcccagtgacaagtgcagtatgttcagagtgcaggcaatgtggcaccagcctctgctcttaaccacacttgtcttcctcctatatgaactagaccattcaagaaggatggcaggaacactgaatgagaaggcaaggtattggctcaaatgcccagtatgacctgcgaagttcctgacactctggaaaccagggtgtttttatcttgaccaactgaggagttcaactcctctggcgtttccagctctgctgtataatgactttctatttcctggcgatggcacacaaatgtagtggaggccaaaacctgtctctgatggactatgttgaaggcctacgtgagtaacaacccaggagagtgaatgcaaggaaagaggataaggagaatcctccaccacatttcaggactcagggttgatgggtgagactgaacatcattctctgaacttttccagcctaactgccacagctaccagcaccaaacacttcctgagtgcctgctctgtgatgcactgtgcgaggtgctgctctggggcggacttgactttctctcttaaagttctaagctctcagaacttagcacagttttccgtttggggagcttttatccagttctgagtcctggtatactcctaactcttactgctgattaattagctagaatgtcataggtttagtttttgtctttattagattctaccctaaatcttttacctttccatatgtacaatttacaatatagtatgaagaaaagtttcacgtatggccttctttcctccctttttccctaagagatgaagtttgggtgctcagcaggagacaggccttttatcacaaggaacttgccaattcaaaccaaacgtgctggctccttatgcatgaagccagaacatatcgatgcctggagaactgggcaccctgctgacattctgtcttctctgcagtaatctggataatccactctctgcaaagttattaatttgtgtaagcagcagaattgatttttctcacatttgcacacagttgggtttgtggcaatacataacatttttcacgatttcagttctttcattattcacatcgatttatgcttaagacaccatcattttattctatttaaccacatgcatggacataacttctagcactattccttatagtaaaaggatgttacaggaaagtccactgagaagcccaggtgtttgtaaggaaattattccagaaagatagaacgagtaaaacttcattatgcttatttgcagtgaaagtatgctgagaatagcggtgttcaaatttaccttttttaaagtaacagtgatgttaggtgacgtaacccggcagggaatgacgagctcccttccttcagtcatgtgtataatttcggggatttcactgtacatctctacgaaaggtctacctgtatctgaatgagaagaaaatgaaaaaaatatatacataaatgattgacatgcaagcatctagacactgtagctagtgtggtatggtaggcattgccacagtcacgtcattctcccttaatgtaatccatacattcacatctttgtctctgaatttggccctctgtgtttctacccagaaaaagaaagcttccctaataaaacctaatttcatatctgttgttggcctctgatcagattgccccaataccttaatatgcaatgtggtatggggggaccactgtgggaaaaagcctaaaagtgcagtaggagagaaaggagaaaattctgcatagacttctcaccacagctatgctaagtgcctcaggaagcgccctccagagcctttgtaagtgctcaaagggcatagatgcagtggcgaaggtcaactctctttggagaattcaaggtgatgcagaagtctagcaagttgaggagaggattatcatttgaatgacagaagcatgacttaaaggttttctagacttttcctcggaggctaataataatgaatgagaaggtctgagctgcttagggggaggcggacaggccggagaagctgtgttgaatgctgcatttatttcatatgtatattaggcttatttctttagtatgcgctacttacctgctaatagcaaagtctgtgcaagtgcctgcagagaagtctggaaaagactttaagcaccaatacttccttaaaaagcgtggcatttggccagtctcagaggcaaggaggattcaaacacctgttcagcttccctgtaactcctcagggaaccagaatgagtccaagatccttttagaaacattctcagtctaccctgcccttgccctcgggaatctattgacatcctcaggcaacgatctcttcgggagtcattgtgttctgatcgtcccgcatttgttccagccttatatactaaatggaaagaagtcctgtgtgaactctctccatttggacctgaaagaaccaaccaggcccccacctgcttgctggtcctgcctcaggtttgtggattacgaagctaattcaggatgctgaatggagaaggaattggagagaaacaaaagcagtaagcaggcaatggttgcccagactagatggtggctacagtgatcattatggtagaactgtgtccccaccaaaacgatatgctgaagtcctaacccccctgtacttctgaatgtaacctcatttgaaaacaggattgttgcaaatgtaattgcttaagctaagtaagggagggctcctcatccaatgtgattagcatccttgtaagaaggcagtcatgtgaagacagacagggtgtgcagactcgcactatgtgcagatggaggcagagacaggtgtgatgcagcggcaagccaaagaatgccaaggattgcgggcaaccaccagcatgtaggaagaggcgagggagggttcttctgcaggtttcagaaggggcatggcccagatgatttgatttcagacttagagtttccagaactgtgagataatacatttctgtagttttaagccaaaaaagaaaaaaaagtgggccattgctgtagcctgctgaagatgggatagttttctgcacagcagtgtggaatggaggcacagatgtgagctctagagagaccctttcaccacagcccatcttgtgtggtccctggcacctatatgttaattattcccactcatcctccgggaagccttgctagcccccttccttcctgcacccttctccaccctagcccacattagggactttcccagtgttcccattgattctgttacaacacggtccacagaaccagcagtttttttctctgggtactccttggatgctacattcctagaggagaggaaatggattgtattcatgtctgtctcatgtgtactgaatgaatgagtgaacgggtatccaaccccgtccttttacagatgagaaaagaggcacaaacaggtgaaatgagttgtctagatgggcacagccaggcctgtaggccagttacttctgcctccaatctagagccccttccctggcggcaccctgaaggctgaacctctggctacgttctcttgaaggcccccatagaaagggctgccagcaggtgacaatggtttttcagagatgaaggctgatttccacacattcagtgggaaagtaagtgcctcatggtactgcatagtgttggagaaattctgaaaaagggctgaacaccaaggcatggtgtgtgagagcaggctttggggcaggctttgagtcggagggaggtggttcagagtacgcctcaaagcctgggtttaatcctggctgtggtcctgtgtaactgtgagaccttggggaaatcattataccctctgtgcctcatttgtaaaatctaagtgaaagggctatgatgaggattacatgaattaatatatgtaaagcacttagaatgatgcctggcaaatagttagctgttaattttcttattattattatgactcatttgaacttatgaacaaagtgttagagttggcagttaggcagacatgagtgggacaggagagtgcccctcctcccaagaatgtcaggtgaccatcaggtgatggtcaggtggttattaaactgtctttctaaaataataattagtcacagctggcaccagagaccgtctcccaacagataggaaacacctgaagctggtgatcagcagcttcctgataagatctcagaagttgggggagcaggctcaagcatgcacactcaaaggcaaaatggcacagtttaaccggtatatgactttcctctgtgaatgctcaactggtaagggaaaaacacctcaagtgagcacaaacacaacttcagtaaacacagtgcgcatgtggctcctcccaggtgctggcaggccactgtgcatgtggacagcccatcccaaaggaaaaatcaggggaaaataaacacaaacccttgaatctctccagttgcctgcttggccctctgccaagtgtagtttgcttcctctcattcctgctctaaaactgtttaataaactctcgctcctgctctaaaatttgcctcagtctctccctctgccttacacctactaatgcccttggctgaattccttcctccaaggaggcaaggatcaagttgctgtagacccatacagattcgctgctggtaccagtaggtagatatgaaaatcacaaattatactcatcatcttaactatcaaaaatataaatatatattgatatagtggcataggaaaaaggattggaaacaaacatactaaaattttaagagccaggtgcagtggctcacacctgtagtctcagcactttgggaggctgaggcaggaggatcacttgaggccaagagtttgagaccagcctgggcaacatagcaagatcccttctctgcccaaaaaaagttaaaaatgattatctttgggtgttggctttatggattattgttgttcttatttaccttcttctatatttgtcagtctttctagaatgatcatgcattattttatagtaatatttttaattattaaagttaaaactcaaatgataaagctccatccatttttgcttaaggaaaactataaattttgcatttgatttacctgagtttcatcctctataatagaatgagacattaactgtcacagttaataaacttatgtgtttattaggaaatctcagtgggtgtagtaacatatgcagagagaaaaagttaatcagatagacacaagggtttcttatcagaattaaattcttcctttaaataaagttgctgagctagacattcagccatggactattgggatttgatcattcctttccttcctcttgtgagtctatatttttgtctcttttgtgcatcccaaggtaaacacaaacactaagaaatggtttaattcatttaactaaattgtaaatccttcatatttaatttactgtctccttaagcaactgttttcaacaaaggacactggcacaaaaagttcctacaggagataataaaatcagtgtagtcatttctagactaatgaataccaatcccaaatgaaaatagaaaaggttaattcaacatatctttgaatttcttctttccctttggtactgtggatccccaaaaaacttaaattttactacagctattggcctctaaaagccaataccaatttcagcactgggtccactgaaattctatccgaagatatcagaacttcagtgatttgtgtccctccaaacactatgcaaaacacattatttgtgtgacagtcaaaagtggcattataaatccactgtgtttgcaaatgagcatatgactgtagatacacacacacacacacacacacacacacacacgaacacacgaacaatactctctgggcttattaatagtatatttcctctgcaatttacttcaaggaagggctaagaatgaatttgcctgacatataataatacaaacatattttgttttgtaggaccatagatatagaagaggtcacggttccattaatatcaccagtaaaaccacttactactcccgtaggacacatctgtctttgtcacaaaattaaaaatgacttccaatcccagccagcactgcagagtgatttcctgagaccaaattggctggttgttgaaagagtgaggaagagctgctccaaagactgccggtgtactggcagctcagacacactgtcaccagggactcatgccaacactcagctaggtggaggtcacactgccctcacctctctgaactcttagagctcaaagcagtgacaggaaactggcatagaatatgaggttttctcacccactgggagtatctgggctgtcacctatccttcaggacaacaagtgggctcagacacagagaaagatcaaacagggacccttgctcagaatggaacgatgtctattttttaaatgtgttttttccttttgaaatctgtaatcatgctggcacattgaagcatacagacatagtggcccctgcatgttatcctcaatggattccatttccaactggcatcacctgggagctctgctgtgttcagagcaagtaaacaatgttcaaaatttaggacttgtgacttgaagaggagttcaagagtaaacacattgttttctagcacatgtacatatttatggtttttacaaagtttttcctggttgcctttcttttaattgcatttttatcctggtcatgaggacatctagtcattttaaaggagggtatgattttcatttactgaagatgaaggggagaggataaaaaatgaattaaccaatcccatgaaaagggttctatctagacataagagttttcacatcacacagatcttcatattgtggaccgtaagtaatactcaaggagaatgtactgattggtaaaatattttatttgaaatatgagcaagaaaagaaaacaggcaggttcttccatgacttacactgcctatcaaagccactgacaactcaaaacagagctttggagcaaccacaagaaagttggagtagttatactaacatcagacaaaatagacttttaaataagaaattattagtgaggaaatggttagtgaagatagagaggggtgtttgataatattaagagggtcaatccttgaggaagatataacaattaaaaacatatatgtacctaataacagagcactaacacacaggaagcaaaacctgacagaatcaaagggagaaatagacagttcaacaataacaggtgaagatttcaataccccactttcaatagtagatagtgggctaggcatagtggctcatgtctgtaatcccagcactttgggaggccaaggcaggtggatcacttgaggtcaggaattcaagaccagcctggtcaacatggcgaaaccccatctccactaaaaatacacaagttagccagtgtggtgatgcacgcctgaagtctcaactactcgggaggctgaggcaggagactggcttgaacccaggaggcagatgttgcagtgagctgagatcacaccactgcactccagcctgggcgacacagcaagactccacttaaaaaaaaaagtggatagaagaactggacagaagattttaaaaagctagtagaacaccagaacaacactactaaccaactatacccaacgacatctatagaacacttcacccatcacagcagggtatatattttcctcaagtgcacatgaaacattctccaagatagaccatatgctagaccataaaacaaacctcaataaatttaaaaggatagaaataatacaaagtatgttgtctgaatacagtggaatgcaattaaaaatcaataacagaaataaatttgaaaaattcacaaatatgtggaaattgacacatccctaaataatcaatgggtcaaagaagaaatttaaaaagaaattagaaaatactttggtatgaatgtaaatgaagacacagcatactaaaatttaaaatttacgggatgaagctaaaacagtgtttagaggggaatttatagctataaatgcttatattgataaagaagaaacatctcaaatcaataacctaaacttccaccttagaacattgagtaaagaacagaaaactaaacctagagaaagcataagggagaaaataataaagattatagtagaaattaaagagaatgcaaaacaacagaataaattagtttcattaattttctaaaccaaaagctggttctttgaaaagacaaacacaactaataaaccttaagccagacaagccaagaaaaaaagagacaagactcaaattactagattcagaaatgaaacagggccaggtgcagtggctcatgcccgtaatcccagcactttgggaggctgagacgggtggattatctgaggcaagggttcaagaccagcctggccaacatggtgaaaacccatctctactaaaaatacaaaaattagccaggcatgatggtggactcctgtaatcccagctactcaggaggctaaggcaggagaatcgcttgaacccaggtggcagaggttgcaggagccgagattgtgccactgcactccagcctgggtgacagagctagactaaaaagaaatgaaacagtggacattactattaaaattataaattaaaaagcattatgaaggaatattataattatatgccattacattagatcacagatgaaatggataaatgccgggaaagacacaaactactgaaacaagctcaacaagaattagacaacccaagcagacttttaacaagagattgaattgtaacaacaacaacaacaacaacaacaagctgctcacgagggaaagtcagggcccagatggcaagtcaattctaccaaacataaagaactaataccaatttttcacaaacttttccaaaaaatagaagagaagagaaaactttccaactcattctaggaggctagttttactctgatatcaaaatcaaagacatcacaagaaaatgacaaaccaatatctattacgaatatagctgcaaaaaactcaataaagtactagcaaactgaattcagaaacatataaaaagaattatatacaatgcccaagtgggatttttttcaggaatgcaagattggtttaacatccaaaaaccaatgtaattactatatcatgtcaatagaataaacatcaaaacccacatgactatcttaaaatggcagaagaaggatttgacaaaaatccaagctcctttcgtgatgaaaacactcaggaaaatgggaattgcactgaatttcctcaacctaataaatggcatctagaaaaaaccctacgtctaacatcatatttaatggtgaagcactggaagtttccccctaagatcaggaataagacatcgttgtccaccctcaccgcttctattcaatagtgtactagaggttccagacagagcaattgggcaagaaaaataaatccagattgggaagatcaaaatggtacaggtattttggaaaacagtctctgttttcagatgacatgatcttacaaaatgctaaggaatccactaaaaaactactagaattaataaatgagttcagcaagattgcaggatacaatgtacaaaatgaattatattcctatacatttgcgatgaacaatctgaatgtgaaattaagaaaacaattccatttataacagcatcaaaaagaataatgtgtttaggaatatatttaacaaaagaaatgtacaacttatactttgaaaactataagacattgtggaaagaaattaaagaagatctactaagtgggaaacatctcatgttcatggattagaagacttaatattgttaagatgttaatgtcccccaaattgatctacagattaaatgcaataactgtaagaatcccagatgacttcacagaaattgacaaggtgattctaaaattcatatgaaattgcaagagacccagaatagacaaaacaatcttgaaaagcaaaaacaatcttggaagaccgcactccacatttcttgatttcagatgaaaactacaatgatcaagacagtgtggtgctggcacaatggattagtggaatagaattgagactccagagatgaacccatgtgtctatggccacttgattttcaaggagaccattcagtggggaaagaataatcttttcaacaaatggtgctggaacagctccacatgcaaaagaatggagttgtactcttatatcacaccatatacaaatattaaccaaaaactgctaactataaaaaatatatattttatagttatataatataatatataatatattatatattttatatatatttgcaaaagggtctcacttttctaggctgaagtgcagtggcaggaccatggctcactgcagcttcaacatcccaggcgcaagtgatgcccccacctcagcctcctgagtagctcagactataggaatgtgccaccacacccagctaatttttttttaaaaatttttttgtagagataagggtttcactatgttgccagggctggtctcaaactcctgggctcaagcagtcctcctgccccggtctcccaaagtgctgggattgcaggcatgagccaccacacctggcctaatacaatattctcagaagaaaccagaggtaaatcttcatgatctcaaatatggcattggattcttatatatgataccaaaagcacaagcaacacaagaaaaaataaactgaactttattaaaatttgaaacttgcatgcttcaaagaacactgtgtagaaagtgaaaaggtaacccaaagaatgggagaaaacatttgcaaattatatatctcataagggacttaaatctggaatgtataaaatatatttttatatgcctcaaatatatttttaaaatctacatatataatatataaacatatgtttagaatacataaaaatctagatatattatgtatctatatattatatctctagaacatataaaatatattataatatacaattgtatgaaataataaaaagttgaagaactcttacaactcagtaataaagacaagctaattaaaaatgggaaaaggatctgaactgacatttacccaaagaagataaacaagcagggaataaacaaatgaaaagatacttaacatcataagccatcatggaaataccaatcaaaaccacaatgagattcactgcatacccactaaaatggctataataaaaaagacataattacaagtgttggcaaggatgtggagcaactggaactctcatccactgctggtgggaatgtgaagtagtgcacccactttggaaagcagtctggcagttcctcaaattgttaaacatagagttaccagatgacccagcaattccacccctaggtatctacccaagtgaatgaaaacttgtgtccacacaaaagcttgtacacaaatgtttactgtagcactattcataataggcaaaaggtggaagcaactcaaatgtccatcagttgattgatggatagctaaaatgtgatatgtccatacaatggaatattactcagaaatagaaagaaatcaagtgctgatacatgcatgatacatgaaagaacctcaaaaatattatgctgagtgaaagaaattagtcacaaaagactacaaattatgtattctatttatataaaatatccatgagacaaatctatgggaacagaaagtagataagtggttgtttagggctggggggataaggggtgatagctaaaggctatggagtttattttgagacaatgacatattctaaaattgaccgtgatgatgatggttgcatatatctgtcaatatgctacaaaccactgaatcatcattttaaatgggtgtggtatgtaaattatatctcaataaaacttattttgaattaaaacagaggtttagtctctttcttagaaatgatgatccactgtttcctgagctggctgagctggaatggttcccagagatctcccagggtaaactcctcaccttatgagtctttgcagcatttctctcccattcccctcctgcatccagtttaggccactcacaaaaaataaaattttcccctgtgatagaaccatcatgatttaaatatgtctttcaaggttgggtgcgatggctcacacttgtaattccagcactttgggagcccaagacagaagcattgtttgaggctaggagtttgagatcagccagggcaacacagtgagaccccatgtctacaaaaaaattttaaaaattagctgggcatggtggtacacacctatagtcccagctactctggaggctaagataggaggatcaatcgaagcccaggaattcaaggctgcagtgtcactgcactctggcctgggcgacagagcaagaccctgtctctaagaaaaaaaaatgtccttcagttccttgttggcagtccctggtgggcaggtggcataatgaaacatctctgccttcacatagatgggaatacttgcctggtgtgtgtgggtattatagtccacatggaatgcgcaatttaatatctcctagtaagctatcctgattatccaaatgaatatcttaagaacctcaactataatttatcagctaaaaatataacaactgtcgccactattggtggattcatatacaaattcaaaggtgataaaaaatctcactgagactggcttaggaatatcagaaaatcagttgctagtttctgccatccagacagacacttacatgttacacaaatatttctatttgagcagggtaaacttagagaaaagtcattgtgtttcagactcaagatgccattctgaaatgaaacatttaaaaatgtattatttgtgtggtaaaaaataagaagtgcctctttctaaaaaagagctctttgcctactacctgcctttcctcagaagaaagacattgctttttgttttgttttgttttgtttgttttgcattgcttcacttataacagcagatcgaacagcaagagcagagcaaaggagaagaattagaaaggaggaacaggagtggtggttccttttctccttcctctggcttcgcctaagccccctgggatgctctttggaatgtgggtgtctagcggcaggggatcaggaaaaccgattcccctcaatccaatgtccagcagaggcggacacatggcacactgtcaacagatgtttatggagaagatataagattgaagcaagcaagaaaggtgaaatcaggacgtattatgtacccagcactgtgcacacggacagtccctggactccagtcctcagagtctagctgagcagacacacacacacctcacacacaagaatgctcatgttgattagaggaaacagtactgatacctgccttgaagggaagtagggacctcattttaaaaatttacagctaagatctgagtaagtgagttgaagatctcagtgagagtggaatgctggctagatttaagcttgatggactgtaagattaagaatgtctcagctttctgtgctctctgggttttcacactaagctggctggcggtttctaggttctgttaaccagatgactgacctcagtcagagatcttcatcttgatcagttgagacatctcagaagaaaaagagaaagggagaagggaaggagggaggaaaggagggagagagggagaaaagaaggaaggagagaggaagggagggagggaaatgaaaaagaaaaagcaaggaactctaatggattactataaatctttcttctactgctaagatttttggccatgtcccaagtcctattatttattcccagctctgcctctgaatcataacattataaaactgtcaaaggacttttaagatgccctaattctgcctatcatgttacagatgagaaaactgaggcccagagaggagagactgtcccacaagcacaggaatacaattaatggctgagcaaaaactgaatttacgcttcctgatctgaggctagtctccctccaccacaccaaaatctggccctgacactcctcaatgactcaagcgtgacaattacatcttcaaatatccacactcagtgggagaaatgagggcccagaaacaggggtagcatggggccttctgacggggactagaaatgggaagcaacggactgatgaagactcaccgcggaaaccaagcttcagtcattggaccctctgcttagctctctgctgtaaggtgctgaggactttttaggagatggtgaggacaacctcagaaccaacagttggccaggcacggtggctgacgcctgtcatcctagcactttgggaggccgaggtgggaggactgcctgagctcaggagttcgagaccagcctggacaacacggtgaaaccccgcctctactaaaatacaaaaaattagctagacgtggcggcaggcacctgtagtcccagctactcgggaggctgaggtggaagaatcgcttcaacctgggagacagaggttgcagtgagctgagatcgtgccactgccctccagcccgggtgacagaacgagacttcgtctcaaaacaaaaacaaaacaaaacaaaaaccaacagtcacaccagagcaagccctgttttctggagcctggggaggaaattccctctcaggggcagaggatgcctggtcagactcctctccagcagggacactggggacagtgggttttccgagaggacagccccgatgcattccatcagcatagctgtgtgcggggcggcgggggaggggagcgggtcggggtggaggagggcagttgaggggaggcaggagtcaggggaggagtcgggctgtgtcgaagtgctgcgctgatgacctgcgccaccacgggactctctagggctcagcttcctcatctggaatgtgggacaggcactttcctgttcctaaactcgcgatttgttatgcattcatttgaaatgttcacactgggcgtagcacactgacatccctccgggggccagacacacgagtggaggaactggaggtgggacaggaggtgttgtggcagctgggaacgtgagcccatgcctgaaggggccgtccctgcttgctgcagtccattgttgccaagtggaaatatgcgccagtgtggctagtgtttccagtttttaaagataagtaggaaatgaaatttttacgtgaactcttctagctattaagcattggcagctaaaagtgctgtgtctgccaatcaaaacatgtgtgccagctgaatccagcctgcatacttccagtttgcaaccctgcatgcactcctgtcccttctctcccattttataatgcacacaaagttctgagggagttggggtgggagcccaggcaaggacacgttagaaagaccgggggctttggagtcaaccagacttgagcccaaagctttgacaggataatttacgaagtatgcagccttaaacatggtattgaatttctttaacttttctgtaaaggaatttctcttattgggttgtttcgaggatgaaatgagatgatgtatgtattaataacaagcctgagccggacattaataaacgatagtgacctacaccaggtgcttaatgaatcccagcagaggaaaggtcctgaggcctcatctgatctggtcccatcaagtgagtgtctgcttcctagatgcgtggggactaatcactcccaagacattccttccttccactttgggacagctttgcatgtcagaaagtgtttccttaagtcaagctgaaattcttagatagttgttctgccatctaggattataaagacgaagcttaatctctttttcacataagagaactttgaatgagactgtcactcatgtctcctattttcccacccagttctttatatttttagattaaatatttaagtcctttcaattgcttcttgccaatgaaaataataaaatcatcaaattacttcatgctcacaaccctatgaggcaggcacccattttaaagatgatgacaatgaagtgtaaagggattaataatttgcttgaaattcctatttttaatgtccctcttgaggtgtaaactaaacagcaagtctggcaccacctaagtctggcactacctttattcctggtgctatatatttcttcctttcctcccctccccctccccctcccctttcctttcctttcctttcctttcctttcctttcctttcctttcctttcctttcctttcctttcctttcctttcctttcctttcctttcctttcctttcctttcctttcctttctgacagagtttcactcttgttgcccaggctggagtgcaatgctgccatctcagctcactgcaagctttacctcctgggttcaagtgattctcctgcctcagcctcccaagaagctgggattacaggcatgtgccaccacaccgggctaattttgtatttttagtagagatggggtttcaccatgttggtcaggctggtctcaaactcctgacctcaagtgatctacctgcctcggcctccccaagtgttgggactacaggcgtaagccaccacgcctggcagggtgctacatatttcttaatgtatcccaaggttggatacattctcttggtaaatatggagtcaactgaaagtctgaagtcttttgcatgtgtgctgtctcagcaatggcttcccccatccagtactagggtagttagtgggttttgcaagccaaatacaggcctttacatgtattcctgttaaatctcattttgctaatccctgttcactgctctagtttgttggaaaattttgggatcgtgatttagtcacatgacatgattttgacccccacatttgtctcattttctcaatgtgccctcaatttcctttttaaagtcaaggaagtcaggtaagactaatatacttaaaaatcccatgtttctttcatttaacaaagatttactgagcaccttctgtgtactataccctgtgctgggtcctggggctatcatggtaagcaggacgaactcagtcctgtccgtagagcttgtgagaggtgagtcctgtgtgaaaggtcagtaggagcaccatcccgagtttgggggtgcctagggtgcttcccagaggggggatatttaacttgagacctgaaaagtgaggaagagtgagctgttacagaagagctgggtggggggagtggggaagggtggaatgtcccaggcagagcacccccagtccacacccctcttactgctctttccccagtatggttaattgtaactcattttctttgacctaccaaactgcaggccccttaaaagttgttggtatcatctttgtacttcctactgtgtccagcacggtgtttttcacacacagggattactaccaatcactactgcctcctaagtgttaggcagtctgtattgtctcatgtagtctcctaatagcccctgaagtaatactcttctcattttacagttgagaaaaccaagctcaaaaaatggtaataatgagtggtagtattaataataataaactcgtatatagtgcatactatacaccaaacaccgtcctaaatgttttgcacatatgcactcttgattatgggaggtggttataggcaagaactttgttgccatctctgccatacactagttatataaccttgaaaaagctacttaacctttctgagaaataaatggagatgactgtgataatactttcagactaagatcaggatcaaggcaaggatcttccctctcactactactttccaacatcacactggaagtcttaactcatgcaataagacaagaaagggaaatagaaggtatacagattggaaaagaaaaaataaaattgcctttgttcacagatgatgtgatcatctgtatagaaaatcaaaaagaatcaacaaaaatacccctggaactagtaaaagattatagcaagcttgcaggacacaaagttaaattcaaaagtcagttgctttcctatatacaagcaatgaaaactagtagagttgaaatgaaaaacacaataccatttgcattagcacccccaaaagtgaaacacctagacataagtctatcaaaatatatataagaatctatatgtatgaggaaaactacaaaactatgatgaacaaaactgaagaaaaactaaatgaatggagagatatttcatcttggataaaaaggttcaatattgttaaaatgtcagttcttcccaacttgatctgcagattcaatgcaatcccaatcaaaatcccagaagttactttgtggatatggacaaactgatcctaaagtttatatggagaggcaaaagacccagaatagccaatataatattgaagaagagcaaagttggaagactgacactacctaacttcaagacttactacaaagctatagtaatcaagacagtgtgatattggcaaaaggatagacaaataggtcagtggaacagaatatagagcccagaaataggctcacataaatacagtcaactgatctttgacaaaggagcaaaaatcatcttgtcaataaatggtgctgaaaaactgggcatctgcatacaaacaaacaaacaaaaaatgaggctagacacagaccttacactctttagaaaaatcaacacaaaatggatcatagagacctaaatgtaaaatgcgaaactataaaactcctagaatataacaggagaaaacctagatgaacttcggtatgacaatgactttttagatgcaacactaaaggcatgatctacaaaacaattgataagctggatttcattaaaattcaaaactcctgctctgcaaaagacaacatcaagagaatgagaagacagggcacagactgggagaaaatatttgcaaaagatacagctgaaaaaagaattgttttccaaaacatacaaagaattcttaaaactcatcagtaagaaaacaaacaactctgtttaaaatgggtcatttcaccaaagaagacctacagatggcaaataagcatatgaaaaggtgctccacgtcatgtcattgggaaaatgcaaactaaaataacaatgagagaccattacatacttattagagcagccaaaatccagaacactgccaacagcaaatgttggcaaggaggcagagtgataggaattgtcatttgctgctggtgggaatgcaacacgagacagccactttggaagacggtttggcagtttcttacaaaactagcctttctattgccctaaaattgagcaatcatgttccttggtatttgcccaaaggacctgaagaattacatccacccaaaacctgcacatggatgtttatagcagctttattcattattgctaaaacttggaagcagccaagatgtcctttggtaggtgaatgggtaaataaactatgaatataattatataatgaatttatataatgaatataaaaatatataaactatgaatataaaaatatttatatgatggaatattattcagcaataaaaagaaattagatattaagccatggaaagacatggaggaactttaaatgcatattacaaaatgaaggaagccaatctgaaaaggctacatactgtatgattccaactacatgaattctggaaaaggcaaaactatggaaacagtaagaaagataagtgtttgccggccgggcacagtggctcatgcctgtaatcccagcactttaggaggcggaggtgggtggatcacgaggtcaggagctcgagaccagcctggccaacatggtgaaaccctgtctctactaaaaatacaaaaattagctgggtgtggtggtgggcacctgtaatcccagctacttgggaggctgaggcaggagaatcgtttgaaccctggaggcagaggttgcagtgagctgagattgcaccactgccctccagcctgggcaacaggatgagactccctctcaaaaaaaaaaaaagaaagaaaaataaggataggtgtttgccaggggttgggattaaggaaaggatgactaagtagagcacagtagattttagggcagtgaaaatactctgtatggtactataatagtggatacatgtcattgtatgtttctccaatccatagaatgtccaacaccaagggtgaaccctcatgtacactttgcacttgggtgattatgatgtctcactgtaggttcattaattgaaacaaatgtaccattctggtggggaatgttgataatgaagactatgcatgtggggacaaggggtatataggaaatctctgtaccttcctctcaattttgctgtgagcctgaaactgctctaggaaaaaaaaaaatcatacacacacacacacacatagacatgcacacacatctaatttttaaaatgagagcactacttcacagggttgttgtaaggataaaatctgttaatgaatgcaaagtgcttaggatggcacccagcatggattaagacccacctaaatgttaaccattctccttattaagcaatttgtccaaagtcaaagacctagtgagtatccgaacagggatttgaaagcagtctgaagcctggatcatgttgtttcaactgtagcttattaattgacatttgatgaaggaaggaaggaagggaggggtgtttactgctttagtaagctacctattttgaacaacacaatcagctagccaacataattcagcaaaaatacatcaaatgacacacaacaaatattttaaatagttaaaggaaaaactgtagaatattagaactggaaggaccataaagataaaaacagatcacctcctcatctccaagcaaggcaagcatttcattatcattgttgaagttatgaaatgccagaaacttaaagccttttcagcttaaggggatttcttctgaaaaagtcccttgcttatttttcttaaaagatcacttgagggagagtttttaaaatccttaaaaccataaagttttgatcaattgtttttcacacttcttgattgtaggggaaaaatgagagaatatggtcaattttattacctttggacttcattgccatctttagatttcttttccttttttctttccttttctttttttttttttttttttgtgatggagtcttgctctatcgcccaggctggagtgcagtggcgcaatcttggctcactgcaacctccacctcctgggttcaagcgattctcctgcctcagcctcccgagtagctgggactatacacatgcgccatcacacctggctaatttttttgtacttttagtagagacggggtttcaccatgtccgtcaggctggtgaccccaagtcatctgcccacttcagcctcccaaatactgggattacaggcatgggccaccacacccggcccatctttagatttcataattccaccacagtcatcaacttttcaaagccttaaattgtgtccaagtggcttattcaggactatgttcattctgattatttttgagtacttatatagttctactaaatgcctgatgatgtataactgcgtcgttgctagtaagtcttagcaatgtggctctagagggatggcatgccaaattttttctggtatggattttagagagccccagaaattgttttctctctgagggaatggcctgaacattttacatgtccacacaccaagtgctaaggatgaaattattaggacatcctaggagaatacagggtctggggcaggggccaaagagagaagatgcatttgttcctgactgccagcaagtctaccaatgtgagtggcttctgtcccaatcatatatcagggtcttctatagtcaagctcccttagtgtttaatgacagaaatgtttttagaagggaaatgtgacatgtcagggcttaaagatatcaagaatgtcttccatccaatttccacgtagctggaaaggaaaatggttaagagttaagttactgttctctaaactctcaccatgtggtcctaatcagctgtctgccagtgatggatagaatgaataatctccttcatacttcagccctagaaggagtgcacagccaggatgtagaggggtctatttcccaagaaaaaaactgcgattgcaaacaacatcatcagtgtgtattttaaaccctagaaatatctgtttcccctctttcacatctttatcaaaatgaaaaaataaatccagcaaaacctgaccttgcactaggtttttgatgaagatgtgtgcagatgggccagaaaattcctaggagttctttagagaatttgaaggataattctgcagatgcacgtcagtctcaggttgctgccattttaggaatctcacctgggtttccagacatgtcatccagagactgagagtcctacctttgttcaccccaacatgttcacctgtctcctgagcaaatgcatccagtagggatgtgagaggaaaaacaggatccatcacccaacctgtctgcacttgtggcctcctggtaatgcagggactcaagcgactctatggtgggaaccctagacaattcctgatcaaaactttggaaaccagttcctactggaagattagtgttagaagaaacacacatttcagaaaatacatggaaggagccacatgttagggatagaggtgagatgagtaagggagggaagctctttggatgggcaggtggaggagagaatgaggccatgtggaaaatggaaatttaaaaccagagaagactctagacattaaccaagcaatattagataacgtcatggatttcctaagaaatctatgcctaaaaaattcaaccaactagtgtggctatgagtttgggttttattttgggcgctttcttgttttcttcctgcaaaatgtaaactgtttttgcctattttcccttggaggagaattttgatgaatagaaacaatattttctctttaaagtttctctcatgaaattatagtgattccattgacatatttttgaagctttggcaatctgttcagccatgtgctgctctctgcccaacacagtgctgacctgcatgaaagcgtgaacaccttctttcggtctggggatgaagggcccacattcctggtgcatttccatcttacaagggtccttctgatccccacagggggaaagtggaggcggcaaggctcggcgatgaagcctgcagattgctactctgttgatgtccctgctggttccatggagatgtttattggacttgccataccagtctggcagattgggcaacaaacaccatctgcccaaccatcacccagctgggcagtgttgactgagccttctgtgtgtgccaaattgtgtcagatctgggaagggatctaaaggcaggcagtgctggagcaacagccacgcctcacagaacatgaatagggctccccattaggggctattaacagagccctcttcactccttagagacccacttctgaacaatagttattctctaaaaaataaaactcatgctttaaaaaatacttacaaatctgtgagctatggtcctagagagtaactgggggacttcacaattgcaggattctgtgactttgctttttatgtctctcacagatcaaacaacagggccttgtgtggagtaggtatgtaatcaacatctgcagacagattcctgttggtggaaactcctgggccaagcctccgagtgggaaaactcagttcaggagtgaaatgagtggattgcacagaaccaccaaaagcagtggacccaaatcagctaaaggagagggcttctttccactgccacattttctccagacctctgtttcagtactggtgtgcccctccccccaccccacccccccaaaaaatcacagtgcttacaattggcactgcttacctaaataatagatatggtctatcctggtaacttttaaacttattatgctaactttcacaaaaagaaatacattttacgtcagacccattacacacacacacacacacacacacacacacacgcacgtatgtactttacatttatgagggtaaaatggatatatgaatgtataaaattgaaacaaaaatagttttactaaacaacacttacccttactctttgcaatttacttggatattttcttttctattctgggttggtttttcttttttgagacagggtttcactacgttgcccaggctggagtacagtggctattcacaggtgcaatcacagctcactgcagcctcaaatcctgagctcaagtgatcctcttgtcccagcctcctaaatagctgagactacaggtggatgccccagctcctagcttttttttttttaatgcaggttgaaacccattcatttgattccatagcccattaatgaatttggaggcacatttttaaaagccctgctcaacttagtaaatttttcctttaaagaaaaagaataaatttgagattacaaaattttaataactgtataatctatgttcttaacaattaaaacaacaactagctcgtagtttgatgtcaagagctgcaactccagtacaggggaaatagacctaacctagctggatcctcatcctggtttctcaatgtatgagctctgtccagctcatgcaagtcactgaggttgttttctcatatataacatggaagaaataccaactccctttctctcagagataattaagtaaaagctcttaaggaaatctgaagttcagtacaaatgagttcattgaatcctcctcagaatcgccactgcactccagcctgggcgacaaagcaagactatctcaaaaaataaaagtaaaaataagaataaaaaaagaatcctcagaatatctgcactggtaggatttctacttgctcaaggtttcatagccaggtagagcctttttttcccccgctaaacacatttatataaaagcataattattattctctcccagaatatctaagttgttagaaattctactgctttcagttatatacccaatgtgtccgataatgtttctacctcagattatgccgctgtgcaaatctcatgagttttatgcatatgggaaaatcaactgcggaaaaatttcttataaaaatgctccaacccattgactttaatagagccaaagaggaaaataatcaagtaaagagaaacagaagagaagagatgagtttcttttacagggatgaactagaagggatccacccagccccatcattttgcttttcgattgtaatttttcaagaggagatattatatttaaataggccctagaagcttacggctggtgagagagagatataagctaacttcacagtgtggggagctcaacaccctaagtttaaggtcttgctaactaaattaaagatactgacaagtgttaactacttcagagatgccattaaaaaactcgtctggtcagttttcttactttacagtcataactcatatattacaataatattttcaatgaaatcctctaactgtgagaaaaggctgacctggagcccatttcctgtgtacaccagagtgtcagaaaagaagtgcaaaagtgctcctttctctctccaaggggatgaagttcacttaaatggccccaacattactgttcttctagaaattaatagaagaattgtactctattgtaattaggaggtgctttgtaatttgtttttgtttatgacctggtgtttcgtagctataattagattcaattcatttttaacaaagcaatttttacaaatgcatatcatattttccactattatgattcaaaagccataccaagggtatatccagagagaatgatgataatgatggtgcctttgcatcaaggtaatttagtgtggcaaacctccacctggctgtgggaccaagtggccccttccaggattctgagtgtcacattgattcccctctttccctcagccactcaacctctgatcaccaaggccaacgaatcccccaattctgtcaactctccttccccaccacgaccaaagtgaactcaggacaccaccttccacctgctttgatgcacagagcaggcccctatctggccttcctgcctcagtcttgccccttccgacctcctcctgccactgagaatgtgaagggaaaacctgaccaccttattccagtgcgagcactttcccatgactccccacagagccctaatgtgaagtgaattcttggtcctttgcttgtaaaatgaagagaacgatgcttcattggatggttgtgaggattaaatggcatcaagtaaatgaaaccatttgtttaagtgaaaagaaacaaatgtaagaaattattatattagcggaaatttaaatttactagataattcggtaattaagtaaagtagttaaatataattacttgggtacttaaattgatttaatacattatgctagaggtttggtggatttatacaagctggaatgataaagtgctgatattgatttttctgtacattacatatcagatgttacatcctaatcagtgctcaggtgggaacagcgcctgttacacagcaggcaatcaataatgcctaagtaagagtttgttcataatttacatgctgggttttgtgacatgtagacagagctatactcctgattctttttcttaaaaccctattagactacaaatctaccttttcaaaagatgtgtttacatagggttactcatccttagagaaaaataaaatgaaatcccaataatctgcagatgcttattggggctgaaatcccccaaacatattctaaagtaaatattcaacaataataaatacatgataaccaagttaatatctagcgagtaatcacagctgtatattaggaaatggttggagttttattaatgccagagacaatgctctgagtcatcagagataagttttgtgctcctgaactaaaataaacctgtcatggaagtgttcggtaacaatggaagcagaagatcaaattttctcagaaagagagttaataaaataatgagagagagacataaaatattagactcctcggaaaagttatgattgtttaatggattatatcacagctaccttggactttaataaggtgtgattatgagaccaatatcaccctaacaggaaacaaataacaaaatagatgttactgttcatagtagtacagttacaggctcatagtaactgtttcctaaatatttgctgattaaattaattagcaaacaagattcagaaggctcttctatggttaccattattgattccaatatcttttagtatcagtgctatttaaaaatagtggtctcataatattatcataacaatttttccaccaagctcatataatattcgtagtatatgtatgtatgtatatgtgtgtattccataataatctatgaaatacaacgcatttcacaatccttccttatccaaaaacaatctaagtgatagataatttcctaatgtccaacaaattatgcaagtgttttatgatattggaacttgtaattttctgcgaatggttgtggactattacaggaaggcagacatgataaatacatgacctaacggccactgctccccgacaatcccacaagagacatcaataatcaatcatggcactttttcccactaagcctggaatttatcctcaatgtcaattttaacatagtattccacaaagcacctgttaatccattcatttattcatttagcaattattatggatttcctaatatgtgcaaggcactgtaccagggaggcacattgcagataaaagtaaccaggacagacatggaccgtgccatcacagggcttagattaacaatggatttgacactcaaagtcatgattgtttgccagatctgctctgttgtatagttgaaatggaactaattctaaatagcagtgtctctcctttgtgatagtaggggactgagtggagaggcttgcactccctggcttcataaagccatgatgtctattgaatagtttaggagttaaaggtgaaaatagctgaacactatttattagaaaaaaagagatggttttctttttattcatttaagtgttcaatttgcaagtcagactgataaacctataggagaaagttttatgaaaatattagaatgaataaatttttctcccactcccctatagagacaggggcagtctgtgactcactgcagtgttttcctttctccacagatgtcggaaagaacacaatatgctacgtggaattagagaaagagaacagatggctgagtacatggctttttccaccactatcaagcgtgttgtctttccccctcagctgcaaaattacctctctgaaagtctctgctcttaatgctgcaccttctctacccttcctcattcctgcctaccatcctttcatccctgctttagaagtgggctgacttccccaagcaaaattccccggcctacctcccactcatatgtggaagtgagctgattgcatcccttgacggcaaactgcttggatggttagtcccttacagttatctaccccctggacaagcacaaaatgtcaaaacagaatttggaggatcggggacatgaaagtggctcagtcaaaatcaggctgatagcagctacaaagaggttactgtcaataacaggcaactgttctgctgtctcctaagactaatcctgaatttggatatgtacatgttatgctcagggaaaaacactgtctagttgccttatttcacaaattaaaaaaaatctcatggccaggcacggtagctcatgcctgtaatcccaacactttgggaggccgaggcaggtggatcacctgaggtcaggagttcgagaccagcctgaccaacatggtgaaacccagtctctactaaaaatacaaaaattagccaggagtggtggcagacgcctgtaatcctagctacgcaggaggctgaggcaggagtaatcgcttgcccctgggaggcagaagttgcagtgagctgccattgcactccagcatgggtgagagatcaagactccatctcaaaaaaacaaacaaacaacaacgaaaaagaactgcctcactaaaatgttagttctattgtactacctccaatgcaaagacccagttcctgacctcaccagaaggtagacccacaatgtatatttagctattgatgctgatggttggttgttttcttttgttttttttaaacctgattctgtgcctgaagtgcctactaatattgctttgtgttctctacagccttgtttgtgtgtgtgcgtttttttctttaatcccctcaagatttgaaaattggaactaaacaaggaagaagaaagtgacaggccatttttattattctttctcagggttccaattttactgtgagtttctacttcttaaaagattttgcatttctcccctttgaatgttacttcatttgttcattctctaaggaaggaagaacagtatcataaaaattatgaatgaatgaaaatgatttttttacgagtaccataaaaaatgaatcaaacatgattcatttttgccctttgccctttgcactgtatcttggtcagtgccagttctcatgtcattatagtagttcctcagtgaacatgaaataatacaacattgtccattggaaccagttatataacactcgagataacagcaacattgcgtttattaatttagtagaaacaacagtattttacagttccaacatataagagaatgcagctgtgttaaatgacaaaaatcatgtattctattttgggcttctcaataactaagaaatagaactaaaatccttttattcacttattcatccaactatgggccacatactgtgctaggagctgtgggtacagaggtgacctatacagaccagtctctctctttgtggagcacatagtgactaactgggccttgacaattctggttaaaattgacatccacgaaagtgtctacaactaggatggaatctctttcctaacccgtttctttcatactcactaggaaagcaacctttccaatggatcagggtagatttatgactcatttgcaaagcaaaagcaaacagaatgtagaaaatggaagtcttaccactaataaatatatagattgcagattctgtttccttcttctttgaagtaggtacagctagatatttgcagctgtagaagccagtgtggtttgcttgagctgtgttcaaggttaaagtactgcagaattgtttgccatttcttccacaggcagatttagttatgctcagcctttcgctttccttactcaccatttcaggcaaagaccatttatgggctgcttcccccctgcaatcacagataagaaaacaaaacatatttatggctgggccctaggctcagcaccagttcctcagcattcattttattaggaagcggaggtcctctcttaagtgtagtcatcttcctctttacgggaaagcaacacattcagaaaagctgtagaacaatactcagaataaagatgcagaactatttgggcatcccttcccccatttccctgagtgagtaatgctctcccttccccatgaatcccctttcatgggaagctggatgcctatggtttgcactttgcagatcacaggagatcactgaggtccctacctttttactctgccagggaatgattttgccttaggcatggcaactagattattcccaaaccaacacagccacttacctgcattggagatgcagtgtctggcctgcttgcatgatgtgctgggtgccttttaaactcagttcaggatcttttaattttgaacctgaactagatcctgaaaaacaaatttttaaaatgtattatttgtaaattgtcttcttacctttttttaagttatctttccatgaaggtgagtttttcatttttaatttatttacatctttaatttacttgtatctttaatttataagcaaaagatacactaatacaaatttctcttaattcacaaattttttctagctctacccttgctcataaatattatatatccttttataccaaatgacctaaataacatccaaaagcctatttatgtagaatggtaatggattcatataggttcaatgaaattatattaaaatatataactagttataatattcaaatatgcaataacttagtaaaaactctcaagaataaatgtcagtgtcatccaaaatatattttcaatactgaactttttccagtgtgggtcatctagtcctataggcctgtctcatctttttttctgaataaaaagtacagaaattttcctgggctctgaatttcatgcaatcattagttgagcaatgatatttttggccaatcatttccctttctgaaccagtttcctcatttggaaaactaattatagaatcaaaatcagttttagaagacatttggtttgtcttacgtaatctatgagttccctctacaatggtacagtcaaaagggaactgttcacacgcttacgtgacattcgacaaacatctcggaggattgttgtgaggcaataaagtgaggtggtgaaagtgctttaaaatctacacatctccatatgatgcaataatgacatccattttagtgactagctgtatcaccctagacaagtcatctctctttccagatctcagttatcttatctgtaaaaaagagattggactagacgaccttgaaatctctgaccttccatttctcacagtcccagcctgatatagcttggatgctgaccctccaattctgatggtgaattgtaatcctcaatgttggaggtggggcctgatgggaggtgtttgggtcgtgggggtggatccctcatgcatggcatggtgctgttgtttagatctgattatctgaaagtgtgtggcacctccccccttctcttgttcctgctgccaccatgtgatacacctgctcctgttttgcctttgacatgagtaagggctccctgaggcctcactggaaggcaagcagatgctagcaccatgcttgtacagcctggagaactgtgagtcaattatacctcttaataaattaccaagcctcagatatttctttacagcaatgtaagaacagcctaacagacagcctcatgattttttgaaccataggtgctacagaggctgagcctcccttgaagctattactgaccaatcagaatactatcactaaggatctctctcgcctccttcctcccctcatccctcagtctctcttctccttctccctcttcttcaccagcctcctcctcctcccctcttcccaggcagctgcaatgcctccgaaaggcagggaatgaggggcccaggattagcgttccttaggcgggaatagaagttagcaggagagaggaaagaaattcttggagggaggaaaacttagtatttggcaccaatctcagggtatagttttctttaaaaaatcagtttaaacagtggaagcaaaggtagaagctctaagtgaatggtcatggagggtttaccattaggtcacagatctgtgagatgatgtgtgtgtcaaataccctggttatgcccagcagtcctctccagcgtttctcttggatttgactatctcaaaaactggattcagttagaagatctgcgtttgaggcttagcttttccacctactgactgcatgaccttggcatcacttaattggctgctcctcaggctcctcgtgagtggaactggaaagcctacgagccacctcacaggcagggtgtgtgcattcggtgctgtgctgtggaagaggctggcttgctgcctggcacgtggcagatgcccactatcaccaacatctaggggaatcacttcccctccccctgcttctgtcagaatattttgctgggtatataatttcaaagatactaaattaacatatgcttttctggtattgctgatgatataaattaatatcttttaaatttttattttattttatttttgagacagagtttcactttgtttcccaggctggagtgccttggtgcgatcttgactcactctgcaacctctgcctgccaggttcaagcgattctcgtgcctcagcctcctgagtagctgggactacaggtgcgcatcatcagcgtggctaattttttgtatttttagtagagatggggtttcgtcatgtttgccaggctggtcttgaactcctgacctcaggtgatccacctgcctcggcctcccaaagtgttgagattagaggcatgagcccagcctaaattaatatattaaaagtaatttttacagacagtagatcccggtatcaaagtactcctaaataaaatggctgaatattaactaaattaaaatccctgtttcatatggatcccattggtctatcaaacaacctcctagatcaagtcaaccccttcaggtacctaggaatgtattttaactcatacttatctttatgagtttcttgaggcaacatgtggcccaaaatcagggatctgtggaaacgccagacttttctaaagccacagccagcaatggataacacctgccctgagaaacttccatgccagaatagtttctgcccttctttatggcatggaactctggggatttaattgagcaattgttcatgtgctggaaaagatccatcgaagcttcctgtggaaacttctggcattacttgtagttatctctgtggtctgtctggagatgctgagcgctcccgtccaggaaaagaagcagttcccctgtttgtgacatcccactgcctacatcttggtttccagaccacatgaatctttctttatcagcaacttagaacaccagtactcctgaccctcatcagaggaaaccgctaacttcaaagaaccacccaaagcccagctgagagaagtgctatttatttatttatttacttatttttgagatggagttttgctcttgtcgcccaggctggagtgcaatggcacaatctcagctcactgcagcctccgcctcctgggttcaagcgattctcctgcctcagccttccaagtagctgtgattacaggcgcctgccaccacacccagctaatttttatatttttagtagagacggggttttgccatgttggccaggttggtctcaaactcctgacctcaggtgatccgcccacctcggcttcccaaagtgctaggattacagacgtgagccaccgcgccgcgcaagaagtgctatttagagaagatctcttagacagtgtgccctctacttgttcgtgtccacactccccatgctgtcccccaaccagaagacaacataactgagtggttaaaagacactgacaaaaatggggttattctaaaaaaaagcgttgccacataatttgtctccagtaacatcagtgtattttgcacctggaatgaggaagctagataaaaaacagttaaccaaaacacaggtaaacagaagtataaggaacaaatttccaagtaactggtgactttgagtgcatcactatccttcagttaataggaaactagaatctcataaaggttattggaggtgtcaagattatagtttaacaggaaaacgaataagaaaaagggaaagtgaaaatatttatttcttgaatgttttgaattcacattattaggccttaacacatttctttgaggcagtttcatgtccatgtacctatctgagtaacaaagattcaacatttgttttagcatctactgcatgctagacacttgcccatcttattagtgatttatataaagatagatgtgtatgtacgtacccataaacacatgcatagtcatagcatggggaagtcagcttgatcgtctcagtagctcagagtcatgttgcccatttacataacaaacctacaggctatttcattttcaagggtggagtgctataatttagcaatgaatctcagatgcagatgagaactttctaatgcttcacatggcagcctagaaatctgatttaaaagaatgatttttgtcctcccaataaatgatcttgtcccttctgtgaactactgttttcatcaaagtcaattacaatataatcataagaggcatacagatctccttacatcacgaaaacatttaaataaaataaaacaaaaaaactcaacatagagcatgaaaatgggctttatcccatgctactttgttagaaaaactgttaaggtcaagcagtgtaggctaatagcattaaaaaaccaacatgtgaacgtggacttatttgaacactgacactttgtattgatcttatctgagtcttttcttcattgtttttctgttctgtattatctggcaggtggaacagaactttatgactctttgacacaaatcccttctctcctttcgcacatgctagacctcacatagaaagcctatacgtagagtgttctaaaatgccacccctaattccccaccttagtttcattaggcaaaatggaatgttttctttgacttcattgggaagagtgaatacatatccaagtaaatgatggctttattttgcaactaaatccaaagcccagatgattgaggctctttcttcaaatgctcttcaaagctgccatgatggatactaaaagagccaactcccactggaggtcattatgaaccagacagccttgaggtcacttgtaaaactcaagactctcaatgtaaagtctgtaaagtctgactaagagtatgtttagaaaactgctatttttactaatctaaataaacagtgttctagctggtcgaacccaacttcaagacaaatcccctggtttctctcccaccagatgccaccttggcaccccttattctgttgaagtcttagggttattctctgtaagaaaggagctttatttgaatataattcatgaaacatctgtgtttttccattttttattatgagtcattaatctccctagctctgccatttgtgagttctgttgtggccatgggcgggccacattaagcctccgattcttcatctgtcaacacaggagattagggttcggtttttaggatcctttccagctaaaaattctgatcctggggtcacagtaattgataacaatgtataagttagaaatcacattttagaaatacttatggttagtaaaaagacaacagcctaattttaaagatcaaccaaggctctgaatagacaccttcccaaagaagatatataaatgaccaataagcccatgaaaagataaaggacatcattattcatcaggaacatgcaaataaaaaacacagggagacaccacttcatgccgactgggaaagcttaaataaaaaagacagataagaacaagtgttggtgagaatgtggagaaactggaaccctcttacatcgcaggtaggacttttaaacggtgcaacccactttggcaagcagtatggcaattcctcgatggttaaacataagagttgatcataatttaaacacatgactcagcaattgcactcctaggtatctacccaagacagatgaaaacatccatccacataaaaacttacacacaaatgtccacagcagtattacctataacagccaaaaagaaacaacccaggcccagcgcagtggctcacgcctgtaaccccagcactttgggaggctgaggagggtggatcacctgaggtcaggagttcgaggccagcctggccaacatggtgaaaccccgtctctactaaaaatacaaaaattagccaggcatggtggtgcgcgcctgtagtcccagctacttgggaggctgaggcaggagaatggcttaaacccgggaggcggagattgcagtgagccaagactgcgcaattgcactccagcctgggtgacagagcaagactatatctcaaaagaaagaaagaaagaaagaaagaaagagagagagagagagagagagaaagaaaagaaagaaagaaagaaagaaagaaagaaagaaggaaggaaggaaggaaggaaggaaggaaggaaggaaggaaggaaggaaagaaagaaagaaagaaagaaagaaagaaagaaagaaagaaagaaagaaagaaagaaaggaagaaagaaagaaagaaagaaagaacccaatgtccatcatctgatgaatgggtaaataaaatatggcagatccttacaatgtggtattatttggcaataaaaaggaatgctgatatgtgctgccacatagatgatcttgaaaacattatgctggcccacagagaaaacgtcatgtaagcacacaaggagaaagcagctatttgcaagccacagagagatgcctcaggagaaaccagacctgccagcaccttgatctccttgatctcaagcttccagcttccagaattatgagaaaataaattcctctagttttattgttaaaaaacaaaaaacaggccgggcatggtggcttatgcctgtaatcccagcattttaggaggctgaggcagctgtatcacctgaggtcaggagttcgagaccagtttgaacaacatggtgaaatcctgtctttaccaaaaatacaaaaattagccaggtgtggtggcatgcacctgtaatcccagctacctgggaggctgaggcatgagaatcacttgaacctggaggaggagatttcagtgagctgagattgcaccactgcactccagccctgggcgacagaaactctgtctcaaaaacaaaacaaaacaaaacaaaacaaccacagacacacacacacacacacacacacacacacacacacacaaaccccacaaatcattgtgctaagtaaaagaagccagtcacaaatggccacatattgtatgattccatttatatgaaatgttcagagcaggcaaatcctggagacaggaaggtagattagtggttgccagggcttgcggggaggggatggagggtgactgataatcagtattgggtttcttttgggggtgatgaaaatgttctaaaattagattaatggtgatggttgcacaactcttgaatggaccaaaaaccactgaattatatactttaatattcttgtctcttacagtcatattttggggtgtcatattctggtctcctatagtatgtgagatttacctcaataaagctgctatttttaaaaacccagcaactgatgactaaagtaatcacagagttatgttgaaggcctagaatatccagttattttgaaatttgttgccacatattaccccatcagtgtgagattttacactagttgtttttccagcttaaaactttagaaggctgattttagagacctaattttcccttaatgttctgtaacatcactacctaatagtagaagtttacaaacatgttgcaaaaaacttgctgttccctcccccgttacaatcttttcaatttaatttagtgttagttttaaatcactcctaattgcatattttgaattttccctatttaaatggaaatttttaacaaattatgtcactaggactctgaataaatctggtgtttccttttatatcaattttttatttctaatttatttgtttttaacttaaagctctgtatattccgtttatttgaaatgaaatgcatctgtctttgattttgcatactgtgttttcagtagtacataatcctgaatgataaatggcctctttatctaaatagagatccctaagtatcatgtttctaaaatttgaatttaagatcatgagccttttacaaaggttgttcgaggttaattaagcataattcacaataagagaaaatattctttccttaagatgtagcttattaaaggccgaaatctcatagactaaatctcatagaatctttggggttggtggcaaggatgggagaagggttaagaatgcaattgcaaatttccggacgctaccaacatttttatttgcgatgcttattcttatagggctctgaaacttaataaaaaaaagttaactcttagttcttaacctctgtgtcatatctctatccaagtatttatcagataatatgaagtgggcattataagtgaatgcctagattaaagtaaccacattaaatggagactacactaccagctatgctgacagggcccatgctttgatgaagagcattataatgtcccatctcctctcacttccagaatgatggagaaaggccagagagttcatattccatccaccaacagactaaatagaagatgtgaaagtcatggggattcgtatgaactgaaagcatattttttcagtcccacagttagcaatgatactaatttttaaaatgtcaggtttgtcttccaaaacaattggccttaaatcaagaaagaatgtaaagaaatgaaagaatgtgcacataaatacacacacacatgcacacacacacacacgcttgctgacacgcatgcatacacttttctctccatgagaacgtcaagtttgtttgagtggtggtggggaggttgatgtagaactagaagaggtttttggtgtgtgctttaattacatttttcattcagcttaggctcagggaaagctctttctaggcggggatttagaaattgacttgaatgtggcaagagtatgaagctgtgactcactgctgactaatcccttatgcagataagattatttgtgacttttacatgggcaactttacaaatatgtaatattttattttagagtaattgtgttattggtctttaaggtccacaataggactgaatgtttaggcagctgctgtccagcaacattatatttagtttgtagaaagtttctaatcctaggaacctgctttttcctttaaatctttatagtatattaaacgcactattttaccacactgatttcttgctttagaggttttgccattctaagtaatcctcaaactattagattcaatatgtgaagtctctgatctcaaagtctgaatagaaaattcaaaatagtcacgtatatagcatttatgtcttgaatccaggtgtcaaaaaataaatcaagaaattacctaaatgtttaacaccagcaactggaattggcacttctccgcaattatgttcatttcaataattctgctctggtttgttcattttaaggctgtcttacaattcatattttaattgtctgtcaatgaaactcatagataggttttgtagctcttggcacaaaagacatcacagtgttagccactgaagtggccaaagtctaaaatcatcaaaacttggacagttttcatcccatccatacatgggtcattgactttactcatttttccttaagcttcagaaaagttatttacacggaaaaaaatctgtgtggtttaaaatgtttaccaggaaaaaatgctctaataacgtcaacattcctactgtctatgtttatgagggaaacatgtcttccgcatgcctctctgagctttttacttgacactgccttctttgagggtcacagtttaacagggcacattcattgatcattaggcctgtcaccaggctaccatcagggacctacccttccaatgacctatagccatgcacaactccttttcatgtgacatcagagttaattaaggttggtttgggagaaatctcctgctgaccaaggagttaccttttcccaaaaaatgctctactcctacaccgctggtctgttattaaatgagttcaaaaaccacctccatagagctgtctaacaatatgtcatttcagtttaccatacgatgtcatgaaagttatctgagctgcctagggcaaaggtcaagatctggttgacagggcacgagacataactcgtaaaatactcggtagagaagtctggtagaccttcgtctggttatgcaaatggacacgaacagagaaaacactctttacaccctaaaaatgcatacaggaacgttttgtctgttaggaagggcttggacacatctctgttttctctatcagtggcaggacacttttacatttgaagcatactccccacgggcttatgttcttatccaatgtcactgtttagaggtctgagaggaaactgagctctgacgtcacgtcttatagaatggatcataattgccagtagtgttatgctactcagaagttgtttcaggctgaaatatacacattttcagattgtgaacacctggaagagacatgacaactgattgctcagtggagatgccatttcaataaacacactcaatgtatgtgagactaaatatacaggtggcttagtgaaagtaactgagtttttaaattagtttgttaattttttatcaatttgtgcatcctctttagaatcatagtgtctgatcagtgacaaaatgcttttagctgcaagagcatttgcatagagttgtattattaagactagtagtactaataacatgcttgaactgccttaactttagatttctaatctctaaattatttaggattgcaaatttcagttctgccaaaggcatcctccgtgttctctttaaataaacaattaccagtttggaagcatagcatggaatgcatgtgactcgcaatctaaaatggaaagttttctgttttacatagcatcaggattacagtttggtctatgtccagatattttaccaaatactctgctttcattactgttcagtgtcaaagttccaggcatctatagagatgatgacagcatgtttcaatgttatggatttgtcatttatgtggatccctgtgggttcccttagaaggaaagtctcacagaaaagatctgggagatatttgatcaattccgtataggagcttgccatgtaacagtttaagtataaaagcgggaattggaacttttaaattttattcaactacgtcttataacctgtcatgtgacataatcttcagatccacacacagttccttctggaaaaaaatgaatatgtcatggagctgtaatgtgatgctgttaaactaccataaaatgcatattgttccagtttctattttgattcccaaatagtgccttcacatttttgtataataaaatgaataagaaaggctggcaaacaggcagacagacaagtgtgcaccttagcactgtagctgttcatgccagaaaagccaaaaatgttattatagcaatacaaagccttatctattctcctcatgcagactttcagcttcagaatcgattacaaataatgacagaataccatttgctttgtatataaaaatggaggagagatgaaatgagattggaaggccgaatgtgataaagttctgatgttaattttcagcttactttgatacagtttatgaagtccaaattatatagaaaacatctttctggagtcctttagactgttcataaagggtattctttaaattcacccactaacaggaaagttgagaagatctctatctttgcaaccaataatatatacaaaccctctgacctttgagatttaaatggccaagagtgtgcaataaagttatccatcataggggaattgagtttttgaaagctacattagcaaatttctaagactcattaaacacattcttgatgattgtgttttctattgtcataatcagtttccttctaagttaaacaatttgaaatataattgcctttcattacacatattttggagattaatcatgcttcggaaatggggtggacatgttgattaaactgttattttttattctgggtttttctaatttcacattttcttaagatatccttcacgtagtaagtatttgtaagagctgtgctttcctaagatttcaaaaacttaaaaaaatcttatcttagatggaattcatgttatacaagttttgctgagagtcaaatttctggaaggaaaagtaatccattaaaagtagtacattttcaccagcagtatctgaatttttaaaagaaataatttaccgaatgtttttcactcatttcggcatgtgatattaaggccttccttacaaatacccatagaagactttagcgttgtttgtattcaatgcctggggaatgctggttttcattctcaggggatatatacccatacaccttcattactctatctagaactttatttctagaaattagcttttttaaaaatatcatccaagacattatatctctgatagaagaaaaacaacaatttctgttatcagttggccaccaacccaacagctttaaaataacttatgaatcagctcattctgtaggacaaaaccaaaaccaaagtagaagttacataaaaccaaaaggaacagctctgtggagaggtagtaaggtgcccaatgccgaagctgctcccatgaaattaagccaccacctcctttggatgagactgatgaactgagttaagggttggactcttaggtgcaatcccaggagtctgggaactccatcctcatttagctatgcttcttatctctcttttactgccaccaatcctggtttttcccctcactacattctctatatgacccctttctctcactcccttaccttgtttatttttccatctttaacctcaacatttattctttcatttaattttttgaacgtataccgatagagatacaacaataaacaagacaaacgaggttgcttcctttacagtgtttatagcttagcatggacaacagataaataagtatatatagatatatatgtaatgatgcataaaaataatttctgcttaaagaaatagaaaattacattatatttgtgtgttatcatggggaagtgccaggtgtggaggtacctcactcagcccagggagtgagagtcttctattagaataaagttggaggtgagacctgaagaatcaatgtgtatttgctaaaagaaatagcagggtctctttctccttcaaagacttccacatctttccaccctctaagcttcatctttccttttaaacaagtgttttcttctaacagtttcacatacatttccttgtttcttagaactcttgttttcctcagcctctgtgctgggaggagaaagctctatcatcttctttcaatgctgtggttcgcatattttttgtctggggtctacctgacttcacctgccactaggaaaaaagccacaagtaatcatactttagatacatacccaggtcacgttgtgcttgttaaaacagagcaccacggaagacgaccggggtggagactcagcaatgagggaatgaatgaggactgtcagatgtgatgcgttagccaggacttcatgttcttaacgtgtccttccttttggcaggtcacctagccagtaccacacatgacccagagccaagaggaaataattttcaaccaaaatgttctcattccaggtgacaaaacaatggcagcaatagtaacattacctagtgactcgggctctgttggtgtacctagaaattaaaggttccaatcaactatcttctgtgctgtttgggaacctaagccagttaacagtctcccagcaggaaggctcatctcaaggaaaatatctcctgggaagcaattctctagaagatgggcagtgtagatcctcattctcaatcctgagtctacagtcgagtcaggagaacatggccagcttagccaaaaatgagaaaatggtcactggacctagaagataacccaaatggaaggaacagaatattgcctgtgtattgggagaattgttgccagctcctggccatatttctcctaacctcctccgcttatacacacacacacacacacacacacacacacacacacacacatacacgtacttagaaggtgaaccaatgaggaaccatgactcctagaagggcctcagacccagagaaatggctcaggatatgatttcagtcagttcagccagtatttattgagtgaccattatgtgccaggcactgtactggattcacaattgcaaagatgggtcagaaacatttcttcctcttgaaggtctttcagctctaagctggcctcttaggggctgtcatttagaagtagaataggtgaatactaagaaatatggaagataatctaagtcaacaaatagagatctcctgcaaactatgtacactatgtctttaaggaacacatcctttaatataggaagtcacacattcttcaccaacataagtgatttatcttagtaaaactcagttaaattcacaaaataagaacacttattcaatgataaacatgtaacacaatgaatacaaccatatctatacctcaaaataaaatataatggattacttgatgataatcccttgagcatcttttaaatgaatgtattaaaatgttataaaataaaaatcttctacacattcctgaactcagcttggaaatagggcatgaatctagaataatgactggctataaaatcgggatcaggagaattaaatttaatatggctcatgtttttcctcatgcagttgtgggagaaaatacagacctcgccgggtgtggtggctcacgcctgtaatcccaacactctgggaggccaaggcgggtgggagtttgagaccagcctgaccaacatgaagaaatcccatctctactaaaaatacaatattagcccagcgtggcggtgcatgcctgtaatcccagctattcaggaggctgaggcaggagaattgcttgaacccaggaggtggagattgcagtgagccgagatcactccagcctggacaacaaaagtgaaactccatctcaaaaaaaagcctggacaacaaaagtaaaactccatctcaaaataaataaataaataaataataataaagaaagaaaaagaaaaaaaaagaaaagaaaatacagccctccaaatcattggaagaggaatatttcttaaacctcccctcctaagtttgtatttaacattatcccaaaatggtgaatgaattactccagcaaggcaattccatgcccatcggtttggactataaagcgcatttaagaaataacaacaaccaagcaaactttatttctacagtttaggattttactccctctaagaaaagataatctggatatagaaccactaagtttaatgtcagtctcaaaaggctaaagtgaagtagaaattcctgaaaattcactcctgttagtttcctgaatttcccatttgccttctaagtgactttgcgtagcgaatactttgatagggtatttttcattgaccagttttgaagacagaggatgggatgggagcttgagtggctgaaccacttttagcttgtacatcaacaatgtgtgtcaaatatttcctaaccctcaagaagttacaggtactcaaagtccattccagggcactgcaattactctatttccacacatatatttttctctagttctaccagaagtccttatggagaggattctgaagccataaaaattttcaaagaacagcagtgaacaaaaatctgatctagcaggagacattaagtggaaaaagagagttaaacaatgttttccaaaaagaaaacaataccattaatcatagatgcagtgttgttgccagagtttacactgccttttaaaactgtttgtttgtaatcctctctagcatatccctgcctccccatctgtttacatacatttttggtttctctaatgccaacttagagaaagaaaacaatcataaaaatccaacagtggatttttacatacatagacaccatgcatatttttacatagtatatacaccattccgtataatttccatctaaagcatgtatccatttgaccaaacgttccagctttttctttggagtgaaagataaaactcctcaataggtggcaggataggatttttctcagcttctggtaacatgacagtattctggttgaaaaagtgtccttctccgagtaacaggtcaagaaagaagaaggaaaacgctattttctccttcttgacttcttgcaggtctatgttaaaggaatgatctaagaaggagggagagacacaggagctacggggcttaaagaaatgctccccgtgttgctcactgtacaaggactgccaatcaaacagggaaatcaaagtgactgacagtaacttgtttaagaaaaaggctcttggatggttgtcttttctcataaatatgacagtttttttattccaaaccctgaaaacaaaactcttgccttttttctttaattcctagatttaatcattcaagatactttgagtaaatgttggtggaaagagtccccgatttcaaaattaaaaagacctaggtttgaatcttggcttggctgttccataaatggatggccctcagcaagtcagcagggtttcctcagccttggggcttcaatccataaaacaaagttacaggtgtgcacagtaggtggctaggaagagacttgatggagttaacacagaaagtgccctgtgctgacatgttcacatttttttcccttccctgggggacagttaatgtcctcccctatccaattcatgtagcatctgccttcagggtcaaacacacttccaggtcgttctgtgaggtattttagtttcattctggaaaagctgtgagctttctggaatctgaaaggtgcagaggagcccacgttggattcctggaaaccatctgtgagagggcagtcccagctttttcctcggacctgcctgatatgagcttttctagaataaagtgctgtcctcatgctgttgtttgtcatctgaactggtttaaagccatatctaggagagcagtttggaagcccacataaaatcatgtccttgatggctttggggctccttttctgactaagttttttgggaggtccttgaatgcctacgataagaaaactcacatgattaaaattctgtcttattggagatgtgaacagtgtctgccacatacagcagtggaatctcccaaggccactttaagctggagtagcagtggcttctcacattctttggagatggccaaactccaaggacagaaggagggaaagactagcacagtccccttgatgctttttccttctcctcttttcatttaggcttgaaggcatggtaggaggatccctaaatgtcgggtttgcaagtctgatagactcagattcaaataattccaagtttacttaccacttctgtgatcttagggaaagtatttaatttacctaagcatcagtttttgcatggttaagaggaccgtacctctcgggactgagtaaaataatatatgtaactcctgttgtggtgtggggggaggggggagggatagcattaggagatatacctaatgttaaatgacgagttactgggtgcagcacaccaacatggcacatgtatacgtatgtaactaacctgcatgttgtgcacatgtaccctaaaacttaaagtataaaaaaagaaatatttgtctgtaatatttaaatgcctaataaatatataattgaaataaaaaatatatgtaaatcaattacatatattgattgtatagtcagtagggtttggttgcctcctttctcccttccccaaagcatgtctgtccctgcagtctcggcacctccagaaaaaggtgctaaatcagggcctctatgataagagccccaagaagctgcagagctgcctgcactcagaatcttggggtcagctgtcctcccttgctggtgtcatgttagtcatcagaggctgctgcccagcatgcctgtcaggtactcaaaacaaaatttgaattaagaatagaaagctcttctctggggcctgttttattttttatttatttatttatttatttttactcccagatactgtttagaagggtcaagacattatgtagcatttattgttatttactataataagttatttactgtattttcttggccaaactccagcttaatagctagactgaaaagcaaacatgaagtgttacacaatggtgtggtccattgtgaggctgtgctcctctccacgcagagaggcatctgcttcccacccctcgcatctgagctgggcttgctttgaccaatagaatgtggtagagcggtgttgtaggcgttccaaagcctaagcctcaatatgccttgcagcttccaccatcacactcttgcaacaccgctgcccccagggaaaggaagccccggccaggctactgaatgaggaaagatctcatgaagagggaggcccagcaccaaggacccagtggaaatgccaaggactatagatgcatgagaaacccaggtgagacccgaagggaaactactcagctgagcctagcccaaaggtctagaagaatcatgaagcataatgcattgttgtgttgggtgactaagttttggcacatctcgttatgtagaaatagatggcagatccaaatggctattgtgcctcagccttgtagaaacagtgactgtgtggtagttcaagtgtatgctctttctgtatttgaaaataaaagcaccaaagtggagctcacgcaatattaagaattacatgttgtacgggttaccctggatgcccccaggaagggggaagcagtttgaattcttggtgtttcacaagaagtgttcccaggaccgtggtttcacacgatgggaggccagctctgtctccaaccagcagtagcttttcacaacagtggggacagaaccctggcacatcatgaaagttaggaggccaccctgcctccaacagatagaattcagccacccaagtgggagccatactgatcccagcaccggaaatgcagatacggaggcccggatggagaggaaattttgcagtcatactggaggaaaccagggctggaccaaggcacgtgggtgcccgggacaggccaatagtatggtgtttgccaatatttacatagagaaaagactgagcactccacagcataaggcagaagcataaggcagagaaggaggaccattgttagtctagacgggcaattcacttctgcccctaacgtacgtacctcactcggcaaaacagtccccctctcctcagaaggcaatttaatctagactcattgattcaatgccctggcatttgatctaagtattctttcttgcacactctactagcacatactcttcctggcaggaattctcgtaaatagtttcttccaccttgtcgtatgtctagtgatgatttagtgccttttacagattggcatttgggcaggtgcctcccatgtggccaggcctctcaaactggcccctgggcagaggttctcaaagtgtgatctctggaccaggcacaacagcatcccctgggaacttgttagaaaagcaaattcttggccctatcccaggcctactgaatgagaaactctggggtggggcccagccagctagttttgcaagcccaccaggtgattctaatgtgtgatgaaatttgaggttcttaacctcagctgcccattggaatcacccaggagctttaaaattacctatgcctaggtccctctcaagagctcatgattaaattggtcagaggtacagccaagacccgaggatttttaaaagctctccagattattctaatgtagagcccaggctggggaccacggccctagagagaggcaaaggctttcatagacatcacttggcagactaattcctaattagggttttgctacaggtggccttgagtttaagtggttttatatttgtgtataataacagccaaggcttttcatttatgctaggttcacttcaggcctcttttaacaaaagaatctgataattgttgtagctctgcctgtgtagtccacatgggtggttcggtggcttgagaggaaatccatttgtgctccacccattaaatagaaggatagaagaccaggctgagaaaaagtgcctgtgagcaccgtgataatctgtgaaaaggtaaaagcatttgtcaagactggcaatgatgacaaggaagaatgttaagtgcaaatacattccatttcaagacagtaagaggcacatgaaatgtgtgatcggcagcggcacaatgcagcgagacaatgacacctccctgacaaccaaaaattctgcaggatacttaccgctgctggtttttgccaccaagtcattttctttcaaaagcaaaaggcttgtagaactttatggtgaaaacctggctatttaattgcatttttactattttccaccaaatccatattttccaagaccttgatctcgccacccatgatttggttaaccatggtattcttcaagaccacaacctctgtttactttgattacaagtctaagccaagtacaagattttgtaaagaattttggaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaagttcccaggggatgctgatgttgctggacctcggagcacacagagagaagcacgttttggagtatgatgtgggaatgtgcagtgtgggccgggatgggggtgaggatagggaggcaccagctcgagcccaagccatgggattccaatttttaagaacatgtctcgcacctagcagggtagtcctgccaggaacccatttatatgaagggttgaggaaacctcatcctaaagaaagaggaagttagacagaccagtgtggtcctgtaaccaaggcccctattaaaacagagttgattctgactgtggccagacctctgtcattcaggtatgcatctcagcccagcacccaaggacttgggtttaagagagggcaagaaagtcaaaccctaaaatttgaggactctgttctctctaaaaattgtataacacgctgcaggaaaaggctgaggtgcttagcacctcaccaacagaggctaacacaggacttctgcagtgaccagagcctggctttggtggctcacaggccccagcgaagcatcatgcccacacaggaggggaggacatgagacagtttctcaaagagttgaaaatcatagctgatctcatacatctcaatcgctcactgaagaggacaaatattatctgttgagaacagttactttaagtaatcccttgtaaatgaggccaaatgaacaggcaggagcacattactatactggaataaactcatggaataaatttgtgtctgagattgcttctgcgaaatgatagtgtggccacatattcattcatttactcattcgttccaacacttaccgagagtctctgtactaggctttatattaggtgccagcggtctaaggacagctaagacatggggtctctaccaaagagaaaggacacagacacataaaatcctgacaatgcaaagtgagaattactgaaggaggagtacacctcagggctacaggagagcagaagaaatggcaagtgctgtctgggagctacaaggaggagctcccagagatggtgattactgggctggatcttgccagcaggagaggaggagacacagagggagggaaaaggtcttgcaggcagacgagcagcatgaacagagtgatgaaagtgaaggcgcctctgaagaagggggaataatttgtttgactagggtagagtttgtgtagctggaacccagtgtgtgtgtggagagaagtggcgaaagacaaagctagtaccataagccacaagtatgtaagccacagctgttcaggaaaaggataccaagtgctcgtaaggaaagttaatcttctcatcaaatctcttggcatgctactaagcagccatcattttgattcttagtttaaaccccttatgtgcgttaagaaaatagaagaaaacttcatattaaaaagatgtcatttcgaaagaaattttagcactgtaataatgttagtcaataaatatttgaacatctgtcttccgtctggggaagaggaaatacaccagtgaagaagagatgttgtctgtagcaggaacatcaggttctgttcctaggcctgccgctagccagctgttgaccttgaaaaacagcactggcctcctctgggccggttttctcatctctggcatgagtagattgggtcaatgaggttccatctagctcttacaacgtgtgtgtgtatctgtgagacaagatcaagttcctcaaagagctcaaaattgaggaaaggagcagcaatcagaaacagctttcaggcatccagctttaccaagatggatgggaaatccccaggaattcttgacatctccccacatccgccccagcggcaatgcaggaaatctagtccactatcttcagcagactcaatgcaactgtttccttaatgaacccccctgcagccccgtgagctaagtcagaggctttcttttcaagccctccctcaaataccccattcctccaatttccttcccctccctcaatctggtataaaatccagcaatttaatcagcagcatgcaatttccacagcacccaagagtgtgaggaaccaccagtgatcctggaaagcatctggcaggagatcttgtcatttcttacaagcctctcctataaacgaaggccaatggagcagaatggactgttcggttctaccaaattgcttaaaccaaatgccacagatggtctatacttttaactactcacagtaatatatttttacttaaaaaaaagtctggtatgatttcaaatgcccttcctcccctacctgcaatgacaaatgcactgaaaaatgatgatatttacttgatacccaacacacccctaactgtgagatccaaaccaagaattagacacgcctggcctctactaacaccagcaggcttcgcatttaacattcacgtgccaagatagcttctctcactttttctccattcttatccccacccacatacacatatcagtttaaagcactacagaagctacttactctgttatttgttcttgtcttgcccaactgcccaagccaggtcaaatatcagccataactctgctgtgtagatctcaataggctgcataaccttcctcgaggacattacattattttggtcaatatgaaaccattttttggtaacacatcaccttcaacttccatattaaataaatttaaagtagacttagaaatgtctcgatcatttttggaaagaacaaagtaattacttggtttgtttcttaaaagtcacgtaaagtagactcaattttaaataaggggtttagtatccctgttaaaatctggaactttttttaaaagaataaagccattctgttaatcaaataagtgttagctttaaaaattcaagaaataaataggggtttaaaatgactgctatccttagaagagttaatgcaactagagttttgagggagcatctactttatagagttatacattctgctagtgaaaaaagcccaagataaagatgactgctggctcaggcatcctctaccagcccatctcttccaaaacagcctattcaaggccaaattgactggctgtttaggtacatgctactaaagaaaaagaaagtttaatgtgattagcaggggaaacccagttcatcctaacagccccagcatcatatggtttctcatccactctatatacaaatataaataaggtggggaagagaaaagagaaagacagacacggtgttcaggccatttcttggaatcattcattgaattttggagtcagaaaagggccttagaaatcaaccacctatactaacgtcttcattttacatacgaaaacaaagtacccacttggtgatcgttagaaaagaaaccagatagcctattatagaatgtccaacagggaaattttaaaaatgtaacaaagtgctaaaatagtaagcaacaatatttgaggaactggagtaagtagtcacctacagttcctttgtaacatgatgcttcagttggaaaactgtaggctgccaaagctcctaaataattaatatttcgaatatgcaatttagaccaaaaaaaagtgcagcttcataaaaccttggagaaaacaacaaaaattgttacaaaaaattaactttattataagagatttattacattcaatttgaaataggtattttcatgtgcactttgatttaatattattaatatggacttccttcacaaaattcacaatttcagtatttccacttagttatagtaaattgtaaatgttagctgttcaagaactcaagaaaaatgagggcaaagaaaaaggtctgtagctttcatccaggttgtgataccttaaaagtaagaaatgagactcagagctggagaaagaggactggtatcctttatagagaaagagcaatagagaggacttgaaagtatctgaattattggcatctttttatttcccagaatgtctggaagaggtaaataagcgctttagaggggaaaggcattatctttttgtaatactgagcctctggttattttacctctcaatgcatgtgcacaccaggcatgcacacacacagaatattaatagctgataagtattcaaagattacatagtacctgaaggaaggcagacccaggttcataatgacgcaagagaactctgcagtggggaaccgtggcttcttactagacattgcttcccggatatgcagcctctcagttgagcatgaaagccctgatgcggtttgtaaagtaggcggtagctgattgttttactgtgagatgcttgttaaccagacagagaaactatgagttttcaaaagcacccatgatgccgactgagctaacatgaactaacagagtgttctgttaactgttaggtaaagaggttctcagcttgccaatgttagtcctttcttcccaaaaaagtgcaaataaaaaaaaaaaagaaattcagagttgcaaaactgctgccccatttaagtaaattataatctaagaaaaatcacaagaggatcccactcacatttctgtaaagtttccactgatctaagatgcttccaattacaaagaaaacgatgcttcactaaagtcagcatgttttcaaaataaagatataattatgtgaagcagaaaatctaataaatcacgtacttttccctccgtaattttagattcatgtaatttagctagatttatctttacataatagtcgagtgaggtatttaaattctctaagcaattatattttaatacaagtgacttttcaaaacaaaaaatgtatttgtgaaatagaaaatacaacattttatttaatatagttatgttagcacctttcccaacctacagtgagttctcagaagttaccacttcgccctgtctccgggtttagtagtttctccaatctaattggaactattacttgttacttggaaactgacggtctagttagtcttcccactgagaaagaatatttaattattactgctttttgggtttaacaagctttttgttgttgttgttgttgtactacgctccatcctattgacttttcttcccgggaatcattgcaatgacttattttatattactatattttatttcatattttaccttttctccacgatgcttaaaagaaaggcgctccgaaatctggctctctgcgcccaggggaacgaggcacaaatctccgccactcagccccactgagcagagactgcgagtccgaaccctcaagttcctcggggctttgacccctcaatggcggcggtctaactgctggtaaaacccccggcccctgactgttccaccgcccgtctcccaaacgcccagcgaaggctgacttaggtggcgggcggacctcatcgattcctcaaaccacatcgtttggtcaaaatcgcccgccctctcttcgctcggattttaaaggctaggcttgtaagtcagtaagttaacggtatttgggccctgggctgcccttgtgggtcagggtcactgatgtccgcgacacggactggaccgcgcaccacgcctgctcccggcagaggccccacccgggtggctgagcgcagcgcactggggccccgcggtccgagagcggcggggaggagcgggcgctcgccgagcgttccccgggacagtccggcttggggactcaagcgggtcatgggatgccggcgctggccctctcctgagatcctcctgctcccccgcaggcacgagtcccctccaaatcggctcccctcctacactctcgtgacgcgaggtcgcggccagtgcccaatatcaccaaagtcccggcctcagcccagccccgggcagcctggcaggctttcaggagcctctgctcccggctccgggggaccctgcgtacctgccccaggtcctctgggaatgggctctgggtgccaggcaggtcccggtgcgtgctgctcctagtgcccagggcctcggcagtgagaccccaacccgacagctggataagggatcagcgatcctgtcgcaaacggacagccccagcgcggacccggtctgagcgctgatgctcgcgggtccaggccagccactcctcgaggcgctccctcggagaaagggcgcagcggccccaagcgtgcccgctgcaactagtgtcccaggttctcgccgtagccagcttctccgggctacagcctcgtctccccgcgtgcaccccgccctggcctcggaggctctgccctccggccgccccatcgcagcccgcctcaggccccggcccccagccgcgcctcacctgtgagaagcagacagctgagcagcgcgcacagcaggaccccggtgtcccagtagctgaccatggtgagcgcgacgcggcctgctcgcccggtgcccgcgctccccgcggccaacgacccggccgccagagtccgtcctctcgttcgccgccgccggccccgcgccctgagcgcccgtctcgcggctccagccaggagacaaccacttccccgggtaatcctcgccgccaggcgcccgctggccgctgcacccgagccccggagcccgctccgagccgccgccgctgccggggaggagccgagaggagtgtccgcctggcgcgctccgagcctcccgcggacctcgat
